United States Patent 10,724,096 (METHODS AND COMPOSITIONS FOR INHIBITING AND TREATING NEUROLOGICAL CONDITIONS) - sequence listing, part 22

SEQ ID NO: 219 - DNA, 1117166 bp, Homo sapiens
tatcttaggaaaacatgaatctcagggtcacagctttattgtatagattttttaacacagccatgttacaaacattgtcagggaacatttacaagaataaataagatggacttgcaggtgtaaaaagattacacttcactgtaatgtacagtcaaaaaatatatctgatattcattgacctgacattatttaccttctgcttttctgagctagaattgaaaagaaaaaaaaaacattgacagcacagtgctggcttttttaaaaagttgatttattttgttttctcttctcatacgtgctttatctatcaaacacccaaactgtacaagtgcaggccattgggattcatggaggaggctgcaaagagtgtggagactttggtctcatgcaatattatatgcccagtggatgtgaagatgtcagcctccctggagttgagcgggaaccttgggatagcttgtgagggtgtccagaagccaaggcaatggtagaggccacaactctttgtctttgattggctagtagaatgtagggtgaaaagtgcttttgagtatgattaccaatatgggttaacccggatttacatgggctagctcaggatccacctggtgatgaaatgtgtgcactggaaatgattataatcatgtgtaaattgagttactgtgcttttgcttttgcagtgtgctccaacaggccttgaatagggagtggggtagaaataacctctggagataatgtgtatggtaagaaaagccctgctctgtgtcctacttggaccttcactggttctggctgtcactcatggccctgttggtcagtgggtctgagttatggctgctctcatgagagatctacatgggtattgggtctatggcaaagcagctgttccctatggtttgctgtttggtgataaccagcctggatcagcccagtatatgtggccacaacagcatgttggcctgctcagtgggggcacttgggtgggagagcagggggcttcagcctgtacagaccaaacacaatctacttggattcgtgctctacaggtatgaatgagttcaaacatgatcccagctccacaagatctcacccatctggaatggaagtgacctgaaatccatttcaccaatgcttctcttccctttaaagagacacctgccttcttttagacagctgctgagatgggcagcttatcctctctggcagacagcaggttcttccttacagctattaagtttcactcatgggtcctagttatactcagaggagtgacctgggtctagcaaactgtgcttgacttcatccaagaatctgcagagctatggaagatatggacaccatattctgcctgacccctcagaagcctaactttacatggaatgacaccactctgccctctaagcctccagactgccctggggcctttgacccaaagaacacctgacattattcatcttccatgggagatacagggacagggtggacactgagagtttgttggaccatcatagagaaggcccactgatttgtattcataagcccaaaggcactgaagtaattgtacagagactcaattttgtaattttggtggtttacttcctatgaccctttctcctccacatccaagagtcctgctcactaaggaaccatgaactacattaattaccctgagctccaggcttttatactgatacttttctgtccaacacttcaaggccaccagacactcattctccgaacattccaattaaggatcagagtccacatctcaccacccagagcagttctcagatatagaaggaagccccataatgatcaagcccctaaaactcttcccaatagattttctttcatcctgagcccttgcacttcccttgtatctgccccagtggaccacccctgagctcttagataggtgggatgctaggtttggaggctaccattgtgagtgttgatgcctccttttagagacctaacattcatgagtggatttcagttggtgaatgccctttgatgaccttttcccatctcttctggaggtgggcaggtgggatgcaaaagactggcttgatctctacaagacatctctatagtcagtgccatgcaaaagcccatccctggttactaaaaaactagaagagtctgctcatgtgcacaaatatggcttagatatctctgctgtgcttcggaggatcagatccatgatcctgaaaaatgtgtcagaagaaactggagctagaacagctccccccacactccaccactaacctctctccctgctgttcagtctatgacctcaaaggcagatccctgcaagacaaagccaaggccttgcattctatcacttctagacatgtatacatggaaaacctccaacagggaaactttgcatgggaggagtaaacaaatctgaatctcagcttgtctcttctagttggatttacttttcctatttccttgttttacttggctgtgatttgaagctggtcacaggctaagaaggagctcagactgttaagtaatggggaagccaagtcagggatttgagatgacatgactatccacgtttatgttttttttcttctaacctaccctccagttgggttgaccatttttttccctggggatcctggcccagcacaacctgttgacatgacttaggaacagcgtcctgttcatgcttcctcttgggctcacccatgtcttccagagtgttactcctggttgagcttggtgctgatgacctgtttacccagcccaggagtggcaagctgcagcctaaggaagggtggctttcttcattttgtcccaaggcagtgaggtaccaaggaattatcatttccttcaatgtctctggatctgggttgggcagtcactcctgcagaggtaacaggataagggcctggctgctactccctgggcctcacttctgttgtgtagagcagtcttactggactgatacctctatgtactctaaggggttcccaccagcgacgaggaaatgtagatcctggtgaggacttacagcaagagctagtgtggcaatggggagtggaggatgaataaacatgatgggtcagagggaaatgcatcatcttttgccccagacactgagatttgcccttgttccaagtggctctggcaagctgttacccatcctttctccagctatgtcacagaagtgaccattttgctaaataagtcatctgcatcctcggttctgagtattcactgggttccagtttcctggccttgcgttcctgttttcctgcctaaagtgctccaaatctaccccttctaatgttgatgagggtccttttttcatgtatgtttttcatgtatgtatgttttcgttcaaactaaagactgagctctgtccaccacaaccccatgccttacccaggaattaattgtgccatagtaatctcgatttcctaatagtgccccctccaaggtgctaggtgctgtaggcacccagtaattatgtgtggctagggtaaagtgaggagccttccagaccccagctgctcatgaagtgtgtcctcagacttgcccacattagcaaccatgtgactccacttggacaacaggcaccactttccagcctagcattcaggaatctgctgagtacagctgtgtccagcttctcttttccctttagggttttgtgggctcatccttctccacgccagatgagcaaatcctcatcattctagtgtgagttaatgggttccttccagcacccaactggaagatgccttagttgaggtcccctcatgaacagtgaggtcagagcacccacacaccaaaggagctgcctaggagaaggtcagttggtcttgatcttgagcctataactggctctgggaggcagcagggtcactgctcctagagtcaattctagggtcaagctgaagaccagctgacctagggtccgtcatagcggggtgaacagaacagaacaacatgaggaacagagcacatttttttttgaaatattcatagagtcatattaaaaccaacaaggctaaatcagaaagtggaatgcaaattttgcatgaattgtgaacgtaaaacatgagactatgaaggaattttaagcttactgttgtttgctttgagctttatccactgacgtatctgttccactctagtctcttctgttatgggtaacctcctgggaaaaatgtgagatacaatggtggaaaaatattgtctctgtagtgagaaaaaaccggtttaaatcctggttcattcactcactagctgtggaactgtgggcaagtgatttctcccctaggagccttagtttcctcatcagtaaatggtgacaatcacaaaccctcctttagaatgctggaagaatttaatgagctcacatgttagagtccccagcatagggtctgttggttcctttgcaggccacacccacagagagggccagcactaaaagcaaactgtccccttccattcccacaaagagaggcctactgtggccttctagaggcccaaggacccctggttggcccagattcttcaccccagaaaggatgcaatgttggagtgcagctaagatacatcctgaagctatttaggccataaacacaggtggagaaatttcctgggcttctcattacttccttgcatcttccccaaacagagcccacatctatgaggtaagagctcctgttgtaaagactcagagagcattaataatattttcctctgctcatgacaggctgagctcaccctgtaaatggggtggggtggggagaccccctgggggtggtggtgttggctccggagatttcctgggtaaaggaaaatgttcaaattcctgggcactggtgccccatctcatccaagccttgccacatccttgtcccatgggatcttagggaagtcatccccatccataagcctcaatttcttcctgtgtgcactggcctaagacctattcactgtcctgctttagagaatggttgggttgtgggaaaataaggggatgagctgggggaaatcatcactggcccttgctgggttaccccaacatggcctgagattttttttttttgcaagtttgtttctccctgaagtcacaccttaaattcctaccatttaaaatgataaaagccactgtcttttgtatctgccagctatttcaccccttcctgagcagaaaaaaatcttaggatttgtgttaaatagctctccctccaccctcatcctgtctggatgtaccaagatctaagaaaatagcatacagcaggcagatttgccatgctacaggctccttgcaggctggggaaggccagctggggcattgggctggagccgagggaggccagcaggcccagtgggggtgggtccccggggtctgctgaaatacacctggggagaggctcatcaaaggaaaagagcaagttcatcgtggggttcctttgcttgcctttgctttgaggcacttccttttgaacctctaaagtgacagcccttccttgatcaagtctggtgtccctggacttctggacagctccagagcccatgccaatggaagcaacttttgtcggctcctttcatgttccatcctcatgggcctggagatctgggttggtgaccctgctccgtggtaaagcagagaccctgggtttctcatagaatctgagtctcatgatccattgcatatttagttccagcaacaaaacaatgagcagacagacaaatagatgtgatattaaaaagtgcacgcttaagggaatgttttcacagtgtctgatgaaaggaaaagaggcagccccattggcccagaaggagtcttggccaacacgaagctgagtgcatctctctaaagctccatggactccttgttgccaataggacaaagtctgtactcgcgatgggcatctgtctcctggaccctggctcatctcttgctgctccccgtgttgtgctgtgcccgcactgggctggcctcccccagactgcttctcccaatgccttttcacatttctttgccattgcacatatggatccctttgcctgagtttcctttttttcctttttatgcttgttaagacccagcaggaatggacgtccccttctccaggaagcccgaggccgaagagactttcttgctcctaggctcatggaacactcatccactccacactactgcaccatggttccatttccccagcatacagtgggctcttgagggccaaagctgtaccttcttgaattctctgcccctcatgccctgtctggggctagaccagccttcaagatggagcttcctaggtcccagcccacctgaggctgtcagatattgggcctaagcactggctagagatcaaggtcgagagtttccctggctggtccattcatagcctgaaggaacagggaattgtttttactgactaagaaattagatgagactggctttcctggggagctgggaatgtgttactaaaatatatctgaaattctgcgcttcccagaagaactggcatcaggaagaaagtactaaatttccatttgtggagttatctgctcagaagtttctggccttattttccctccataaaataattgcttggcttagagaagatgaagaaaacagcacggagaagtctcattgccattacctgcccctttggaacccaggatttcattactaaggaaggtgcgtgggtttcctcattggaggagatgatcaaatggagatgataacaagtcagtagctctctcctgggggttctaaggactgtgtgaaatgtcctatggaaagtgccaagcatgatccctggcatacagtagagacttagcaaatgttggttccctctcattgactcactcacactttggacaagaccctagatctccaggcctgattctcttggcctattttaaatcaaagtataatgggctccacaatggcctttttcaaggtggctgctgggtttctttaggaaggagttcaaatttggacatccaaattatgcacaaagctggtgctctatttgccccagaaaccaaagggaccatcttcaggctcacccatctctccttgctcagtggcatgctgtcccagggtgggagcttttaaggacattgccaggaaaaaataaaaggcccgagagatttgtcttagaggtacatactcaaactcccccgcccccttctttttgacataagagactaagattttacaccctccaaaagaaagtttcttttcacatacactttggaaaataatcaaatcttatcttgtttgtctcttccaaagaaagctaccaccaaagaaacacaggggttacatcctacaggtcagcccaagccctgccccagggaggtggtccctttttacaaagacaaggaggagcagagaagttccctgcagttccaccccctcccactgaccacacaaaaaagcaaagaacacctttatcaaaaactgctgtggacacagctggccggccagtgaatgctggacggtcaaggcccaggctggggaaggggtacagaatggttgtgggcgaagccccatgcaggttaggtgtgaggatggggggcctctcttgtggcctagggaacatcgtaaggtcacactggtccagactgcaaatgtctggtgccagaggcccctgaaggaggttgcagggggcagcagagcagtgacccccaagagcctcaatcttttccatgacgtagaggagcagaacacacatctcctccactcctaaggagaaggagggcaggggagcctcccactccccagcacctgcacagttggcttgccaagagatccacaaactcagaacaaaagcaggtggtctgggagccagaaatccaaggccttgcttgtgggtgtacttctgcttgggcccttggctgtggctggttaggttgaaaaggaagcctgggccttttggagcagcatctcccacggcaacaggagacccctcagaaggtgcagagccccccgtggaacacagggccaccagtcttctccttggagtcaggcagggtgccacctcagagctcctgagcccagttactgccattcacacaaaagggggcttggtcacagcagcctctggactccggcaggttccccatcccattgagctaaaaggagcttaaatattccagtgccacctcgtatacaaatttatactgttcctgagaggcggagaggagcagaggcagagagggagaagaggagacgagagagatgaaaaaggaaagggaaaatgcatttagtttagagatacagattttggagaaaactttttctatatccatattatgtcaactcaaaattacccatatctggacatccttcaaaattctgcttgatgcctgcttctacccaagcttcctcgaatgcccagctggcatcattccctttcttttttactgttttgtacaacagggcttctcaaactgtaacgtgcatacaaggcagccagaaatctttttaaaatgcacattctgattcagtaaatctggagtggggctcaagattctgcatttctaacaagctcccagataatgatgctgctgctggtctgtgacccacacgttaatatggcctcattttgactaagaccactattcgagtaggtttaaagacttatattaaagctcctcgtgcatggtgcggtggtccaccatggtaccaggtcttatcacccggggctctgcccacacactctctttatcacactttcctccatagtactctctactataaatgctctctattgtaaaaattaccataaattaattggaatataattggactgaattgaaaacatacttcacattctactaatccagcatcctttcctttaggcctgaattaatgacactgtcttaaggaatgggcagaaagtgaagcaaagtaggtgtaccaggattagtaattggattttcctgcaagaaagaaaagttggggaggttggaaggggaagacacaggacagacaacagtgcataccaagggcacagaatgcaggtatacaattagcagccaggtgttgagtgatgttactatttgatgtcattttctccaggtcaagggaactagtcagccctggctgttggagaacagtccttgggatactcaccagggtctccaccatgttggatttgttgttacgcagtgttttcacgatgtggaacacgtcaatgatgttttgctgctggatcatctcacacacactgcagatggcacagaaggttccactacggcctcccccatttctaaacacagagcaaagaggtgagccatgttcctaggtcccttccaggcacctgatgattctaaagctacatcagtaggagtagggatcagctgtctgggcagatgcaaggcaaggcaatggtgaaggctttagcctgagccatgagttatggtttgagtcccatctgtgccattaacttgctttgaccttggccaagtcacttcctctgtctgggccccaagttccccacttgtataatgaaggggttggactagatgacctttgagagttcaattagcttgatgttttcttggttctatgagcatgttacagtcactcagggcacactcacccaaaccccaagggcaggatggtactgtgtctttgtacatgtgacacctgcatccttgctgatgcttgcatccatgtccaaaagaatgctctgggtccacttaaacatccaataaagacaatgaaaatttccaagtgattttcctactagttcttcccatcctccactaaggacagcaatgctctgttagcctagggtcagccagcccaagcttggaggtaggaacttggagggaggaactggtcctgataggctttatcttaaaatgacaggtctctactatacactttggtttaagcaagatgctactgatcttgagtctagggatacagggttggtggcagaactgtgtctctgttactcctttctgaaactccataaatcatcttcatggaaacacccttcaaactctttacagacagtccctgtaggaatatgcctgattcagaactcctgggcgtgttgccaagagcaactaatgatttcatgtaatggtctgtgtctaaagaacatctggacagaaactaaggcactcagtcaatctcccagatgttttatctacaggacatgcagtgaccagatgtttcaagtacagagagttgctttccattcactgactggtgcctgcatttcaaggtctgttatggtgtctgtggccctcaaggaaaccaagttccctgttggtaaaagaatgcccctgtaccttcctttggctcaaactactggccaccttggctggaaaggacatagataaaaagacactagtgcaaaaaaaaaaaaaaaaaagcaggctaaaaaacaaacatgagagagagagagaggagagaaaggtctcctatgaaagacggttctatcatttctgaagcaagaataacagcgtccaaaaggaagaggtgagtagacacagggtctcagggcctggtggtgtgagaccctgaaagatgggtgctaaggtaaggtcacctgaatgtgtgggaggcatctgggcatctggaggcagcagctattagctggcaggaaaccagctgctagtttctgggatgtgggcagagccagctgggcttggctgatgtcacccatcagcctgacttgggacactacgcagcatcttcctgaactctagcctgaggtttgcttcctctggagaagaatttttgctgcaggtggtggccctgaagctctgtgtgtgcatctctatgtgtctgtgtgtttaacctcctttaagctctttgacttgcctaacatgtgcatgcaccacctgtttgagagggagaataattagctggttttgaaaagactgacctcaattctgaggtcagtcagatgttatcagtgcctccactagctccagaaatatttgttgtaagaaagagaagaccttcgttcaaatttcctttaacataacattttaaaagagagaggccttctcaatgacttttcctcaaatcgttgaagttctaagaagcaaagtgagtgtgaatcaaatatttcacacatagctgttatggctgcagatttgttttgggtgtgagactttgtagaatcctctgtggtcactctatactcccaggatagattctgtgacacttgctcttttaagtaattacatttacgtttgcatatttgctaccatgacattcttggtctctatgttggcagataaagtgtgttcactttctatttcatgccaaagcactataaggtctgaagattgtctaattccacatacccaatgaacagacgaggaaactcaggcttataaaattcagtgattttcttgacgttgcacagcttgtcagccactgtcctctcgaggtcctgacctccacccagcgtaatgacaccagaattcattagactggacaatgtccattcgaagacaggaggtaaagtctccagttcaccccagcaatgggggtataaacacagctggtctggagctcactgtgcccctgcacaatagtgttcctagagtccttcacatccatctatcagcccctgagggcagtgcctttccctcatgctctttttgtcctatgatccctttaagcccattgtagagaagcaggcaacctcctctcatgtttgtggaaagaccactaggttttgcatcaataatatgtcatatattagttcaggacaacaaactggcagccccgttccattaaaggatcataattcctttgaatgtactgccactagcctttgagggatgttgagttgtggtatagccaggcctgcctaggactggggtatgtggccagcagcatctgcaaggatgctctatcacccaccaccctattgccctggtgacacctccctagtactcacaggcagtggaccacagtacgtccctccctcccgtcatactgctcctgccacttctccagtcgtcggaccactttgagcagagagcgcttggaggggggcgtgtcccggtaggcaggccagccaatgtactggaggtgctggactatacgataaccatcctgtggctgagaacagagaggctgttagggctgttctgctggggatgcttgcgtacatgcaccttgcagataccccggggactgcagcatcatggtggaagacagaccaaatgggatctaagccatgtcctcacggggagagtccccatgactacttctattccttcgtgtacacagattctcttgccgtgactgccctgaacccccttttgtacctgaaaaactcctgctcagccttcaaaacccaatttaaatgtccctttctttaggaaagccttccctgactctgttgggcagagttttttctccctgaggctcatgtgccagaacatgtctcactgtctcagtggacagtgaactctgagcaggggggtaggggaggtgctgagctcctttcatcctgggccccaagtagtgaccaaagctgcattagttagcaaccatttcatagattgctaatctgcccctcccacccactactctgctcagccagtgaacatcctcatggaagtaagtaatcacttttcatctaggtgttggcagtgcctggcccaaagcttatgggatccaatcaaaggctgcatcaactcatgccagtacagagacacagtggggaagagctaatgtctaagaagttttgtctacacggcagcaagtgtgtcaggaaacaggcagatggcaggttggatgtcgctcgttgcatctctatgtgttggagtcattgctgagtctggagccggaatcagcacaggcatcacttcctcaaggaagaaattatcaggagagcacaacacagactcttggctggctcagcgggatcctctctcggcagcctccatctgtcttggggaggaggggctcagcaagcaatggcggccgtgtacttacccgggccatgttacagatgcggaatattctgtggatgatgtcctcgtcgatgtctgcggagacgaactccacctggatgggcccatagcacccggaggtcttctcaggccagtactgcatacagaactgagataaggaaagaggtcacagaaggagctcaaaggcagggggcgggtatcaaagtctcatttatcaacaagcttttcttttctttttttctttttcttttttttttttgagatggagcatcactcttgttgcccagcctggagtgcattggcacgattttggctcactgcaacctctgcctcccaggttcaagtgattctcctgcctcagcctcccaagtagctgggattataggcacctgccaccatgtctggctatttttagtaaagatggggtttcgccgtgttggccaggctagtcttgaactcctgacctcgggtgatccacctgtcccagcctcccagagtgctaggattataggtgtgagccactgtgcccagccgtcaccaagctttttttatggctggaaggacacattggccagaaaggtagagtattatgtaggaaattagactcagtttcccctttagggagcagccatccactttttctggtgttgaaatatcaaggctttgagcacagaaacactgggcttgcaaatctttgctatgttgatttcaaaccatttgttaggtttgcttaacctgagtttcctcatctgtaaaatggggagaataatatctacctctaagccccgctgtcaggattagatagaacatgctaaagaaagggcaagtaccatctatttttcttttcaccacgcaaatcatcacaagctcttcctcattccaggaaaaccttcatagtgttcattcatgatcagatcagaagtagtgtaaaaaatataggggtttcgggaggcggagcttgcagtgagctgagatcgcgccactgcactccagcctgggtgacacagcgagactccatctcaaaaaaaaaaaaaaaaaaaaaaaaaaaatatatatatatatgggtttgacctcaggcggccttgggtccaaatctggtctcaggtgctcactagctgtgcagcccaggcctcagttttctcataggtaaagtggggataattatgcttactttgcaccaaaagttaatgtcacatggtgctgacagatcttgcctatgattctttctatttatctggaattggaaattagaacctacagctgagagcaaaaggcagtgattgaccttctgtttaagacagtggttctcagtctgagactgttttgtttcccagagggcatctgggcaatgtctgaagacattttgattgtcacacctgcgggttgctatgggcatttagtgagtagaggagaggatgctactcaacatcctgcagtgcacagattagctccccccgagagttatgtggccccaaatatccatagtgcagagactgagaaaacctagtataaaatcattataattattattattattatttttgagacggagtctcactctgttacctaggcgggagtgcagtggtgcgatcttggcttgctgcaacctctgcctcccgggttcaagtggttctcctgcctcagcctcccaagtagttgtgactacaggcatgtgccatcacacccggctattttattttttttatttttattttgtgtttttagtagagacagagcctcaccgtgttagccaggatggtcttgatctcctgacctcgtgatccacccaccttggcctcccaaagtgccgggattacaggtgtgagccactgcacctggccataaattattctttaagcttcaggggtcattgagaagaagagatggaggctgggtgcggtggcttacgcctgtaatcccagcactttgggaggccaaggtgggtggatcgtgaggtcaggagttcgagaccagcttggccaagatggtgaaacccgtctccactaaaaatacaaaaattagccgggtatggtggtgggcacctgtaatcccagctactcaggaggctgaggcaggagaatcacttgaacccagggggcagaggttgtagtgggtggagatcacgccactgtactccaacctgggaaacagagcaagactccatttcaaaaaaaaaaaaaaaaaaaaaaatagaagaagaagaagagatggatatcttgtttcttgtatctttgtctctgttaagccactagataactttagctgaggagagaatgttgaggtggggggtggggtgtgtggctgcagagaggagcaaggcatgctccctccagttcctggttcccaaggggcacaagatggatcctgcctaggtctacaggtcccattgctggggtacagaggggagacaagattgcggctgcaggctcgctggggaccaccccaacatgaacaaagaagtcatgtgttagacccttcatctgggggttaccctgaagatatagccaagattcacaaagaaagacccaccgaggcttctgagagcagtttgggattgagtctctcctcagcgggggtctggttcaggctaccccaggcttgcaaatagggggctagatggacagaagtgacccaccccctacagatgcagggttttcatcgaagggggtgcttgctctccacttcgtggccgaagaacagccatctcaccctgagaagtcacatgtgaaaataccttcattctctccttcctccagaactagaattagaagggaagagcagcgagcaggaaggatgtaggagatggaaactcatgtctcccaccttcttagctgtggaaaccccaagttctagcttaggaatattcaccttatagcagcagttggcatactattgcccacaagccaacccagccagctgcctatttttgcatataaagctttgctgaaacacagctacacttattcatttatgtattgtccacagttgctttcatgcatcacccacagagttgggtagttgtaacaaagaccatatagcctgcaaaacctgaaatatttcctatctggctctttacagaaaaagtttggcaacccctactttatagggttgttctgaggataaaggacataattcatgtaaataaacccttaccacagtgccaggcatggaataagcatttactaaattccagtgattcataccattgttgaatccatcagtgctcaacaaaaataataatagtaatagctatgatatataaatttgaaggattcttcttatcgcccctcataaatagcataagtatgcaaggttaagcttcagaacgcaatgatgccttgctttcctggcgtctccactgggggttaaccaagcatagtgagaaaggagctctgagtgtgtgtgagtgtgtgtgtgtgtgtgtgtgtcttgtcgggcgctggtcacgggcctccatggctggacaaccatctgctgagctgtgcaatgatgacaaatccacaatttgaacttcatttctctttgccattggctcttccgccttgcaaccttcacagtaatgagagattggtacaaataagtctatggttggtcagagaaaccagaattaatcagaactgcccattaaaaaaaataattgcctttatcacctgcactgaatttagggttcctagagtttggctgtgatcctgacacaaggtgcatggatccaaggtatcagggaagtcctattatccccaatatcttcagtctggagagaatgtggaatgatttgtctcttttaataagatttccagaccaatttctcaagctgatagattctactacgcctcaaacaagactcctatatttcgggacacttctctgcattcgattttctgggtcactctctcataatgcccagagggctggggaaggttgcaggcttttctaatcctaaatcagagtcatcctttcacttggatgccctaatttgtgagactacagcagcagcagaatgggtgaattcagcagggtgatgtgctggcaaatgtggtgtttgagctgccagggatcatcagggtctctctgcagcccgggacactgcatatattctagccatgggaaataagagaaagaaagcaggggggccatgttttctcttcccactgaccctttggggctcagaaatgactctcatcaataagaaacatcctctgtggtttagctcaagactgtcctggtgttcaagtgctgtagctgcacctgaatggatgctaccattttggtttgcttatgttgtgtagcaaaaggtgcgaaaatgcattggggtttcttcttgaagctccctggattcaaatcgtggctctatcactttctagtttgaatggcttggctacatctcttagcttctccagtttgttatgagtggctgtgaattttaatgtctacttagcatagggatctgtatctagcaagtactcaattaatgtaagctgtgattattaggcagtatgggggagggttcctcaaaccaagatggataaatagatgatttttttcctccacttagtagcttttatgaaaatttctctttaggataatactcaaaggactgcccgtgtggaaattctggatcagccagcttggggtagctgtgaagatgagtagcatcctagatatgggatactgcatgtcaaaatacagagatctgtgggttgctccgatgagctgaatgacccagaagataaaagaggaaggttgagatcactgtagaagcagtgaggtataaaaggcaactcagtgtgtcacataaccctgctcctaaactctgaaatatgccataaactcataatagcatgtaaaatgcatactgtgcatgtatttcttgcagaaaccagcaagaaactgagctcggctccctggctcacatagacatggaacagagatcacatctgtgagtggaggagccagacttttcatataagcacgtaagcatctgcgatttatacaactcctggggagggaaagcttatggtttcttaaggctcaggaaatgggaattctaggaagcctacttgcctctttaagatcacgaggacgtagctgacctaaaggccacacttaccctgaatgcaaccttgacattttcttccttagatgtaaaacttttgaagttggctgatccaagaatagattcaaattcttcagccaagagtctagaccaactgactttttccacttcattgcctagtaagtactctctcctaccctttcttttccagtggtctgagggtgaaaggtgatactgcctgaagggagggctttgccactgcagatacatacaggtagtggcgatgaacacaccggggagaggaagtcagtccagttgttgttaatgatttagaaataatcatgcttcttccaaaaaaacagaggggacttttgttgtcttttgtcagaacaagttaaaccaagcaaaggttgtgaagcctgtgtggatagccctggaacagctgccatacattattccacctagtgctctccatggctgtttgggccatgaaaagatgtccttggggggtgcaagttcacgtgtgatatataacaaatgcagaggtagcctcacgcattaaacgtctttttcttgctgatggaatcagaaagcttgttatcactggaataaacatgctccgatgagttgaatgaaaactagcatatgggtctatttttggaataaacatttttagagcatatttcagtgcaccttagttatgcctttcttttattaaaaatactttgataaaatggaaaggccaagtaatatcatcacgttagaaataaaggactttatttattaaggcccctgcgacccagagtgaagaaatcaatcccaggccacctaaaggtgaagtgaattggtattttaaagagagaaatgtaagtttcctgaattgcttttaaaattcagcatcagtgattataaaattcctttaaacagattctataaagatccaaaaatatataattggctttgatactatgtccagttaaggaaggcagactgtgaatgaaggcataaagaagacagggacagagggagaaagagagggagagagaggggggagagagagagagattcacacatctctcctcattgtatccttccagtagtcccatgaagctccataatacaatctccacatagtgggtggaaacttactcttaaaacagctgcatcagagtttgtttcagggaaggaagggttggagtttaggaacttacctacagaagagtcttggggtgggaggcaaggctcagagcaggtttaagaaagacgtactaaggagatggctagattttgcagcttaagaaaggaacaacttttggggagagggtggaagagctgagaagggagggatgggaaaggaggtaaatgggaagaaaatggtttgggcaacagggtcaggggaagatgtgttactgctagtgagagctgaggaggcaaggtgaggcttcagaaagaggatgtgtgatgttcaacttgaagtcatgggcattgctgggatatgaagctcatatctctccgactaaagcctcagctgaaacttggaagtaaacatgagaagacaaccccctcagaattctcagaaatgttggggatggacattgggttttcccataggatggggagtagggaacagagcaaattttatttaaatcttcaaagacagaatgaacttggctaacatctaggttatagtaatctaacaaatgataacattaagacttggagaaagtaaaggaactggctcagggcaacacagtgagtaagtaccaaggctacaatttgaactcaggtctcttgaccccaggtttcttttttactgttacccctaccattctggtggggacagaaacagagacacagccccttgcaaagtcagacctgaggctggctgagatgcaggttgggtattttgcatattttgctggtgtgttaggctgtgttttcacaagcccagactaaaaatggggatattaggagttgctatttgccctagaggcacaatggcagcaagagacatctctgaaatagcaccctgcttttctcctgggagaatgaggagcttgcctctctcacttccatgggaatccatcacagcccccattatccttgcactcaggcaccctcacctttccaaaaggctttgcatccctgatctctcaggctttccacagtgggagccccagaacagagcaactcagcttttatgtaagttgtggactcttatttgttttaaaggaaagaaacatccttgtatgctccatacaccaggtgccatagcacattcataggtctcaggggttaggatgtggacatctctggtggggccacgattctggctaccacacagccccaccctttggctggcatgcaggatctcctgagctctctaaacagtatggtgagtatggcatgactgcaaggagggcttctttctggtgtctttctggtggtccgtagagaccacaaagagggaaaagatcttgtcaatgctgttggatgtggttgaaaatgttctttctgctgagtctgagaagtgacagcatgctttgctggctggcgtggttctaggattttaccccgcaaatctgaccacagacatttggagtcctaaagagttagaaaaatctgtaaggttgaatgcagaagtttgaatgcctttattttgagccctcattgatcataattacctttgaacagcaaccactgcaggaatgaaagaaaatttggggctgactaaatgaagtagtgtaagattctgagcaggggcagatttggccagcagtgcaaaaaaaataaggccctgtgagagcttacaccctcttcttattttgctgcagcttacaggtagccctgcccaatccccaacgtacgctcttatggttcccaggcaaaccacaggagatggcatcggtcctctcaggagtgacctagcaatgctcaggtcctaaggcagacctgtccatgttgccaggctgggctagcttggaggctgccttggcatgagcacgcaggcagacagatgctgacgccgcttcaaagaaccgcccctccaggtgctgagggcggcttttctgatgctcatcctgtgtcattgtttattttcataaggcgcccagctgctgcggtgatgatatttatatcaataagtgctctattcatctgccggtttcagggaatgcttgccagctgcgtatggcagccaacctcagggtacttctgagcctgatgtttttgcatttagagaatcagttctcaaactctgtaccaacatctgggcctgaaagattcttcattcacccaggacccaccctgaaagggggagctatagccaatgaccttgacctttgtttcaaaggttttatatgtcccgaagtgaagttctttgaaagtcatcctctgtgcctgagctctggttttgcagaaagggatgttgaaaaagagaagagcaaacagggttttgcaggccagacttcatgcccaggctcatgagctgagttcattcttttatttcttcagccaaaagcgtagggtggtgatgccttcagactccaaaactctgcagggaatgttccagaactctctgttttatgagaattcatttattttttatagttatctcagtttctaaccttctattgctcaggccccaatcattgacattatccttcattcctctttctttttttgacagggtcttactctgtcgccctaggctagagtactgtggtgtgatcacagttctccacagctttgatctcctgggctcaagtgatcctcctgcctcagcctcccaagtagctaggattacaggcatggaccaccatgcccagttcatttaaaattattttgtaggactgggtgcagtggctcatgcctataaccccagcactttgggaggccaagatcagcagatcacctgagatcaggagatcaagaccagtctggccaacattgggaaaccccatctctactaaacatacaaaaattagctggctgtggtggctcacccctgtaatcccagctacttgggaggctgaggcaggagaatcgcttgaacccaggaggcggcagagttgagatcgcgccactgcactccagcctgggcgacagagtgagactccatctcaaaataaaaattcttttgtagagacagggtgtcactgtgttgtccaggatggtctttaactcgtggcctcaactcctgacctcaagtgatcctgcttccttggcttctcaaagtgctaggtaagattacaggcatgcctggcccttgattcctctttctctctcttattccatagtcaatctctctggatgtgttgttggctttaccttcagaatctaccccccagttcaaccaacctcacctgccacctgaattatcacagtagtctcttgtctgttctctctgcttccatttcagaaaccactcttccccatccttgcaccaacaatctattctcaacacagcagccagagggatgcttttattaaaaaaggcaaattatgttgctcctctgcttcaaacatgtgcatggctctctgtttctctgagagtgaaagcccaagttcttctatgtcttccatggccctctgacctcaccttctgctgctttccccacagttgtgctgctctgcccatggcctctgtgctgttcctcaagggcaccaggtgcatgcctaccctgcagcctgggtgcaggtgttccctctgcctgtgatgcccccctgagagtcacatggctcactctctcacctccttcacgtctgtgttcaaatgtgttcttctccatagggcccaccttgacaatcctattgcaatgacattctatgtcccagatccaacgttctgatctttactaccctgccttcttgtttgcctttttccaaacactcgtgtcagccttctaacttataattgagcacattagagaatgtgtgttgcttattatctgtctcctgctttagaagagaagttgcatgagagatggcaatttttttttatgcctcgctttgtctgtgttgctcagtgatgcattccaagcacctagaatagcttccagcaaatagcagatgcccaacaaatatgggttgcctgaatcaatagactctctccggaacgtctctcacaggcacatcccaaggtgcactcaatttcatcccctgttcatctgctcttctcgctgccttcccctaccttcctgactttcatattttccccagttatatccccagttgcctaattgcccagactcaacttcctgccattatctgcaactttccttcttattcacctcccacctgcacctgctccctaaaccttggggacttaagtctggaaatgttttcacgtccaattccagtcctctcacctcctggccacttctgcagttcagataactacctttattgtctacacatttgcaacattctcctccccggtctcctggtttccaggtctttcctccggccttttacctgcactgatccccagacctggctttctttttattcttaccctttttttgcaatttttattttttttattttttaagagatggggtcagccagatgtggttgctcacgcctgtaatcccagcacttcaggaggccgaggcagggggaacacttgaggtcaagagtttgagaccagcctggccaatatggtgaaaccccatctctactaaaaatacaaaaattagtcgggcatgttggcacacgcctgtaatcccagctacatgggaggctgaggcatgagaatcacttgaacctgggaggcggaggttgcagtcagccaagatcgcaccactgttactccagtcgggatgacacagtaagagtcagtaaaaaaaaaatgggttcttgcactgtcacccaggctggaatgcagtggtgggatcatagctcacttgagccttgcagtgctcaagcaatcctcccgcctcagcctcctgagtaactgggactatagacacatggcaccatgcctggctaattaaaattttttttttttttttttttttttgtagagacagggtctcatggtgttgcccaggctgggcttgaactcttggcctcccaaagtgctgggattacaggcatgagccaccatgcccagcctctagacccatctttctaacaggaaccctggctgtgttataccactgtcaaccctccagtgtttcaccttcctgcacagaaagtatttctaactgtgctcctccaaactccagtggtcccacaaaggactgacccctctaagggcaccaggagaaaatgagacagcagtgtgggtggaagcccaacccctgcctactgcttcatcatgagcagcttttggtcatccctatttcatacattgggcttgcatgaaagcttttattcatagaaaggattctgtcgcttacaaagtagaagtctgaagcttgctatgctgccaaccaagacccaagctccttagcctggcacagggacctctctgcaagctgggctctgctgcatttttcagcctcactacattcttctcctcctgatattcctctaggtcccagccacactggaacataaactgttccgcaaataagtctgtgtatattcatcccctgcctcgcctttgcctctgctgttccctctgcctgaaatgccttttcccagtgagttcagcctccatatgcctaaagctcctctgccttcttcaaggccaaagtcaccttctttttgaagtcttccctcaccctctgggcagaattcattgctccctgctcctggccaacacagcacttcactgctgacctctattataacacagccacatgaggttgggacaatgtgctcatctgtctctggagcaagaccatgcgcttttggagggctgaaactatagctcaggtctgtttaaaaaatttttaaattcccatccaaggcctgcacaaggccagctctcatatgggaattcaatgttactttaagttttatttaaggcagtgaaaggataggtttttaaaaatctgaaggaccattctcagctcttccaccccagaatggctgccctggcatagaaactgttccaagatacacgtcctgtgtcctgagtatggggatatgctgtaggcacgtgatgcttggagctatcagaacagaggggctaaggcaggaagcctgccggggaacaaaggtcaaccgtgaggaactggggcttggtggggtggtcagtgggtaatgtgtccaaggttcaagtcccaggctctgtctgtacaggctgcattgcagagggggaagggaggtgagtgtggccgggcatctgggtatttttcagggctgcaggtgctcagtgctgggggaggaagcctcctggctctgcaagatctgtgtgatttggagcaagacaataatcaatgcttgtgagatggagcaacagagtctggtcccgggcggggagttggacaaagcccataggcagggggagtctttgctggaggtctggggggtgacaggaccctctgtaggtagcagaatggcttgtctgatgctcgtggccagacactgcttattacaagacagctggctggggcagatgtggcaggcaccggctgtcaagggatctccctccaggtttagagcatggcccccctgacccacctagggcttggcttggcctcctcctacctgggcagtgtccatctcattcagcatcaccacagaggagcagttgtaatcgaacaccagcctccagaagtctgccacggtgttgggtagagggtgctgggtgaccacgaaggcggcaggctgcttgtggctctgacaaaggaatgacacaggcttcgtaaattacacatccatcagtgatattctgatgatgatgaggcctggactgaggccagaggctccagagcctgccaaatagattatacaaaacacctgcctgttcttttatctctccacgccctggcggcaaaggggaccttctcataatgaacacaatctcctccaaactaagacatttcattaggaaagtgtcactgggatgggattatccaaataaattatttatgcctcggagctcagcaaataatcataattacaatacgaaatgaaagatttcagatgcagatttgttgctctactggtcaagacacctcttgggatataagggattggccgcatccctgtggccacgatgctgggcgaggttttgggtcggcctgaggccgagattctcccaaaggggcaggctcccttctgcctccaggctggagtgaggggctgagttgccctggcaaggtgggcactgtgtcatgtgagtcaatggggcagtggaaagtacacatgcattattaatagtccggtagacctggggttcaagtacagctttaccacttgtaagttatgagtcatccatctgtccatccatttgcccatttattcattcatccattcatccattcattcaaactttgtagagtgctttttttttggcggggtgggtgctaaatactggcaagttattagatgattccaaagctcatgttcttcacctggaaaacggaaatcataaatccaaaggaatgatgtcacacagattgaatgagatttacgtgtgaaaaggccagcaaacaagagccggaacgtaagcctactggcagggcagaaacacccctgactttgttttacgtccttggcactggtattgtcgctggcacatgctagacagtgccactccagtgaataaaacaataaattcagtcccgtgttgcagatagggaaacagaggcccagagaaaatggcctgggcggggggggggggggtggggtggtctggcagcttcatccagggccctatttattttctccccaccctgaagtcatgtatttgaaaagattgggaagattctccacttcatcagtggctcatgtgcttgatatgttttctcaagagatgatgatggtttctgtgggagttacagctgttttcagtgcagttacaagcaagagggaagagggcaaagaccctggaaaaagcaggacaaagccttgcaaacatggatatcatgcgtgcattggctgggggggcccttcttccgagggccttttcctggccagtagaatgttcagaagaggggtctgggtgggcataggcaaataatttattttccaaaagccaaactctctagctgtagacagcatcaactttgagccatttccagacatggaaaaacattgaggctttgagagttaacagacttggggctccaatccttggctcccatttctgagctacttgaccttgagcaagtgatgaatgaaaatactctgaccccgaggacctcatcagaaaatggggatgagaatacccacatgcaaaatgggacagtgcaagtccagggcccgacatggtgcccaacactcagtgaatgttagttttcttttctttttccctgtctctgtgataaacgctctattaggccagcacgcctgacaaagccttatctgaaaatatgttcgagatccgtgctcctgccgggtttcagggatcagccggcaatccatttcatggataacatcatcctttaccaggggaaacattaaaaattaacccagaggacttcatatttttctgctaggagcaaagctgctatggttaccagataatgcactgactgggctggaatacagataaggacgacttttttttgtttttaatatcagaaaggcaaaggccccagtgatggctcacaggagaaatgccctgtggacaaagagaatacaatcagcatcagagcttggcagaaggcatttgactccaggcagtatctaacctattaagtagaggccaggagcttatttgatctttgcctggatgaggaaggcagggagggggtgttgggagaagtgggagacaaagctaggaggaaattggaagtatgggcgcacccctaggctccatttctcatcacactcacacacataatgcacacctacatgcacacatacacatacatgcgctcattgactttagaaggctctaagctataagctaatgccaaaggtcttctctccacctctagctacttgctatgaccaagccaagactccctgattctgaacccagagctagggtttttacagaggatatgggcactctgtggacagaggccagggcaggcccctagagagctgggataggcattgaccttccatcatcaccctcctgcctctaacacccagacccttgggagaaacttcaagaggattagaggtcagagaagttgttggccttgaccccaggagaaagcatcccatgtttctgtctattctgagtgagataggagggccacatgggctagatggatgtgaactcagatgggctggggaggggaagctggaagggctcattatatcaggcaatggtgttcttggttttgagcctcaggaggtgagatgtttgcctcttattggatccaccaaattgcagggaggctcaagaaatgaattccagagtgtgacccaggagctctgtgtgtgggctgtgccactagctccctgggtgaccttgagcaagtctctttctctgtctggcctctgttttctctgctgaaaagtgcatggctggtagtagatggtccatagttccttcctactgcaaacacctgtacaccttggaggggaagtgatgataatcagaagtatccgaaaaacgcaggggagaagcttaggctcgctggaccaggaacatgaccctaatcccaaaccagggtagggtgaagccccttcctggacctgatgacaagaaagtggggggcagtggccctcacaggacagccaggaacacagcccgcttccaccccatgcttgttttactgcttcccactactttcccaataaccatttactgagcccctactgtgcgccatcctcatttttgtctctgctcaggagttatctggaaccttcatgggagctaccagagggcagaacctgtgtctgcaccgtcttgtgttcccacgctcaggccaaggcccagcacagaaaatacctgctttactaaacttcaggctgagagtcggctctgtggggaatggaagaggttgctaggcaggcctgtagacttgccatggtgacacgggagccaccttacgcttctggtctattctttccaggctctttgtatgagaaaaggagccaagagcccaccttgtgtctaggtttggaccagagcctgcaggggaacaaaggtccttgggactagtagatcagaagcagggggggctggctggtggggtcagggccctgaggtccagccacctccacctcaggaagaatatttgccctagaatgccagctaggagctttctgcccgggctcggcttacatccatcagtgctgcgttgatgtaattgctggattctccgtccactgagataaggaagggcaggcagcggtccagaggcagcacgtccatacttcgattcttatcatggttccggggcaggagcccaatgctgcagtcctcgggccgcacacggggtgtcacaatgttgagggtctgtggggcacaaaggtgaatagataggccctgctcatttggctgcccctgagcaaaagagacagtaatgttccaactcagcctaactcgcctatttccaccctctaagcgcagccccactctccctttcccgggacccatttctcttccacggtgatgttctgtcctctcctgctccctgctatagggtgtgtgagctgtgtgacaccttcaaaacgccaaggctgcagaagcagcgcatccacacacaggctcagacacagcctcatagtacctgccaaccagatgaactaagtcgttcagctcagccagtgctgctttaaagggtgggccagccaggagggcatacagaggggtgggggtagggaatccctactgagggctaaacatcacttgcgttgtcatggaatgggggaaatgatttaccagccctcttctcagagagaaagctgtctgagtatggaaggatgcctagatgacctgctcaggatagatgagagacctccgaggggcaaaccctaacaggtctgggaaattgctgtgtttggactttgccgagtacatcttgcaagtttgaggccagagctgaactgctctagccaatggactagatgttacgtgcaatgaccagtgttctgtaccctccatccttccctcattcagctctctgtctctacttcagatcaataatggctatttgttttagggattgctaaggtattggcctgcctgggatatctgcccgtggaacaatgggcctggcatttgcccactgacttgaagcaagacctggagcttccttgctttctcatacctggttctcagctcctgttgcccaggtgtaattctgacactggtcttgggataaagggctggactctggctttatcttacttagtgattcatgtccaggctccctagaccaatcaatgttgccacagctctgaccgcatgggcttccaggtgtggatctggtatacctgagctatgttctaggacagtacttctcaaagtttaacatgcatacaaatcactcagagatcttgttaacttgcaggctctcattcactatgtctgggccaggtccgagattctgcatttataacaagttcccaggtgaagccaatgctgctggtctccagactgcaggttttaaaattttatttattttattttttatgtttttgagatggagtctcactctgttgcccaggctggagtgcagtggcacaatctcggctcactgcaacctccgcctcccaggttcaagcaagtctcctgcctcagcctcctgagtagctgggattacaggtgcatgccaccatgcctggctcacttgttttgtatttttagtagagacagggtttcaccatgttggtcaggctgcagaccacacttttagcagtaagagtctactgaaaaattactgagaggacctgagtccctccagggatgaaggagcatgaaattcacacctgtttgtataaatttgtctccattcacaacttggactagaactgaataagacctcagttaaaaaacatattcacagttaaagacaagtaccagcaatccctgagtgagtgtgtagttgctcatggctgtgcattttgtgttctggaatagattctgcagcttcctagagaagcagacactgaaagtgcatagatcagttgtcccaaagaaaaccccacaaatgtgcacatagccactgaagttggttgggttactgttacggactaaatgttttcatccctcccaaaatccatgtcgtaatcttagcccccaatgtgatggtattaggaggttgggactttggaagacgtttcgatcatgagcatagaaccctcatgaacgggattagtgctcttataagaagaaacatgtagggccaggtgtggtggctcctgcctgtaatcccagcaatttgggagaccaaggtgggaggattccttgagcccaggagttgaagaccatcctgggcaacatagtgagatcctatctctataaaaagtaaaaaaaagaagaaatgtgagagcttgctgcttctactttccaccacgtgaatatgcaacgagaagacggctatctgcaagtcaggaagtgagccctccccagacactggatttactggaagcttgatgctgggcttctcagcctccagaaatgtaatgaataagtgtctgtcatttaaaccacccaatctatggaaatttgttataacaacccaaactgactaagatggtcaccgagcctgggatttgctcatacctgaaattcatctttgatttggctggagtttgtctgggggtccagcctgctgatattgtagtagagagaacggaactcacacacagggatggcagtgttgccacagaggcacgcttccaggatggcatcgtgcacaaacacatattgctcctgcaaagtcagaagagagggaatggggtgccaggtaagaacagtggcctgggaattagctgtccacatttagtgttgtggctatgaagaatagacatgatttatcaatatattacaggatccttactttttatactgtaacccaaagggccaaatttccatgtttcctaatgatcacctgagctatggtgggtcttgtttctgatagaagatgtaatagcatagtcatgataaaatgagaaacttctagacatgctgtcagcaggcgctcttggtgtccagcccatgtcccctcagctttcacctttacctgaggaaggctgcttgctgcaaacacctgtgattgtctgctgaaggcagaggggatacttgggctgtgtggaaaggaaccctcaagcaatgacagatggagagttgaggatagaaatctaagaaatctctccctttaggtggaatcacttggacacgcatgtgtctcagagttcgccagcagaattgggttccagttgtctacagtgtttaacaacttgttaaagtagcctttgtttgtttccttccctgctctgcctcactttcccattcaccagccactgtgtcttgggattaccttccaagcaaattatttgccggcaaatctttgtctcacgatctgctcccaaaacgtgtcatatcttctcctatctcaattctttgtacctgctgtactctcctcctgaaactccactccctcttttccatacctttaatgtttcattctttctggaaagccatctgttaatccaccaggcagaagttggtgttacttctaggccccagataaatgtttgttgagtgactttttctgcagaacttggtcagtttctctataaagagtacttttccagatgctatgtgatgcatctgcatttgaatatgtctccccatatgtctgactgcaaccagcaagcctggcttctgcatgcatggacctaggaatagataaagcagccctcttggctttagtgctagaagcctgaagactggcctgtgtgagttagctcagagcctatgtgtgtaaaccaatcaatggtggtattcactgcagattcagagaggctggctgtaccaaaaccatgggtcacttccctttgcaggattgatgatgtgcatagttccctatctgtcccagctctggtcgcccaggcacccagagccttcactagaacagaagatgggctcgttacaggaatgataagccaaggtacagagtgggataggcagaaaaggctgcttagtgagagtgtggttctggcgaaaaagcagaggcctttgggggtcacatggaccgaagttctaccacagtctggtatgtgaggtcttagggacacaatttcttagtttcttcttcattgataaattggagataatactaggagctacaccatagctggtttggaggagtagaaacaataccgtgactagaaagaatgtatgctgcctggctcacagtaggtacacaacaataaagattaattcctttcaatactcttaggtttgggctctccaactgcacagagagttgcctaaaggtctgcttctcccttgagggcagaggctgtgtgttacatctcttgaaatgcccagcacccagcttaagtactcaattactttgttgattaaaccattccctgcagtgactgaaccatcgcttggcacgtagtggtcactgaataaatgccagtccttctctttccttctctatcacttcacccaaggcaagaatactattccaataatccccgaaatttgtcattctgtccctgcttggatggcctcagagatggagaactcaccaccattcttcattggtggaactgcctgcactgtagacctccagggttggctggggcaccctagcttctacagtagtctcaccatagtaagccacgtgtctactccctcctgcttctctcacacccaggtcctttccataggatgcccctacctatgtgtctctccgttctatcatcatgtttctccttggtcagggctacaggtggccaactgtcttggccccctaggactcacctctgtctgtaccaggttgaccctttgggcccggagctcacgcacgcagttgaagatgtccaccaccccttcattctcggccatgtcaagcatggtgtcaatggcaatgaagcagccagtccgcccagccccagcactggaagagaggtatggtctgtgttaaggatcttcatggggggaacctgccctggggaggcccctagcattcagccctatccccaagggtcctgctgggaggctctagattatgtgttcccacatttcctttcttaatatgtatagtttgtaatgcatgtgcaaaccacacatatacatgccattgccttgtctgatggataaaataatacatccatatagcataaaacacctagcatggttcctggcatgctggagctgcctcatagatatgtctttcctattttctacccttcttttctcttcttttttcttcttcagcaaatgggttgacggatggaagcaaagaaggagaggagagagaacagaggggagatgaatgacaggacagaaacgagagtcctctgagctgtccccaagacagagagtggttggtggagcaccacgttcaaaggccggcatctggctccacctgcagctgttttcgcaggatcgtgaagcaagagtgtcatgaaactggagcagctgaccgtccggagacccttgtcagggatcaagtttcttgatacatacttacttgatttctggtcactagtggcttctttaggagaatctcagaccaagtataaaatggtaggggaactcaacgagactctatgggccttggccagccctttctagatcagtgctgggctctgaaacatcagtgctgaccaagaggcacgtaagacatgtgccttacacatgtgcagttttggatgggaaggccgggcagcctgtcaaggaggcccccttccgctgcgttttcacatcttgcctttctcatggaaacaagtgtctttgtctaacaatgtagatgtcaaaagacacacaaagaggaagagagatggaacaagacaaaaaagcaatattggctcatggtaaatccaaggggcacaggccagtgcggaccactacctacaacaatttggaaagtacacccattggaagcagagtcttcattcatgagaaactttcatggtttgaatgaagtctgacttaagtttgcttcagaacctactccccaaaatccagatgcggggactcaagagacttggcctctgtgtctgggagggagtatagggggggtcactcgtgtttttttcttcaatgttcatattcaccatgctttagtataaagaatcagcccaatttggttccaaattttggaacaactatcaatcaatcagcggtgaccaagttgcctagtgtccgtttgtttgttagcttcagatttctgatgcttttaacatacctccctgcagggtccttgtgaggacaaagctgtgtttatttcatttcagcatcacatagtaattgaacacaggatatttgaaaagaccccctaggattaaatcctggctctattacttattagctgcatgacctcgggcaaatgacttaacctctctgggtttcaatactcatctataaaatgatgttgataataattaaaatactcactcatctataaaatgatgttgataataattaatagatccacctcacagcattaatagcacaatatgtataaattggatgaaattacaattaaaatgcataatgcatacaaattgctttgtgcctggatacatagccattttttattgagaaattattactattatattcaacaaatatttattgaaaatctaagatgcagtagatgctggtattaggagtgggaatatgaaaacaaacaaacattgttcctgtcctgaaggattaataaataatctggggagggggagaaagaaaacattaagaggaggcagagaataatgatatattagagtgcttactatatgtcaggcattctctcttaggcacttagccaacccatttggtaataattttcagaatggccccaggagtgggtaccactctgctcagatgcattaagatgacctgctaaggagacacataccggcgtagagccatcatgcgccgaagtcctgatgataaacaaacatttgccattgtctttctttctttctccctaacccttgatctgggtgctctttgggatatagagatggggggcattaatgatccattgccctttgattgctatgagatataaagcaaagcagaaaatacatgcaaaacatttagagagtccaggattacctcctcatcctcacttgccttatctgtgaaatggggttgtgtagctactattgctgggaagataaataaatggatgctgtatgaggacggggctggctctgagacatccacagcttatggagtcttccatggtctcttgactgacacaaactgccagggcagggatgtgataactcaagcatccagggtctgaaaagatgggctgccccaaggtcatattggaagagagaggcgttgggaaggagggggatgccagctggccagccttcaggtcaggaaggccatcctcctccaattctggacacccttgacaggatacttcatctccatttgggaggattcaaagacatgccactcattctcaatgtgactttctaggtcagagctgaaaatatctcttcttcataataaggtaaaacctggtgctgtccatttctctctatgagggaccctgcaggctggcaagtgatcttgaaaataatatagaaatgaaaagaagcatgcttccaccaaggcgccctgctgccatgtcaaggagctgagggcaagtgtctggagaaaagcaggtgaaatatccccactctgtgtttacctcctcagcacttgagtttttgtatctgtaaaatgggaatgttaataatgcccacctctccagactggacgagaagtaaataatgtgggtaaaatgcacgtgacagacccagcagatgctgccagtgttcagcctgcctccctggtgactgacttcttcactgttttcaggcaacaacagtaacaatggccactactgctattccttttgttagctgaccttgtgaccaagtatcatcagaaagcactgggcatgggggggacacaggaagaggagtctctaagagtaaagccactagaaaagataacatgtccctcccaagaaagccgagctgcagaggcacactagggtaggtggaggactttttctttttttttttttttgagacagagtctcgctctgtcacccaggctggagtgcagtggcgcgatcttggctcactgcaacctcccgctcctgggttcaagcgattcctctgcctcagcctcccaggtagctgggattacagatgtatgccaccatgaccagctaagtttttgtatctttctttagtagagacgaggtttcaccacgttggccaggctggtctcgaactcctgacctcgtgatctgcccgcctcggcctcccaaggtgaaggacctttgacttacctgcagtggaccactatgggcccagcttccggggggttgaggaacttgacctggcggacgaagcccagaaggccagtggcatagcagggaacgccgtggtcaggccagctggtgaagtggaagaggcggagctcccggatctcatggtagcctttctgaggaaagaacgggcctctgttcttccagctgctgccctcgcatacccagcccagcaacacgtggagccatagctgctgcactgaggaacctcccgcagggacagggccctcacagtgtttgttaataggtgttactggatagagcgattctgtaatcagttacatttgggaaatatgggattgttaaaacgaaaccgatggctttattgcaggatttctcagagtcttgagtgtgctcatacacactctgaatgcccaagagggccacagagcaccctaggagaccttcttttgtttgcctaggggatcgtctttgacaaatgtttcataggaggtgtattgagtacggatttaaagaaatgttggccttaaggaccaagtcagtccaaattgtttccagtggaatctgaggcgttcagtgattgaggtctgatattctgtagtgttccagccttggctgtgatagtctgtgtggctttcaaagtttatataacttagtactgacttctttattaagtagattcttacttagaatgattacataagatgcgaaacaaacaaaggcagagcttctctgatctgatggagacagagtggggcctagagctctgagcggttcccctcccctttcacacccctccacccctcacagagacacactccgggcccagtagtggttttctgaccattccatggccaggtcacacttctaagccttcgcttagacagttcctgttccctactatttttctacttagcaatctcctgcagatacccagagaacactgaataggaagagtctgtttgattattcattcattccttcattgaaaaatcatttaccaagtgtgacctgtgcccagccttcccagccttgtgctaggtactaggaaggtgagaataaaagccacagctcctatccctggaacagctcatggccttgtcggggaggcagatgcccaagtgggtaattctattgaagtggataaaggagtgcctgctaacctgatctgaggagaagagaaatcccagaaggctttctggaggaggtgatgcttgacctccatcttgaaacagactaatagtgaaaataataactaacaaacattaactaagcatttactgtgtgccagtcactcttctgaacacttcaacatgctaacttacttaatcctgatataaatccctatatttttatctccatttgatggatcaggaaactgaggctaaacaaggttaagtgacacacccaaggtcacagtacaactcacaagttgtaaagggaccatgtgaaccctggctgtctgtctccacagtctgcactcttaatcattctaatatagtgatgtgtgagtattacccagttgacgggagaagaggaaggaatccaaggcagggggacagcatgggcacaggcctggggacagggcttagcatggtgtgtgcagagaatcactagcaacccagggcaatgctagaggcaagtggaagtcaggccatgggagaccacaggcctgggggtgcaggagaatagatgagagctggatcccagaaggccttgaatctacattaaggcctttggactttatctcaaaggcactgggaagctacagggagattacacagacggttccacacaagaggaagtgcatcattagacttgcattttaggaggctgcatcctgctacatgaaggatggattcaggtgggtggatcgggggttgcagagagggcactattggtgcccactcagatccccatcactgggccagtggactcattgccacctgctctgagtcgtggctgcacacagctcacagttaccctcttctgaagagaactgttctcagctgaacaggaacccccctcccctggggtgtggctgggtggggcagcatccttcagtgactgactgatagtagagggagagtgaccaactggcttgccacttgctcagtctgcccaggactgacgggttgcccggtacgtgggactttcagtgctaaaaccagtaatgttctgggaaaaacagaaattttttttacccttatggggggcacctgaggcccctttgcctcaaggttggaccaagtgtgcagtaccattcatgttccagggctcccatggggttaggtggaagcaagtctctgctgaggccacttcctcactcagctcctttccccaccccatcctggctctctcactgccttccccctgcaaactctccctaaacacatgagccagggcacccaaacgactgctgcttctggctctgcttctgggaaacccaaactaacataggggcaggactagaggcagacagtcctgttaggagggagaaatcagatgcccagatgaaggcagtgatgaatgagctgaagtgagagaggagaaagcttcaagaatacttggacttttttcacgccatcctccaaatcaattcagtcccaagaagccttccttcgagctcttcccacctgtgctgtgatgatttatcaaggatcctctctccccgatgcgtctgtgctgtcttcaagggcagacagcactccctgtttattatttccaggttcccagctcaggaaccgattttgagctaaaatcgcaggtaatgtttgctgagtgcctgcctgcatgctgtggagaggctggctaagcccagttaatcctcagaggcccttggggtcttttaagggcatctccctgtgagtaatatcttccctcgtggttgtttaaaagacaaagaaaatgtaacacgagaaaggaccttaatgcctcaacatggtttgctagctgcaattcctcaaggcctccctgcccgtgtcgccagtcactcatcccatcctcgggcattcaacacagatgtggcagatgagactggtacccctgggtcctcttccttgggcctgtgcttccaggcctgagctgcagggactgttggttgctactgcctttcaattgtccccttctctggagacacgccctcagctgacaggggctggcccaccctggaggttacccctcagtggatggtccacgatcagcagactgactgacgtgggagcacagaagtctggcttccacgccttaagggggacaactcactctgtggcatagtttatccttggaggttccctgtggatcagctctaggctagacttcactggagcctctgtccttggttggtgtctttccttccctctcctgcttcccactctctcttaggaatttctcctgggagagctcccctgatatacctcatgtttctgaatccttgcctcaggctctgcttctaaaaaacctgacctaaggcaacattgaagtaccgatggtttccttcctcttagtggagggagttcacaggcttcctgactttttcacccgagactgcagattcagatgaaaaagaccctgagactttaggagcctgggggttggagggggagcttccggggcaaacagtatgtcctaggccactctgtatgctggaacagtactgtgtgcatgccgggctctagtctgcagagcagcctgctttggcccttgcaaggacttgtcaaagcctcaagggcacagctctcaaagcatgtaagtccccagtgcttttgcatccttaggcctgtggccacattgtctattaaagtgattggttttagagaaatggaacctatggtgtaatggaaagagaaatgtgttacaggagccaaggtgtgaatcctggttgtaccaaccttgcagctgggcaactttggatgactgatttaaactctctgtgtctcagtttcttcatatgtaaaatggggataataatagtgcttaccttatagggttattgggaggattaactgagttactctacgcaaagcatttagaaaagtacctggtccagtaagtgctcagtaagtgttagctatcattatgatataatagtaatgatagaatagcaattattatgtaacatgttataaatatatttatttgcaatcacatccttgctcaccaagcttgtgcagccctggcctccttttaatgtccagaccagcatttctcaacctcgacactactgatgccttgggctggataatcctttgttgtcggaggctgtcctgtgcattgtggaatgtttataagcatctctggcctctccacccactaggtgccagtaccatcctaacccttctcccccaagttgtgtcaaccaaaaatgttgccagacatttacaaatattccttgggggatcaaaatgcccccggttgagaccacatgccttgaacaggttgagatcactttttcccctccagactgcatgttttttccttctgcctgggatagctcttctttcctttctacccttcactggttcctcctccctcattctctgcccaaatgcctcctctgctaagaggccctctcctaccaccccatcctactgtggatttctatctccatcctttgcatattcctgtgtggcttttatcacaatgtgttgttatttcattgatttgcttattgaattcagtttgccccacctactagatgtgggatccctggtagcaggacccatgtctgccctgattgctgatctgttgctggtgccaagtatggggctggacgtagagcagaccctcagttaccacatgttctggatgaacaaacaagctggctctcatggtggaccggctgcccacagcctccaagaagcttaccttctggactgtgaaggtgcgtatgacgtattctgccaggggctctgtttcaatcagggtgactttaatgtctccgtagacctccgtgtcatctggccagtatcgcacacatttcacctgtggccaagtgagagacagagacagagacagaacagagacaaggatgcataagcacatggctgagtgtgagcagctgtctcatctggtcgtcccatccaaataaacccaagggtgactttggtggcatttcagtccacagggttcacagctggccagggatcagcaagctgcacagggccaagctcactcccagaggcactggagccattagaaataattgtagtaccttcttttgcaaagctccttgtaactttccaatgcattatcacactatgtcatcaaatagaacaaggtgagataggtgggtgttattgtccccactttacagatgaaaataatactgaagttcagaggtttggtgacttgtccaaggccatgtggccagtttggggactgactgagtcccctttctgctctgtcagggtggagcagctgagtatcatcagctgagcaaagatgagaataaaaggtgggaaataggaggtggaagcagaagtggttgggagggggacatcattaagaggtggcagttgggggtctggaaggagaaaggctcttggttgggaaaaggatggtagctgctggactccaagggaagatgcgcagttcctctctgaccctggacgcgagcaagccattccccagtcgactgtttaagtcgcactcatggatgaaaaagagatcatggttttccccttaaaagaacaaaagcatgattaccattccgggggacgccgcacggcctagagtggcatttcccacagtgtgttccgctgggtgctaataggtgttaggtaaaaaacaagaaacaaaaaacaaacaaaaaaaggttttgtggtcaaatgagtttgggaaatgctgtattacacagttaaataggcagctttgctacaggactattcagcttctttctcatgctagtgctaatgtgttttgtgttttgcgactctccaaaaggggcacagaggacgcagcatttcccaaacgtatttaaccgtggaaccctcttctcactaatcatcctgcagactagcatcccatggaacccacttagggaaacactggtatagtgcaacagagcatgggggcaaatggattcattgtttggtcctaacactcagtatctgggtggcccaagaaagtgctgaaacctctctgagcctcagcttcctatcaataatgatagctaacatttactgactgtgtactctgtctaccacggctcacaaagtgttctgcgaatactttacatgtattaattctaatgacttatcaacacaactttatgaagtagatattatcatccccattttgcagacgaggaagcataggaaagctaagaaaattgcccaaggtcaactgttggtaagggatggggccaggatgcaaacccagggcacttgaataataactaggaacatgggctcctatgatggttgtaggtttcggtaatgcacaataagcacctggcacagtgtttggcactagcaggagcttatctaagagactgctttcctccccaaatccaatttagatttatggtctatccatcaagggaatctgtttccaatgggggatatattgtagaacaggctggaatttgcctctgaatccctgaatcctgggctggcctttatgtccacagtagctgcaccctgggcctgggtccctggggaacagtctgagtggagtgaccacaagcactggaatcagagtccagcgtcagattttgtgcctaggttttggctgagtgacgtcagggtaggtactctacccctttaggtctgtttcctcatctgtaaaattgagtgatggactagataagggtggactcatgggtaaagtctcacctggtcctaaattcccattaggccctgagatgtccatacccctttattggattacgaaagcccagattgtctccttcccatcgtcgcagaggccagaattcatctttatgaattatctgtttcttacccaaacaaaaacttacctgcccacattttagttagttcatatgatgtgtagagagcccttttaattctcgtgtttgtacaccttgcctttaaactcagcagcccacccacatgccagagttaactaagtaggcaaaagcaagctgggaatagcagtcccatttctaagccccaggagtagttgaggaccacttcagagagagttgagatggagcagagcaggagaccaagatctgagccctgaagaacatcaagatttagaggtcaggggaagaagagcgggtagcaaagggttggatgctgctgagattgagtaagatgagaagagagaagtggagactggatttgtcgacatgaagggtgcgagtgatattgacaatatcactattggtgggatggagggaggagctacgctgcggtgggtagaagagaacatgagtgaagaaacagagccaccctgtgagtctttaaagtttggcagaaaagagggaacaagaaaatactttttatttaccttttcctttctttttaagatggaaggtactgggcatgtttgtatgctaaggggaacaatttggcaatgagaaagagacttattttgcaagtgagaaagggaaaaatgaaaaaaattattgagtagaatctgtgatccaggcactatgcttgcctttggaagggcagagacatggcttctgttgtgttaggctgagccataggaaacagttgacattcgaccatttgggtcaacaaaaacagccatttcttatagtcaaatctgacagcagaggagaagaacaagaggacagttgtagatacaagtaggattgtggtgtgacaatgagggagtgaacgactgatggttttaatttcctcaaaatatatgagatgacatcatcaacggagagtgagggtgtaaaaagggatgaaggggatttgaagggaaaggacattgcttgaatgtggaataggagtgatgacacctcccttgtaggttgccgtgagggtgaaatactgactaggaggcacttagcacgatgcatggaacaaagagatgttcgagagtgcatctccagcatcctctgcccaggcgagtgcaggagaggcttaccctgcccacttccaccaggtttgtgaccatgacgatgctggcggagttctcctgccagatcattctccaaaagtcctttacagtctcctgcatcggacctgccaacagagaagacagtgaggttagagaatgcaagtgcaaagcagcagctgagaaggtttgtccccccggttggtcaagtctccacactggtgagcaggagtgaggccaggtgatccttgttaagacaccaagtatctgagacacgggcctgagacatgtgagcctgatggggacagattagggtatggatggggaaaggctcattccaagctctcacaatctgcagcatctactggaaatgttggcagcctctcctctcccttctgtcctcctcctgctcagaccctttctaccaactccacctatcaccttatctggactgtattatggcttaagggagttttcgaaaattggtctccagaacctccatgagagacaggaaggcaactggggtggggggtggagagagctgcagggtgccagacgctgagaacaaaaacaggagatgcctgattttgtgcttgacaaatgctggaggcattcctctagggcctcaacagaaaggaaggaaaaaaaaaaaaaaaaaaaaaaaaaaaagaccaggagcagaaaataggctctgacagtccaaagcaatttccttggaaattactctttcaatgtcctgggccttcatcatttttaaaattacaaaagtaatacatgtgtttgatataaaagtttgaataccatttttctatatttatatgtatatgtgtgtatttactgtaataagcatcagacctattatatgcattttctgatgcccttaaaaattcttaccaagcgtaacagttttaatagctgcgaagttttctataatatggcggtaacacactttatgtaaccaacgtaccaattgttgggcatttaagatttttcgcttttttattcctattatagataacaccgtgaataatgttcttatatgcgtcattgtctatatatataattatctgcaggatttttttccagaagggtttgaaaggtacgatcatttttaagccttctgaaaacgcactgccaagttactttctagggcagccagctgcatatctgttatgggcatgcacctatcgtggagataaggcaccatcagctccggccctggcaggtgttgatggcacctgcttgggcctctccctcctgaccaagtgaagctccttgctctgtcactcatgggcctttttcctatagtgaaacttgccaccattttccttcccaaataaacaaatgaacaatctcaaggacctctggagagtcttcagcctacccctccgtggcttctttgctggtggaaactcattcctctcctccagggctgtttagtgaaaaaggagggttggagtaacagatataggaggagaggacaagccttgcagttaagagagccctttcccctgggacccctgaagcctctctgaggcactaggtggagggagggcacttaccttgagtcgcaatgtagtgccgaggtcgatggtatccctggataacaggagaaaagcactgtgaagagtctgttgtcaaagcttgcaaacagcacaatattaataaacatcctctccaagtcttgattttctcatgggcaaaatgagaacagcatcagttattcccagagaagtggcaaaggttaaatgagatattgcacataaagtgtgtagtaagtcactaaatgctagctatttttatagttacttgtgaggtgcctacataggcttgccttggagccagtggcactgggagcaaagattggatgggcattgcttatccttatgcacccaaaaacaggtagagaaggagtttccaggtttatggggagcatcaaccaccaaaaagtctttcttgagccatgattatatgaagaacactgtacaagaccctatgggacacccagagaagaaaaaggaagaaaacaattcaattgttgacttcttccattagtaacaattagaaaaagaaaattgagaagcatcccacattgcttctctatgccaacattcctgggcttggaattgaagtcccaggtacggagaagaccttatggaaggctgacctgggagacccataaagatacctgcaaatacaaagaccagtttctaatttctctgtacatttcagagcactacagtaggccctgctgtactctggttggggagtaccctgctgccccataaccttcatcattggacaagaggttgaaggtgacccctcttttgcctggacatggcatacatggagtgtcctctttccagttacagtcatattgagtagaagtttaagttttggagacagacctgcatttagtgcagaacactgaatgcaattagtatttgttaaataaatacatgagtgaataaatgaatagatgaataaaatttttaaagaacacagatgccaattttagagcctatcaattgggagattgttgacagtcctgaaatccacttagcttttatggttaaccatgtccagagaaaataagtcctaaagtttgatgaacatctgtctttgtcttagatgttgctgaccagtctttttgccctgttgaggtagatgaactgcctcgaggccactttcttcaggaaatagaactgccatctgtatggtttatggtgccacagatgtggcatctctaaagttctagacccactttctgatacaaagacaagtttctgcgtcccttgtacatttctccacctttgtgtttcacttgctcgataatgattttgcaggcaccttccaattgctgggcctgctctagagttggaggttggcaccaatccaggggcaatgtcatgaccagaactgttggattaaccgcagagcaatcaacagccctactaaaactctgtgcttgaggactcctatgtacttagtgaggttgtcagtttcttaaggacaaacactccctactaagcttaaaattttttttgtcacagagctcagcacaatgtgagactcagagcaaatacccaataaacaagctgttgacaaaccaactaggcaggcaacacagcatggtggttatgcgtaccatggactccggaactcagctgcctgggtttgaacgctggctctgtcccttctagggtgtgtggtctagggcaagctacttagtctcattgtgcctcagttttaaaattcacaataacaaagatatgaaatcaacctatgtgtccatctcaatggatgactgaataaagaaattttttatatatatatatatatatagtattccatatatatatggatatatatgaagagatatatatatatagatgtagtattccatggtgtgtgtatatacatatatatgtgtaccatggaatactactaagccataaaaaataatgaaatcatgacttttgcagcaacatggatacatggatgggcctggaggccattatcttaagcaaaaaactcccagaaacagaaagtcaaataccgcatgttttcacttacagtgggagctaaataatgtgtacatatggatgtaaagtgtggaatcgtagacattggtgactcagaaggttggcagggtaggagggtggtgagagggatgagaaataatttaataggtgcaatgtatactattcaggtgatggttacactaaaagcctatacttcaccactgtgcaatacatacagtaacaaaactgcacttgtgctctctaaatctataaaattaaaaaattaatggggataatggtatttacctcatagtgttgttgaccagattaaatgagttgatatataacagttactatgtgccaggcactattctaagatttaacatatatgtctttgctattgttattttattgtttatttggcaaatatttatttactgagtgcctatcaagactaaaagtgtatgcaggcctctcaggggacactgggatgatgagaccttctttgtgttaatgtaataactgagcccttccctgtgacacaaggggtaggaagacctatcccttcctccaagtcaagtggacagggctgctcaggctaaaagaaagaattaaacccaagggttgtcttgagtagctttgggaatagaaaatagtcccctagatcctggaaagatgcagtttctcaagtctgccctcttctgccattcccatcactcattcccacagccctcatcctccctggctgaggccacagcaccaaccactagctggcttccctgcctgcagtttcactctgtagccttgctgcttcctaaccccatgagcttcctcttgcacactgagtgtgttatttccctgcttataagcctgcagtagctccctattgtctgcatggtaatgccaaatgccttaccttcggactagtcatctgtctccattttcatctccagcctcacctccagttgtccctctttgtccactcctacaaccccatgcaccctgtgcttcagcctcaccaagctgctcttgaaatatgctctcctctgggatacagagctgactcattcctcctgagtggcccagtagggctttgtatatgctcagtgaatgcaattccatgtgctgcagtaaatttttttgtacctttctcctcctgggacatgggacatgccacccagagctgggtgcagttttcagcagtctggttggtgaaatacatgtatgaatgtttttgagctgaagttggagcatcctcttaatgctcaggctggaagaaaaagagaccctggaggaagctgtgatttggaagattctaatgtgcttgaaattcagtgagataacattttgagcaagagattcacattttagttgtggagttagatggcttggattctctattttgtgaattcatttgtttgcacagttattcactgtcaatcaacaggtattaagcacctactactatgtacaaggcactggaaatacaaaagtggacccgatgaatgtggactttgcttttgagcaacttatagacatcaacagactggggtaaaggctactaatgggaagatgtggggactctgtggagtacccatgggaattgaacagccaaggagggtcccctcagaggaggtggtggttgattggctccttaaacctagtttgggcatcttgacacctcttgtcatttctatttcatcctttcagtgatgttcccagtttctctgccattctttcatcatccactggctcttgctcttcttcagagatagggatcacatgtccatccagaggccttagcactggccattccccgtgcctgctatgtctgcccccaggtacctgagtggcttgctctctcgctccatccaagcttctgctcagttgtcaatcacgtctgtggagagttcatctctgaccaccccatcagcttctttccactttctctggcttacttttcgttagataacctatcaccaaatagcacactattctttcttcatttacatgctcccccagttgaatgggagctccatgaagccagggctggcttgctcatggccatgtccccagcacctacaagtcagcctgggccattggccttgaaaaattcatattgactgaatgtacgcatgctgtgtgcctgttcccacgctgcatctgagtaaagagaccctccttggcttccaaaaacccacgcagtccccaaagagaaaacattctaaccacgagactcctcagcaaaggagataaaaggaaacgtactgctcaattggggctcctctggggattcgccaagagcgagtacagaaaacttcctaaccttaaaagaactttgagttcatttaagtcccacctacacagcacgcagattgactgcaaaccagcactgggcctgcctccatctgtctgtgagcaatgggaaagaggtttgcatccaaaacgcatttatctcactctgcactcatgcatctgttacttactggggacccagatacgatatttatttccaggctggtaattcataacagatttaagtggccaatacattttcgggtgtgcaaacaaacctgccagcgggatggttcagacagtaacagaccacggcctccggaggcagagacagggctggccccattcagctcattgtcccaatggagttattttaatgaatcgtcaagatccaattgtagagaaatgattctagcatgggcagttagctctttagagagccaggaaggattgtggctgcgttggagaccagggtgatggagtgaggacctagttagctgtctggagtactgttttgccaggaatccctatagagaccccaggaattttatctttgctggagtatgtagttggttcacaattaatggagttcctctactcttcaccctatagtggtaactgtgcaaggagttgcttgtggttggctttcttccctttgtccctccatttcccctttttccttccatggtctgctctgtatggatcgcgccatgggctcctattctttctgcttcaaattgggtttagtcaatggggaacaaaagcaggaactcagaggccaggaggaggttggggcatatgttcttctaggttcctccctgccaggtctccatgccttgcttgaccttgtcactcaatcaagggcttcagttcttgaagggcagccctctctcatagctactctcttcccttatctgggtctagggctggtaaggactccctactattgttagcctagtgatactgcaccctaccctactggtttctcttaatcctgttcacatccttattaaactttccctgggtacccactttggggaagcctatgtttccttttgggatcatgacagatactttacatcagtaattgcacacttgtggggtggcatcattatctcattttatagatatcagaatgattaagtaatttacccaagatcataaagctagtaatcaaaaaggcctggattcaacacaggtcttcaacacagaccagattcatgactttattggccctggattctaaccactgagattgagcctggagttcaatatcccataataagacagcatgaacagaggccatttgccctgtctgcctaacctattacagacagaagaagaaggtcgtggtgtgtcctaagtgggcagagaactgaagttcagttgtgtgaccttggacagtgctcttaacctacagctctggtttcctgtctttaaaggcttgaaacatgccttgcaatgataaaacaggaaatgaatcagaggcataattagcagttgtagagattaacttgcatttaaagcaatttcgtttgttgcctataaaataccaaagtgtatcttggccctgactgtagtcagatgctcattcaactttggagtgagtgcctatctaggaaaatgacttttgttgggggattctagtcaaatgatgaatgccagatacagaaactcaggcatgccagaccctgtgtggcctgtggtccttagggtcatatccatgcagccatagacaaggtcgaggagaaatggaaggaatcaattcaacctgcatcaatatatgctgactcggtccttgctgtgtgttggctacaaggcggtgtctgggagtggggggggggaggggaaggagaaagagtgctaaactgggagccattcaggtctggttcccatcctggttctgccactgaccagctgcatggcctgagacgtatttgtgatttctctaaaccttagccctccccatctggagaatgggaatgagaacacctaccttgaagggttgttaagaagttttgataagctgacttacttgagccacccatcataggaccccaagagtgactcattaagagccagttggtgttgtcattgctcactgtgattattaaagacagcagggtatggtgggagaggtactcttgactcaaatttctgctccctcctcccctacctcctagcagtataatcctggacaagttatataatcttaagagactcacttactcatctggaaatgggtagtagtggtacttaccttgtgaagttgtgatactagttaaggtgatgttggtacatgaaaggtgatcagtaattcttaggttactataaacccttcttgcctggctggctctaagtcatctttcaaggcagaactgagacatcacctcctccagggagccttcactggctacttccctttcccaccaacttgaagctttgattttcctttatggtcccacagcccctgctctgtgaaggtctattttcttatctgactccctcaccagatttgagtcccttttaggtcagagacctggtcttaaaagtcagtatttcccatacacagtggagggtctgctctgtgtttgtgaactgaatactggatgtatgaaggaaaggctgctggcatgatggatgtatgctcagagtgccttgctctgggctggagaaaagctattcagaactggctgtctcctgtgaacttttctggaagggctatggtggcagagacggtgttcatcttcaactccactgaagttgcagcctcagttcttggccatgtagtaggccctttgttaattagggtgtagttagggaaacagaaaccagtctatgtgtttcagacgaggcaattcagtatggggagttggttacacaagtgatggaggagccaagatgccaaacagagaatagtggggcaacccagagatcagggacaggactaggctgcaaccaacccttagaactagtgggagaacaggagagggagaaataactagagtccagagtccagaaataaccagagccccagtgggctgactggcaggagactggactatggcaggcctgcttgaggaaagatggagccacagacagggtacagccactgctggagttgctgcccaaggaagggagtgagatggagaatacactgcccttccatcatcctccagtgtctgtctgtctgtctgtctgtctctctctctttctctctctctctcacacacacacacaccctgcaatgcaaggcagaacagggaaggacacaaaatagatctgagggcaagcagtcagatgatcaatacaaggctcaataagtatttgttgagttaataactcacctggcttagtctagattaagggggaattcacaaactgcaccaccacactttatagcctatctataaatacatttgagagtctaggggaccagtatgaatctctgtgccattcttcaagacccatggactgtgagctgaggtcctgagatgcatggcttgaatcagtcacattgggttgtccttctgacctcagcagtcatgctcttgcttagcaaattctctcacttccatgcatacccttcttggctcctgtttgagtttagtcccttcctcagtcgtctctggaatattgaagcagcctctttccttattggttgtagttgtcttaattccagaatttcttccctcggatctgtcttatctttggtagcagataaatcatgccaaagctcagttctaagctggtcacctccttgataaaaaatttttaatagcttcctcttgtctatgggataaagtcccacttcctaagtctgagcatttaatcttcactgatgtagtcccaacaatattttccattattcctgttacatattctctgctcccctcaaatggagctgctatgtatctcctggccagttgctccatcttggcttgtgctattctctctaactagaggcccctctcccctctctttgattttaaatcatatctgtgcttgaagctttggttcacatcatattttgcattcctgatgggagaagtgatatttttccctacttctgaatctctgcagcatgttatctgtacttttgacacttaacaatttctactttgccctggaattattgatgtgcacattatctccctgctaaggttttaaagggtagagaccatggtattattagcattatggttcccatagcatctagtatacattttacagtaggcactttaaaatttttgtggcataaatggccatgcgtttatgtgaatgaatgaatggatcaacagacatatacacaaatgaataaatggggtgaatgagtaagactaacagttgtcctgaggccccatagagcaggctactacagctagcctgaaagtggatgcagtggtagatggacagtcaacttgggttacactagttccacatatcaaggaggatccagactgctctggaagggccaccttctggaggagagtttggggtaaaccacagatcttgagcctgcaaaagccagccccagcccccagccccattaagacactcacgtcaatgtagttggcattgatgtagtcagagtgcgggtctccatccagcaccagcagcctcacccgggaatggtcgtctgcagagagagcagaaatcaaggggatggttgataagaggccttacgcagctaatgtcctcctttagaactactgtttattaatgactgcatatcaggcattgtgctactctcatttaactctcaacaccaccctcagttactgctcccatttatagatgaggaagtggaggctcagggaggtaagcacttctcatttttctaccttcccttctgatttcgtcattacctaactggattagtcacctgtttctttaagtcttagtgacttaatcattaaaatggggatggaaatacttgcttcataggacaatgtgagagagaccatataaaaatgcttaggacaggagagtgttgcatctggattaatatactccattttcatgttgtttaaaaacagcaagtttacctatcttccacacatgcacaaattgcttttcatttgccccttggagtattgttagagatagattgtcagccatatattgttatcaatactatcattaaagtgaggctgactaaatcattataaaagaggtcatcaataactaaaaattgtgttatagaggatgccttttcaaacactatctagacataaacaagatttgcaggctttatttggtagcatgcttacttcaactaacaccaaataaaaaccattaaaagaaaaccagtacagcagaagaatcaggataatcctttacagttaattaagtgagctctgacacgctaatagacacacacaagtggaacattggttcggtctggttgggaggagggaccttggtttgctatccaggtcactgtgcacgtatcattgtgcagtcactgcatcctagttcaccttcctctagggcaggaatgggtccctaagatgtgggctggagagctctggacatccccaagggttttctgggagtcacggaggtcagatcagcttatcttcttagaattatacagcattctgcagtttacaaggcacatttattgcaattaaccaaaacccccttgagaactgggacattatgccttattccctgttccatcccctgcacctttaaaaggtcctgacatacagcaggtactcagtagtacatggaaaaggtataattggatgccctcattgggttctcacagtgaccctgtggaagagaagtaggatgggttcttttagcccttgttacaaatgaggaaactgaggctccagaaagcctgactggccacatggccagtgaatggtagagcacagaggagtgaagttctcttaactctgagttcggtcgctcctgtttccaaagggggtgtaagcacaatgttagaaaccacttcagatatacccagcagagggaattaactactgagaagtggttgcctgggttacaaagagttgagcagccagatagaagaaagtggagaaactcagagataagcagcaacaaggagacactgcctgcccttgggctgaagggatggagggaggtggtggagttggcagtgctcaggagctggggccacctgctggaacctgaagccacagtgggattctagtaggagctggaggcaaggaggtgcttcccttgctgctaaggaaggcaattgtagttgtaataccctggcttctccctttctccttctctccaatctcccagtgcatgtcattggctaaacctaaatagctgacaggagagcctgaaaaacacaacctgcaggggtaagttacctgcaatgcacactagagtgggagaaggtaaggaatgggtcctattatggacaaacaggcctagggctggtataagatacaccccatatctatccattcatttaagaatcattcactgagtatctgccatgtggcaggcaggcactgtgctagacagcaagttatactaaatgcgacttttcttactcatcagggggaagtttcagcagaagcaactagagggagcaggtgggtggtctaagcaatccctttgggtgagtgggagagtggaatgtgacatgggggaggagtttgaagttaacctttattggattcatggtaggtaagagaaactttacatgcattatctccttcaaccatttatgcctcaaaatagccatataggttattataaggataccagaatgatatggtattatgagtcttcccattttacagatgaagacactgaggctcagaaagattaagcaagcttccgaagttacgcatcatgtgtgtggcagagataggacttctcggttaggtttatctgaccctgaaaccctactctgcccacataacttgctgtcccagagtctcaggcatctcacaggcactacagctggagtgtgtgcaaacagctcttccccagttcctgcaggattctagccccagagaggacttcctgggggacagcccatccagcaggctggaattcagacaaagcctggcacctgactctcagcccagggcatcaagcctctgttaccagcagttccagaagctgtaggcctcaaaaaagtgaaaatgcacattgtgttttcactcagtggtctcattatgacttactgattcagaaatctcctttatttgttgagttatgcctgcccctggggcccatagcactggaaacagagattgtggtttaaaatgttgaaagggaatttttaaaatataaaatgaagttgaaaaaccggaaagcaaaaatgattaaaaacaaaacaaaaagaaacgaacttatttattctagttaagtgtacttatggatgaaagtgatctctagccaccagatgatggtgtttgacaacgtctctccttcatttattaagaatgtgtttactgcacacctactatgtgccaggctagttgaagggattaagaaagtgctatcaaatgtgatactcatgtttaaggagtttgtcaatttagtggagacagactgtatgcagaagcaaaacttccaaatctagaagatggggaatagagggctttgtgtagtgacatgtgaatgaggaattaaaaatgagtaaggtttggccagtgcacaatgaggaagtctttccatcagagggaatggctagagtgaaggcagatatcctgaaaaaagcaagcaccgtgggggagctgcaagggtctcctgtcctgggaaaacagagtgtgaggggaacagcgatgggaggggagacagaggaggcagcagcgggggtttcatttcagaaggctctccatgccctgtgaagccatgaagactcaaggaatcatgctgggctctgcagggcagcctaatacagtgtttcttttctgggacagtggaaaggtgctttattatgatgtaaccaaaattcatgcctacacagctaacttatgtcaagtgagataaacttttaatataagacgtgagatatggagctgtgatcagatttggcttcaaatcttagctccatcacctagcaagtcaattgatctctcttagctttggtttccttagcaaaatggagccaatactatatggcatgagaggattaaatgagaaaacataggtgtgaaaagtgctaggacattaagaaatgagaggataagccacagactgggaggaaatatttgccaaacacgtatctcagaaaggacttgtatcaaaaatacacaacaaactcttaaaactcagtaagaaagcaaatgacctgattaaaaaatgggagaaagatctgaacagacacctaatcaaggaagatatacagatggcaaataagcacatgaaaagatgtttaacatcatgtgttattaagaaattgcaaattaaaacaagataccactacatacatattaggatggccaaaatccaaaacactgacaccaccacaggctggggaggatgtggcacagcaagacctgtcattcattgctggtgggaatgcaaaatggtacagccactttggaagacagtttgacagtttcttacaagactaaacatacacttaccatactatatctagcaattgtacttcttggtatttacccaaatgaggtgaaaacttatgtccataggaaaacctgcacatggatgtttatagcagctttacttaaaactgcaaaaacttggaggcaaccaatatgtccttcaataggtgaatggataaacaaattgtggtgcagacggtccctcacttgggatgattagacttaggtttttttgactttatgatagttccaaagcaacatgcattcagtagaaaccttaatttgagtacacatataaacgttctgtttttaatttttggtacagtgttcaatcaattccctgacatattctacactttattataaaatgtactttgtattagatgattttgcccaactaatcatctaatataagtgttctgagcatgtttaacgtaggctaggctaagctatgatgtttgtcaggttaggtatattaaatgcatttttgacttatgatattttaaacttatgggtttatggggatataacctcactgtaagtgaaggagcattcattcgatatccatacaatggcctatggttcagtgagaagcagaaatgagttatcaagctgcaacagacatggaggaaacttaaatgcatatttctaagtgaaagaagccaatctgaaaaggctacatactgtacaattctgactatatgacattctggaaaaagataaaactctagacacaggagaaagatcagtagtttccaggggcttgggaggagggaaggatgaataggtgaagcatagaggatgtttaaggccgtgaaactattctatacaatagtgcaatagtagatatatgtcattgtacatttgtcaaatcctatagaactgtacaacataaaaagcaaacctgaataaactatggactttagctaataataataaatcaatattagctaattgtaatgaatgtaccacactaatgcaagatgttaataataggggaaacagtatgtgggtgggagggagtacatgggaatgaggtactttctgctcaacttttctgtaaacctaaaactgctctaaagaaaaatgctaggacaatgcctggtacacagcaggtgcttaataaatgatggttttggggctgaatgtgaggcaggcagtgagctaatagcagagatacttagaaacttggtgctctccacttgacctctgtaccaaatacagatccatctatctgcagaggcaaagaactattgtgtgtgttcactaaagggtggaattcagctgtaggtccaccacaaaggcactgcaaggagtggcagtgtcctcatggtttatttattccttttgggagatgctaatattattctgtgtccccttcttcttctaactttatataattagaaggataaaaaattgtgtttacccacatgcacatggagaaagatggggcggcaggcgatgtgaaggcgtttatacgaggtaatttacaagcagcctagaatgttcattatgctctatctacattttgcaagcttgaaaaacagctaatttggtactccttgtttgatattcaagacaaggagaggagttaagaagagtcatgtggaggagaagcaaactcctcaatgaggcgaggggaaggtgcagcctggctcccccggctctcagttgaggtgagagatgggcaagagctggctgtggcgaggagggaactggtggcagaaggtagaagggagacatggtaccaagacacataaattcaaagagctccctttaacacaagtctaggggaacatcatcactcagtttgcaatcaatctgctgttccttgcttgaggtcaaagaccactagtatgctggtaaatgtttaacatacagctccctgtgggaaaaaaggccctgatcagtaatgtctgctgatttctgtggtgtaaatactcccaccatgaccgatttcaagctaccaacatagcatcaaccacctcacaaaattcctgaaaatttaacaatctgcttttgcaagctggtatgagtcagctacagaacaccactgacagaggacaaagcctagcacaccctgcaatgtcttgcatgatctgatggtttgggacctacttctctctccagcttcacatactgctctgataactgtggtcttctttcagttgctcaaatgcactgtgttcactctgaccacagggcctttgcatgttcaaagaacacctccatccaagctggcagttgcgcctggatcctgggctccaattcttcctctcctcatagctgacccctcaccacacctgtagacccagcctatcccttccaaagactggcagccaattcttgcctttagcagaagggaggttatggattgggtggagtctgaaggcagacctgaggcttgtcacaccctaaccatatcacctggggtaggttaccacctcccctgagcctctgtttacccagctataacatccaaatcatatatagctgtgcagacttgctgcaaggattaaaagatgtaaaatatgaacccacctggtatgttgtaagaaattaacacaactatataaattcagttttgtttttattctagacctgggccaatggcatcagcagcacctgggaacttgtttgaaatggaaattcttgggccccagcccagactcactgaatcagaaactgtggggtggggcccatcaatatgcatttcaatatgccctccaggtgattctgatacacgttcaggtttgagtatacagaccaatgtttagtgacttagtgcagaggtgctctggttattcacttcaatctgtcttgggaaagaccagaagatcttactggaaatgggccataagactagagactcaccttgtgccaggtggtgggatacggaaatttagctgtgtgaaaagtgtaagatgttccaggcacttatcaaatgccatggggatgccatgccatttgattctcacagtaaccctgtgaggtctataccatcatcccatttcatgaatgagaaattcaaggctccaaaaagtttaataactcaggagaaggtatagggatgagggcttctttatagagttgtagggtcctcactcctcctggaacgctgagatccatgacctccatacccttctatgccacacttctccagcttccactttcctctaagttctcagtctccaacattggtcctcatcccactaaggtctcatggccacccgagagagagggttcactttcctctttcatacagttctaactctcagaacaaaccacaactccttctccctccctccatcaccaaagatagcccagtaaacctgtcatctcaacccacatccacttaaagagagaatcacttcaaagaggtggggctggggagagaatattatttggatacttgatattctttcttcctgtcttctgggcactacagagggtaaagaacagtgctttttttttttttttttttttttttcagagaaaagagatttgactcattacaatgaattgtggagctgaaaaaccatttcctacaagtattggaaatgttaatgccatcatcttgcaaaagtggataaggaggaggcaggtaattctgctgagactgcctgggtacctcactgaagctaaaggtctgcacattcaatcttgattgaattaccattatcaagagaggctggcttgggcatgatgcagagacagcccgacattctgtgtacctccttgtcctgccagatccatgctggctgaaattggaaaacgcccctttgtggggtcctgggaggagctgctccagtagatgcaacctttgaggggactgaaggggactggagttgagaggggcaagcaccaagagaggaccacctgtgtcctaaggatgccatccaggcactgccccactgaggggcctttctgaaggaagggagggaggtttcttatttggatttcttcaaaagaagaacatgagatatgtatttggatgcaagtagttgttgtcggggggtgatcccaggaaacaccagcaggggagtgggaagtgagacagagaaagaagaaatctaataggggtgtgtcattcagcaagttgccattgtagcaagttgaggcttaattcggctgaggagctctgggagtcattctacctaagcagagagggagctggggtatgtatatacccacttccatcagtcattaattgagggcaggttctggggacatttaatattctggctctttgggcctgccctgcaagaaggcagagaaggctctagtggccagaaaaagtccttaggaaaagaagcaaaggtgctggcaatttgaattagcactagcacacatgcaagtagtgagtgtttggggatatggcagggtaccaatggtttctgcaccacaaggcatctgtaggacccaggcaatggccaccctcagagacagtgaagaagaatggaggctgagagtcaggagcattgaataaggcacccactctgtcacccccagctctgtctccccaggaatcagcagagaaacctgctgtgaaaaaagtcctctgggttttgttttgaacctgagttcctcactaggagtgagggtcctctctgcactccatagccccacctccttctggaaaagatgggcctctctgaagagctcatctgctctgaggttgggccttagcaacacattctcccccaggaacatggatgtgacttgatgcagagaggactctttggtaaggaatatgtgccaccctaccctggcaggcaagagaccacagctctggtcatggctgttctacagacttgctgtgtgctctcgggcagggcacagtccatctctgggctctctcttcttgcctgtgaactcaaaaaggctacactaactcatctagacttaaaagtctgtgacttaaggggccacacaagattcagatttaataatcattcagcttaatttggcctctccatcctgagagctgccctagagccatctgatgggtgagaacctgaaggtgggtgaggtgaagtgattgtgctgaaggtaaacaacagaactgggatgaaaacctgggactgcctgacctcatgtctaagaccccaatacacctgagcccagtggcttttcctagattgggagaagataagtctcagaaaatgtgctgatatcctgtgtgcccgcagaccccctctccacttcatctggccctctaatccaggaggctgattgctatggccaagattggacattctcaaagttgcacatgcgtcaccatcacctagagggcttctagaaatacagattgctagactctgtcctcagaatttctgattcagtaagtctggggtggagcccaagaattagcacctctaatgagttcccaggtaacactaatgccactgctgtaggcattatactttgagaaccactggattaggtcaacagatctcctgttctctggattctggttggccccagccaatggaaagcacaggcagaagattgggtggagggaggagagtgtgatggaggtacttactcctccagcaccccttggtggggtcaccatgggtggctgccttgccaccaaaggtcgcacccacctctggtcaggtcatctctctttgggtcctggtaacccctcctacggaatccttcctggtctgaggatggaattttggtactgcactatcccttgtagtctttctacatctagattacacctttataaagaactgatcccagaagggggcctcattttgtaacatttgcaacccctgtgatcacttcagcttctcagtgtcagcaccttcctgccagtctaggaagcacctctaaaactttacatggagaatgctttgggattcttgaatttccccttgccaacagtcgctgccctagagttacttggaagcaaaggtctctttgttcttattttacccattcatttccttccctttcacttcctttccatttacactccctagaaaccccactgtctctattactaaattctaaatagaatcacttggaagaaaggagatatttcgccaaggtctcttgttgtttcttttgtaggcagtgccctccctcctacttgtcccctttaatcttttctgttctccctggcctgggcctttgtcctccactccagcctcacagtgctctgggttccttaagatgctaatcacagccagttttcttcttgcgccaagaatatttctatttatcaagcctcggcaggctttgcctttgggagggacgcatacaagggcaggaacactttccattccttggggctgtttcttttttacatatcccatttcaattccaggttgttttttttccatttccctttttttcttgattctcctttatgtcttgcgctgctttctgaattcactggttacctcggcactgtcttctttcagcactgaatgcagacctgctcttgccctgatctcttgcagaatgattgactcttaaattagaaaggagattctggtttatttaaacccatcaaggtggtatcgtcaaggtgcttcagttctctctgtctccatttgggttcctcagaagtagatctaagacagagattttagtccaagcagtttatgtaggaggagacaggaataccagtaggaaaggggtgatgtacgacagggaagagaaggcagcttattaagggtgagttttcaagcccattaggactgcaggtagctgtattctcatccctgtgggaactccagaaggaacttcaggagaacggtgaagaagctggggtatttcatggtggagggcttctcctgggggtattaacccttcaggatttgcaggctgcctgtgcctgggcaggggatcctttcccagctttggagaaagtcctcagtctaagagatgcaggcagggcagggctagggtgaagcaagctcagagtctcaggcataggctttatcagataagtgactatatattttagggtacagtgtccacagtgcaggagcagagaatgctggggaccagacagggcaagcagctccctgtggcagagtgggggctccccaggagcaggagctccacctcccagtgcccatcacagggcctgctttgaggaggcccacatgtcataagtcttaatacatgtttgctgactgtttgaatatcacttctcaacacttcacttgcaagaaatcttgctgtctgaattaccatcttccaagagagaaattataaatgttttctgattagttctaccattcatagcccattcctaaatcagcacaggaaacagctaagctaaaacttctgcctttttcttcctttacaatctgcctgtatcttactctttcttcctccaagttttttcttaggcaatgtctagacagttaaaacaaaacaaaacaaaacaaaactctgaattgtgctagaaataatttgtcattcaggatcctttttttttttcttttggatgaactgggttactctgtgagctgagacccagggatgttccccacaccattggtgagatgtcaaaaggtccaggttggttacactgagtcagacaaaggctgttgtagactcctgttctaattagaatacatgcttagcattttgcacgagataactttgtcttctctgtatttattttactttgaaggctgtacctacgaatatttggcagtgacaatacttgtgtgttacctatgcatgacattcagttctgtggcagtctctctcttcctcaccccccagaactgaataccatgcacctgtcacacacaagttattgtcactgtttgttcaggccccatcatcccttggtgagactactgcagtagtctgctgactgatccctctgctaccagcccttcccaatcaagtataccttccatatctgctgccctagtgatctttccaaaatggacatctgatcatgcccacctctccccaaccaacctgccttattctatgtccccacaggacatgtcctgagtacccagtgaatcctggttaataaaataaggtggaatgatagatccatgctgctcaccagtgacctcaagcaagtacccctgtggctaagagtaatggtgccaggcactgtagcaagagttttatgtacctttaaatgctcctcctattatcctcatcattgtaaaggggaggaatcaaaagtttacagaggtcaagtaactttcccagggccctacagttgggatagaaacctgggcagtttgactcccgagggcgctaactactctgcaccgctgacttcatcaatgagtcattcactgggggtgcctacaggaaaggtaaagctcattgttgagcaaaggcaatgtccttccttagctctgcgtaacatgccttcccctgcaggctcagtacctcccgaggtgcactgatgcagacctgagggcaggccctcacctcagagcccctgccctactatagtggggacaggtagaatctgtgttgccctaaactctgtctctcatactataggagtagccccgggctcctgtgaggcctgagctgggcataccccaagccccaggtgtatgccagagttactggcttcttctgagcatcagcctttacttccaagcatcagccagtgtgactccaccttcttggaggagcatcattctcttgcccgggttctcctagcccctccctcacaggctggggcccatgctcctcaccccaggttgctgccaaagtcctcctttgaattagaggagcttctgggaacacagagctcatctctttatccagctgtggggtcttccgcatgtcagcccttttggctgggcttcttccccgacctgaggaattgagcaggcaatgctcggtgagacccagccttcagaggttcttccccaagaggcttcatggttctgctctgccctgacccatctccctgcctgctccctctggctgagatcagccatgctctgtcatccagtctagggatggcagtaaggctgatataaagcttccatcttggcatgtagatacaaagctagagacagcaaagattatttgataacaaattccaggtaaataatagtaatagcctcttttcccctgcatcctcaacacctgaagcttaggagctcccagaagggcacctacaggatatgatgttcccatatcgattcttattgcggttttcatcctccttggctgtgtcccacgaagctgtctgcccctctggtaaggcctaaaaagcaaggacagagtggttagagtggcctgagataggagctttatggaagtggagatgaaccaacagggcaaagtaagacccactgcgatgggactcctagtggaaagggatagatgtccttggatggggcctggggaggacatagattttgtctgtccctggacctattctcttgttcattgtttcaaatgttattgatgtcttctgtgtcatgagttcacaatctagcccagtgggggaatcgcttgtccattcattgaattattcattcatacactcaacagatacttactgagcccctaacatgggctgggcactgttttaggtactagggatatagagaaacagacaagttccccttgagcttccagtcaactaggaaatatagtaaatgtgtaataaaagagtaaatgtgtaattttagatatgaaaaatgctatgatgaaaataaagcagaataaagggatagtgatgaggaatgagaattatttcagattatacactctgggagggcttctccaagaaggtaacattttagttacagtagtcctcccttatccttggaggatttgttcaaagaccccccagtgggggggctcctgaaaccatggatattaccgaaccctatacatactatgttttttcttatacatacatacctatgataaagttcaatttataaattaggcatagcaagagattaagaacaataataaaatagtatgacaacaatatactacaagttatataaatgcagtctttctctctctctctaaatatcttaatattttttgactgagattgaccttgggtaactgaaaccatgaaaaacaaaactgcagataagggggacttcattaatgatagatactataattccttcatgatactgtaattccttaatatgaaacagccagtcacaccaagaaaagtagaaagtgcttttcaggcagagggaacagcagatgcaaagatggtcaggcagcaaccaaatgaccatattcaaggactggagtgttgtgaagagggaagtagtgatggaagtatctagagcggatgggggagtccagattatataagacattgctattactggttaatgaactgggcattattctaagtgtgatgaaaaaccatcagagggttttgggcaggggaatcatctgattcatgtattacaaagtacaatctggctcatgtatggaacacaggctctgggaggggcatggaggaagcagggagatctgctagaaagttgtggcagtggccaggcgcgatggctcaagcctgtaatcccagcactttgggaggcctaggtgagtggatcacgaggtcaggagatcaagaccatcctggcttaacacggtgaaacccagcctctactaaaagtacagaaaaattagccgggcatggtggcaggtgcctgtagtcctagctacttgggaggctgaggcaggagaatggcgtgaacccgggaagcggagctggcaatgagctgagagcacgctactgcactccagcctgggcgacagagcgagactctgtttcaaaaaaaaaaaaaaaaaagttgtggcagtactccaggcaacacatgatggtaccttggactcttagaccgtggtggtggacatatgagaagtgattatttgcaggatgttcagttgaatgttgttgacttgggttgcctcggaagcagactcagagataacaagtcaggcacaagtagtttgtttgggaggcactcccagggagtttgggtgggagaatgtggaagtggcacaatcaagggaatgaagtcaatatagagcacatcaatgagcaggttaccactgtgggcaactggggcctaatccaatgggcacatctcatgccttagagttatcccaccatggggttggcacaaagttggggtagttactgatcaattcgcatccagtattggttgaggacaactcttggaaactccccagcatttcttccatgctctgtgggcagagtgtgcatattcttctgtcttgaagaagccctcaggcaaaaagtcacaggtgcttacaggaggaagccataaggtgggcatgcgtgggaacagtgagtgtagagtggatgtgtgcagggcaccatctgccatagatcctgactgtgaaggaaggagaggaaagaaggctgacccttagatcattagtttgaagaactgaggggggagagatgtgatttattgagatggagaagcctgggttagaaacaggattggggaggtaagaattaagtgttgtgttttgggtacataaagtgcttagtagagtgcctagcattgaatactgcacacttttttaaaaacatgttcaaaataacaaaaatggcagccacgttggagatgtccattagacatccaagctgatgttgaataggaagttggacatggacacccagagcttagggatagggaagagatagaagtcatcaatcagtttaagaggatggcaaccaccgataagacagacaagtcaacaaacatgagacaatttacaagagttatgagtcaagtggtatggaaacacagggaagggtgcagtcagttatttcacagacagggaggacgggcagttaagggagtgggaacagctatagaaaagctgcagaagcatgattatcagaccatgttttgattactctctctaccctaaatttagtagaataggctgaacatcctgctcatgccctttcattgcttctgagactgaatttgtaacaccttcagtctacacagctctctgtcagcagtgcaggaggagaacccaccattcattttaatacaccagccttgcctttgcccatctattccttactaggtctatcctaagcaaggaggaacctgaaccaggttgatcagaaattcagcccctcaataagccctgttttattggcaggttcttaacaggccagtgctcatgcatggttctacctttcttgcatctggtctctcaagtgttaagtcaacctgggtgagtcttttcctagagttggagttggaatgctttttctgtaatgggcaaactagaaagaagtttgggctttgttagttgtgtagtctctgttgcaacaactcatactcaactctactgttgtagagtggaaacagtcacatataaaaatcaaacaaatggtcatggctatgttcaaatacatctctatttacaaaaataggtgttggggccagacgcagtggctcacgcctgtaatcccagcactttgggatgctgacgtgagtggatcaagaggtcaggagttcaagaccagcctggtcaatatggtgaaaccccatctgtactaaagatacaaaaattagctgggcgtggtgacacatgcctgtactctcagctactcaggaagctgaggcagaagaattgcttgaacccaggaggtggaggttgcagtgagccgagatcacgccactgcactcctgcctgggtgacagtgagactttgtctcatagatagatagatagatagatagatagatagatagatagatagatagatggatgttgggctggatttagcctatggctatagcttgctgacctttattctagaagcatgactatgatcctcatctatgcagtggctgagtaggtggaattagtgctcattctgctacctagcaactgaagattcattagagggcacaggaaggagttcctttcctgggcttctcaggctgagccatgttctacaacttagcctttcttaggttttagattcgggtaataaagtgccttcctagctattaatgggtcataattttgttctttctgtgtccaacgcccttagacaaacatcctggaagagaagcaatacaggtgctaggttttgggcaccaatctctgacctaaatctgggtatggcaaaaatgttataaggataggtaagtgctcatttcacaaatgtggggcttatctctcacttttctcctcttgttctttctccttcttctccttttcgtatttctcttcttgctcctcattctaccaaaccttgcatccatattgccaccagtttaggccatctctaggtggaagatgcttctagctactgcaggtaactcttagaactcagattccagccctagcctcctcttctatcccagccaggtaactccatctcctccaggcaacttgccaggtctgttctctgtatgtgaagggaggttgctgctctcagtggtagcactggacttctggatgtcaaagctgatctattgagggtggattttgtacctgaaaccctctgtgataaaagccaattgttcaaccaaacatgtccccctgaaagtggggtgaagccaaaagcaggatagcatgactgttttcatactaattttttgaaaaaataattgcgttgagtacttgccatgtgccagggtttgggttaccattagcttaaggtctctttatgactgcacattagaatcacctgggcaggttttacaactcccaaagccaaggtccttctcaagaccaatgaagtcagactctctggggtgggacataggcattggtagtgtttaaaactccccagctgatgctactatgcagccataatttttgcaaatagtgactttaaaatattttcccatgagtctcctcattggttccttttgttttgggtttgtcccctccaatccattctccactgtaatcagaaagatctttctaaaatgtgaataggacccagtgattcctcttgccattgccttcaggataaatttcaaactctttagtgcaacatccttaatgacttcaccccaaatgcccctgcagcatcacttcttgctcttatatctatcctaccagttataaggtgtttaaaatttataagacttttcgcatgctgttccctttacctgaaattcccttccacctgagtccgtctgacaaactcctacatgtccttcaaaactcagcgtaagcatcttctttgtggaatcttctctgttcactctccctcaccccactgcatccccaggtaaagccagttacttctattattagatagacttctttgcatctaataatttaactctatttctcaacttggtcataggcttcttcaaggaaagggtagcatctttgtcacgactgtatctccagaacccgatgctggctctatacttcagatgtgcttgaaagacctatttaggatgaatgaatgagtggaataattagtgaatgaggtggcttctgtgctttcagagggcaaatatcctgggatcttagaggtgtcagtgaccttgaaaattgcctagttgtgttcccatccacaatggccttccaagcagctgataagtggatccatagcatctatcacttggataacctccatgacagatagctcaccacttctccaacttttggcctcacttttggacagactcaccagagttttttctttactcaacctcactgcactttgcctatgccatctcatggggccccacagaataaatgtgtgccctttctctgtcctgtgacatcctgcagagatttcatgaaagtctcttgtattcactcccagaatccttgaatggcagtttggggtcctctcaccatcaacaaacaccatgccttccaggagacaccccagcatgcacctatccctcaacaatcctaaaccgaacaaaacagttgtgataagtgggtggcagttcgtgggaaaccacacaggccctgtcatggtcctgggagcctctgtctcccttagtgggggctgaaggggaccgagtaggcctgggggctgtgatgatgttgataaaagcagaggagggatgcctaatagagcctctgggagggagtggtaatgaccccgtaattggcagactttgatcacacatccatttccctttttagggagctacaatctaataagggataatctcttgaagcaaaaaaaatatgagggggaaaagtatgaaagagagactcatttccatcttcaaagtgagcaagctaagggcattatttttccattagtggctagttacagtagattgaccagggaatggtggcagtcattaggcgctaatcacattcttttgaaaccaaaattgccatctcattatattcatccattatcaatctccgctttccttttctcattctcttctcctgagagtgctgggccctatttttacattcctctctgagtgtggaaatgtttcctactcttcaacagtgttgtttttccaaggcagtcattttttttttttttttttttttagttcaaaagatgtatttggggatgtccttatccctggagagctgcgccgtggtatttatagaatcctcaaaagtcagatttggaaggatcttttgagaaaattattgactcattttatagatcagcaaagtgaggtcctgagacaggaaatgacttgcccaagaatatacattgagtctgtccccactccctccctcactcacttccttccttccccagtgaccatctggatgccaggtgctgggatagacagggacccgggcaagggactagatagggtggtgtggggagaactctgaaaaggggagatctgagagggagaaaagcagcccctgaattctgggagctgacctggcactcacaggtaggccttggtgctctcctgctgaacgtggacaattgcacggaagaccaaccacaggcaaggccgctctgaggccacgatggaacaagacaaaagcaagttgtatctggatgcagacaaagatatgaacattgtccaagccaaaaaaatgaccaaacacccccatattctggttaatatgagcggcctgattctttgccaattacagctctagcctctatctgatcttcccttcttataggtaagatgtattaagatatccaatcataccacttcccagtgtgtccaacctaaaacaaagcctcacctccttagggcctctttcaaatcagcaaacacagcccacattctgagtccttcctaacatcctcttcctgaaatgtcccacaggaatgcacacttccaggtatgcattcacttcattgcaacaagtgataaacccaacttgttcacctccaggaggtgtgtccctgctgatctctggccaatacatttcagctaaaaactaaatgataagcagatgccagctttggcgagagctggggaaggaatgttccattcagagggaacagcaagtgcggaggccctgggatggaatgagctttttgtgttctagagcctctagaaagggaggctctccagagcagagagaataagaggaggatgacaaataatgtggatttggcttggggttggggcagggtgttcaatcaaggtctcgtggaccaaggacaagaacgtgagttttattataattcaatgggaaagttttggatttttttttttttttgagatgatggaatttccctcttgttgcccaggctggagtgcaatggcatgatctcagctcaccgcaacgtctgcctcctgggttcaagtgattctcccgcctcagcctcctgagtagctgggattacagtcctgtgccaccacacccggctaatttttgtatttttaatagagacggggtttctccatgttggtcaagctggtctcgaactcctgacctcaggtaatctgcctgccttggcctcccaaagtgctgggattacaggcgtgagccaccgcgcctgacccagaaactttttaagaggggtaggctgagctagtgccagcatcatgataaatggcagacagtgcttgtcactggaaccttctttatccttgatgatatgctttatagattttagaataaaattatcatctggtacccgccccagactaactctccctgcgagtgcaacccaccctcctatccacagagctgagcccatgggaggctcagaccacatgaccacaagtcacagacttcttgtgttctgctgtgctgactcagtccataggactatgaaacctacctcaatgtcccacttagtacgttcattttctgctagaactgagaatgatcgctgatgcctgtgtggctgattttttcttctacctggttctactgagccaaaccaacagaagcttgccatccttctttagacactcttctttgcacctaagcccttctgagttatgcctaaaatagtaagatgtcaaaacacaaagcttcctagagcagctcactcccaattcaaggctgagggcgtgtcagcccatttcatttacccatttacctcctatcctcagcagattctgtcatttgcaatgccccccttcactctcctttgcttgactgtatccctggagataattggatatgttatgccctagggtgcagcaaaaccaggccagggatcgctgatgaggcagttcctggctgatgctccagggcacagctgagggcttgccgcctccatgttcagtccagcctgccaggatttctccacacccctgtccaacactgtactctcctggtgcagggaacactctggagagtcttcagcaaggaggcaccattttacctgggtctttccttcatttgtcttgtcaagaaatacacttgcacactaactgtgtatgcgagtcagggaaaaggcagagctttgcaaaaggcagacagactaaaatgtttgaatatttttactgcaaataagttcaccacttcgagtgtcaataaacgtttctgaaaagagtcagtaatacatcctgaaggttatgggtggggaaggatttaactatacagaagtaacgcaaggtaactttttggttgatgaaattctcatgtgtcctgattgtgttggtgtttaaacgactctatttattaaaactcataaaactgtacactctcccaaaactaattttatactatgtaaattttaaaaaatggaaaataacacaccccacggaattttgtgatgattagtgactacccgatacaatacccatagcacctggcacaatgcctggtacacagtaggtgcccagaatcttccatcttccatatcctctttcccagggatataatattgagcctttttggtccacttgtagaaatcattctcttgccatcttcagtcaaaaacatcaaggattttttttttttttttaattttactttaagtaagttctgggatacatgtgcagaacgtgcaggtttgttacatagctatacatgtgccatggtggtttgctgcacctatcaacctatcatctaggtttcaagccccgcatacattaggtatttgctctaatgttctccctccctttgtccccacccccaccccctgacaggccctggggtgtcatattcccgtgtccatgtgtcctcattgttcaactcccacttatgagaacatgtggtgtttgcttttctgttcttgtgttagtttgctgagaatgatggtttccagcttcatccatgtccctgcaaaggacatgaactcattcttttctatggctgcatagtattccatggtatatatgtgccacattttctttatccagtctatcattgatgggcatttgggttggttccaagtctttgctattataaatagtgctgcagtaaacatatgtgtgcatatgtctttatagtagaattatttataatgctttgggtatatacccagtaatgggattgctgggtcaaatggtatttctcgttctagatccttgaggaatcgccacactgtctttcacaatggtagaaacatccagtttcttttttcttacaagggcaaagatgggaaatctctgaaacatctattctggtttgcctcagaccaaagggattcccaggatgtaggactttcagttttaaaactgggaccgttttgggaaaattgggataagctggtccctctaggtataggtaaaatagcatttagggaatgggaacgtttcataatctgttgggagcctaaggtctggtctctattgtggtccacgggttcagttaacacatttactgatgtcgatggtcagcttgtgggtgacaagggaatcacagctctgcaggttgtgcacaatcgaagagcattgcatctatgggagcaccatgcatacggcagaaattttagggtttccatatttattatgaacattttctggaaggtgacagccaaatatcttgagacaggtgcaccttttgttatttcactctaaggtgctgtaggagttagtggtggccttggcagaggccaagctttcaacaaattccatcttctgtgctgaaaagcacaagacttagggattataaatgtggacagagaaggcaggagaggatgactaatgacgtctattcagagtggcatcaggagagcaaatattattgcataccatgtcactaaatagacagtaatttatgagttctgctggtgaagctaagtagaaaatcagattgcagcaagatgggggtatttgtctgtgacaggaactttgatcaaggcagagaagttgagtgcatgtctgcatgtagactcacaaaacactctttaaaaggcccaattaaaagctacaagttctcctttaggtgacaaattccctgccttcaagaagtctatagcttaatgggaaatctcacgcgagggtacctctattcctcccagctgtgagtctacaatcttggggatccccataattcacttcaggctacagacttccagctgtctacacccgtctccatggtcatgcatgagcttccgggtggctgactccagaccagcaactctcctctaaacttgcagccagctatggtgaagaggcagactgccaggggccatgatcataaccttggtaactgttttcaagaaaactgtgcaacgggtgtaagattcctattaaatctccccaactagtttcatttctcctttcataggcaggcatctttgtttctcctaaaaaaaaattggctgcagcattttaatcatttcgttttttgcttccaagctttgcacatgtagttccctcttgtacacaaccttctcctctacccatcttcttctacttttctctaactcggagtcttatcttttctgaaacttctgatagcttttggcaacaagaagtggcaaaaagcaagtgtgtctccaaagcatttgaactagagttctgttacatcattacatggtgtggcaagaccacgagctttctttaaagcagcatctttattttctttatttatctttctatctccagtgcccagtgttaggtgcacaataaatactcagtcagtgtttctggccagattagtgttcataaaatagaagcatatactatcagcctttagaatttcatgctaagcctgtagtcaaacatttcacagatgaaaatgagacccagagagggaagagtcttgcccaagaccacccagagtctcaggagcagattgaggaccaggttttgactcttggtcaaaggatttttctatagtaccacctgaaaattgctcacttggttgggggagatcctgtattaaatacacaaaaaacccaccatgtgctctgttagaaacaatattgtaagtagaacaataaaaataggctaaaagggaaagactgagtctcttcccttttcccttaatggggaatctcacacgagggtacctctattcctcccagctgtgagcctacaattttggggatccccataactcacttcaggctacagacttccagctgcctacacgtgtctccatggtcatgcatgagcttctgggtggctgactctaggccagcaactcttctctacacttgcagccagctacagtgaagaggcagactgccaggggccatgatcataaccttggtaactcttccaagatcctagatccctccaagatccttggtaactcttccatgatcataaccatagtctcttccatgtgagctctttcctgctggaaaactctcaagtttgaaaccacagcggtcactgatggcttttggccactccctataatggcctattgtcttttttcaatctggaggtggggtggagtggagtgaaacgagcaggtggagcccaggtattcctgttttggtcattatgagttcccagagttgaagaaccccatggatttcccattcatgatttgggcgtgggccagtaattcctcatgcccctccctagaaccatgctcatctgcaaattgaggagctgaaccagaacctttctggggttgcctgtggtgggatattctgtcatcactctgttaccaactgaggagaacaaaccttgtgggagaagcagaggtgtcctcagacactgctcagggggctctgagcagagaagggagcacctggggtgacctgaaacttccatctctatagttataccccattcaaaagctgcctgcctgccatcaccccatcacccacagatgactaagaacaagatggcaacacaggccttccccacaaaagccatacatatggtgtgtccgtcctgagctggaaaatgaacaaatgtttgctcttcattaggctgcatcatattcctcacagctgttccttgttgctttaaatagtcttaatggagctgtaataaccagtaccttctggttgccctactgggctggttccattcattatggcgacagcctgtctggattgaactgggatgaatgtgcttcttccttctctcccatcacaaagtcacctcttccaattctcccttttcttccctaaacctgctgctcttctgactaccatggcagcagttacatgggacacagataactcggctctccagcccacatctcttatattttgctgtgatgcttagggttttgctgtgtaacaggggaaggtgggagaactggagctgggggggaagcaggctggggaggagggaggatgctgtggttcagaatcacatgctcttgactttaataggaagggtatatggttcagaatcacatgccctttcatcagcaggagtagacctgagggttggcagagcatgccaggggatgtgtgtgggcacatgctggggactccatgggttttcttagtggttctcagctttaaaagtatattcacatcaaccggagggcttagaaaacactgaagtatatatcccacccccagtgattctgaaatgtggctgtacactgaagtatacatcccacccccagtgaaactgatctgaaatgtggcctgagcattggtgttttttaaaacttccccaggtaactctaatgcgcaacccaaattgaaggcctctgactgaggctcagatctatctggcaggtgaagttaatttgtcttgggcctccttgagctcctaggagcccaaggcccttggccaattgtggtttttagaacttgagacataaccatggaagcggcagccccagatagtgaggtcccatgcgaccatcagtgggagggaggcccagctggctcggccaattggttcttatttagactcccagaatatcagtgacagaagggttatttggatcactttgacaaacccctttgctcccactgcataaatgtggaaatggaggcccagaggagagtgacctgcctaaggtcacctgaatacttaatgaatgttataggacttgattccaggcattttgactcttcaattcaagatagttcatacattatttcaaataattgaacttaaaatatatattgagagactcaagttttcatgccaacgagaacaagctgattttatggctctacatgcagaaaaagtgcgtaggcttgtctgggctctgggcccagtctcctggtttgggcagccccatattttccttgaattactgtcccagccgcctacctgcctctgttgtccctgctctgatctctacaagatctaaaatgcaaatctactttagaaagtcctgctctcttcgatggctccagtggcttcttgattacaatccaaagtcattagtgtaacaaacactcatcttttgcttcatcctggcccctgttgacagtttcagccccatctccctccatgcttcctcccaaaccgtttctggttcccctcactcaacctgctgtgcccacccctgtgccatagcttatgctagccgctctgcctggaacgcccttcccttctttaatttggttcttcctacttctcaagcttcggttgaggcttcatgtcttccagaaagccactggctatttacctttaggctgggttaatgcatcccacccccaaggattctcatagctctggatatacctctatggtggcattttttggctctcagaataggctctacattccctagcaggcaagggctctatttagttcccagagcctagtacagtgtctgtaccctggaaaatgctcccatatcttaaagttgaaattctgaaaggcctggtcctaggtccttgtctctgtctatactcacttgcttggtgacctcacccagtcttgtggctttaatcatctataggccaataactcccaaagctttctctccagcccaggcttctttatcaaattccaacttcatagatccaactaccttcttgccaccacatggagacactaatatgtctaatggacattgcaaactcaatttaacatgaaactactgattgttccagctctgctttacttgagcatccccatttccattagaggcagctccatcctaccagtggcacaaacaacagccttggagttacccttaattccttttgtaacatacaccatgtgttaggaaatgctgttggctccatcttttaaatatattcagaatccaaccacatctcaccacctcctctgccatgccctgagtcatcgttgtctgtcacctgggttactgcaatgtcctcttaacttgctttcacccttgccttcctaagttccattctcaacacagtagctagaaggaagtaaggtcagatcattagcacttgtcttctcaaagctctgaggtggctttccattttagtcagagtaaaagccaaagtccttataacggcttgtaatgcatagcatggtcaggtccctctttatttctccagtcgaatctcctattactcttatcccttgctcactcttcctctgccaccctggcctctttgcaactgcttgtacatgccagatatattactctctggatctggaactctcttcctccagatatcttccaccatgtctatattccaagtttcgtcatctaattaaggactatccttttatcctttttactattggaacctcctctacttcatgtccctggaacaaatctcccttccttgctctattctttctttttccatggtacttgtggcagactgtattattatccaaagattttctttttctttttttttttttggagatggagtctcactctgtcccacaggctggagtatactggcacgatctcagctcactgcaacctgtgcctcctgggttcaagtgattctcctgcctcagcctccagagtacctagggttacaggcacccaccatcacgcctggctaatttttgtatttgtagtagagaaggggtttcaccatgtcggccaggctggtcttgaactcctgacctcaggcaatccacccacctcagcctttcaaagtgctgggattttcttccccccccaatatttcttgctctgcatgctcctctagaatctggcaactgcccctcctcctcatcaagggatagagtcaaattcccctctcctagaaagtggggagtttttacctgcttacaaccaatagtacatggtaggaataatgcagtgtgatacccaagtttgggccacaacggtgatgcacttttcaccttgttatctggggagctcacctatggagttctgagccaccatggaaatcgtccacctatcccaaggctactacactgtgaagaagcccaggccactgaagaggccatgtgtaggtcttccagtggacaatcccagctgaaagcctgcatcagtcactagacatgtgagtgaagacatgttcagatgattccagcccccagccttggagacttcctagccaaggctctgaacactgtgtagaagaaacaggttgtccctgttgtaccctgcacagattccacagaatcaatgaatgcaagagattggttgtttcatgttgttaaaatttggagtggtttgtaacatagcaaacagtatttctcactgtctaacacactacattatataatttgcttatttttttaagcttatgtttatttcctatttccctttctagaatacaagcttcagaagggcaagaatctttgtttcattcactgttgtatcctaaatacctagaattgtccctgggaatagtaaatagtacatatttactgaacaaattttaagtgattattcaactgaattgaattttgtcttctgatgcagcttgctatggctgagatgtcccttagatgtcaacttgtcaaacccactcatgtgtatgaaaacactgaacagagcagagaagtgacaggcaacaaacagcacagagcaggttggtatgagagtagcactggaggctcaggagtcttttatctgcaataggacaatgattctcctagcagatctgtgactcctatgctcaggaggattaccgagatatcacaggagccttgatgatcaaagcaatccagctgtattctgggctggacattgcgggctagcacattgtgaaatgacttttatcaggcaatattttccaattaaccctcagttaatcagaaaataatgttaactagaagctaagctttacagcttgctgattaatataatttggactaattgaggccaaggctagcctagttagatttctggttgagattcaaatgatgaaataacatgtattgtttgttttctcattataaaagctgttcatttccatgctagaaagtttggaaaatacaaaagggtacaacgaagaaagtttgaaaagcaactcaccacacagggatgaatgctttaaaagaaatattaatctagaacgaaatgcatgaaagtagtcaaatacacttgtaattctgtcttcaaatttcagattgcaagttcttacatatgtgtttctcagcatttggctacttgtccctttttttttttttggtaagccacatatctcccttaatgatatttgaaatttttaatcaaattgttatgactaatgttgaatataccatttcctttctttcttttttttttttcacccaaacagctatttattatccacctcccatacttccagtttcttttgggagatatgccacctggaggctgttttcccaatcctatgttgccttcctcactttcttgctaattattaaaatataacccatcctctgaaggccatgctgtctatagaatcttgttttttttttcttggatatatggcttgaaaatattttctttttttaattattattatactttaagttttagggtaccaaataacataatcttcctgacatttgttcaacaagcaggtctgcatacacacacagaaagcatgctcacatgcaccctatgtcccagagactgggaccattcaaccccctaggaaatgagatccagggatgggtagtgatgagatcatcttcttcaactctaattcgaatatcctttcaagatttgtagatgagaatatgaaaagtgctattttacttagaccgtttttgaaattaagtgctagctctcccaagcttgtaattacttacatccattgacataaacatttttgttcttataaatatgtcaaacatgccccttgtcaccatgttttacactctcataaagttttaggaccagataggtcctgagagatcaccttatccaaattcttcattcgactaataaagaattttaaaactcagatagcaaaattctaaaatcaaacagcttactacattggaatccagctgtctgcacccccagtttagcacaatttcatgacctcatacgacttcagaaatattgctttgtaagctctttctcagaatatagtctgagggataaacttagtctgcaatattaagaattccaaatgtgtggagtctgagccaatgagttttctactgcacacagcaaaactgaatcaagcatagctggggcacacgctgcatgtgaagaaaaaaaaaagaacaaacaacaaaaaaaccacaaatacatataactcagaccatggtacacagaagatactcaaaagatattttaggaaagaaggagggaagggagagacaggaaaggaaaagtgaagaaagaaattcttgttttcaaagctggctgcagctggagtctaactgcaaccaggagagttgcagaattattcttggagagtgagctgctctttggttcagaaaaacgtcttaatgcattttccttttattttattttgctttttgtttgtaaaacgtgaggcctaatgggcaggatttgaaacaaaaagagtgagataaagaaagctaaattgttctgcaaaataaaagaggaacgtggtgccctttgtctggatgctgaggggtgggggtggaggaagttttgaagacagtaaagaagactttgaggagaaattagatagagacctgtcaggagaccagaaccttagaaggccttaccagcaatgtagatggttaaggaacttataagaagaacaacgttgtattgagctgctgcctgtcctttactgcagtccttctctattattccccaaacctcggtaacaaccactacctgcaaatcctttgtgttagggatgctttggggagatgggaaagggatgcccagtgcagggtgaagagatggtgcagaaagagggaactgtggtcactggagatgaagcattgccttcgggggatgggagcggggaccagaataccacagaagcttgagtatgagacaagaggtgaccaagggcaagcatgcatgctggaaatcattggcaggggagatgtgctggcttttctacagcatgtgggatgggagcttgagccattctggcatagtgaatggaggtgagactccaaagtgcagaaacgttggaggtaatgaaactttggataatgaaaggggaaggggagagaaacaagagtgaaaaaggatgtcttagaattatttagcatggtgcttctcaaatttaatgtgtatacaaatcacctagtttctggttaaaatgcaggttctgattcagtagggagggatggggcctgagatgttgcatttcctacacgctcccaggtgatactgaggctgctggccagggagccatactttttgtagcaaggctttagtgcccaaataagcctctgaaactatcaggaagtttccccacaggctggtctcttacctcgtattcctccttgaacccgtagccctggcctctcttcatctgcgtgatgtgctgcagcaagtcagccacccggatggcgggttggaactggtcccgggggtagctcatctccacagggtcacaggtgcggtagggatgagtctggatcgtgagggtgggctgggaaagctccccgcggctgccatctgcttcgaaaagaaggaggcagaacagatcatcacctatagaagctttgccctttgtcctccctgtctcccccagcttggcctgaggagggcagagggaaccaacttgggactcaactgatagggaaactgcaaaaggattggagatacactccttccctggcctggctgtgttggtagatctaagtatcaaacccacaagcaaaccaatgaccacaacacatttcaagggcacagactgataaagttccaggttgttcatcatccccgtctgtctcagtccttcgtttagactttgttgggcagaaccactaagaagctaggcaggctatttattgggagccccctcctgtttcggaagcagagaggctggaaatagtgcctgatgcctgtctgcaggggaggagagcctcaggtggcctcaggtactcgaagattggagtcacatgtataattctggtctatttgcctgcatggctgtgacctggcttctctactatttttttttcctttgagttttaccctgggaagaattggggctagtcttggactgccagaagctagcagggaccctgaccctcccagctgctctctctagttatgagctctgccacagtgaccaccttcttgctattgtatagtttccccatcacttaatactattaatccagtggcatcactgaacccactttgcagatagggaagcctgggcctcttccttcagtgctgctagctactttccccgggcctggatgctatgtctcatcgccttcataaaatctctccctgatgtaggatctatattctctcttgataaaaaccttttcatccaatgagttgctttaactgccttctgtcagtttggtcaccctgaaaactgatgcctggtcagattgggtttgaattcttctgttccccttggacgactagaaccaatttcttgcttaccacctccctgccaggcatacattcttgatctctcagggccagtttacctttcccagaaccatctaggcttggtcttcccaacctccttccaaagacatggacagtctatgccccagaccatcttgtttgtggcatgcaagagatgagaactgccagctgcagcagttaatgtgtctcccccagatgttttcagaccctgcaaaacacctatgcaggtacccactcggcctatgccatactcattccctgggaggtttagcatatattcccaattttctgcaacttgtcttttcaaaatccatgtgcccttcagcttatttgcctgtcatgttggaatactccatcagacatggatcctgtgtgtgaatgcacactctacttctcggcagcagcatcggcaagcctgttcctggcaaggaaagataatggaagggaacacctgaccttcctgctttctaggtgaccaacttgtcccagtttgactgacaattttccagttttaacattgaaagtacagctgttgggaaacctctcagtcatgggcacacaggaatggttggtcaccctaatgctttcacttatatctgtggttggagtaggggataaatttttcactttgcagccttctgcctgcctccacctaccaagggaggagaggctactaatctgactggtctgactttgagacactgatggggtcgtacctaattagtaggtggggtcatcgtaggcagagtgtggtctctaaaacttcctaattcagggtggtaggtaaacatctccaaaggagagactgtcctttggggaccagccaaataacccctggactgcttacagaaagatttctaagatttagatttatgcacaagaaagaagggcctaggcaagtcgttagcaaaaccttcctgactgcacagagaaatactgcttactttttctcccgggattttaggtaatagctagtacatgttcactggcattgcttaaatgtaccacttggcaaacatgggggtgttccctttctccatcaaccccttggtttcatgagttcgacttactgagaacccactctgtgccaaggactatggtaggcagtggcaatgcagacagaaatactgattccaccctcaaggcttgactgtctagcaaggaaatagacgagaagaatcaactgaagaaaaaggacagagcctgagagatgaaggcacatgtagttaagaacaaggaggttgataaggagtaaaagctgtgggtagaaatgtcaggggagggcaacactgtaacagatggtgcaaggcagatccagagactgtgaatgtgcaagacccttgaagccagtgtgaacctgctgaagggttttaggaggaatctccttctttaaagactcacactgtttcttgtaggtgtcccagctgtcatgaatagctctcatcgaaggcatccttccagcgaatatcactcctgtgatggtgtgattggaaatggagaggaagggagcacttgtgtttgattcatctagagatggtacaaagctatggcaagagccacagaggtatggatgctgcatacctaaagcttggagtcatgccatactctatgatttctatgaaaggatgagctgagtcaatgctaggaggcctgtgagtatttcccaccaaagctaccatcaaacatggggacagttgtcttcagagacccacagtctcccagaggaacttggggcatgggctgcatgggagaccagctgcctgggaaagacaggcttcctaggaatgggaacttggctttttatgtgtgtgagaaatgtcaaatgtttccaaaaccaaatagctgtcaatatggatattttccctaaacacattgctagacagactgtaaacttggtgtcagcaaaaccaacactggaatggaaaataaatgcattgaaatttaacaacttgtattgctgtaacatttgcaataatgtcaatgccagtgctaatgatgctatgaagactcagaaccaagggattttcaaggtttattaatccaacgggttagactcccctttccaaagtatcttacctcacctattcccttattaacctctgataatgcagaagtgatgtcttttatcacactccatttcaccagacgcactatacttaattttccatcgttaggtttaatgaaaacccaatttcacaactcacttctctcaggaacctacaagtaatgctacgtttttatcaggcccaattaaaagacgttatgatgttcctgttcaagagggagccttaaaactaatgtgcgattctgctgctaattcaacaagggcactggaattcacacgctgctcataaaatgtaactcacaccagctggcccagggacagaggatttttcattttttctcctcaccagccccttaattctcatgccttcttctgatttatgggtttggtatgtttatttatcgtgcaataatattttggatttctttcacactttttatatagctgttacctaaccctgtgaattcccctgcagtaactcttgttactgcccgcgaggagcttgtgggatgggcagaaggattttggtgctgtgtatgagattttgggttactgtctcactgatttcctctttgctgtcttcctgctctctcctcctcttccttgggatcctagattcatcaccgctgctgcccacccttatcccctgccccactgctaccagccatatagatctccctctacctttagtcacatatttccatcacttactgggaattgccactccaactggttaagaaatatttaatgagtacctatactgtacaatgcacgttagatattgtgttcatacagcagggaggtatgttcagggagaaataagcaggccacagcccttgaaggaggggagaagaaaatataaggtgtgcgtgaataagcctaagataggaagagacaggcccctaagagatggaagaaggatgtgccatggggtttggcaatctggaaacattctccaagcattaggcattcatgatccacctctgtgtctcttgccatagttgtgtaccatctatgtgacagctgtccaatagaactttccacaacaatggaagtgttctacatctatgctctgcaatttggtggccactaatcacatgtggctactgagcgtctgaaatgtggctgatgagacagaggagctgaattttaaattttgtttaattttaattaattcaaatagaaatatttacaggtggcttatgtctactatattgggcagtgcagatatacagaaagagatagggaaagaaagagagttctagagtcacacagtggggcaaagaggtctagaatagcactggccagtggaaatatattgcaagccatgtatgtaatttaagatggtcttgtggcaacattaaataaggcgaaaaagaacacatgaaagtaatttcaataatacattttacctaaccccatatgtctgaaataatatttcaacatataatcacaaaaattattaatgctatatttttacattctttattcacacaaaagctttgaaatccaacgtgtattttacacttacagcacatttcaattcagactggccatatttccaggattcaacagacactggtaaatggtaggctaatgtatgggacaatgcaggtgcacacagacttatccagagccagatcaagttctaaagagaggtaatttagagctggagtaaatgctaaataaaaagacactgatccagtgtaaaacagctctcacccagcactatccaaaagaaccttacacattgacaccaatgttctatatttgcactgttcaatatggtagtcactggccatctgtggctattgagcactttgaaatgtgcctactggtgctgaggaaatgaatgtttaatttaattttgatttatttcaatttaaatagccacaggtggccagtggctactgtattgaacaatgcagatctacacaattacatcttcaaaacttttcttcagataaactctcaactattttttttaactttgcctcattatgaatgatagtgcaacataaaatcatgaatgtgatgtgctaattttgttttagtgctcactaaaatgtttacataactatttgagaagaagtcggggccaggtgcggtggttcatgcctgtaatcccagcaatttgggaggcctaggtgggcggattgtctaggtcaggagtttcgagatcagtctagccaacatggtgaaaccccatctctactaaaagtacaaaaaaattagccaggtgtggtgctgtgcacctgtaatcccagctacttgggaggctgaggcaggggaattacttgaaccagggaggtggaagttgcagtgagccaagatggtgccattgcactccagccaggggtgacagagcaagactccatcttagaaaaaaaaaaaaggggggtctgttcatgttgcatgaggggaactcaatctgcaccctgagaaatgttgagtctgggtcccagaatcagatagaatggggtttggatcattccttggccaagtgacaaatctttctgcatctcagtttctttatctataatacagagaaaacacatgttgtaaggattcaaagagatagtgcatgctgagtgctcagtacagtgtctggtatccaggaagcagtaaaaaccagtatttgttctgatgaatttgtgcataatgtcatattggacatatgagaatccacacactagagatggcatctagggagtcatttagggcttctttcgcctttccttgtctcctctctgctttcctttatgacacaccccaaagccatctattttactccattcctgctgctattgccctcattcaggtcttcatgacaggactactccatcagtttcctgatggcccttccttctttcacagttccctttacagagctttgatcaagtcatttttcttagcaaaagtcttcagggagtcaagacaaaatttcttaactagctaatcaaattcctgtagttccttaccagtatcaatgtatttcttctatcactattcatcctagctccatgtgctctttagggcaggagagtatgaagagtgatgtgtaagtagctagcgactgctcattgagaggagagagtctggaagaggagagaagttttgaggtgaagaggaggctgggtcacctgcacagagtggggatgcaactggaaccaacactgtggggactgtggcaacagcaggtatcagagtcaaagcacagactcactctgaagataaaacattggattcaaatgtgatcttcacagatttctagctataggacctcaaataagttacagctgacccttgaataacatggaggttaggggaaccaaccctctgtggagttgaaaatccatgtataacttatgacgccctcaaaacttaactactaatagcctactgttgagcagaagccttattgataacataaacagctgattaacacacatgttgtatgttatatgtgttatatattgtattcctacagtaaagtaagctagagaaaagaaaatgttattgagaaaatcataaggaagagaaaatatatttactatttattaagtggaagtggatcatcatacagttcttcatcctcattgtctacacattgagtagactgaggaggaggaggaggaggaggaggaagaagaaaggttggtcttgctgtctcaggagtgacagagtcagaagaaaattcatatattaagtagagctgtgcagttcaaacccatgttgttcaagggtaaccatactttgagcctaaggtctttatttgtaattgctgatggtgatgacaatgatcatgattgatcatcatcatcttcttctgagaaggttgttgcaagggttaaatgtgattccactggaagaaatctcaaggtggaacctggctggcagtcagtgcctcccctcttctccctcacaaaatactagaaaaggctcaagataataaacttgtaacagctctgaaatctaagtctatccactaacctattgccagaatctgggaagaaaacttgtttattattgcagcagcacacatcccatgtgcaggaagatatatatttcaactgctaaaaatttctcgaaaatccctctctcaattgattcaacataatctctcaattgattcaaccacaggtagtttcccctccaacgctggaagtgattacatttccttgttgaagcataagatgaagcagttggcttgtgcttaggagtcatgttgtaagaatgctctgttctgtgtttctgaattctagacttgcactagcataggtgtatgagatttgtgacccctgaggaacagtagattcacatcctcttactcaatgtaacaacagatggatttaccttttcccatctttcttatgtctgaccaaacacatagtagggttgaacttgtagaactaatagtaatagaatgccactccactgtgccattttctatggagctgaaacaaacatgatacaattgactttgatagactttgttacttgggataaagcaaacccaatggcctgaagaacagaaaagaaatgcttccaattttctcattttaattcctgagctcagagaatcaaagactgtatcaaccatatagcagggttggggcatttccaagctctttctcctcctaaacctccatcactggggtctttgacatggtaaagacaaaagatggtatctttgtttccgagacgcagattcagtgttaggaagcaattgtgatgggaacagtcatgggaaaatgcttctaggattcatttactgtttctgataaagagatcaatcctcctgcttgtgggggagagtatgaattccttctttcacagcactcacaccagatggaaggatggtgttagacactctatgtagggatgggggctataaacatccattgctcctcttgcttaaaccactgccagaatttgggaggaatattgatgaattatagcagcatcacacatgccaggatggtatggaataaaaggattccaacaataactagttggacagtgaggcaacgatgaggatctacctcctctatttactggcaagcaacaggtctggagagacttctcttcctttaaagttaaataaacagaaacaagataatatgaggtcttagaagaaaatccaccatgttaacagtaaggaaagtgatagcctggataccgtgaaaagtacaattttcaaacacacacacacacacacacacacacacacacacacacacacacacacaacagtcagtattgactgttgacccaagagccatcccctgtcttgttattttctggctaagttcaccgtatgacttggtgggggcgggggcagggaatgaccctactcccaaaacaagggacaaattctgatgtccctacgccatcaaggtgttccgataccttttgcaagttaaataaaaatcttttatatgatatgggagggaagttccattagaaggcttctaggaaaggttctcttatctctaagaaggacaatccagtggcccgtctctgccaccagacagtaccatgtctgtgtgtgatgcctggaactgctgaaacaatcttgcatccatgaggggagctgggctgaggttgccctcatgccaagataagaggatgaagaggagagcttgaaagaatgtgggtcctcaatgacattcatgggcatctcattcaaccaactctaacacttgacttcctgttctagaagataatacattaacttgctgcttaagccatttttattcattttttttctgttactggtatcttaatctaaacaacagaaagtagaagtgcattttaggttccttgaagtttattgaaaacgaaatgcgagaaaagatagaagaataaaggaaattaaaggtgaaataataagactaagacaacagacttttcccaaaatagatcaagttaagaagtagctagaaaaaatatttactgggtgaggtaagaaacaattgtaaagaaaccaaaatgcaataccagaattaaaatgggcactggaatctgtaatgagaataagcaacaggcttgtggagaattaatttgaaaaacttggaaattaaaacgcaaggaaagcagaacaatacaatgtatatttcctttgtatatatcatctgctcatgtgtgttcatgtgtgaagggaacaaaaagacatttttagagaaaagaaaacaaacatataaaagacataattgctgttacagaagaacagaataaatggaacagaagcacattatgtgtcctttcttatcaggacacaatattaaaacaactcattggcaaaataaaaacttaaatcttcacgtgtaaagagttctccacctacaacttaaaaatagagcctatattctgatacaattgtttaaatattattgatgtagaaatactcagataaacatctaggctggaaaatggctatgtataaaaaatcagaaactacgttactcatacattttcttgcccaaatttaaattccagaaaacaatgaaacaaaatttttcaagtaaaaatgatgtggctaaaaaattatacagtaaatagtttttcatttgcgaagctacagaaaggcattccctgacacataaagaataagaagttatgttggctctgattcttttccagagggttgggtagctgataaagctagtcaaggatgtgagtccagaaatagagaaaaaaacatccacaagaatggaagaagtcttgttataaaaaaagttgatttggtaaacacagatatgagtgtaaaaatcacaataaatgtgaatcaaaacagaatgaactataagaggtaatgcttaaagagaaatcagatttaaaaatctaatataaaaattcttggctaaaatttccaattgtattaacaaaaaccaggaagtgggtgactgatacatcactaggaataaaagtatattatcttcttcacctttcataatggatattcaatgtgtactatttcaatcctgacactcttaattgaagaacacaattttaagcgaatgtgtatgtactgtacagggtactgtagaggtgtgcatgtgtgcgtgtgtgtgtttaaggcatcaactactagcataacaagaagaatgaacaggattcaaatagagataaaaaaacaaaacaaaagaaaaccctgacttctagtacaagtgcatctggcatccaaattttgttacttgtttgatagaagcacctgccaacatagaaatcaacattaaaaaaactgtgtaataccactgaaaactacactgtcctgacaagcaaatgagaaatcatcctgtagaggtattttcataatccaaggcacattaattcccacagaacaaaactgcctccactaaagacgaactcatagtaaaaaataaattataaagaatgacaagagccttgtaaggaatcttatccccataggagagagtcagaagtcatcatacacagaaaaatacacctctcaagaattgaaaataataaaacaatcaaagagactattaagtaaatacatttagattgattaaagagaaaaaagaaggaatatgaaccattgcaataatgcacacatgacagaaaaaggataggtgggtttgaaaaatatacattcaacttcttgagataaaaaaacatagtcattgaaaatagaaagaaagtaaatatgtatataagaacagacatggaacataacacaagttaaagatacagcagaggagctgaaaaaaaacagcaaaagctggctctttcctttgaaaacaccaacaaattagacaaacctctgccaaaaaatgattaaggaaaaaagacacaaataagccacttcacagttgttagagactgacagaacatttttagcccaggcttagactggagaatgattaatgaccagagaagccctgagacacatctcaagactctgatggacgtggtcagggtcagctggtaaacaccagcccatcacctgggtgctagctttttaaaaaagaagtcatattttgagatcattacagattcacatgcaatcgtaagaaataacataaacgggtcttaaatacccttcacccagttttccccaatgttaacacttgtgtaactatagtacaatattataaccagaaaattgacatatatgttactgatcttattcagatttcattagttttacatgcgcttgtgtgtatgtttaatttatgcaattttatcccatgtgtagacctgtgtgaccaccatcacagtcaagatgcagaaatggttacatcacaaggacctctcatgcaatggaacactagcgctgagtttcttctttctacactaagacctggttactagattctgggagactgcagcaataatgaaaagaattgtctctcagtgaaatgccaaactccgctagggatcgacaaactgggatcccatctttcctgatgctcctttaatccaggcttccacaggaccacaatatgtggctggtcatacatgctgtgcactgttcaattttagagggtgtcattcctttgacggccttgctcttgtgatctacaagggccatcaatcttgacttgttccagtgactagcggttattattttcattttgagtaaatcaagtggaaagtttcacccatctggtctagagaggaagcaataagcaaagcatcagtctatggacttagttccctaagagctgaggcagagttaggaaaggagacctctgttcagagattcttctatgtgtctggagtgaactgggccacaataaagggttttgtgcatgtcatgtgtgtggggagtgtgtgtatcctggcaagcatgtgagttttcccttacctcttctccaaccagatataaatggctttttatctgttttagaaaataaacatctaggtataattttgttcaaaaaagggtttcactattttttaaaaaactttcaaaataatttttttctttttgtcaaaattctatcaaaatcagtgaggaaagaggcagcaaaaatgctgataccagtgttccacagcataggttgtataaacaatacatttggaaaaaaaatgaaaggtcgttgagtttgccagagcaacagatgtttagtagtgatagggattctctgtggctggccttaaccacttagtgatcaaactaggaagtgagggaataaagctgaggggcgtgcatggaatcctggaagtattttgttgcaccacaaagaagaagggatataattatggactttttaagtcttttaactcactggaaatataagccctttttggtaacatgtaggttgattatttaattcttgcatattcaccatccatttatactttcagagacacttgttgttgaaaataatggccttaaaaaatgctgaactttgaccggtagaagaataacccataaatagacattgaaatatacgcctaaagaattttataaactgatgataaagtagagtacaaatattggttggcaaagaatggattcccagagagtgtattatttttcagaagagaatgaagtatattaaagtagatgaaactgtaaggtggcttagtgttagaaagattaatattattggaaagttacttcatgctttcagtaagaagttctgcatgtgactatggcttgttaagataaatagcatatgcaaaagaacttagaagaacatgtcttggtcagtaagttactcaaagcataaataataaagaaaggtaaatcacacagttttaatattcttgcaagcatgaagggagtgataagggtgtggcatttgagaggagtttatatggaaggaaagactgggattaaatgaggaaggatctgagttatagataaagggattgattgaggcagcaagcacaagaaatggaaagcgactctgcatgtcagttctgtgtttcacagagccactaccagcataaataaaacccggtattgatagatccatgtggactcacctgcccctattctcaaaccatcacttaaaggaaaacttgggcaggtgaacttatcctcaaagtggggccctgtgttgacagggactgccagcaactcggacagtcttctgccttgaaaattctagagtgtttgaagaatctgatatattgaggaaaacggcaagtccaataggaaagactgagaggctcacacaatactctctgaagacagggtagtggtctaacacgtacagactttggacatgaatagggctgagtgagaaccctgacaccatcacctactgcctgtgtgattttgggcaagttactcaatctctctgaaccagtttctgcaaagcctttatggctagtatctctgaaaactggagatagaaagagaaaatcaagcactgatttataattgttagaagctcaacacatcagaggttataattgttagaagttcaacacatcagaggttaatacaacagaagaagagatagtcatttctctccatggccaggatcctcaaatctgctgcccctctctttccctatccatagtggctgaaacaacatccttacaactccttgaatcccctcttccttctccatgttcttttctccaaaataaggcatgagaactttttcaaaggccaaagctgagcatgtcacctccctgctcaaactttttattggatgcccactgtcctttggctatgttccagatttaagatatttaatatggcttcaaggctatgattggtctagctctcaccaatctcatttgcctcatcttgtgtctctctgtcctttcccctctaggctgcagccacactgtctcctcactgaattctcgcccacctgagaatctgtacaggacgtgctattctcctggagtgtttataacttttcccccaaacttccaaggccacgtggactcctattcatccttcagcactcagctcaagtcaattcctcctctagaataaacaaacccatctgtggtatgaatgaatggtggttaccaattgggttgagtaggggcaggggatggctgggaatgggcatgagggatcttcctggcaagtctgtatattactagggggctgggttgcaaagtgtatgcaattgttgaactcataaaatggaaaacctaagatttctgtgtttttttgcaagtaaattttatctcaaaggaaaaaaccagactcttgagtcggcattaatgatgtgtacagttaaatattgggaggaaagggaagtgtagtgatgtctaaaatttcctttgatatgcataaaaattaagatggattgaaggatggatagatgggaagataggtaataaaataaatatagtaaaatgttaatagtagaatctaggggatgactggtcactaaaagtattttaacttttctgaatgaagatatcaaggaagacatctctgtctgcctccatccccatctgagggtcccatgttatatcctaacagtatcattttcatgaattacaatatatgtatattcctgaacatacatcgtcttcatgaattactatagttattgaataatagtgagattagtatcttatccttcaccggactgtaagctccatgaagacaggtatcatatctgtgttgtttactcgtgtatctccagaatctagtgcctactctggaaacactcatttgttaggtacaccttgctctctgaaatccaccctccaccttgttgataaatacaatgtttgtttatcttcaaggttcatctgtcatgtcttctaattcttttggtgaggatatcatgatctctatttcctgcctcagttccatttgccttggtgagtgtggggaggttgataagccacatttactcaaaatgcatatcttctcctgatgggcttctggtgattttaactacactcagatccgaagctcttctctcagagtgaaaatgttcagcttcactgtggctccaggggactggacatgatttggagtttctcattggctccagggttgtatgtgcactgaaaacaactggcccagaattttgtattatgtatatatcaccaaactccataacctgcacacttatgggaagatgtgtgatagaaggaaaagactaagtaatgcctcacactgaaaatacagactgctcctattttctatctctcattcataaaaattataataagactaaggaatgcaaaatagttgcagagtaatacttagctaaactagaaaaactcaattttgacaggtttttacaatcttcagcctgacaggtgactttgtcttttgttgatgtgcaagaaagagaaaatgaaataactaaacttgtctgaaagatgaaatttaaatgtgcaacagatgtttgaaagagtttgccattgttgtgggtggataaaagcttcctttctccatttcaaactatgccctggatatttaggctgagtttgtggatattatgaactacaaagacaacgggacattaagacaatggaaagaacacagtttgggagttacaagacctgagttttcatcctggtgttaccactaaattatcttgcacaattaccttcacctttgtggaccttaattttaaaaccaggcagctgaattagaccaatgcttctcaaggtgtaatgtacatatctagagatcttctataggcagattctaatacagtgggctgaagtgtggcctgagagcctgcatttgtaacaagctctcaggtgatgctgatgatgctggtccatggaccacaccttgagtagtgagggattaggtggtctctaagggagcttccagttaaaagatacaatgtgttctttaaaggtcctggaatttctcttaaaaaagcaaacattattctttctgctcttactgaatgaatgaagtagtacagcttagtattgttcaaaaccaaccaaaaaatgcaactaattaaatctgatggccttaaccctggaaagaacagatacctaacactctcataagaatgaataaagcagtgtgtccccatcaaggttcagcctggctgatcctcaggtgctgaattatagaggctgatcactgaaatgccaaactactttgttttatatagtagattccaaatgctagtaccgtacaagagtcattcaaagaacatactaaatatagattcctttgctccatattctagacataaggatttagtggctttagtttggggccagtcatgttttgggaactactgttataaccattttatgggggggcaggatagcacctagggaagaagaatggtaagtttgacccaattccttattgggaacatggtaaagatctttctgtctgtctgtctccctccttctcttctcccttccctcccctccccttcccttcctctctctcttttttctttctttcctttctctctctctttctctctccttccttctttccttccttcttttcttttctttctttcatggagtctagctctttcgcccaggctagagtgcagtggcatgatcttggctcagtgcaacctctgccacctgggttcaagcgactctcctgcctcagcctcccaagtagctgggataacaggcacctgccaccacacccggctaatttttgtatttttagtagagataagatttcactgtgttggccaggctgttctcgaactcctgaccttgtgatccacccacctcggcctcccaaagtgctgggattacaagcgagagccaccgtgcccagccagaagatctgtttttcaagcctgcttgccagcctctgaagaatcctagtgattctcatagtaataaaggtgtgcaagtcataagggagtcaatgttacagggaaacagtccctgaatagttgcccttatgggatgtcaaagctttgaggatccctggcagctgcaatgagaggtctggactgtaattcctatcttcttgtctattgaaatgcatcagaagaaccagggttaaatcctggctctactacttattagtcaaaggctttgggcaaattaattaacatctcacatgttaagccatgtattagttatccactgctacttgacaaactacccccaaccacagcagcttaaaataacaaacatatacgatctcagtttctgcagatagaaatctggttgcagcctagatgtgtatctctggctcaaggtcttttgtgaggttgcactcaagctgaccgctgtggtaatgatctcatctgaagactcagctgggagagaattcaagttaactgatttcataatcactgacatgatactgacagattcattttttcatgggctactgcagtatgggactcagttccttgctggctgttggctgggcatctccctcgatttcttgccaataggtcaacttacaatatagtagctagcttcccaaggaacagacaagtgggagtgagagagagcacccaagataaaagccacagtcttcttaaagacaaatcttgaaagggacatctcatcactttatcatatcctattcattggaagccagtcactagatcttggctgcaatgaggaagggcgttatataagaatgtggcataggaggcagggatcattggggccatcttaaagtttgccaaccacaaatcctaatatcattctgcaatgtttttgtgagaaccaaaagaggtaatgtcgatgaaagaacatttaaatatacacatatgagagtatattataataattcattccaaggagtccagtcaaaatcttccagctgactttgcttagctttgccaagtattccaaggcattcacttaataaaagttttttaattcatgaaagcttctaaagtaccctctttacacttttccaaagagttttccaagatctgatttttcaaggaaagtaaatggtttaattttccttatcacatgaattgccattgacaacaatctttaatcgttaaagagttaacaatgtactttcaattgctttacgcagataaaaaatccattccctaagacaatgaattagccacataattgacagccaattccagtaataaaacgctaattaagtgataatgctaagtaaaaaatataatgtgatgaatttgctaaacaatggcctaactaataaattttcatgctaaataaatgatttggaatggtgactaaaccctcaccacatttagggtcagttgaaaaagcaatgatgctttcagaaaacaatgacagaagtgactgtgccagctaacatccttaacagtattacactgggctctttgccaagcagggccaagggactaagtctgaatggggtaggtgtaccggaatctggggggctggagcaatcaccatgatgatagtatgggtgactagcctaaagaaaggcatggaatagccaagtatagccagctgtagtaatagcagaacccagcaatgggcaagaagatgcagaaatcaatgctagatcatcttgagctaaagaagatcagggtcagcaccaaggacagatcctggatgcggtggctccgggaagattcctgcagatagacgtgttttgtcataaacaaggaagtcaaagattacagagttttctccttaccccagaaggctaggctagtggtgagactcagctctcataggcacaagggtcttcactattttttggaagcaccatggtttcaacccatttaatttacaatggtaccttctgaaaggatctaaatttagaggagaagtccatatttcttatgggttccactggttttgactgacctttacagctggaacagggttctagcttccacatatcaggcacatgcttgccttgggagcctctaatagagacactctttcctgacatggctcacatctgttacctttttaaagtctttagtcagatgtcatcttctataaaactgcaatcctcctccacttatgactcctgatcccattcagcatgttctattgtttcagtgcaccctcacttgttattatgtcatatcatataatgtacttatcttttgctgtccattgcttatttcctgtctctctttccacttcctaccatcaatggaatgtaagctctagaaagacagggaatttttaatttctgtattcttcactgatgtatattaaaagtgcataatatgtcaggcacatagtaggtgctcaacaaaccttgttgaataaatgagtggcagcatgttcagaagcttgttacactctaacctctgaagagagtagtgcaatcttagaaatcagtggagtaaacaagagcctatatcctctgattttaagacaccactgtcccagtatgccatcctcttacttagtggcttcagaggtgtccgcatatttctcactattcgggagggagtacattatagtagtaggatcatatgcaagagaaagattaagtttaaatcctagctctactactaatagctatgtgaccttgagcaagttatttaatctccctgaacctcaatctccacatgtgtgaaagaagcctagtaccaacaataatcatcaactcataggttttaaggattaaatgatataacgtatgcacagcatctagcatagtccttggcacacagttagggctcaataaatattagtttcttgtactttcccatttaaatacaatatgatacatcccttaatacataagagtaaattgacttttcagattatgccagatattgggaaggctcacaagggcatgaaattggagaagagtaagctgtgactggggaagtgtaaaaggctagaagcctagagccctctggaggagagaggggagatcacaagggtaggggcagtaggggacacaaagtgggtctgaagagtgttccctctgttttccagggctacactgagtggtagagagtccaaggaagccagtatttggtgatggggcctttagaactgatgactaggacaaagatacaaggattaggactttctaagaaatggaggtgcaaagtgcaccatatatctctcccagactagtgcaatggtcccctcccttgtcctcctccctcaaccttcctctatgggattaaaatctaagagtaaccctagtcatcgctatgtctgcaggtcctcattgtcccagcaatgcataagatcagttgactgaatactgaatagtgaaagtgaaccattgtgatctatcctgacttaaaattagcataatgattcattcaacaaataccactcaatcgtattcataggccaagcaccatactagtctccagggatatagtagaagcccggacagaagttgtctatgcaatcatggtttaaaagtctggtgaagatgacagacattagccaaaaaattattaaatgaataaacatttgcatacaagaaatttctgacacatgctaagagggactagaatgtagtaaaattaaaaaaaaacaacaagtggccactgtttagatagacaatttagggaatccctcaaaagaagacatttaatcatagacctgaaggataaaaagtggctaaacagtgaaatatagagtggaagactgttctggaaagagcaaacagaattgtgaaagccatattttgggaaatgcttagtgttttcaaagaataggaaggaggtcaatatgactggagtatattgagcaagacagagagtagccagagatgagactaaagatgctgacagaagtcatgtcattctgagccttgtaggccacgaggttaatttttacttcatctggagggcaatgggaagccaataacggatttttggttgagcagtggcattgtgagtttgttttttaaaattgaagaacacgctaggcaaatggctatttcataaataaagcataacaaagatagtgagttattggtatacttctgctgatggatcaatatgaaaggagaatgatgggatagaataagaagggttacagagagggtgacagggaccagatttgcaagtgtgtgtatttgctagaacacagctggctgaagattcactggatgaccatttgggtctccactgcagaagagacagaagtgactgttagtttggaatgactcctatgttctgagcctctgtcatgtctgtacatcagtgggaatttcatctaacctagatcaaagatcctgaagataaaaggtttcaccttggaaaaactcaactggtcccatgagacattaactgaataagaacactcatttcaaagtcaaacatgtccaaaaatttccaggtatcacaccctcaaaatactgactaatcaatacaatatggagcaagcagggagatctagtcaatacactcggcttaaaaatggtttcaagaatggaatgccgtagaacaccttctctctaccattgcttcattacagagagttggccatacccgttgggttgtagtgactgttaatcctacaagcaggggtgtgtgtgtgtgtgtgtgtgtgtgtgtgtgtgtgtgtaatcagatttccatgtgcaccagcattttgtgctgtcactttccttgaagtctgatataggcagaaacaatacttacttaaagctttatccactcccactctccaaaacttttacctcactatcaccaagatgatctttctaaaaccgactcaatccttcctttctacttcttaaaatctatgttagctccttgcagaaacataatacatttcaaactccctagtattcgagaccccagttcctgcttacctcttcaggttcatcttttaccacttaatcctatggttctaatatttcaagtactacagagaagccaatccacttataattttaagtgcaacataaggaagggtcttcctgggaacctaacagcaaggaagaccaacaccatggacagagacgctaacaccgtcccctgcccttcaccctgtctttcaggatataggaagaagttaacattactgatgtcttttggactctggatgttagggaatacatttatactcacaaggaattgtacaagagagcaaaagctatagatttgtaaaatgtgcagagaccacaaaactacttgcttgtaatagcagaattatcacgctaatccaagtggaaaatggaggttttgaaaatattcctattattgactatattagccaagtagactttcccacctctatgcccctgtatatgtattcttttattttagaataatgtcatagcttgttaccaggatgaccacaattgattccttctcttcctatatgcatatgccatttttcctatagaagggttgagtctgctcctctactcccttaaatttaggctaatatgtgactgcttttaataatgatacacagcagaagtgaagctggctagttctgagcctagtttttaggaggactagcatttctcctggctttctcaaacacttgctctgggggaagacagctatcatgcaagaagtacaattaccatgagtctgtcctgttgctaggaagcctaaggtagatgtatagggagagagtgattccagcctaccctagatgttacagtcattttagcataggggttgaatatgcaaatgagggaggcatttgggccttccatccctgacagatgccacctaaggaagaactgaggtcccagacatgttgtcctacaagagctgtcacagtcatctccagccattcaagtcatcccagctgaggctccccattttcaagcagacacaagctatccctgttgtaacctatccaaactcctggcccaaagaattagaagccaaatacaatggttgttgttttacactgttaagttgtgatatggtgtgttacaccatgtcacttatttcttcttttctgcattgactaattctgaccacacagtgtttaagattcaacttctctatgatgttttctttgatcaccttgaagtaccttaaggattctatttcctgctggtatttctttcctttcctttcctttgctttccctccctcccttccttcttccctcccctccccactccttcctttcttccctccttcctccccccttcctcctcctcctcctccttcttcttcttcttcctcttcctcttcttcttcttcttcttattcttcttcttcttcttcttcttcttcttcttcctcttcttcttcttcttcttctcctccttcttctccttctctctctctctctcgatagagtttcactctgttgcccaggttggagtgcagtggcatgatctcggttcactgtaacctccacctcctgggttcaagtgattctcctgcctcagcctcctgagtaggtgggattacaggcatgcaccaccacacccggctaatttttttttttttgtatttttaccagagatggggtttcgccatgttagctagagtggtctcgaacttctgacctcaggtgatccacccaccttggcctcccaaaatgttgggattacaggcatgagtcactgcacccagctcattcctgctggtattaaactcatcctggctgcttctcacctagaagaatttgatatcctatcaactcatcgtggcttcctctcacctagaaaaccagcatggtccaaatatcttcctttttacctcacagtttttacttcggagtttcaataactagagaaacatcttggctgccaggacaagtggtgtggaaaagccaggtatccatgaccacatagattaaacccatgtaacaggtgcccatcatctcccagaacctcctcagaatactgttgtccccatggctacctgtagggtcatccatccaatcaagaatcacatctgttgttatatatgcttctttcctttactatttttcttggttcttccatcgggagggccatatagtagcctatctgaatctctgcctatatttgtatgtggtctgaagatcaccagctgatttctcttcctattcctatgattgaaggactaattgtatcagattcccagatccaaatggttgacttcttgaggatattttgagcagcagcttctggttttgtaggaaccataaaaagggctttgtaaaattcccttcagtgttggctacagtgggtgatggcaggagtgggagagaggctaagatccagatagcatctgactggcaaagcatcatcccttgatttctttatccacctttattcaattctgaacgctgaaaacaggacaatagtgtgtgatgtcagttgtactgagctttctaaatattccttttagttttctctgagtatataggatttatatacctaagtcttgtctgtttatccaactattcatctacccatctgtcaacaagagtttcaggtattcattctgtgccacatgctgtgccacatgttgaggatacagtaataagcagaaaataaatggtccttccctctcgagcttgccatctaacagaggggtcaggcactctgctgaggatacagtagtaaacaaaaacatggtcctcctttcttcagcttcccatctagtagaggggtcaagtcttaaacacatttgcaaaccgcagttgttgctgagaaaaaaggtggaatacaattctgtcatagcacctaacaaaagaaatccaatctggtgaagggagaagggggtcaggaaaggaagaaatgtaagaatggaggtctaaaggaatcaattaggagaaaagcatgggtatagccagtgatctagatgaggagttggaaaacatttctgtcaaagaccagagagtaaatattttaggctttgtgggctaggtggtctctgtggcaactactcaactctaccattgtagtacaaaagcaaccataggaaatgcatgaacaaataagcatggttgtgttctaataaagctttattctaataaagacagagtgcactggatttggcctatgggcctcccatcccacgctccttctaccacattccttctaccacacttccaccccacattccttctaccacaggacctttgaccatgccattgctctgtctagcaatagcacagtcaaaggtcctgtggtagaaggagtgtgacaaagtttaagtactgtgagaagattatggtgtcacggagctcacagagaaaggggaagtgagatgagagagcctggggaaggtcagaaggacaagacctgtatgtgaagtcaggatggggactttgatctttagcttataaacaatcagaagcaaaagaattgttttaacccagggatgagtggtacaacgtgtttagatttgccttgaaaaggtctccctggctcctatgaaaaaatagactacagaatgacacggatggatatgaggattatttaggagttgtggatcttattcaggtaagagatgatgatgacttggacaaggatggaggtagtggatatagaggaaaatagatggattctagatatatcgaagatgtagactcatcaaaacttggtgttgaactcgatgtgggaggtgagagagaggaacgtgtcaagattaatctatgttacatctctcctgaatgtatccttgctattaaggggaattgaagttttatttcattttcagccccatataattaggatatcaactcatatgattggtaaggtgaaaagtaaatcatctgaacagagatgaatcacaggttaatggatcacgacagctcccccaccctcactggacaacattctcttggcagcttctacacacacctctactgggcataccaagtcatataactattatctgtgttccctatttcatgggctttttgagagtagaaatgccatttcttatgctactaatggttattattttggttagtggaatcttgtgctcacttaacatctgtctattctacaggtgagtgtagatttgagatgtgtttgatgtctggtggggtgggcagttctttccacctagttaagagcatctcactaaaagtcaaccggtgctgagtaactaaacatcatggaacccttttcaaaattatgtaggaagcaacccagagaattatggaaatggtgatgcactgagcataggggctttgcccatccttggccctttgctatttccttctactacctcacatgcagcttttcaatctttgtgatagtccgccctatggctcttccattgactttcctagatccactcccaaccattaatacataaaccagacctcaggttcttgccgtaaacttctactttgaatgtagagatcctatcacaatccagctgagtagatattgatggggtcttctaatccatcagctccttcacacattctgagttccatcccaggatccaggtgatttccagaatgctctgcacttggaccacatttacacagccccatttatagcccactgttttgatgttataccctgagctttaactgatggcttttctataggtcctcctatatgtaagtcttggctcaaagttctggttcttccattaacttgctgagtgatcctaggcaatgagtttcacctctgtgggccgcagtttccctattcatggcaaagtctccaatcacattgtatacaaaatgcagtgaacatttatatccccaggccaggctcctctgttgagctccaggccccagagtccactgccaacctggcatctcttccatgactcaataacacctcaaatcgattggcctagatgtaaatgtccccctcttctgcttcaaatctggccccttcctgtgctatctcatttggcatcatcaccacctacctagagtgagtatgagcagaaaggaagagcttcagggctaaggccggggacacttcaatgattagaggttgggagcaagtacagaaccagtaaagaagaatgagaagaaatggctggggaggaaggcaaaacacaaggagagcaaaagtcaagcaaagaaaatgtttccagaaggaggggctgcgtgataggtccatcatgtgaaactaggttcaagccctgggcttggtttctcggtagctatgtgaccttgagcaagttacttaagttctctgagcctcagtttccataacatgcctcatagcattgttgagaatattaaatgaaatgaggcatagaaagtgctttgtccagcaattactcacaaaatgttagctagtagaattattatctatgttttcaactcatcaagtctgtagctttgagcagagggggggaaattggtctctaagctcagtttattctgctacctagcaactatatatttacatcgtcaacatcacttctttatccctgattactttaacaagcactttttaagtgctctgttataattcaagaccacctgtgaggtgtagagaacaattctattttcttctcaagatgtagtggcctaggataaattgtcaaaaagcaacttcagccttgtaactttactgaggtctctttgaaagtgtattgaggaatgcttgggccagctgacaatgacagtgaaggtctgtaactgataaaatgcactctgcttatctacaatagaaagctggatctatacaactcaaagagcatatgaagctgggttccaaaatcacacaaggacagctgacactgggatcactccaattcccaagcaggttacccttcctggaaagtgaatttaaatgggacacaaatgtgaagtcctttccaaggaggctccagctaccattccagcttcgtctctggccatacattcttgacacagagtatcttggacttcaaacccacttctctgagtccaccagacctcacacctcatatttccaagcttttgccccttccacctgggtcaatctgttctcttgcactattttcaaatcaaaatccatctccttacatcgtattttccaaatcacttagccagaattaatcacttgctgggtgtctgatcagtgtttctgggacactatacacaccttttctctatcatttatcacatttattgaaactaatccacttacaactctcctcttagaggacagtaatatcattggaggcagagaccatgtcttatttatctttacaatccctaaaatgcttggcatagagtcggcattcattgaatatttaaaggaacacctcagctactcccataaccaggagatgaaaagtataattcaatttgagaaggttctatttatgcagaaatcagattaggagtctacagaaaatattacatagaagacaaaccattgttgactgtacttcattcctttgaagggtaccgtgggacaaaactagaacggtcgtgtccctaattaaaggccacgggcccaattctagctggttctacttgtgactcattgagtgatcttgggaaaactctctgcaactcaaatgttcatttttaagatgagaagtttggatcaataacatctaaggtaatttttagttttagtttgattatgtataactattatatcttttttgagtctaatattcttctctaaaacttgtcttaatttaactccttagtgtttgtgatggaaaattggtcaactttctcaaggctgcctaaatttccattttgtaactgctaaggaataaacaattccattcaactttgggttgccaggaacttaataagtgtgtcctttaatctgtcagctaagtggatgattgcaaaatattcaataattcctgtaagatattcaataaaactggagggggcaagcttgtaacattcaattcttctcccagattcaatttaatcttggagcaacctgaaaatataattgttcctgcaaacaggatttttgcatctttgagttctttttcacaatgctctgttgagctctcgatttcagtgtgtgactcatcattgcttttccttgtaaatttccactccttccatcctgactcttagattgttcactgttcagacaaaaggagacaaaatcaaagatacggttgagattcccagattcggggaccctcataactattaatgggctttagcacccttcaggtccagtactcctatggcaataacctcttagttcatctacccagggaggtgagctagagccttcctctcccagagaggccataattctactatcatgaaagacagctttgcaaataaagaagaagggcttgagtctgacagtcctgggcattactttgagctagtgattctctgaatcacctggaaggcttgttaaaaactgattgcttggccctaaccctagagttttgggttcagtaggtctgaggtagggcctgagaatttgcttgtaacaagttcccaggagatgctgatgctgctgttctggagatcatgcttcaagaaccactgctttgagcagatgactcagtgtctgtggccttaagtttccttgtctatgaaatgggaataataacatctacagaaggcagcatggaggagtagtcttggactaagggcctcggggtgtcaggctgacctaggtttgagttccagctctgccatttaaagctacaaagccttaggcaaattccttactattttaaagcctgtttcctcacctttaaattatcaggtataatcataacacttacttaattttcccaccataccaatgagataagaatgcttatacaatataaaacactcagcacgtaaatgggcatataattaatgctctgtatataataactaggatcataaatattaacaatgtagtaattcctacatttcaaggccccagactaggaggattaagtgattggctgacacaaccagaaataaaaaaaaaaaaaatagccctgtaggcttggcaagcagggtcaaacctaacaagaaacagaacagacaaaatgtaaaatctttgatttgggccccaaaagtcatcttcatctgggctgactgaggcagccctagctggaagccatgatttctacattaggcagtcacgtgatgaatatttagaggttaattaaaacatgagtgatatattttaaacccaggtttaggatcagagtgagggtgatggtagctctctgaactcccagtgactcagcccaatgtagagggtcatggttgtcttggaaaccacacattccgtgggcatggaccaaatggagacagaagggtcaaaagagattttgagcagactgaaaaacagaaatttattccgaggagggctgatggctgatgcagtgactgtttagcctgagggaaggacctgggcacagaggtagctgcagtcaaatagctggggagggtgtgggtgctgcaggaagagaagcactgattccattaccctgtgtgacaccagagggcagacaaaggccagcacgtggttgctgactaatacatggttgtgtacaaaagcaggaatgaatgaagttacagaggacagattttggcttaattgaagagagaatacattatgagaaaagatggaaccaggtctgggcttggaactagatctgagtgtgaattccagctccatcattcattcattcatatattcaaacaagtactcaatgagtatctgatgggccagagagttgggcaactgtcattatgtactgatcaacaacaatgaggggtgggggatttaggatgcagtgtttaatacagctcttagcttggggtcatcaattatgccatttatgaaatcaagataatgattcctaactggttgcattgttttgaggatcagagacaatatgtgaacagcacctagcaaaatgactgacccagagagagtcccaagcaaatgtagcaatccttgacatcacacaccatcaagtcaagagtttttgccagagaagatcagggtcaggccagttttcccagagacccatttcccagccagctggccattttcctgaaagggttaaggaatctttacaaagagtttaccaccaccccagccagcctctattgttttaaaagccatgatccgtcttccctatttgaattgctttagttatataacatgttcctaaaataatctggctaaaattttgcctggtacttccttctgcctgcctcatctctactgaaccatcccaagggagtaccaagcctgaacattctctgaactgcccacaaagaaacccttttatgaggtctgtgtggtaaagaacaggaagaatatcaggtttcagggtccaccctcctctttggcagaaaatacctcttaaggtgactgtgtgctggctgcctggtatattttggtcatgttgggaggtacaaagtcagggaaagggtcctgtggctcttcgtgtaggcttccattgcacaaagtcctgtaacaaaggttctctttcttgaaccatttgtctccactgccaggctgcaagctctctgttaggcaggggccattctttgctcctctctctctataactacccagggattggtctagctttgggatgcgtaaggatgggactactggtctgcagtcccactttcctaagagggtcctagtaggatgattccggcagaacctgtctgtgcgtacatccacttggcagctgccttcctgaggcaggagtttcagggaatagaggaaccagtaagaagcactgttctcccagccagaaagtctatttcaccttgatttcctgtctctccttcactcgccttcatggtagagagaccgctaaaggtcaaaggaaagacaaagttgcttggttttgaaagtagaatatctgctctggggtccagggcccattatctatttgtcatatgacttcaagaagatcttttaatatctgagagcatcagtttcctcaactgcaaaatgaattcgataataatcatatggactatacagggttactgagagaatgactaagactccatatttgagcatgcttatcatagtacctggcaccttgtgggaatctgctaggctccatgccagtacctggccccaggcctctgttcagaaaacagctgtggcagcagcttctgcccacatggtagaaaagccagctgacctatcagtaaggaagtgaagttctccctttctcccggctgtcagtgaccttcctctgtgagactggtgaatgttgggctaccatccacagtagaggagaaggaacactgatttaggagtcagagagccttatttgcttctaattctatccctactctttcttcattgtgtgactttgggcttatttacttcagttctctgaagctcaattttctcattcacaaaataggaataatatctaatgatagggttccttgggagcttcagagtggaatttatataaagcataagttttagcacatagtaggtgcccaataaaagttatcttcttctttgggcattttctactagaaatcccagagccaaagtggaatttaaaattatcagagcgcatattttagattacattttaatgtaatatagttatatttcaatatatcctggtcctgaccttcacattttcctgatactgattatttttctcactattttttaaattgtaggttcttttattggatatatccccaaattctttgcagaatgagatggatagactctaactgaaatcaggagagatgtattctcattacgactctgcaatatatgtatgatttgggccatgaaagctctctgaacctcagtttcctcatctgtagaatgggaataattaaaaacctactagctaccttattcctacaggaataaggaactattgctgcagtggagcgttttgcagaaagacttcgtaaactatgaaaggcttacaagtagaaccatgtattatttgtgatataatacctcattttattcatctttgaaactacctctctccccagaccgtgccacatggcttacagcacaggggtaggcatgtactgagaaaaagtccattaaatcccagctccaaggtgacacttagcagagagctagatggcccagtgtctgtctgatgacccttagagaaggactgcctttaccttccagacatggaataattcaatagagggaaagcataaaaatcaggacggagttaactcatggtacccagtaggcaagttaatctgtcaaatgccattatgggaagagcagactaccaagtccccatatcacaggaattcaaaaggaatttattttgaagcatttttgtttggactgaaaatgaacaagaagatgacatgtgaacaaaagagataaagaagaagatttaagcaccagaagaaagacccagaaaatgatcccagtgagcaaaagatcgcagagaaaaataacaagtacacagggcagtaagatcaaaatcagattacttaataaaagctagcatttctctaaatggaaaacaatgcacgttgtttgtccttgaaatgtgacacgtactcctttttcaagaataccaaggcactccaaagcaatggcccatatctgacaaagccccatcaccctagagccctggaggtcattgttcctatacaatattagaaggtttgattgaatagatgtcacagaacttagcagtcacttgaaatagaaaaatcaaacaccgcatgttctcactcataggtggaaattgaatagtgagaacacatggacacaggaagggaaacatcacacaccggggcctgttgtggggtgggggatgggggagggatagcatttggagatacacctaatgttaaatgacgagttactgggtgcagcacaccaacatggtacatgtatacatatgtaactaacctgcacgttgtgcacatgtaccctaaaacttaaagcataataaaaaaaagaaaaaagaaaaccccagaaaataaacctatgcagggacaggtagaatttgaattaggctagggcctacctggtcaataatgaaataattgctcaaggcacgttcttctgtaatcttttgcaatgtaacaactattctgtgccctacctctcaatgctgcctcaacatttgtacataatctcagggcctcctaaagacaccgattcagaggccagacagtcacttccctaatgccacaaaaatagattcaattctacatacatcagggtgatttcagaagcaatttctcatctccagtgtaagcattacttacatttttccccctcaaatctcatcccagtggttccacagggcattttaaaggtacctgatgcattctagggcagtcaaaagatcctgagagtgtttttgtagctgtagcctgaggacgtcagatgcatagagagtcctaacgtattcagtgattcagactaatgcagaattttctaataattgagtataataagtcaatcattatttaaatattttagaaagcaatattgttatgatgaatgcatatatacagtcatatatgtatatttgtgtatatatgactgtgtaggtttatacctctctctgtatatttacgtgtctgtgtaaatataaaacacatatgcacacacatacatacacaccttaatcatttgaaaagtttgtccctggcctttaaaacatctaattagatttcactggatatttctcctcttcctttatggcaagttaaactatttcagtcttgggtgttttcatcttaagggtctaagttttggcccatagcgaacagtgacaatgttatcctttgaaacataagaaatcagtattacccaggtttgcatttgagatcagaaagattgagaaccaatatctaaaatttcagggtcacaatgattgtcaagaagttttggccataatcattttgcttttaagagtcctcccagggtacttttacaaatggaaaaaagtgcacaagaggctggactggacagaaaaggatgaattggtattacttgaccagtattttcaatcagatgaacttgcaaatgaacttctctgccccagagccgaaagcaggggatccagtgacaacttagcatagccagagactcagtgagctcctgatgagcctttctctttttttctattattattaattgacactaattatatacatatttatggggtatagtgtgatacatgtatataatgtataataatcagggtaattaatatattaatcacctctaaatttatcattcctttgtgttagaaacattcaaaatccactgctttagctatttgaaaatatacaataaactgttattaattatagtcaccctacagtacaatagaacattagaacttattcctcctagctacctgtaattttgcaacagaggttggtttacagatgcaaaattatagctaggatgttcctttcttttaaggaaaaatcaagcccattttcttgtcaaccctggtctatgtcaacaaccaatttccctgcttctaggaaatgtatgagtctcagtgatttatctggattgaaaatgggaaaaaaaggactggcttcatggttaggcaaaccgcaaatttgctctgatccctaagaaaaacagatgttaaatatttgctcataatcagtatgtgccattagactttgtctttaaaagccattatctaaccttaagaagaactcaaacttaccatcactggtaatgtgcaaagcggtatgatatgtccattaataggatgtaaagggaagtacgtcatatcagctatgtcatatttttgccaaaatgtgtaacctgaatgttatcatgatgaaaaaaattagacaaatctggattgtggaacactctgcaggacgacagccctagactttaaaaaaatgtcaaggctgggtgtggtggctcacgcctgtaatcccagcactttgggaggccgaggcgggcggattacgaggtcaggagatcgagaccatcctggcaaacacggtgaaaccccgtctcgactaaaaatacaaaaaattagccacgcgtggtggtgggcacctgtattcccagctacttgggaggctgaggcaggagaatggggtgaacccaggaggcggagcttgcagtgagcagagatcgcaccactgcactccctcctgggtgatagagtgagactccatcaaaaaaaaaaaaaaaaaaaaaaaaagtcagtatcctgaaagaaaaaataaagttgagagggctgttctagatcaaagaggataaagacagctgaaaaccaaatacaatgtgagcgctctgattggatcctggattaaaataacaaacaaataagcaatagagaacatttggaggacattgaggcaatttgactatgaactggtatattagatcactgaagtaaggttatactttattgtggttatgttgaagaggtatcctagttcttaggaaatacatgctgaattctctggaggtaaagtgtcatgatgtctgcaacttacttctaaatgattcagaaaattttgaaaaaaaaaacatggataaggggagaaagagagagagggtgagtacagccaagtgcaaaagtgcaaatgttgcaaaatggtagcagttggtgaatctaggtaaagggtatatgagtattcattttgctgtcttctcaacatttttgtaggtttaaactaatctctcttcccaaagacagtacatcagtatctaagcatagctattgcctctgtccaagtgctgtattctaaatctgggtgcctatgagaactctctgaatgacttacaaaatccatatccctcagttgggccccacctctcatcccccaggagattttgattcaggagataaggtgtggggtccagatatggatgtgttgaaaacctccccaggtaggttctgtgctacactggagcttaggaatcatgggcctgagttactctcagatctggatccattaaaaacaagctgtgtggctctgagatggctggccaaacacacttagcattgcatagcttacctataaaatgggaacaataatactaaggatcttacaggactatggtgaggatgagagacagtgtctacattatagaaggggataaattttttctttctttctttatcctctcatagatccccatcatcccaaactgatcatctcttgagtgattttttacaaaatggaggttcttccatttgtagcttacatggtatgtggaggacatctgtgttatgcacagattctttgagacttcttgcattacccaatttggggaagaggctgggaaatctagtctgttaactgtctgatagaatggctgtaagaacagaagcaagtctgtccacaaggaagccttagatgttggcagtcttggagttcttcttaggataagggttaaccctgatatcttaaccacccaaatcttgggatcctttattaacactgcacaaggactcaggtgcccttgaccaatgctacttggaacactggctgtggtggaactggcaaatgtttgagggatgaggcttccaatctaaatatgtaactcatcagccattgtattttagataagttgcttctctgagcctcagtttcctaaccactcagagtggagacagtcataatctgtgactcacctaccttatgtggtgtatatgaaacacagatttgaaaatcttaagccactcaattcagtgtggcatatttttctccttaaggacataaccatcctcctcctctttcttttttactgctattatttttaacctgtctctatttatgtccacaagcagttaggatgacttgctcccatttccatctgatttggggaagattttttaaatattccttttcatcttaggatgaactgccccaagtctttgtcagggagaaccttcatcccagtccatatcaggcaagcatccataccctatgcctggcagcacctgatcaatgtgtggggttcacagcagaagtactagggctgagctggaccacggatgtccccttcccctttgttggctctacttactgaatccgttgacgtcctgagaactagaagagaagccttcatcattgcggctggcgctgagcttggtggtgggtttgtcggcagaggccacaggccccatctccctctgggctccactctgggtctccttctgcttcttggccagcttcctttgggacatgtgcaaggggaaaaaaccacagtcagatggtgccagttgcattaaagcattgggtagattgttcttccccaatgctcatcctcaacccccaaatctggttcattctccagaaaaagaatcaaggcagaacaaaccatgaatggtttccatttactcagaaatatgagactcacgctgctgcctcacccccgacaatgcatgtgttctatgtttgagcctaaaatgggaaatcaatgagacttgtacaatgcttcccccactctcctttcagaggaaatcaacaagatttgtattcctttccctaagtctcctttcagagggaggaagtggctagactggcctttctgtttctgtggctctgaatgagattaaaaatggaggcttgtctttctcaggaactgagctcatcaaaaacctaccaaataatagtagagtgaagcaggggctggtggttggaaatggatgagtgtgcgggttagtttcacagctcaaaagaaggaaatttagagctgaattgatgcaaccttattcccatgggaataaaagaccctcagaaccagacggatattatcataatataactattatgataataatagtgtagagcagtgcttctcaaactttggtgtaaatttgaatcacctgaagagtcacaaaaaaatacacacacacacacacacacagaggctcaggatcattgaagtaggacaggacctagaattctacatggccatcaagttccccaagttattctgacaccagccactggaggttaaaaatatcagctttggtgtcagacagactcaggttcatagcttacctctgctgcctgccaactagctgcaagacccagggcaaatttcttactctaaatcctgaactattcttctgtatactgtggcagatgacaggaccaaccttatagggttgtgaggattaaatgagacaatgcataaaatacacagagcacagtgcctcgcacatagtggacactagacacctagcagttgctattcttgttttttctactattgccagtggatccaactatattctaatgttggaattccctccccaacagccccactgtgggatcccatctctccctgaattctttcaaatgatgtggactttgacctcactgaggaactaaaaagttaaaaagttcttttctatggatttaaaatctatgtcctttaaattttaactggataggtctcagatatatcattagagatacaaaaatatgactaactcctcttgcatataagagttattcaaatatttcgaaaaagcgaacatggtccctctttttccaacatatatgcatcgaaatatagctgttatagtcttatcacatgaaaggctataggttaaacatcagatatcttgagagtaaatttctccaagtctcttactccatccttcacaacagtaggcttcaaattcaattttggtcattcctgtcctgtctcaacacacaaaaagggctgtcccagagaggtcaaatccagtgcaatacagggaataattttccaaggttgagccccactgatcatgaaacagatagtttcaagaggtaacaatctccctgccagaggaagtataaaaggaaaggataaacctcaacttaggctgggaacagtggctcatgcctgtaatcccagcacgctgggaggctgagctgggcagatcacttgagcccaggaattgagaccagcttgggcaacatggtgaaaccccatctctacaaaaattagccaggtgtggtggtgcacacctgtgctactcagcaggctgaggtgggaagatcacttgagagcccaagaggtggaggctgcagtgagccgagatcacgcctctgcactccagtctgggtgacagagtgagaccccatcaaacaaacaaacaaacaaaaaacagaaaagaaaagaaagacccaaacctcagcttagaagtgttttagaggagttcacataggacaaattccagtttgatagcatcctccttgaaacatgaatctcatgctctaggtgtagacttcacagaagaatgacagagggcatactcaaatgaggacaatttgaggaaggtttatttataaaaggtctgctgataaaggtgacaaatgtatagagacccataatatactagtgcctcagtaggagagctgtttattacctatgggaccagaggaacaaatagaggaagcagtaaccagagccccaaagaagagagctgtgaaaaggaggtaccctgaacagaagcagcggctttctcttgaaaggcccagccagtcatagacaacctgacagggagagaaccagaggcaaaaaaaaaaaaaaaaaaaaaaaatgccctgactacaccttatgcccttcctctggtcgcctgtggcagttctcactagctgaacccaacaagtcagaagtggcaagtgatctttttgacagacttcatacagaatgcactctggaagcagagagcacagtagagaaaggtggaaaggggaactggatccaggaatcccaaccaagaagagaaaagttgcgtgtgtgtgtgtgtgtgtgtgtgtgtgtatgtatgtgtggacagtgtcttattctgttgcctacactggagtgcagtggtgcgatttcagctcactgcagcctctgcctcccaggctcaagtaattctcatgcctcagcctccagagtagctgggactacaggtgtctgccaccgcatccagctaagtttttgtaatttagtagagacagcgttttaccatattgcccagggtggtcttgaactcctgagctcaggcaatccgcctgcattggcctcccaaagtgctaggattacaggtgggagccaccgtgcccagccgagaaagtttctttatacgtctcgttttggccataatttggagaaacatgtagcctaaaatggaattctttattcactaatttttttaagttggctcggggaaagaaaggcactcaggaagaggaatgcatcttttcattataatgctttggccacaggcacactgttctaccagtaaaatgattccaggcagatatacaacaagaaatgaagcattggattggtcagacaattagacaggggcgggggaatgccaacgaaagaaaaatgagcaattctgcttctgatgacattttgaaattttattcttcatttattatcaaaaaggagtgtgtttaaaaatgtatatgtgaccttcttaatcataaatttgaaaagaaatatagcagattctttgcttctatctgagctctgctcacattgccccagcaggaaataaaaggaaatctgataagagagttaacttaaaactataaatgagtatgtttcggaggctttgatatttccttaggggcagaactctcaaccaatctcattccattcagggtaaagtaatatggaaagggttgtcttaggcacagatcattggttttcaaaggaatcataataataatgaaagccttgctgcttttatgaaaaatggtactttatagaaatgtttgggtagctctgaacacctgtattaaaaaaagaaaaactaagcatccccaaaacacatatttaaaaattggaaagctaactgaattgtaaaaatatcagatatattacatccttagtatttaaagctgatggctgactctgtattttcatggtgataataatgttatataatcattttaatgtatggatagatgttatggcaattggcaaagacagctacaaggtggaaatggagggggtatttgtggaaggaaataaaacacaaaaccacagtttggggatctatatctattctttcagaattctgaatttaagtgttaaaaagacctctcagtaacacagaaaaattgacattcatctccatagccaaataatttaatttactacctcattatttttctctctcaacgaaagagaaacccaaatctgtgaatagggcaaacaagacccttaaactaaggactgggcttcaactcagtcttattctctgcacataaccttatcctcccctttcagaaaacatcaactacctcctcccaccacactatttctcaatactccatattccttgatgtgtccctcttcttctccactggtcacctcctctttgtcctccaaggctcaatgtaagtgtcacatctcctctgaggcttctccctgctcttctacatagaattataattttctcctcttgcttgactcatccattgaacatgtacatgtataagtctctgctaaatactagaagatcatgtcttcttgaccttaatccacatggaacatgaagactaatggcaaagacgggcattaaacagataaatacagagacaaaaatcacaaagacgatgaacaccaagaagaaatacctgttgctatgtaagagctagaacctggtttgaaccctggcagcagatcagggagggttttggtgccatgttagctacgtacttgttgagtcaaattgcagtgattcaactctttcacctactacgacaagaacttcttgggaaagggcttttgactctttgcacctactccaatttcttgctgagtgtctggcacatggctcaataaacttgttgcacgaatttatacttaaaagtctgcaatttggagtctagaaaagatagtcctcttactctgaacacaaattacaaccactttaaaagtagatacgtgcaaagaaagagaaggaaacgcctgcataaaattagctggtgacctggaatattcgtaactagaaatattttgggcggtaacttagcatttccttcttggaatgtttgcagaattaacaaaatattcatgggagtcagagatttcccccgcagagcccacaaaatagctgcagctatagcatgttgaagaagaaaaaaaaaatctcatgcaatagtcatatgactcatgggatgatcatataattcatggaattctcagagccttcaaaactcaagtacttatgactttctgaactgaggatttttttctgtagttgctttgagatttttgccaactgggtcacacaatttcgccagcagggggtaccaaaagctgataaaaagagagtatgcataagtctgtttattcctttgcaggaacatttccaaagctgaagactgttttaagacacagcaatccaaagtttactgcttctgacaggtgaggacgaggtgacgcggccatagctcttggcattttccttctaacggatcactttgagctctctctgaccttcgcttgttagctgagggaggggtaggtggcaggggatgggcccaggatggaccatgagtcctgtgatttgttctgagtgccactctttacaagggatactggcaggtagaatggctcacgggagaggaatgaagggctgttaaaagtgtggaaatcatgctacgagaggaggagtgcgtgaaacatccagggacatttctcacggagagggaatacaaagtaacgttctcttcatgcatctgatggttgggtctctatggtcccaggggcagaatgaggaccaggttggcttgatacaacgaaggaatttctttttttttttttattatacttttagttttagggtacatgtgcacaacgtgcaggtttgttacatatgtatacatgtgccatgttggtctgtggtggggtggggggaggggggagggatagcattaggagatatacctaatgttaaatgacgagttaatgggtgcagcacaccaacatggcacaacgaaggaatttctagcaaagtagaactgcttaggtctcttttggaagcacctaacgcctgaattcccctccccaatttttctggtttagcaaccttctcttcaccttttaaggcccaactcaaatgtcccctactcttagaagtctttgcctccttcccaaagttagaagttccctcctctttgctcattaatttgttggacaaatagttaatgagcaagtacgttgaatctgtggctgttagaaggaaggagatgatgatatgaaaaacaagacaggaatcctgccctgtttggcttttgcaagtactcagctccctgctattggagaagttcaagtagagactgggaaaccacttagaaaagaggtggtggaggatcccaggatttggactctgcaaaacccttgactctcttctgggctaggaacaggaccatccagccaactggtgggggcaggagtctacagggttccacctagagtttttccctgaatgtgggagccatgcccactctcctggggagacactgatcaggcactcttcctcttccccatagggctcctcctctgggccatcctccattgcaatctccagataaactttcctggaaaccatgaagattgaaatcctggagtcagagatctcagccataggaagtggaccaaaaaaaaaattcacaagtgaggccctgcttctactaaaagctggcactgtcctctttgaatccaggatgctctgctggcatgactagatctcagcttaaagttacacatcgcaactgtaagggaactatagcatcttctcatttcatagacaagacactgaggcctggacagagtagtcccttagctaagatgcacagcatgtaggatgcaagccctgctttctgcctgccagttcaggaatgtggacacctgctccacattcctccatgcttcttctagggatttgcccttccagattagaagggcaaattcagtctgtggtacacatgattccagtgtcttacaaatgcagcaaaactttattcatctatgcccccactgactcagaattactgtaattgaggcaaaggctgagctacatcacataagaatcaatagtgtagcagggggaggagccaagatggccgaataggaacagctctggtctacagctcccagcgtgagcgacgcagaagacggtgatttctgcatttccatctgaggtaccgggttcatctcactagggagtgccagacagtgggcgcaggtcagtgggtgcgcgcaccatgcgcgagccgaagcagggcgaggcattgcctcacttgggaagcgcaaggggtcagggagttccctttccgagtcaaagaaaggggtgacggacggcacctggaaaatcgggtcactcccacccgaatactgcgcatttccgacgggcttaaaaaacggcgaaccacgagattatatcccacacctggcttggagggtcctacgcccacggagtctcgctgattgctagcacagcagtctgagatcaaactgcaaggtggcagcgaggctgggggaggggcacccgccattgcccaggcttgcttagataaacaaagcagcccggaagctcgaactgggtgaactgggcggagcccaccacagcacaaggaggcctgcctgcctctgtaggctccacctctgggggcagggcacagacaaacaaaaagacagcagtaacctctgcagacttaaatgtccctgtctgacagctttgaagagagcagtggttctgccagcacgcagctggagatctgagaacctgcagactgcctcctcaagtgggtccctgacccctgacccccgagcagcctaactgggaggcaccccccagcaggggcacactgacacctcacaaggcagggtattccaacagacctgcagctgagggtcctatctgttagaaggaaaactaacaaacagaaaggacatccacaccgaaaacccatctgtacatcaccatcatcaaagaccaaaagtagataaaaccacaaagatggggaaaaaacagaacagaaaaactggaaattctaaaacgcagagcgcctctcctcctccaaaggaacacagttcgtcaccagcaacggaacaaagctggatggagaatgactttgacgagctgagagaagaaggcttcagacgatcaaattactctgagctacaggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcagggtattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactcagcttcataagtgaaggagaaataaaatactttacagacaagcaaatgctgagagattttgtcaccaccaggcctgccctaaaagagctcctgaaggaagcgctaaacatggaaaggagcaaccggtaccagctgctgcaaaatcatgccaaaatgtaaagaccatcgagactaggaagaaactgcatcaactaacgagcaaaatcaccagctaacgtcataatgacagaatcaaattcacacataacaatattaactttaaatgtaaatggactaaatgctccaattaaaagacacagactggcaagttggataaagagtcaagactcatcagtgtgctgtattcaggaaacccatctcacgtgcagagacacacataggctcaaaataaaaggatggaggaagatctaccaagcaaatggaaaacaaaaaaaaggcaggggttgcaatcctagtctctgataaaaccgactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaattcaacaaggatacccaggaattgaactcagctctgcaccgagtggacctaatagacatctacagaactctccaccccaaatcaacagaatatacatttttttcagcaccacaccacacctattccaaaattgaccacatacttggaagtaaaggtctccttagcaaatgtaaaagaacacagaaattataacaaactatctctcagaccacagtgcaatcaaactagaactcaggattaagaatctcactcaaaaccgctcaacgacatggaaactgaacaacctgctcctgaatgactactgggtacataacgaaatgaaggcacaaagaaagatgttctttgaaaccaatgagaacaaagacacaacataccagaatctctgggacacatttaaagcagtgtgtagaagtaaatttatagcacttaatgcccacaagagaaagcaggaaagatccaaaattaataccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagctggttttttgaaaggatctacaaaattgatagactgctagcaagactaataaagaaaaaaagagagaagaatctaatagacacaataaaaaatgataaaggggatatcaccaccaatcccacagaaatgcaaactaccatcagagaatactacaaacacctctacgcaaatgaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatagattcacagctgaattctaccagaggtacaaggaggaactggtaccattccttctgaaactattccaatcaatagaaaaagagggaatcctccataactcattttatgaggccagcatcattctgataccaaagcctggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcctccctgggatgcaaggctggttcaatatacgcaaatcaataaatgtaatccagcatataaacagagccaaagacaaaaaccacatgattatttcaatagatgcagaaaaagcctttgacaaaattcaacaacccttcatgctaaaaactctcaataaattgggtattaatgggacgtatttcaaaataataagagctatctatgacaaacccacagccaatatcatactgaatgggcaaaaactggaagcattctctttgaaaactggcacaagacagggatgccctctctcaccactcctattcaacacagtgttggaagttctggccagggcaatgaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtacaaaaatcataagcattcttatacaccaacagacaaacagagagccaaatcatgagtgaactcccattcacaattgcctcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagttaccaatgactttcttcatagaattggaaaaaactactttaaaattcatatggaaccaaagaagagcccacatcgccaagtcaatcctaacccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctctctaataaatggtgctgggtaaactggctagccatatgtagaaagctgaaactggatcccttccttacaccttatacaaaaatcagttcaagatggattaaagacttaaacgttagacctaaaaccataaaaaccctagaaggaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacgggcaacctacaaaatgggagaaaattttcgcaacctactcatctgacaaagggctaatatccagaatctacaatgaactcaaacaaatttacaagaaaaaaacaaacaaccccgtcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgcggcgttattcacaatagcaaagacttggaaccaacccaaatgtccaacaatgatagactggattaagaaaatgtggcccatatacaccatggaatactatgcagccataaaaaatgatgagttcatgtcctttgtagggacatggatgaaactggaaaacatcattctcagtaaactatcacaagaaaaaaaaaccaaacaccgcatattctcactcatagatgggaattgaacaatgagatcacatggacacaggaaggggaatatcacactctgggaactgttgtggggtggggggaggggggagggatagcattgggagatatacctaatgctagatgacgagttagtgggtgcagtgcaccagcatggcacatgtatacatatgtaacatgtaactaacctgcacaatgtgcacatgtaccctaaaacttaaagtataaaaaaaaaaaaaagacaaaaaaaaaaaaagagttcaatgtgttgggaagtcacaaagtataagtaccatgctagtgctaggaaaataaagatgacccaattagtcttttttctcaaaaaaaaaaaaaaaaaaaaagaatcaatagtgtaaatagggatatggatgtgtgcagcatttaaaggagaatgcactgttttccctcgtatcaggaggcaggactgcatagcagttaatatactggctttggtgccagacagcctggcatcaaaatctggctccatgtcagactagctgtgcaagctcttgcaagttactgagccctctgcatgccagtttcctcctgcctgtaaaacacggattagagtagtacttcccccgtcagactgttgggaggattgaatggtatgttgctggtaaaccactttgcccagggtatgcacacagtaagcactcaataaatgctctctggtatgatcatattttaaatacaaaaaaatccatgttagtttaaataacctcattatttattaaatatgaatactttgaagtggatgccctggataatgacttttctttaaaaacctccattgatgcagtctagagccatgcttttcagctttggctgagcacatcatttggggagctttaaaaattaccagtgagattctaatttaattggtctggggtgcagcctgggcatctgggcattcagaagctttccaggtgattatagtgtgccactaagcttgagcaccaccgatgcggaacagctgttctccaagtgtggtttccctggaccagcagcatccgcttcacctggggatgtattagcaacgcaagttcaccggccctgccctgacctactgaatcagaaactctaggtgatcaataagccctccaagcaattctactgcatgccaaagtttgagaaccaccgaagtaggtgggcccactcttcagcaggtctgaattagtaaagtttcattcttgaaaatggaacactagaaggtaagagacccgggtgccgggtccagatctccagatatctcattgagttgccgtgaacactccctttcccctctctgtgtattgatttcactatagtgggggagttggcatctaagaatcatggcaacaactgatgcttttaaaatgattgttatggattgaactgtgttccactcacccactctctggccgcaaaagatatgttgaagtcctaatccatagtacctgtcaatgttaccttatttggaaatagggtctttgcagacgtaacgaagttaaaatgaggtcactagggtggctctgattcccagatgactgatgtccttacaaggagagggaaatttggacagaagtgcactggaagaatgccacatgacaacaaaggtggcgatgggagtgatgagccataagccaaggagcacggaggactggtgggcaccaccagctgccaggaagaggcatggcaccattctatttagagtctcagagggagcctgacccctccaacaccttgattttggatttatagcttctaaaattatgagaggacaaattttggttaagtcatctagtttgtgagacattggtacagtagcctgaggaaactaataaaatgaccataattcctaaattgatgttatttgtttaataaacattatagagtacttattgaataccagccactattcaaggcctttataaacagggtattaagttccttaattctgctacaacaccgtgaggccaggagtattattagttccattttacagataaaagaattgaggcagagagagttgaagtaacccatggaaagccacccaggctttcagaggcagagctaggattcaaaccctccagtcaggcttctaaatgttctctaagattccctgttatgtcacgcttaggcaaaaagccatcacatatctccccttgtcctaaagctttctcagctgtctccctttctccccaggcaaacacacactcacacatatgcacatacatgcatagacagctgcggccagaaaactcactcacaaccactcatgtcctgcaggcaatgagcatcctgtctgctcactgcctctgttgggtaccaattctggggcatagctggtgggtcctttccctcctgccccatcaccctcatctagggcttgtgaatcccccagcatggcaaagttacagaagcaacagcagcagcaacagcagcagcaacagacgtcatgacaatttgaaaggccaaaggacttggtcttctacttccattgctttgctatcttgctgtccatatctgtgcctctatctgtctatctctgcttctttattctgcctgtgactacctctctggcctggatgggctctcctaccaatcacactctttccacttaggcaatagtcagaccctgttggaccattctctgcacccagcagtgaaatcagagcagcagaaagcccgaaacacaggtgaggccctcctccctctgggtacatggccatactggcccctgggccctaaagcagagcctaggaatagcactgactttggagccacactgcctagactgaaatcctggctccatgatttattagatgtatagtcttgggcaattgctaaacctccctataactcagttttctcttctgtcaaatagggataattataatgaattctcttagcaatgctttgaggtagatactaacttataattatgaaagtacttaactgggatctgtcacctaccaaataagctctacataagcatttgttacataataggtgataagaaagaaaaaagtgcttcaaagcagagtgtgaccagaattcatggttcagacaatgggagcttccctgaatgaatgctgtctgagctctgaacccctgggttggggagatggcccctctgttcttggtgttgcagaaataccatgggctctggccctggactgacttggctcctaacagtggtgtaatcatgatcaggtctccatttctgtgactctgtgagactcaatttcctcgtctatagaatagaatttaatataccctaatttgcagagttactgtgatgatgagaaatgataaatgatgacagttccctagcatggtctttggcatataaagatatgcaacaaatgctagttcttttttatcctccttccttgccccagcaatccgcatgactttttccttgctttcatttttaattttatgtttgatctgcttcccaagatgagcactctagggaaccaaggtgactaatctttcctccctgtagtttcatcttgctctatccatatcctgctcatacgacccgaaaccaaaccagccagtggggcagatgctcttcccctattcatgcgttgaccttcagtttcacatcattaaaagttgtagaatcttggattctctggctggaaaggccctcccagtcattttcccaccctagctaggagactccttgcagcatccccagccagtgggtatccagcccccgactgctgaattccagcaacccaaactcatcacctctgtgggcagctctttaacagactgcagctccctatatagggccattccttgctgagctgaggctgagctgaactctgtctcctgaaggcctcaccctttagatgctcctcctcggtctgtctgctatatcccaacaaagcctgtatgtggatagatgatgaccatgaattcttcaagctttatcccaagcaaccgcttccaagcagcgtctcctggttgctgaggctttatggctatttccctacagctgagtgaacctccttctccgttccacactcacatgcccacatctcttctcagatctcaaaccaggactccagggtgatctccctctcaccagctcacaactgcctcctctcaccctgaccccatcttagaccttcagttgccaactagaaacatcatctccttcttgctgaatggctaacttacagggctattgccctgctagactataaccacaaggacaacaacctttttggccttgttcactaccaattccccagggccttacatagattttggaacaagcgggtatcctgtaaagacctgttgaattaacatattaagagatgatcacaagtccttcaaatcccattcaaatcatcacttctttcaggaagccttttctgatctcttcgtgatagggtaggccttgcttctgttttgtatcccagtcatttgcctatcttctctcatcacttttcattataatcaaggtacaaaatatacatatttgcgtattgtatttgtatttcctttagcacatagtttagcacttcccacaatgttgtaaaagctttaaacatgtttatggaatgaatgaataaattgagtgacactttccattcctttattgttgcatcgtcccatatttgagcttccccgtgtctacgacttgacccttttcatcaatttctgcaccaaatttctgtatttaagcagggtcctacttactattctacaagttggctttcttctgcaggtagtgcatggcaatgattctcagacttgagtgtgcatcagaatcaccttgttaagcaggcattgttggtctccatcaccagtttctgatttggtaaatcaggggtgagtgcaaaaacttttcatttccgagttcctaggagacgctaggttctatattttgagaactactggtctatggaatgccatcttctgccccagaggggatcacataccatttatcttccaacttttcttcatcagtcacctcaaacattacatccaggccaggcgcagtggctcatgcctgtaatcccagcattttaggaggctgaggcaggtggatcacctgaggacaggagttcgagaccagcctggccaacatggcgaaatcccgtctctactaaaatacaaaaattagcccggtgtggtgacacacgcctgaagtcccagctactggggaggctgaggcaggagaatcacttgaacctgagaggcggggaggttggagtgagccgagatcacaccaatgcactccagcctgggggatagagtgagactctcaaacatacacacacacacacacacacacacacacacacacacacacacacacacagaacattacgtccatcccccactccaccccaaaactgtagatgggcataagaccatctatcctttaatccacaattcccatttttctagaattttatcctaaggaaataataagaaggaaaatatacatgtatcatgtaggtaccactggaaacacagcttcctctatgccaggatttctcaacctcagcactgttggtattttgggccagataattatttgctacgtatgtgttggggagttacctagtgcactgcgggatgcttagtagcatcctccttggtttccaccctctagatgccagtagttccccctactcccaggcatgtcaataaaaatgtctctagacattgcaaaatggttttctttttgggtaggcagaattgcccctactactggcatagttaggtaaatgtaacagtttaacatttagcagatactaccatgtgcttagtattttaaacatagctccgattttcacaacactaacaaggtagtgattatttcttttgttttataggtgaggaattcagggcccagaaaggttaatcctaaactcgtaaaacaggtaaagggaacaggtgggatttgagcctagctcttcagcctgctgagagcatgctctcctcctcacccaacttggctgcctttctttaatagcaaatgatcggttaaagcctcgtaaatgtctaacaatagggaactggttcagtaaattatagtgcatcccctggatggaatattatgcagccattaaaatgatggagggccattaaaaatgaaaaccatgtaacgacatggaaaaatgctaactggattacattaagttaaaaaaactagaaaataaaaatgtgtctacattgtgattacaacgatgaagaagtatatctatgtgcggatggctcatgtgttggattgaggatattaaggataattttcctttcttctttgatatccattattgttatcagagtgtcttcatgatcctaatttctaagtagtagcagagtaatgataagattcaagatgttaggtttgccctaggcccttcttccacctgaattagaatgaagacttctctaaactctgactatagcaaggggttgatttacccttactttccctcctattagcactgttgcatgtatgtttgtgaccccaggcccctctccttgcactgaccagcttctcccaagcacagaaagctggaagcatagaagaaaacaactctgaaggcattggtgtgaatcactctgggagccagggctattaggaacatacagtcttagagtagcagatggcatctgtctgtcacagggtactgagcggtgcactgtctcatgcattatgcatcaagagtggcctagcaccctggcccggctgtgtgggacaagtcttgcaaaagaaacatctgatgaactgatcgggatgtcaaaatgtcattaaggataaattaatggatgtgttactttggctgtaagaggcagtgccagcaagacaacagacagccggtgggctgttctccagcccaagacagacggcgtttgcaatggagattcatggtctttatgcaacgtgaggtgctttgcagggagaagaataaacagaaatgctccagcacttaagcgccataaaatcacaagcatgagattaattaattagtgtacactaggaaggcggctggtctgtctgcgctcctggggaaagctagaatggatggcactgggttagagatgacgggtccctgcaccagcctcctaaagaaaagcaattgaatttaatgtgcaatcataaactgccgctgatggaaagataagtctggtcggtgtttgttttttcagggatactatttctgcctactgcttcaaacactttgtgtctgtgggtcaagtatctgagaggactggggagacctggaaactagttctgcttataacgccatgtgggctatgaagggtgttataatctcaacacatagagcaactctcagggaagcctgactccccctgcgcctttctagatagggggttgtccattcttctgtgataggaggctcaccacttccctttcaacctgacccagtgttagataagcattgttagagagttcttccttagacttccctagcctcttcctccttataacttaacaacaacaaagacaagaaggagaatagctaatgcttactgagtgcttgctgggtgccaggcactgggctctggtcaagttacaatgttatcatgtattatctccattttgcagtgtaggaaaaagaagaccagagggtgtgaaagacatgctgaagatcgcacagctagtatatggtagggccaagatccaaacccggggctgcctgaggccagggcttgacagcttaactatcacatggttctaagtcctgtaactaccattaattggatggagcctggcttttagagcaatacagaatatgacaaggcaagacagatgagaactcacatgtagcacatattgggcactgctaagcacctggcctgggtcagcctaacacatcgttcatgcagtagccttttttgagtaacgaaattatttccccatctgagatatctattttcttatctttttaaaaaagttatatatatatatatttttcaacatataaaaatcggtttcacttctgtgtatttataatgaacaattagaatctgaattttcataaatagtacaatttacagtagcacccaaaaaagaaacattcagatataaatccaccaaaatacacatgggacctacatgacaaaaactataaaatggtgatgaaagaaatcaaagaagatcgaatcaaacaaagagacatacatgttcctaagctggaagactcagtattgttaagaggtcatttctcaccaaattgatctacagattcaatgcaaacccagtcgaaactcagcaggatattaacaagcttgcggatatcaacaagctaaaatgccattgtacatttatttccaaaaaagaacagggaggcaggtcgtgatgggtcatgcctgtaatcccagcactttgggaagctgaggcaggactgtttgaagccaggagttcaagaccagcctgggcaacatagtgacaccctctctacaaaaaaataaaataataaaaataaaacacattaataaaaagaatggggaaaaagcctctaaaccgcacatgtccagaaaatataacatgaaacattgttatgtataaatatcataatcacttaggtacattgtttaaataaagttttttatgtatgtctgctataactaaattggaataaaattctctccaaggtacaaccctttttataggatactataaacaaaaacgttaagagacaaaaatttactcaatgaagtttaagcaggactcaagaggccaatttaaaaaacaatgaacgtgaccccaaccgtatcctctctttaatcttggtcctatttctccaatgtagatgataaatttcataccaattgtgaaacaacgaatgatcttgctcctgttttagggacagtgagtatatttaaagaaatgatacagttggtagagtttttttgttttctgttttttgatttttgagatggagtctcactctgtctcccaggctatgagtacagtggtgcgatcttggctcactgcaacctccgcttcccgggttcaagaagcaattctcctacctcagcctcccgagtagctgaaattacaggcatgcaccatcacacccagctcatttttgtatttttagtagagatggggtttcgccatgttggccagggtggtcttgaactcctgacttcaggtgatccatccgccttggcctcccaaagtgctgggattacaggcatgagctactgcatctggctagttggtagaattttttatttggttggtatattagtccattctcatactgctataagtatactacctgagactgggtaatttataaacaaaagaggtttaattgactcacagttctgcatggctggagaggcttcaggaaacttacaatcatgacagaaagcaaaggggaagcaaggcatatcttacatggtggcaggagagagacagcatgcaagggaaactgccactttttttttttttgagacagagtcttgctctgttacccaagctgtagtgcagcggcatgatctccactcactgcaactcccaggttcaagcgattttcatgcctcagcctcccaagtagctggaaccacaggtgcatgccaccatgcctgactaatttttgtatttttagtagtgatggggtttcatcatgttggtcaggctttctcaaattcctgacctcaagtgatccacccaccctggcctcccaaagtgctgggattacagatgtgagccaccacacctggccaaaactgcgacttttagaaccaccagatctcacaataactccctcactatcatgagaatagcatggagggaaaccacccccaagatccagtcagctcccacccattccctccctcgacacatggggattacaatttgagatgagatttgggtggggacacagagccaaaccacatcagttggttttcatcttttctattgtaatttagagcaaagggtaagggctagctttggaccctttcattgcatctttcccctgcactcagacctgtaaagtgcttctctctggggcaggggctgtaatacttaccagcctctttcagaatccctgccacagccaccctcaattcatgatgagaacacagcactagtaattagcacatctttgttccacgggtttcttccttcatatgacctgtgcccctgctcagtgtggtgagacttcatttccttacatttaaaatatttcctcattggagtgactcaaagatttcatgagatacctgtggtgtcatgcaatatatagattggatttgtccactctgcctggtttataactcccatattccttgttacagtcttttgctataatgttgggtgtgttagggcccaggggaaggcctcaggtgatacaccctctctccttccttcctttcacttgccccaaggcaggactctcatcttcccctgtctttctgattgtgggtcttaagaccttcctctgagagggtcccacctcatacccagggggaggaatgctgattttatgaagctcccctaagaacctatgagggctgcgtttggagagagagcttccagatagctgaacgcgtggaggttcctggatggtggtgccccggggaggttatggaagctccatacctcttcccccaaaccccaccctatgtgtctcttcatcagtattatttgtaatatgctttataatagaccattaaacatgtttccccgagttctgtgagctgctctagcagctctagcaaattagttgaacccaaagaaggggttgtgggaaccccaacttgaagcctgttggacagaaatttcagaggcccaggcttgtgactggtgtcttggggaatggggaacagtcatggggactgagcccctaacctgtgggatctgacactatctccaggtaggaactgaattgtaggacacccagctggtgtccgctgcttgatgtgtggggaaaacatcccatacatttggtcacagaaattctcttccatgttgatgactgtggtagtgtgagagtagagaaaaaatgcagtgtgagagagtttttcttgacacaacacttacgtgaaagtacttggtaaactgcaaaacagcagtagacagagtaatataaaacataaaatatactaataataactacaaggtactgagcacctactacgcgccagatataaaaaccagatgtcgtatatgcattcaattatcttatgctgtcctggtaaatccccacagcaacagcccacatttggtgttattgtccccaatttacagatgagagaacagaggctcagagaatttaagttagtaagcggcaaagtccaggattcaaaccccaacccagtccatgctcttttcgctacaatgctgcttccaggtgttgcttattgttttcctcaccattcagagctaaggcaaaagcactgtttaacgcccttaaggaatgaaagatgagattacagaagtacaatttttgagcaaattgccccttgcctacatggctggaaaacacatcacagtaaaacagtcaatgtgtatacttcaaatcagccacagatctggaaaaaccttagatcccacaatttcatggtagctctgctatataaagcaaagataagaaaaaataataatatgaaatcccgtaccaaccagatatgagcttagatttttcaccaaaaattctcatctggtagattcccaaatcaaaattggtatggggaaggaagaatgaaatgaagtatgaagacttagcttttctccacttctgaaaaagtccattgttgctaagctgttttcccaaacagaataagccttctttagtctcgaggctcaatttggtctacaacattaataaaacgatatttacaatctttacaaaaatcaagtctttcattaaaaacagggttttgaccacactaatctttccattcttccacttaaaaaacatgggtggttgtaatatacccaccaattcccaccctcttagaatgttctgcactgtggttcaaagcccttagaataaaaaactgctccagaaagcaactcagccaatgttcttttattctgttaagaaagagatttcatcagcagaagcattgagtcccttgaggcttcagggatagaggcttctgaacacacatttctgaggagataatcatggtggaggtgactttactcctcataatgcctccaaaaccatcatgagtagtgattgttgcaagaaactaaatactatttcaaacgtatgtgctcagggcatttttgccctttattaaatgacctctgtacatttatgaacagtctaaggattgtctacctcaatacctaaaaaaggaaatgatgccaccaaatagcatcttgacttctacagattttactttccaaactcaagttccatcatcatactcaaactcatgtttatctgatgattgtatgggaccaaattctcaactaaggttctgggccaaatggccaggctaatgcttcacgatgctctttcaaatgcctttatttgatagccctggattctcaagcccttccagatgggtggttctcaactacggtttcagattagaataacctggggaactttaaaatgtctaggcactacccctgaccagttaagtcagttctccaacctctctttatagactgtggcttggggtcttctccctagctgagtgccctcccgcaaatacaccaactcctctaagctctgttcccagaaaggcaacatttctaatggcattgttcagaatatggtggcctctctcgaattctgacaaccttgcctttttaaaggaaggtgttgccagccacatctcaataaacaagcctgtcccccagcccttatatttggaaatggccatggtagtgcactctcccgaccccattcaaccccagctctttctctgcccaccggtctacagagtcttcttgtataaaaatgacattgtcttcctttgtagttctagccaaaatcattagttatctcttttctttcttgttgatatcaccacgggtggatgccaggaggagggttgtcttacccaattgcttggaggggaaaaatctgtgaagtttaaggaacaccatctaaaatcctcctacttcattctattttcaaattcttcttctacttaacctatatctgctagttacaattgatctctcctctctcctctctctctctctccctccctccaatatatcaaaccactgctttgttctagcctagctctataatttcataaatgacaataattcccctggcaagtacactgtattaatttcttaagataatcccatgaattgaacactaccattcccattttacagatgagaaaactgaacctcagagggtttaggattcacagctactaagtagtataaataggattcaaactttctccctacccctttctttccctctctatagcattcctttcttccacttctttgcctttttaagtttttttcctagcatgctatcaaattaagttatgaaaaaaagtgtgtttctgtgtgtgtgtgtttcaatgttatgaggccgaggagaaaagtgaatgaatgtgtcattttttatttatttattttagacaaaatctcactctttgtcgcccaggctggagcgcagctgcacgatcttggctcactacaaaccccgcctcccggcttcaagcgattcctctgcctcggcctcctgagtatctgggactggaggtgtgcaccaccccaccaggctaatttttatatttttagtagagatggggtctcgccatgttggtcaggctggtcttgaatttctgacctcaagtgatcagcctgccctggcctgccaaagtgctgggattagaggtgtgagccaccgcaccaggccaaatgtgtcatttctttaaggaaacatctggcatctactttataccaaaaactttactgggcccgttaacccatggtatctttcctcaaaatagaatcagtgacttccttgcctttgttatgtcttcactgctcctcttttcatgcacttgtaacattattttgtaacgttttattaacacgttcaagttccttttaagctgcaagctccttgagagggtatttcttactaaagactcaacaattttctctccttagcacaagggaattgctcagcaaatgcttatgaatgaaataatatgtcatttaaacatcagagctattgtaaaatgtaagtggtatgactcccattttacagatgagaaactgaagttgagatggaattaagtgagttatctaaaactgtggagccaggaagctcagggctttttcctgcttggcacagtcatctatctaataatgacttccgaaatacctccaagcttaactagacaactaggtaataagtgggaaagcactttggaagagataaatccctaaaaacaaacaaaatgcaatcattagcatcatcatcaacattgaggggcttaactaaagcatttccttccattaaaagcactattttgaaacacttagaaaggcattttccagtttgtgcatctcaggatcccatctttgctacagctctagctgtaagagtccttcccatttgggggatgcttgctgaaggtagtgctttcggaagtaaacccaatcctgccttggagacatattgctaagtgggcactgtggctgggcacttctgaccctggttctctcctctggctggatcagcaaaagggtattgctacggtcttctctgtgatacatcttcagctcccccaagcaggagctatgtgtgaagatctctgtggctctcaggtccagcacaagcacaggtgaacagcaaatgcctatgaatgaatgatcgcccaaggaaaaacattttagagtttatgtattatcagtgggcaacaaagtaataaccccaatcagttggtatgcagagtgttcataagcaatgaagagtgcatttcagtggtgggaaacccacttgtctccagaaaagccaatgggagagtcccaagctgggttctctgaaaatcaatcagactctgagagagattgacaagcaggagatgtattggggaagcttcacctgtagataaaagggaagaggagagaaggggaagaggaggaagggaagaggaaagaaggagggaaggaaagggaagggaaaaagaaagggagtgggcagaggaaaggttgaatggtgatgcagttggagcagtggctaaagccaaccccaggggaggccctgaagctggggttgcttttacaccctgtgtcaaccagtgagtagatgactttgagtgaggcggctccaaagggcaagttctgaaggggggctgttagtgtcacaaacaagtgggtttccctcccctgaaatgcactcttcattgcctatgaacactttgcctaccgattggggtcattagtttgttgctcactgataatacaaaaactctaaaaagcttttccttgggtgatcattctttcataggcatctgtcagcatcaattgtagcgaatggggaaagtccctcattgtttttttttttttttttttttttttgagacggagttcactcttgttgcccaagctggagtgcaatggtatgatctcagttcattgcaatctccgcctcctgtattcaagcgattctcctgcctcagcctcccaagtagctgggattacaggcacgtgccaccatgcctggctaattttttgtatttttagtagaaacggggtttcaccatgttaaccaggctggtctcaaactcctgacctcaggtaatccacctgcctgggcctcccaaagtgctgggattacaggcatgagccaccacgcccagccccctcattcttgaaggtggatctgagcagcacatcacagagtcctccacaggaattttctttctaaccacactgcagtagggtactcctttctgttagcagagaatctccatactctcattaaccttgtttataaagttcaagtatgtttatgaggtagaagcattaagagtcacagacagtcttttctaagcctcaagacatcactaatacctggttggtattattaggttggtttaaaagtaattgcggtttttgccattaaaggtacattttacctttttaaaatagtaatgaacacaattacttttgcaccaacataataaaacttaaacttaggtataaatttataactgaaatataaacaccttttgccacctttggaggtaaaatttgtatttttcctgattaaagtgacagagcctctgacttacagatttgctctgtttggcatgcgtgactgatgcgtttagacgccagttcaatagagtaaacaataaagcatccgttcagttgcaatccctatccaaatctatcagtacacatggtctagcccagtgcatttatatctattaatatctcattgtaatagcagtcattaattttacacatttataattgtgtcatgcaagtaccaatgcaacatttctaaacctaaaacccatataagactacaaaataggtgatctgaaagctctatcatcaccgtaggccaaaataagtgaacatggatattaactaacttctagagaatagaataatataactcaatgagagacaaaacaaaattggaagggtatcaactccacacatataaccactcatgtatctttgttcattcatctaatcaacacaatcttatgatgcctgatttgtcctgagcactgatctagtcactgggaaatgaatgatgagtaatacatagttctccctacatggagactgacatgcaaagatgccaagggcaggataacctgggaagggatcatgaattagtaagtcaatgggtgaaggaatgaaagataaatgcaacgacaaagatatgagcccagcgctatggatatggtccatggaaattggagggggcctccaaagtagagaacaatgacactccctttataaagatactggagttttctgggcacacaagggggataggaagaattccaggaagaattcactgcagggataaacattatgaaagggacaattaaatcagagtgatgtgaggatgccatgagagttgttctcaaagtcagcaggaaaaataagaatctgagatacttgttaaaaagcagatccccaggccatgcttttaaggagactgagcagatctggggggtgaggctcaggaatcagacttcccaccaaggttctcctcttggctgaagagccacactgctagtaaccactttagtcttgactgcatggtaatgtcttacattttcacctattaacatgtttgctgttgataatttgatatttactagtaattgatatttagcaactttaaatggttttcttctattcctattttttcttcatttttattcaaagtggctgataaattacattaaataacttttgagtatctcttgatggaatcattttaaaatgcctgtttaaatatattgaagcaatgatatctgcttcacagcagctgatgatgtgaaaaggcatttgcctttgaagaaaggagcagtctcttattttggtgaggccctactatgtgctaggcattttacattatgtccattgaatctttgtgagacttcttctgtaagatttgtattttttgtctctgttttacataccaggcaactgagattcagaaaaagttgagtggcttgttcaggtcacacagatgcaaaaatagaagcaaaaatggccttaaacccacagaagcaaggaagttacaaggtctagagttatctaaaaaatgatgtcatttttttttcttttcaagaacagagtaccaccctgttgactttagctgtatgtccgtatgtcttttaaattcatcttgttccttcactcattacacaggcacttactggggttcactgcatgtgttaggagttccatggagaataccctaatgagcaagcaacatccttaagacaaatttgctcctgcccataacataaagcaactgcagttcagagaaaggcgccattcccacaggtggagagaatcatgagagacttcttgtagaaggcagtgtttgatctggactttgaagaatgatatcggatttgaatatattgagatggaggagatcagaaggctatagaaaagcccaggagtcccatggagtatctgtggacagaaaccagcccaggtcacggttttctgcctcggagacatctgcacaaggcatttgtccaaggctaagtgaagtagttacgtgctctctctcagccagaacaattggtaaacaccttcgcgctttctcaagaactactacagtaaaatacctctgttcaaaacaattactgtgcctatcacacaccttgaggtaaattaacctgtggacacatgccaactcttaatatcctttaaaaaggcaaacactgaacaactgaagttgttggggtctgctttactacagaaaggcaaaaagggatcccagagaggcatttttgtcagctcagaatgtgaggaatagtagctgctatttataaaatacctactgtgtgccagccactctacatacacactctctcgttgcccttcaccaaaacactgggaagtcaccgctattatcatgattttccagatgaagaaactgaggctcagagtgtttctatgagtgttccaggtggaaacaatctcacaggagaggcaaacctagaattgtgaaataggcctgacaccaaaacccacatgattcacatttgtgtgtgcgtgtgcgtgtatactggagagacaataatgggccttatctttaactatcctgtgtccctgggtccccagatccctctgttccatagctccatttttattgggctgttatttatcctggtcattaacacccctttcataacctcttgctctaaccctttggctacctctgatgcagcagctcagtgccctcagctctgactcctctcaacatgttgcctgtgcacagcactgcttggaagaccagccacatcatgtggccaatccccaggacagcagagacaggactgccccagcggcctccttaccagcctggaatagctaccacttcttatgcctagaagggcactgatggccatgcacagaaacgaggccctacaggcagacagacttgcatttggtacctggctcttcttcaacctggctgctgtgctccaagcacgtggtccaggcagaagtgcccccatctcccaaagaacagggcttagtaagaagaatgggtagggcttgtgggccatgtggtcctgagttcaaacttaaccctgctgcattctggctgtgagcaatagacaagtcttcagacttcagtcttaacatctaaataaaatcaacaaaataacatatactttgcagggcttgttataagcattgggtaagtatatatagtagggaccaactggtaatgcctttcaacttctgcccttttgtagtctggtatagggtgcgccttattcacttttgtgcctgcaacatcaggcacgggataaagtacatggcaggagctcaataagacaggatgaatcttgactgtcacactcttcctacgctcaaaactctagggcaagaattggcaaactgtgacctgtgggccaaatctggctcactgcttggtttttaaaaattaagttctactggaacacagccacactcattcaaacacatagctatgacttcatgctacaacatcagagttgagtagatgcaacacagaacacaagggtttgtaaagccaaaattatttactgtctggctccttatggaaaatatttgtggaccactgttctcatgtagggatactttcaaagatggagagcacttgatggcctctttattttgggggaaatatagaattcctctgctcctcccccatccatactttatctcctctttccctagtttatttcttcttcttagctcttaccactacatactatttatttttgttatatatgttgtttactttctacctcttctactaaaaaagctccacgtgtgcaggaatttttacttgtgctaactcctatatacccagaaccttgtccaatgcctagcatgcagaggacattccacaaatattggtggaatgaataaacactgatttcattgaagagactggtgagccaaagtgtgttgaagagagaacacacttcaatgaaatcagtgtttattcattaaaaggaccaggtggcccctgatacctatgaggagggtattacttttcctattttatagataagacaactgagactccagttaagtcagtgattctctaacatgcatatgaatcacctgcgaccttgttacaatgcagattctgattcaggggtctgggctggggcccttgatgctacctctctgacaagctcccaggtgatgctgatgctactggtccagggtccacacactgaagagtgaggcttcaaggctccccctcggggcatatactagcacatggggggccatcatttcctttctgtttcctcttcctcatctccatggctctctctcaatcctatcatctccaaggcctctccctcctcccccactcccagactgttccctgtccccaaacacctcgcctccagtccttcacttccatagcccccaactccagtatcttcagccccttccttctgcccaggctcctccactataactaaatctttgcccaggactttctgatctttcaggtagccagtatcatgtttcttctctgttttacaaaaaaaaaaaaaaaaaaaaaaaggtgaaaggtgatcctactcatggtccccaggcaggctggctacctcttcaaccttcatccctacaacctgtacaagttacttctgatggccaaatgtccaggctgtgcccaaacccaccccctccatcctctgcagcatctgctatggccaaccaactcctcctgctgcaaaagccttctcttgggccttacgcttttctcctacctgtctgtctgctttgccagttcctctcctcttctgattctttaatcatggtcagttcctgggcctcagcccctagcccttagccctctgttcttgtcccctttctccaggcctgctttcatccacctggcactctcatctgcaacctctcagaggaaggttccaaacatccacgtcctacctagactccacttctgcatttctaagttcccatgggatgcttttgcttgggagctccaccagcattctcactgcaatatatccagagtcatatgcatatgactcacatgaccatttctcaccccaagacgtctccatttccaggataatcaattctccctcccatctacttctgggtagctttgggggaatgacttagcttctcagagcaatttctttcccattaaatagggataatggtacctaccagactaggctattcggaggacttagtgggctaatgtatgtacagactacttggcatgtggtggtggtttcctattctcccctcctgtataaatgattaaatataccttacctgttcgatccctttaagtctagcaactggttcatctatcacaagtgcttggtggtagttgggatgggaagatggtgcttaagaggaaatgtaaccacctaaggtttctgtatagaaggcaggctatttgcagtggcatacaatatatgaccgtcatgggggccttggggttggtgaatataaaatgaatataattatggaaaccctgtgtcctatccagatgcttctgcatcccactgctggtatgagcttcctgctctgggacctgtggcacagaacttcatgtctgcaccaattgaaaggcctgtgtttatcattgcaccttcaactgcaagtatgtgcagatccatcctctgtcctttcacactgcttatcttggattccaccccagcacccagcacacagcactgtataaagtgggcattcaaagaccctgataggcaaactggctgatagagggatgggggttagatgccagaggtggtgatgggtccctgtatgcccacatctgctgtgaaacatgcataccctaagaggccctggaagaagagaggggctcccagggactactattcctgccatgaaccctgtggtttctgaaaggggaaataaagaaaactaatatttcatgagtgtcaactttgtgccaggcactttacaaaatcatctcatctcctcttcacagcaactctgtgagtcaggcaccattaccctcattttataattaagagaaaagagaatcaaaaagtttagaaaatttgcccaaggctctataaccagtgcacgatagaggcgggacatgagcccagagctgcgtcactcctgaagctcattctctttccaccatagcaatgacacaccatattgtttcgtacctccgtgtctttgcagatgcagtttcctctaatcagaattttaattttttcagtaatgggtaaagccatctctgaatacactgatacctatcccctgccacacaaaaaattcatcactcaactaagtgttcctgtactacagtatgtagaggcatctctcagctaacgtttctaataggtgacgttatgctagtctctcagataggcttgcatactgtgaggctgaacctctgggttctagccatttcttcatccacaccatatgaaacataatgtgcatgttcaaagcatgtttgtgggatgaatgaataagtgatctggtacttccagtattggtgatgggggcccatttgttcccatataacatgagggtggtagtacccgtcctaaagacctgtggaccccacactgagcagaggggatggggaggccttttgctggctccatctttatctatgaagccttcagcaggtaatgctattaggcacagcctctctcataaagctgagtttgccagaggtgagggaagacatggagcgctaagcaatacattttaccggaagccaggcattctctgttttaatcccactcttttgctagctggatgttcaatgaattcacatccttcaatctctttctaaggtccctacaacctctcaatttccaaaaatagaaagtgcatattaggaatgtggactagttcaggggctttctaactttttatcaccaaggatctactgtacagagttgttctcctttactatcatgttttgagcatctctgttgttgttgttatttattattattattattattattattttgagatggagttttgctcttgttgcccaggctggagcgcaatggtacgattttggctcactacaacctccgccctgggttcaagcaattctcctgcctcagcctcctaagtagcttggactacagacgcctgccatcacgcccagctcatttttgtatttttagtagagatggggtttcaccatgttggccaggctggtcttgaactcctgacctcaggtgatctgccctctcggcctccaaagtgctgggattataggcgtgagccaccgcacctggccctctgttttattaataagaaaaataatcacttttttttagcaagtgcaaaaaaatggataagcaagcacccatctataactcccaacaaaatgcactgataatatgagataaataatgctaaacaccaaacacataatcccaacccaaagcaaagacactggatgtttctttcacctgtgaggccggttctagataaagtaatgaatccctgcagactttctgaaatagcataaacagccaatgaatacctttctaaactttgagcccccagggctacccattctccaagtaaaaacacatggatttagaagttgctaagactgtgattctgtctcatgtgtgcaagtcctacagcaggatttggtcccctgcttgatggaattcagggattcctaactagaaaattacactcacaaaggagaaacagcccttcacatctctaaaaataagaggaaaaaaatccaagatggtggaaacataacgaacttgaacaatgacagtgcactttcaaatgtaacacatttatgcaaaataaaaactttaaggctacagacaacttagacagaagtgaaaatgagaaactaacagacacttggttggtgcaggaaatgcatgctacaggttcccttacagggcacgaagcaaagttaacaccagctcgatacttacaagtaataggagtaggaataagcatttcttctatatattgatgggcagtcagatgaaggaaatgtccaaaatgggggaaaaagaaaagacaaacaaacaagaattagatttttaatgaaatcttgattcttagaaatgcacatattatttcagcatccctaagctcaaggagatgcaagttcctctactaatcatcttcactgagaatcagatatttccagtggtagaagaaacaagagagacctcttctataatagggaaacccatggtctcacatagagtaagccatgtttcatgttggctgttgtagttggttcaaagttcttccttatggtcaaccaaaactagattccttgtaattatgatttttttttttttttttggtcggcggggtgcaggtgagggtattggatcagctctctgtggcttcctgggactagtctaccactcttccctatgataatgtcctgtgatctaagcaacaccaaacttcttctgtctcctctatttcagataaagtcacatcagagtctatttagtaaggtcatacccaaagcaaggaaatcatatagccagtacccaagatagctccccagtgatctgcacttcctagtattcaggcccttgtggactgccctcccacagagtcaggactgaccctgtgtgaatagaatgtggtaggaattatgttctgggactttccaagctggggaaaaaaaagaagcctctcagctctgtccataactctctcttagaaccctcagtctccatagaagaagcccagtttccctgaggctaccatgctggagagatcacaggagagcctctgagactacataaaaagaaagaaatgtcccaccagcccccagccattttactttcagccaaccaagttatctcagctgagaccattgacattgcggaacagaaataagtcattcccttcaagctctgcccaaagtgaagacacatgagaaaaataaataactgttgctctttaagccattagattttgggggtagtttgttacatggcagtagatgaccggcgcaaagtccaaccttatcttggaagagcactgtactgagagagaggagttccaaccttcagtctgaacagactctaccttgaataaactctctgttccttcatttctgcatctgtcccttaggtccattaaactagatcagtaattttccaactgtgttcacagaagtctgggggttctatagcagccactgtgtaatgaagaaggagggtactgagcaagtgaggctgctgccccccaccatccaccaaagcacctattttatatattgaagttttatctattttatactttgaagtttcatttaagatatcatatggctgagaattccattctccaaaagaaagcttcaaaaatcactggcttcaatctctttccaatgttcctactggctcctggcttctaagcaatcacaaaactcaaataaaagcatgatattccctttgttataacttttcttatgttgtaagaaaataaataggagtgttcttatttcacatcagattcagctatactgacaataaatgatacatttatagattgagaaaaatggctagataattcaggtctccaaatatccatctgagtagacaagaatggtttccttttttcttgaactatttgattacttgcaaccattatcccatttgcttggtacaggaaaatacagtcgttataactgcagagtgggggatacgtcttcacagccccaaattttcccatctcaagtaggaaatatccaaaactcccaagatggggctatctctagtctttctttcatcatctcatctcctcttcacagcaactctgtgagtcaggcaccattaccctcgttttataattaagagaaaagagaatcaaaaagtttagaaaatttgcccgaggctctataaccagtgcatgatagaggcgggacatgagcccagagctgcatcactcctaaagcaaagcccaaccctacacacccagaaggaaagtgagtctaaaagttaagaagccacagaagaaggaaagccccatacctccttagggggctgagctagggaaaatgagccacagtgcagcaagatctggccacatagaaaactgttcaatatcctggactgaaagaacagtgaccctagatgatgagaaggtgaaggactggggactgcaatgagtgggaattggaagctcctacagaaagtcatcaaatccccttcaccagccatacacgttagcactgtaaggagataatttctttacctcactgctggcaggtccagtgcctggaaggtgattcccctgggacacaaaactcagggtccatttgatgaagacttataggacacctgtgttctctgtattgtcaagaacactgagctgagaatcaagaggccagcattataatctcagatctttcaattgctcattgtgacatcttgggcaagtaagttcttcttcttccctttggacctctatttcctgatccatgcaccaaggtggatggcatagatgaccgacagctcaaacagctttcaggagtggaaatacaataagccttagcatctcagcaccatcacttaactaactgcatgaccttgaacaagtcactaaacagccctgagtcccagtttctctatctcaagcttggggacaataattatgtattcccaagaatcaccataggcattagcattatattaatctaaattatactcacattagatatgatatgtaatatataaagtattctatgtaaattccattaatctaaattgatattagattatattaatctaaacatctggaatgtattagggctcagtaaagggtggcttatgtctgcacctcatccacagagataaggtttactgcttcttattctggtcaccaggaacaaagtgttcacctctttaggaataataaaatatgaacaaatacttattcagcacttactgtgtgccaggtattgttctcagctttagcacacattaactcatgtattcctcacagttgctctaaaagataggaattagtgccattcccactattctgatggagacactgaggcaaacaagaagtaacttcagatcacacagctagtaactggatttgatagcaacatggctataaagcttgtagctcattttctttctttttttttttttttttttttttttgagacagagtctcactctgtcgcccaggctggagtgcagtggcgcgtgatctcggctcactgcaagctccacctcccgggtccacgccattctcctgcctcagcctcctgagtagctgggactacaggtgcccaccaccacgcctggctaattttttgtatttttagtagagacggggtttcactgtgttagccaggatggtctcgatctcctgacctcgtgatccatctgcctcagcctcccaaagtgctgggattacaggcatgaaccgccgtgcccagcccatagctcatgttcttgacctcaagcctgtgctgctttcaaggacagaagaaaatggatatatcttgagaaatctggggagtcaggcactgggatgtcaaaacgttatctctttcaatcctccccacaaccctgaggagcagatataattactctcacggttagctgaggaatctaagattataagtccatgcctcactaggtcaaaggctttgtgtatctttggaccagttgcaaggcctccatcctgagctggatgctctcactgtcagcagccacctcctcctcagctacactgagcattctggaccttctagtttttctgctgtcaaccttcaggattcacctcagcctgagccaagaaaacatgcttccttcttcaccttcaaaccacagaccaccttttccaagttgcttttctgagttatcctgggtgtcaccaaaagccttctcgtgctatctctgacccagcagcaaggcaactccaggataatggtaactgacaaacttctattaattgaatctcttttcccaattaaactgcaaagtcttctaggtcaagtatcacaggtctttattctgtgaccaaaacagtttacatgtgtgtttttctctaagccttgaagaagatttactgaaggtctaaatttacaaggatacagtgatattgcaagtaacagattgcctgaaaccaaaaatcctgagcaggaagacagctgtgcttagaaaaaacaaaacaaaacaaaacaataaccccaaacttaataaatcacatactgcagaaccttttttcagctagctcacaagattgacttcaggcacagttttcttttgttccatacaatttaaacaggacaaagttgtctatctaacgacccatttaaccacctacccatccatctagatcacaaacccacctgttcagccatctatccatccatccatccatgaacctatccatgcattcatgcatgcatgcatgcatgcatccatccatcccatccatccatccacccacccatcatccatttatccatctttccatcattaattcagcagaaacttctcaaaggcctactatatccttatctctgtcaagtacagatagaaagacatatgagatcctaatctagtccatatgtctgatgagagagccagactagcaaattataaagcagatgataatagctgtcacttaaatactgggagatcaatcatgtgtcaggtactgttttaagtatattgcatgaactattttatttaatcttcacaataaccttatgaggcattattatccctgtttacagatgagtaaagtgaggctcagagaggttaaggaactttctcacatttatatagttgttaagtggcatggcagggatttgaatccagggagtctgatttaaagagcctgtattaatagctattacattgtattatcttctgtcatgataaattgtatgataaggcaacacatggagctgtcagtccatacctggggataggagtgaggagggaaagcaggcaagatggcccaaaatctgggatgcctgagtggtaaagtaaaagagaagtcagatggaggagaggggaagggaatttttaggtagatggaactgtgtttgtggtttgggcaggtgggttaacaaagtgggaatggcaagatgttggaagggctagttcccaaagagtttaagcagcttggtctcagtcccataggtcacagggaaaacccaggaagtcatgtggccaaatatttcttgtaggtgaattatttttagcaggagggtgaggagaaagtcaaaggcagagtgaatgtggttacaccatcactgactggccaacacaagaaataccaggggcttcctttgcagtggccatgggatggggaagaaaggtcagcagtgtgcaaggtgtttaagacacaaaatcaaaaggtgattaaatgtgaatgtattgaagaagacttccaagttctcagcttaagtggctgtccacgtgagtgcaagcagaaggagcaggattcaattttcaggtgtagaggaaggagcagtttagaacaggatgaacagaagatgacacattttgtttgggcgtttgggcttttttcccacctcgataaatcactcaaaattatgccacagaatttggcatctcagcaggtcctgttttatatttaatccagattagatgatgtttcagagtgtggactccattatcagattgtccaagtttgagacccaactctgccatttattaggtatgtgattccaggtaatttccttaaactctatttccatttcagttttctgatctgtagtacccttaataaagtgcactgctcttttagcttggcctgagttagcttttctgattgtctacccagaaacaaaacaaaacaaaacaaaattttgtggcaatgtgctctctgaaggctcagaccatggcatgtcttccacatactgcctccagccttgccttgccaccctcctaccacaggacttggtgcacgaaccattaatgcttaatgttgacatttaggtctgttctctgagtgaagctctcttgtataatccatagagagttgatctgttctaattccactgggctctcccattcaacatgtttttaggaaattctcagtatttgcaaggcacactggagatgaagatgaatcagaatagacagctgatggtctagtgaggaaatgggatgcaaatacaaaggaaaagtataaggcagaaaataacatgggtcctcccagaggggatctagatggtgaagagattctgtccagatcaaaggtcaggaagggtttataggagaaagtgcctactgaattagtccttaaacatgggtaatagctggtcacatggagctgagaaacacaggcattgaagaagaagaaagttcgtaagcaaaacttatggagcagaggtgagactttaggagacttgtcagaaaaactaagaaaaaaatagaaaaactaaaaagctaagaagaactaagaaacttgtttccatatgggcagggagacagtatcacttgacaaagttccccaggtgacttagacatgtacttcttccctcacttccacctcatgaaccatggctatggagaagaagccattgaagggtttcagatgacaggtttgagagtacgagctttattttttaacacaatgctgactacagtatggaggataggttagaggggtggggcacagttaggaaggtcagtgaggaaactcatgcaatagggctatagaggtctgacccagggaaaagacaatggaggaagaggaggcagaggcagaggcagaaaggaagggagggagggagggagggagggggagaaagagagagagacagagagacagagacagagagacagagagagagagaatgagaccaagagaatgtagagaatcctgggtgttggaatcccatctgtttgttgatgggataggaggtagtgcctgtgaatgagatgggaaacaggttggggagtaggtaatgattttgactttgactacgaaatacctgagggattttcaaggtagatgtccaggggcagatgatatggataatggagctctaacaagagaagactgatcttcaggccagcaaaactacaaccaccgggtagtgtgataaatacacaaatgaagactagcatgtatggcacagtggctgcagaggaacatcactggatcttcctggggcaggaggctggtggaaaggctttgctgagatggtaacatttgggagtcctactaggaagaacaagaggctgagagtcagagtgtgataggaactttgtaggttaagagaaatctcaggacatttcattcagggaaacagcatgctcaaaagaagaaaatagcgaaattgggaaaaacaagccccagagaggaaagtggtaccgaatctgagtcacatgtttcttagtccaggatttgcttatttcctgtcagtctccatggactgacagagtagaaggtagcagcatgagctctagagacactgagactgggtttccacatcaactctgcccaaaacgttcaccaactcacgtgatcttttcgaacttcagtttcttcttttcaaacaagcaacagacctaacctactatgattattaggaatattaaaatcagagtatagctgcagtttaaatgaaaaatgatgcaaattatgtcagtgtgtgagcattgattgcaaccctgccattagcatattagtaacgggtttggagctggcctggtacagttgatggtcatgtggagatgaatgtttctgtagatattgtgcattgtaattccttaagcaggttcagggaacaaagcctatttcaataattagctcatttgatctttagaatagccccataaaactggctacctttcatagaagggaaagcaaaggctaagatttgttaagttgcttctgcaaggttgacagcaaataaacaggactaaaaatttggggccagtttttctgattctctgtcccattagactgagagctactggagggcaggtacaagtcacagagaattgatgtataaccagagatgcatataaaatatcagaatagacattcatatttatactcaagacactccaaatacactcttggaacagaagtttccatttggacagacaaggaaagtttggcaaaaggttaaggctggactaggacgagctgggcaggggagcaggggaggagacagggtctggctagaaccatggatggtaccaactttgaatatacctccctaaaatttcctagttctcatttgaaaattaaaatgtgatggacgggttagtgtaggatccaggcaagtccaggggtgcggatcttgtgaaaagtcctgcataacttggctttggtgtttccctatgcataagtgcatggccatgctttgagctttaagggaccatgttcagactccaggaagtgtgtcccaagggataaaatcgagctatatgaaacttgtgtgcgcatacatataatttcacgctccacaaacaaacattgaattgtagaccttctcatatgtgagtggctaatgaacactttcaactattgagacatgctggttaaggcaataatacttgatcttttcatcttaatttgcattaaaggcacacagtgccccatggtattaagttaagaaaacatagagttggtcatgcaacctcttgattgctggttttggaggagtggggaggatgtctaacagttctaaggggaggaggcaagggacgaagatgatcaggactgcagtgctgagtcagtgatgaaggtctttctcttatgtcaggacttaacatggtactcatgaaaaggaggtacattttactacataatgacatggggtacccattacagaacattcagaactctagatgtgatcgacagatccagaggaaaaagatggagccactatctagtgacagcagaaggatggatattgtgtagttggtgtggctaaaaccacactggtagttaactctgtcagtgaggggctccaggatcccttcttataatgctcatatcatcctgtttatgtccatgcaatcctaattccatatggttccacattcaatacagcccagttcaaacagccaaaggtaatgcaaaaagaattctaaactttaacttgcttctctttcaaactataagagaatcccatttaaatcacccaccaacatctcatatccctttctccttttcgtttctcaagatctccctccccccgttacaaaacaaaaccaggcaacaacaacaaaacacctctcaagttttgttgatattctctcttttccctcctctattttgtattcaggtgtctaaatataaattaatttagcttttttcattaaacccttcccttcatccatggatctcaagcccattctctgtctgtcttctagttctgtgtcataaaaggaaacccctaacaggaagagaaagactctctttggacagtggcaaggaagctctaaagtcagtgatcacaaaccttcagagggagaagctggggacatcttatgtttctggaaacatctgtggttatagctttaggggggctttgagtcagctgaatctattaggagcagaaaaaaaaccccggaaagtaaccatgtccatgaccagggaaggcagggagaagacccaggcaagcttaagccagtggaggggttgtagcagtgttggcctctgtgaacttctgagtccaagcactgtaggtgatgataggacactgaggagatgttaacactagtatcctgagctatggtgatgagcctgctacttggaagtttctttgacttgaatacatcttcctttgaggtagatgtagacagtattctggccaacagtaagttggtagcagactcaattgatcagtgtagtatatattgatatatatatgcagctggggggtagctggggacagaagaggtacacagaatttcgctttcctttggggcatctctagacacaggaagacattgtaggttagtggaaagagtgcaggcctatgttcaatttctctcttcctccccattttctcctcttctcctcctaccctcccctcccatctgtaaactgttccaatcaactaggccaacaaaatgtcttattttcttcaaaagatgccatatatgtaaacactgattagcaccccacaacatgcaatgcccaggttttgcctcctggggagaaatggtgatcatgtgatgcctgttgattgggtctgatggacagttttgatagacatgagagttgatgaagatactcagaggaggttaaaactaccacaaaggacttattttatagttgctcctaccctggaaacataaagccttttcctccctcccaaaaagtcacactcacacatttcagaaatagctgtgagaaggaagtgaaatttcttcacaatctcacagatgatggtgacgtgggttaagccaggctttagaaagagcaaaattggaagagcatatctgatttacaaatcagtggcaaagaataataaaatttcaggtctatcaaagaggtattcagttccattaatttgggtggacaatcccaaactcacctctgcctctaatatatctgtaactctaagaaacatttcacctctgcctctaatacatctgtaactctaagaaacatttcagtgatcttacatgtacaatgtgcttactgctcccagagaaatcaaaagtcatatactaccctatgtaatagcagcagactagtcactgggacatataatgtggccatgtgttatcagtgatgatggtgatatgacaatgtagtgttgaccttaaccctttgagggctattcacccccaatattaacataataccttctgttacccctagtttctccaaccagaaaatcagtagatggaggagaaccttagctcttaagccattgtgctgggagcttgaggcaagacatgatcctattagacagaaaaatgtcaagaagaaatgtcctcacagtttaatgccctggccagaggctagtatggttgatccaaagcagaaccaggagaaagagagagagggacatcctggggcttgcatagccaagagagggttgactgcatgtgtagtggggaccctagtatttctaaatcactgattgctggaaatggggatattgcttttaaaaaattcttcattttatattcatgtggttcctaaggtaggagctggaattagttgttaggggtattctgttcctttgttctggtaggaaacacatttgatgagcatttttcatcctatagatggaagcaagttcccagcccttgttcttggggttgccctgaactctgtgcataagcaaacccagagcttcaggctgaggtgttggtttggttaataatgtagaaggctcttttgcctgggagcagggcacaatacaccacctagtattataatgtggataaatgttttgtttgctatgatagactgaggagtgggaaggtagagactaaggttggggccctggcattgaaactgagaagacgtggaggtgggaagtagatgtgttaacatggtggcaggcaggggctaaggagaggggcgagtaagactctctgtttagaggaataaccagtgcaccctgtggacagggatagctgatattcaccctttgtattttcttccctctgtaatttccttgtgttatcctcaagccttgtgaatgcctcttaaacagaggatgctggtgtagtacatcttggaaataagggaggaatctgtgtgcatgctttcgtgagaaatgcaactggagaaaacacacagtatgagcaaactagtagctggccaaaggagtccagggagacatgcttttgagaggtgacaaacaacagcaacccagctgggaaggttctgtgggacaggacatagtacagagcctgtaataggacttgtaattgggaactctcacaccactgtagactctatctctcatggagagggcagcctgggatgctattatttgaccagtggaaatcaggggcaaacggaggtgagaatggtaaaacattactttcctgcaactgcgtttctggactgatccatgttcctggggctcccgagctatcttgatgacatgattgataacaacacagcagttaactcctataagactcaattcatgatacgtggaatcccatggcacatcgcggtggcccagtcatagggatcactggcccataagaaaatggccacctcaggaccacctgccaaacaggcagcatgcacccttcaaacagcaacacaatgaaccacagccggcccatgtatttccggacctcaatggttataacagaagatccctgctggacaatgatcaacagagcaaaaacctggccacacagcagtgttgaggtcacctcgggtcagcagagtcttgcaggcagcagcagagactcacctccttttgatggtgagcatcacgcccaggagaatgatgatgaacatgaggaggccagcgatcacgccagccatcttcacggtgttgtccacctgcttctctggctccacagtgttagaattctgggtggaggcacctaggaagggaaagggaaggatagcaatgttgaaagcacccaaacatgcgactagacaatcatcataatgacaacagcttcctttagttgagtgctaactatgtgccaggcactgtgctaagggcatcacatacattgtcccatttaataacttctgaggaccaattccttgtgaggttgggattatcattagattcttttgagatgaagaaactgacatgcagagaaattaagtgagttgccttaggttctcacttgggcaactgtgttgaagcattcttttccttaaggcaaatcaagttaagatttttttttctctcatattgctttgtctctaggatcaaaccatggaacactgggaattatacctaaccctacattattctttcaggtaaatggtggaaataacagctttattttggggcaacacaatttaaataactagatttttaaagataaaaagaggtttttgttttgttctttatagggaacaaatggtagggcaaaaagtttgtatattcaagggaacttgagtacaccttgggttcaaaaaaacacttaaatctgatcaattccatttttagcatttaatactaatgcaacatgctctaccaggtgttaacttgctgacacaatcctcagtagaggaggcaggtcactggccacttactatacatccttagccctatcctgggtaacttcatggatctggcctggtcagtcctcacaaacattcccaaaggtagacgagatactgattttcccattttatagatgagaaaaccaagggaagttgctaaaagtcacatggctgataaaggtcagggccagaattccacaggtttcctgattccaattttagacctcagtggtcagaaaccctgaatcccttcaagtcatctagttcctcaatcccttctccctaaaacaaccattctgcttatgccataacaaagtaagcaggcaaagaatgccaagaaccagtatcttcatgctacgtactagggatcagaggcaacatcttatttcagacattctagagagtagtccaggggttatcagcacccgaagtgaatttcctcctgcttctatttatattcctattggcgccagcctttaagtgggaagcagcttaaagtccaaaccatcctcttcctaactcattccttcttttcttccacatctacatcagctcactcttcatcagccaatacgctttctctgagcctgtgcccctgggagagtttctccctcttctctaaattctattaacactttataacactttgcacatgcctcacaatatcttttactacaatgcaccaatattattagttatttgttttcacatctgtctcctccagtggtctgcaaactcctcaggggcaagattacgcctcgtttatcttagttttcccatgttagcacagattctgactggtaatagggctccctaaatgtttgtggttgtttagtgtttagctaaaaggatgacgtctctgcccacacacatttgttctcatggaagcaaattgagttttctcctttttaaagtcatttattcatagaactcagcagagtcttgagttgaaggaatgctactacccaaaagctatggtcctgattcccaaaatgcactgatgtttaagccctccagcacattgatgcaccccctttttttttgcttaagagcattaagtgtttcctctctcagagcactttccccaagctgttgtaacttagacatgttgggtttacttggccaagtctctctagtgagaatggtaagtcaccctattcatctctctaatgccagtgtctagcacaggcctccctcctcatcattgctgcttaacagataaattataacataatatgagggtgagtgaaccacagttgtggactttatttatccattcaatcattcattattttgccattgagtggccatgtgctgtgtgctaaactatgctgtctgtagagtcagagattctgttcctagaaggacttctggatgaggaattttattcattcctttcacaagctaatggcaaaaccaactcatcaaattccagggctgactgagtagactcttctcatctacagcccagagaattcctgaaagagttggccaccatctcttcagcagggctggtctgacatttagggatggggggacgagggctggttctgaggagctcccatgcagcccccatttcccaggctggagacatgatttctgagatgtggctaatccacaatgtagcaagcataaaggaaggggagaatctcagatccaaatttcctcaatattgatagagtctttttatttagatttggaggaagggttgtctctggggcattcactcactggcacagcccaattttacttagtgtgcctgctaccaggtcctgttctagagactaggagtgcaatggcaaagagcccctagagaggatcctattactctaggaacaatgctattagcttggtctaatgagactcatacttcattccttcagtaagtgatcataaataccctctatgtgccaggcatttggtgatacagtggtgagcaaaacaggaacagttcctgctctcaaagagtctacaattagtggtggttgggggtaggggaatataattaataaatcaagaatcagtaatagcaaacttgaaccctgttaaggtttgaacagagaagcacatggcacttgtaaatagatacttgcataattaaaaaaaatgcattgcttcttggagcaattcacccctaataggggtgagttccaaaggaagacaggctgtaaccaggcaaagggaccatgaaagcagcatatgggagcagcaggagaaatagccttgcctaatggggcaagcaccctgttgtacttaaaaaacaaaaaaaagaaaagaaatgtagtataaccagggcaagaaagcaaggagggaaagatgaaaaagaagctgaagagggcatcatgaatgagtccacacaggatattactggccacaatgagggctgttgttctttaaccaaaggaagacagggcaccatttaagtgttattcaaggagcaatgatatggtcagatttgtatttccaatagatcattccagctttagtgtggaaccaaagtggattggtgaaatgagttttgagactactgcgggcattcagatgggagttgatagttgcttaggctcaggtgatgacagtgaagataggcagatgtgataaaagagacaattacttgaaatagttatagataaaatctgttgatggattggatatggggaataaaggagaaagaactgtcaaggatgaccacaaatctttgcacgatagggtggatggtggtaatgtttacgggttccagacacaatggaaaaagaatagctttagggggaaaatatatctagggcaactggagcttgagatatactccagcaaagtatgtagtcaaaaatgcgatctggagctctaaattaaaggtcagagttggaggcaaaaatgtgtgagtcatatgtacacagatggtatttgaagcgtgggggcctgttggtgaaatcaccctgggaaagaataaagagtggaaggagaaacagacctagaatagagacttgagggtctgcagtatttagtgagtagagggagataagcctgaatggggaacaggagtgaccagacaggtaggaagtaaacctgggagagtgtagtatcctagagccaagagaagagaatgtttcaaaaaggagggcatgatcaactatgccaaaggctgttcccagggtagaatcaagtccacacacaaaggaaagtgaagatcttggatgagtattagaaaaattttcccaaaagaattccaagacattcctaaatagaagcagcttcagcaacgaccataaacctacaaaagaacatacttgagggccacagaagaacattcaggggattcggagaggctgtctgaaagtccagagcctagaggtttagacgaattcaatgagttcagccaacaggcagcagagctgaaatcacagactttacacaggaggtttttagaaaaatccatgcttggttggtctaactagacatcagatacaggaacgtgaacattccctgggacagggaaaatccagctttgcctttggcactctttaggggaacttgccctagactctggatatttgtgcctctgttcatagtggaagtgtgttgacagggttcaaaggtgatacagggatagaggaaatggactaaaggcaagacagcatccacgtgtgactcccatatctgagggatggacagaggatgggagggtcccgcttttgtggcagagtcaggtgtggccacagggattacatcttaaatgctcagtggagcagaatgtgacctgtgatgggagtcataaaaaagcacatcagggttggctactgatggggccattggcaatgtggtgcgctttccacagatgccagcagtaggtccatatagaaggctatctgtctgactcagtggccccaaaatcgaaagggacttttcagagggctatcccactggaagcccttcagtgggataacacctgcgttacttttaccccaagcatatcctttccatgagagtcaggcttagtatcagccttagtccctaaaaggctgtctccgactctgggtgactttgttttattaagcagggcctggggatttgggaactgggagaaggaggagggatttgggtgcatcttcctcatctttaccctccagaggacccaatctgagaataggccaagcaaatcagaattggcatctaggcaggcaccagatgataaatttctccaattggggaagctttgaggctctacttgagtctcctgtgtgatgtgataaccaaaaataatcttgtgaactcagcttgtactgacaggagactccctctccaacatcatgctgcaagcctcacaagcctgacctgacggcacagccaactgtgtcctctgagctctgagcactcccaaaggctgaaccagttctcaaagcagctgctgctgcatcctgctgtctattctttccccaaatgccatgatggctaaggatccagtctcctcctagctccagcccagagtcttaatctggcttttatatgtgctacctgtctactcttacatatggaaacctggtgcacaaggcatggcccttggtttattaagctctacttccctccctcaatattagctccatacatagggtctagttgccatgttttctctctctgctgcctcctcccatgctacccagcaaccctcccagctgattttccccaaggattactgagacctaacaagggcagtgctgccctgctctactctgcactggtcagaatgctctggtgagtcctgtccagctgtgaacccaacctctcaacagggacctccagagtgaagacaggccatgagccttgctactcaaaaagtggtccatcgaccagaatattggcgaaacttgggagtctataaaaaatgcagtatcttgagccctaccccagacctactaactcagcagctgcattgtaacaaggtctctacatgattgaggtacacattgattgagatgcacaatgttccagagattattgactttgaaggtacatcactctgaatcaggatttttcatcttagggaagggaagattcagatgagacctattttttgcctttagatagataaagggccattgtggaaggtggagtagatttggtccctttaatttcaaagctcagagctgtatcactgggtagaagtgacagggggtagattaggaatcaacacaggaaacgtttgaatgtggaagagctaatcagctaaggctaaagcccagaccctttcaatgcggcatcatgttagagagaggatgaggtcattatggttccaaagtcctgcatcagagtcagcccttcattttacctgcttactctgtctctgttctcatctccttggcttcctggatgcacaactaagccctgaggacctcatgtctacaggatgctgacctttttctctgacgtcatcttttacctcaacttggttccccttaattccagtaatactcatactcttggtgagagaaattatccctattatctttagagccatgagactcccatgcagtccattcccaccccctcaccctgaccctccccatgttacccacaaaggcaggggaatgtgtcatcaacaaggacaagagctggctggaacatcctgtgctccccacaaagcagaagggacgacaagacttcttatgccccttttgatgtcgagatgctatggttttatgagtctagtcaaaagcattgggtttcacattggaaatatgcaagcttgcgtctagatgccatcactaatgggttgtgtgaccttgatcaaacctgttaaccgcaatgtgatttgatattctcatttatgaaataattagaaaatgccaagttcacactgggattttctaagaatcaaatgtaataatggagggaaaaatgcttgataaactcttgaggaactgttcacatatggggcacagtgatgatgtgaccttagcactggatccagggtagcactagggttttttgtgtctatgaactgtaggtcatagaggctgaggcaatgcctccttgtaacctgctacctaagttcatccgatcctcaggataaaggcagagcccctagagtgattcacttaactttcctcatataggcaaggcccatatcaggcttgcatctggatgacttaatggcagcaataacataatttggcaacaagggactggcaattaatgattaatgattcattctgaagtgctctcactggtgacaggcccaattctagagctttacttcagagaattttccttgtaaagatatggagcaaaaataggagtcacagataaagaacatttaattgcaattgataaaaccaagtaaatcccaatggatgcataacccatgctggtgatcattgctgacgataaagaaagcaacccggctctcagggacactattcctaaaaactgcactctttaaaacatacagttgtttctcagctatccaagggcatattatccccagtgtggcttatcagaggcaaatcttactttgctggcagtttaccccagtctactgaatggcttcttttgttgaagagtttctctggctttgtatgtatctggcacccagtagggaaaacctttgaaaccctgactctaagctggtacttctacgtcagggaaggttttaagcattacaggcatctctgattatgggggttttgccaagaggagataatagggaaaagatgaagatgctgggcaactttctggctcttctcaagtcaggtaagcaccataaaccttcttgattttgctggaaacaaattctcagaatagcagattatttttaagatggaattaaagtccaagacagaaaagaagttggcaggagagcatctggatacttcattagattcaagcctctagactttacaaattgcatcccaaggcattgagaatatttgtaattgtgatcatgaactactttggcagtctttgaggactgaaattgtagcaaacaggaggggtgcgagaagcctggggagaaacaaatgctgttgctgactttttttaaaaatgaaaaaaaaaatgtatttcagatactttacgctagtgtgatgttgatacaggaaaaaaaaatagactagatgattaaatcaggttccccccacccccacccttaccacttaaaaaaggaagaaataatcaccagaaaccagcacagcctcacatcagacagcattcaaccagggaaaaggaaaccactcctaacttttaaaacagagcaaatttactagaaaattagtacacagggattaggagacaatgctggggaaactcagagggtggtagtatcaggaagccactacccagcccagactggagaaacaaaaagagatggtggagttctcaaagcccagaagtaaggatcacccaacagaagtggaactctggtagacccatctggagacctgaagccatggagtcaccgccaaagaaggggcctgagcccaagagaaagaaggctcctcccttcctccagctttaccatctcttattaaagtctcccattagccaaatccagaagccagtaggcatgcgggtcccatgcaggggtcacctacatgcccaggagcatagggcaacagtaaaggatggttgtgacaccaaatgggccaaggacaagcatgggcttcttataaacaagtgatgctagcctcacctctctttgccactttcgaggggtgtgtgggcttgtaagtcagggagaatgtccagaactgcagcttgattttagccaagtcaaggccaacatggagaaactgtggctgactttcaggacagccgggtgtgaaactgagttcttccagaagatggaaacagaagggtcaagatatctgaccacatgcaaagtgctaacaatgaacaataaagaggtaacacatctagggcttttactacaatccaggctgccgttttaaacccttcacatatattctctcttttaatcttcactgccctatcactatggtttggatctgtgtctgcacccaaacctcatgtcaaaatgtaacctccagtgttggaggtggggcctggtaggaggtggttggatccctcatgaacggtttagcaccatcccctttggtactgtcctcatgacagtgagtgagttctcgtgagatctggtcatttaaaagtgtgtagcacctccccccacccccccccccccgcccactactctctcttgatcctgatcctgccatgtaagatgcctgctgcccctttgccttctgtcatgattggaagcttcctgaggcctccccagaagcagaagctgctatgcgtcctctacagcctacagaaccatgagccaatgaagcctcttttctttataaattacccagtcctgggtatttatagcaatgtgggaatgaactaatacacctatgaagcaggttccatcattatacctatttctgagatgtgggaacagcctctgagagactaagtaatggtagcaagcaggagagctgggacataggccctggcagtctagcacagagattattctctttaacctatcgtactactctgtcacctctctaataaatagggggagagaccgttcagcagagaaatgtgtttgtcttttctcaaatatctggaagaaagaagcagacacgtatttagatctagaatcttccattgaccagccagattaaaatatctttgtattgatgcctgtctctgccgggtttgccacccactctatcatgcagttctatttcatgcatctttcttgaagattatctcctctcatgccctcgcacccacgtatcctattctaatatctaagggattgatgaacatgtcatgtgaaccttgttacatgagccaaattatacagactttgctcaaatgatatttaaacttgacctttttaacttaagttccctcatccttttcacttttcttgtatatcaaccaccacctccaagcctttcatatgttgcagttagttttattataatcgctgggctttctatataatacctttattgatatttagcaaacaaaccatcccatataattccatagggagacaagtcttgttcaaatttaggtgatttttttctgctttgtctccaatattctttctttgatcttgctgtgactaatttttttaaattgctgactacctccccatgcctcaaagcaatgcctccttcaccagatctggttgataatagagcacttgagaaggattatttcatcattcttctaagtgacatcacctaggatgtttctcaagtaataaataaattgcctcaattcatcatatgacagtaattgcttttagtcacgatttaactcagagtcaatgttaagtagctggaaaataccacagagatgcagggttttcaaagatagctctacccttgctgtggaaaaccacttaataagtactgttaaatgcaaagaagatacacatttctaataccccagactcctcaatactacccagtcagtcctaagaagttagaattgacttcatcacagcctatacaactaaaactgctaaatattgctgacagaagttgccctcgttttcggcctcgaatggaggttagcaccctgtgagacaggaatagctttaattgattgtttgaaagcactcaggccactcaaataaattgttcctcaagtgctgattttgcttggtctcctgaatctatgcttccagatagaccttgttttacactgtaaatgctctgtgtaggtcaaattctagttcagtcatgttacacacaccaggaaagacggctaaatgagactctgatagagaacgtcttctggatgtaagaaaactcctttattctattaagaaagtgtcttttttttatccatggaaatagaggaaaacagacttatttatgagcagtcatgcccaactgatgccagacacagtcattattgacacaccccttctatggcatatccttttaaaggtttcaccgttggtgagctggaaatccatttatacctcccaatgacctcaactactttctgttgtgccaaggaggcctaacctatgagggctgccaagacccagctggggtagagagaggattcagtctgtggtaagactaagaccttaagctatgactagagtcaggtataaggttgtctaagaaaccaagtatagggcatactttgtagactgggttaggtttcagaccgcagtcaaggttaatgaccaggatgtggctgaggtaggggtcaaagctaaagcagagatcaggagtcaacttacggctcgggtttagaagtgttatggcagtcagtctgcatccatggtggggtcaaacttgcccacaagtgtggcttagactttattcagaaataaaatgtagcccatggccatgaaaataactggacaaagcccagtgacctccacatggactatatccattaccttggtctcattagcatcagttcaacccttggcttcataggaatagtcctggacattgcctaacctgagtggtgctaggattataatgatgacagtggctatagcaaggtgctgagcatggaaggtaattagacaacactactgtcttggaactcactacttagggggagaggaaagtgcaaactaaaaatcagagttgagtgatgggcaccaacacagaagtgtgcacaggaaagggcatgcccagctctgcttaaacaaaactagactacaaacttgatttccacgtcatccatggtgtgggacacatcagggcattcctgtgaccactcagtggccttctcttttccctccccaccttgactccctgtgggccagactgtcctgctgatgcggatgaagaggctgagtcatctcagtgctgacagtactggctccttgcttatagaatctgtgctttgagcctggagctcaggaggctcaaagccgcttagctgctgcaggcaggagcacccacggcctgcactggggattaagggtttagtctgaagaacagatgtaagaagaagaacataaactctttaggatgccctgcagcaaagtgatagtccctttagagttcttcaggcagccagtatgagagagctgtggtcacactgaactgactgtaattcttcctgtgaagctcagagcagtcccagggcagcaatgggccaaggagaggcttctcaggagcagccagtatagagccaagtacaaaagccaatcagggacagtctgcaggtcatgtaattccgggacactgagaacaggttaccacagcctggcttgtgaagcaaagcccaggccagggcatgaccagcaagcagatgctgagactattcaaagggagaagcagaaaccaaaccaagaaaggaaggtttagagccacagagtggagacctgtctgggccaaatgtagaatacagtcaacaaggggacctcactggggagatggggtgagccaaagggattctctggatggcagctcttggccaaggttttcttgaggtctgcccactttaaaggcacagcccttaaagctcaaccactgcccactggccagtgctcaggatcactgcatttctaagtacattcattttccagggctgttattacaaataaccacaacccaagaggtttaaggacagaaatttattccctcacaattctggaatccagcagtcccaaatcaaggtgacagcatggccatggtccttctgagactgtggcagaactcttctttgcttcttcctagcttctgctagtggttggcaatgcttggcattccttggcttatagatgcatcactccaatcactgcccctgttgtcaatgactttctccctatgagtctgtctttacatgatgtttttctcttcttgtaaggacaccgggcatattggattagtgtccacccttctgactttatctaaactaattacatttgcaaagatactgtttttaaataaggttccactcacaggtactggggttattacttcaacatatccttttggggaacacaattcaacttctaagaccaggtgaagctgagtcatgacccacacagcctggggatgggctacaagcaggagcgggagctcagcatttcactaaatgaaatgcaaactctaaaagggttcacagccaaatggacaggcagcatgtgggaagaggaatgggggctcctgcttggttgtggactgagcagaacacaaggcttctggaaggataatatgtctcagcttcctttgtctgaactgcatagcagggtgcaccagaggccgaggctcccctaggctcatactcagaaacataattcaattctttccaaccaactctggccaaattgatcccctaaggggtgactgtattacctgacttagaggggcaagaaaggggaggagaagcaaagatctgcccatctggggcagctttgtccagattatgcatctgcaacatgccgcttgcagctagcatcagagtgcctggaaaggagagaaggggcacgggaggaagcaggcaatctataggaaggattagtggaagcataagcaggatcagacagaggagccagtaaacacgcagcacagaatttcagattagtgcaactaacccgtgcaacggtaataaaatgagcagcagcaagcacggaattgattgttgagattccagccaaatccaccatgaacatgttttctttcttctagcctttgcccctttgcttttgaaagcagaaacactgaatcactgtgttctgtattaaaagctgatctgttcccctccccaaaggatggatggaaaagcagctctgctcttagtgggaggtgaggagggtagaagaagtggccagtgtggttgtagcagatgccacttgccacactggcacagagtcctaagacagggtcttccctatgactgcccacgattcctgcccccagcccaacctcttttgggccaacaccatgagatcccaggcgagacactgggctcagcaagaccagctccagcagatttgggggagctccaaacaagggctctgaagactcagtctctaggaagcttggcaggtgagtctgcatggagttcaaatactggattgaaaactagtgactcacaattagcccaacaaaatggtagatggtgagtagagtgaggtgcttgaaccatcacaggctggaggcagaagtggggatgggggtgagtataccatgcctggcacatgctccatcaatgtcagtcatctgcttatttattaaatcattcatgcatggggtcaaatgaatgagcactacaatgtgtgctaggcacagggaaagagttgatagaaaccaaacagctccaacaaaacatgcttataccttgtacatatgccatgttcaatagaaaactttgcttagggcgggggagggggttgcagttctttgtgccaagtggcccacccagttgactatctctgcatgcaatctggagataatgggggccagtaaaggttttgcagagatcaaactgtctgaacttgatcctagaggatgagtaaggcaaaccatagagggagaacatctcagcagagagaggagagtgtgagaaggcaagtaccactcacatgatcagtttgaacgggttacaggatgctgaggaggaaataaaattggagagataaaaaagggataggcactaggtggtaaatggcctttgattcaggctagttatcccaaagcacaaggggagccctgggagcattttaatcaggattagactctctctcttttttcttttcttttcttttttttgagactgggtcttgctttgtcacccagactggagtgcagtggcatgaacatggctcactttagcctcaacctcctgggctcaagcgatcttcccacctcagttagggccacaggcatgcgctgccatgcctggctttttttttttttttttttttttttttgagacggagtcttgctctgtcacccagggtgcagtgcagtggcatgatctcggctcgctgcaacctccacctcccggcttcaagtgattctcctgcctcagcctcctgagtacatggaattacaggtgcgtgccaccacacctggctaatttttgtatttttagtagagacggggtttcaccatgttggtcaggctggtctagaactcctgacctcatgatccgcccaccttggcctcccaaagggctgggattatagacatgagccactgcgccgggcctttttttttttttttaactttactttcgtagagacatggtctcactatattgcctaggctgatctcgaactcctgggctcaaacaattcactgactcagcctcccaaagtgctgggattatgggtgtggagccaccatacctggcctgaatcatactcttatttttagatgatcactctggcttcagtggggaataaatattggaaggggattgatgtaaagacatggggaccccaatttggaatctgtgacactaaccttatgagtcccagacatgagttgtagcagtgagcaagaaggagacagagattcaggagagatttcagaggccgtatctatcagatttagtgataaattggatactgaagatgaggaaaaagagaaggcaaggatgatgcttggcttctgaatctgagtttaatggcagtttgaatggaagactggagactgatttctccttgctttaaggagaatatcccaggagagaaaaaggtgcagtgagagcctcagtcatatatgctccctgattagacatttgttttgaagaagcacaaacattaacaatcatctcccacagaacaccctacagggatgtgacaaccctcttctgcattaagtcttttgattcagtggggagacgggcaacagaaaatggcagctcaaatgatgtaccaatagccttgtgtctgtcaagctttgagcatctgttctaagactgttgttaaggacagtatcctaatgcacttgatccaaggctcgtctcctcccccattctgtagtgtcagccttacagccatatgagtagttgcccagaacagctgaggagggtcctctgcaatgatcagcctggctcctggatgtcacctgccctcgtggcctccagctgtagctcttcccctagtcttctggcacagccatgacctttgtgcactccagaaccaaccaaagcactggtcaaggggaactagaggatgcccaggtcaaaggctcagggatgtccacatcctttcacctatctcagctctcagtcttgctcttgccttgggtcactgcaggagctggggttgctgtgctgctgtgcccagccatccaccttatatcctaaagctttgatgagccctgattcatgacttctatttggcactttaggtgccccaggcctgaggccctgatgggctcttacctatttcctccaccactcacgtttctcagaaaccacagttctggcccagtcaccagtcacagtctggcccagattcagtctgcctgaatcttaccaatggtcagcttgcctgctgctcactctctggacctcaatttcctcatctgtaagatgggttaagatcattataatgatggcacaagtctaagataatgaagttttttatctcatgattcttctcaataactggtcatttttagtatttccattttgcagatgagaaaatggggaaactttggggctcaaagcctctcagatagtaaattatgtggcttctgagactgtcctgaaccatcctgccatggtatttcccaatgctggctcagaatgggtgttctctaatgtctatgggcacagagcatggagagtatgattacagactgtcttgagagacctgggtttgaattctagtttcatcatttcagagttgagtgatttttaatcatctgaccctcagtttcctcatctgtaaactgtgactactaacagtactctatttggcagagttgctgggaagtttaaatgagttaatgatgtgaaactcagcacattccatagcatgtaggaagtatgtaacatacttgctgttatatttttcttttcatcgtcttattggacattcccaatgctttgtcccccagagctgccccctctctcctgacaggctgtgcccctgcctctgctgcctgtcttcgcctctctccatgaagcattttcccctcatggtggctgttcaggttggagcttcacccggttctcctgcctctggttcctgttctcacaccatctgtcaaccccttccactgggcacatgctcccttggagggtcactgaagcctcagggtgtccaagctcacagggcccagggcatgaccctagggagactgctgccttgcttcatcatcttctcttggcccacatagctttctcccaaaggctcaaactccttctgcctgggtctgagtaaagctgcccctgggaaagttgctttaaggacagttgctaagaactcccagagagtgtatgatgacctgaatcctgtcactgtgccaaggccgtgatttaaagaatttccagcgaaataataagagagagttttaacatgaggtacacaggaaataaaggaataataagggaagctgtatccaatatcttctcaaacctggagctgggttgagagtgcatccatttcttctgttgaccctcaccatgattaggcctggctgtacagggactcaactgtactatttcacaaatgaagaaggtgaggctcagaaaggcgaaaggctgagtaattggctcaaggtccccagttttaaggaatggagtttgggctccagatgagggcttgtcccacagctcttttttctgtagaaaattgacaatgggcatggggcatggccaagacaatgaagtcagatctgccactggggatgacctttagcacagctactctggcctccagactggacactgtcagtctcctcttgggctcagaagtccaggccacccccttgaggcctggctgaactgcaggagggatgtgaaaagaggccttctttctgcactggtgggcctggggaagactgagttctcttaatgttaattaactggtcacttctctactgcagcctccagtcagctcactgcagaaaagtgcccaatcctggccagaagaggattttaccttatttttctcaatataaacattcctgacctctacccactaggtgactatagcccctcgcacccagctgtgacaaccaaatacatctccagattttgccaaacgtcccctagtcctagagagcaacaaggaataaaaggaactgaatatttactgagcctcttctctacacatacatttctattcaccaactagggacaaagatgaccctagatgtgttacctcttgatctgcactgcccacaatggtagtcaccaagtcacgtacttagagcacttgaaaggtggctggtgtaactgaggaactgaatttaaaaatttattttattgaagtgttctatgtgtaaaatacacaccaaagacttagtacaaaaaaagaatgtaaaatatctttcatctgttgttttctttaattttgctgcatataataataataatattttggatataccagatgattgtgaacctaagataggtgggcttaagattctttgactttacaatgctgctgagaaagtaatacctgttcagcagagactacactttaagtaccagtgcaaacattctgcttttcactttcagtacagtattccataaattacatgagatactcaacactttaatataaaataggctttgtgttaaatgattttgcccaacttcaggctaatgtaagtgttttgagcatggcacatttaaagtaggctaggttaagctatgatgttccgtaggttaattgtattaagtgcattttcaacttacaacattttcaacttatggtacatttattgggacataaccccatcataagttgagaaggatccgtattgagttagatacattatattattaaaattagcttcacctgtttctttttacttttctcacgtgactctaagaaatttaaaattacatacaatattcaaattctatttctattaaacagtatggctctggaggtttataacagaggatgatttttgtctccatggcacatttgggaatgtctggagatgtacttggttgttacaattggggttgacgtgctgctggcatccagtggggagaggcagggttgttgctaagcatcctacagtgcacaggacagccccctgccaccggcccccaacaaagaactatctggccccagacatccatggtgctggggttgagcaatcttgccatagagaatgaattccttgaaggattagccaataaattaggaagacctgaagaactaattggacctagatgggcaaagaagttaaagcttttattgcacttagttctcatgattacctatgactgtggctattcatatttcaatttctccaaataaaaataatgaagtctggaaaagaaaaataaattatccaggatcaccagcccagaaggtggcattgctgagagctgaactcagcctccactcactccgaatgccagcctgtccctgctacataatgtggtcctgcagctctctgagttggtgctgatatgaaaagaggctcctgtgcttaaagtctaatatccccatcactcagacccaggcagttattatttacatcagccattattgctaccaggggacgaacattaacaaaaacaccctttgaaagggatggcactcacaggcacctcacccatcaaatgaggttgagaaacgtgtggaaataaatggatcacaatgaaataaacctgtcagaggaggaacattcagacgccttagaagacaagaggtaagaacaaaagcacctgatatgggactggctctgtttaaagaaaatattatctgactgctcgactggaatagagcctagagaacaatggcccagcagaaacggaacagctcgcacacactctggagaagtattgtttctctgtaaattggtggtgtgcacagtgacgagagtcacttttctcccactgtccatctgcaactcccacctccctttgggaagggcctctgataaggtagggctggggactgatttcagtaaagacctactatgtgctgcaactgcacacaacattcctagcattttctaatggaatttttaatatgactgcatgaagcacatatgataattagttttgcacgtgaaataaggctatgcaacttgcttaaggtaatctaacagggagtggctgagatgaaattcctgtggtgttggcagtgacacactggagtacaggtgtccatggcagtacaaaggcagagataaaacttgcccatagtggatgctgtttaggctcagccccaatctcctttactgggcgggtgtgactactctccagctgctgtgggtgctggcgcaaatggctcacaaatacctcccttcctagagaagtaccatcaggcataagggaaccacttccccaggaggtcatgcattcccatggcagcccacagccagtggctgaccaacaccatggtacaaatattggcccccttgcctcaaggtgggcccaactctttagtacatttcctactccagacctcccctttacccagggctcaggtagatgcagatctccacatccccccttagctttgttctctgccatatctcatcttcctccctttcttctgagaacactctgcaatgaataatttgcacaagaatctccatctcagtctcagtgtccagggaactcaacctaagacattcaccagcagtgatgtctctgagtttgggaaacagggtggcaggagtgaactgtgaaggtactggatgcccagactcatgtcatcacagcctgctgcacctccttctccaccatgataaactgaccgttcagggattagtagaccggaggccattgtctgggcaaggactttgagagaggtgacagttaaaggtttgaaatctccaagaaacttcccattgactaaaaagggaccctgtaataaagaggtctctaggtcagcagattatcttttgagccccacgatggacatcaacctctgacatgagtgggctctgtgtcctttgaagaatggcatacatttatgtgaaatgaactccacctatggtacacttgaggaaaggggctggtattcacttcaaacaaatacagactctggactgggcgtacccatggcagctccttcgatgtctattatcttgtttagtctcagaggcctctgcatgtgtacggtctacaacgtaaatggtgccccataaggggtaggtgggattattcctatttaacaggtaggaaaagtcaggctgatcatggtatgggtaaattgtcaggacaaatggtagacctgatcatagtgagagcttctcatttcctaagcacagaattgttatgtcaacttttttcccaaacttagatcacagctcagctgtcgcttcccctgtgaagcactcctttggctgcacatgggtttgtttattttgaataccatgtacctttcctttgtaacaccacttgaagtggcaaatttatttgtgtagtttttggaccagtggctgtttcttctcctggaaaggcactggaacatatcttcttttgctcatcattgtacatctccatgcctagaacagtgcctggcacccagtaggtacttagtaagcattagtagaaggaatgaataggtgagtggatagatgagtgtatgcatagagggatggagggatgggtggatgaatgaatgtgtgggttgatgggtgaatgggtgggggggtgggtgggtgggtggggtggaaagactgctgattcctctctggtgcacctggcctggaggacccactgagtgtgggcaactctcccctcccacccgcccagggctctggtgatcacctgtggtgaggaggcagagtggagtccccggggtcacctgggcgctgcccattggtgctgaccacaaggaagccagtccccaggcagcatgcagaagagaaggagagaaagaaacacacatgaaaacgtgcagcacggtgaacaaaactgcaattcttgtggctctgaagagctcacactaaatagcaaaagaacatcatgatttaacaaaacagggcctgaaatagatttaaaaaaaatgaaacaagagtaagaggcaccacttatcaagcacccacgacatgccaggtacttttctgggtgcctcacatataatgtttctaagatttagaataacccagaaaggtcagtatgactataaataaatctgtcatttttccaccgaaactacttctctgttagacttccctttctgcataaatggtgccaccatccatgtagcttctcagtctagacacatgggagccctccttttttctgatgtccctcttataatcaatcaccatgctttattaattctaccccagaaaagctcttgaagctgcttccttctctttaatttcattctcactttgttcaagccaaccttgtgtttcacatggattatttaagcagcctgtcgtctggtctctctgcctccagtcttgttccccttcagtcttactctccatccttcagttgaaatacaacagtgctgcctcgttgtccccaaggtaaacttcaaaccacctcactcagctcacaggccctccatgatgaatctcctgcccacccctctggtcttgtctctcttcactaccactgcccaccctgtcccaagcatgacaacagctttccattatcaacagccccccaccttcttgtatgtaagccttccttaggtgagtcactttgcatgggatatactccctcctgctccttcacctggctgataactgttcatccgtcaggtgtcagtttataacctgttacctctagggagtctttagtacgtcagtgaatctgggacagatgccccttcttgtcttcccataacaccctcatcttcccttcttattgcaatatatcactgtattagaaatggatgccttctcttaaatctgtagtctccttgaaagcagacacggtgtcccatttactagtgtactcatgtggccttgcattgtgcctgacacatagtaggtactcagtgaatatttgttgaataaatgaagaatgaatgaagaaatgttgaatcatagaatttgtaaaacttgttcaaggtcacaaactggtaaaggttgtattcaaaccctggtttgtctggctttaatgttcctgtcctttcaaatccacccctcacctctctaaagaaaaacatacaaaaggttgaaaggtgttttaggcttgtccagggactgcagctttctccagtgatccatcaacaaaactgcaggaagttcttatgcaaaattgagaagatagagtattccagaccaactgataaacaaaaaatacataatttcaaaaataatacagatggcaaacttgatcaacagccatgaaatactataaaatttaaccaccagtaaatagtaatcataatacttctcccttaaaaatatgaaaagttttgctgttttaaaagcacaatctaagtcaggggtcagcaaactatgacttgtaggccaaatctggccccccactccctgttttctgtgcagccatgagctataaatgctttttacatttttctaatggtggggaaaaaaatgaaagaggagtaatattttgtgacacatggaaattatataaaatgcaaatttcagtgtccataaacaaagttttattggaacacagctgcactcattcttatacatattcttatatgtatggttgctttggagctacaatgacaaactttagtatttgtgacagagaccataaggcctgcaaagctgaaaatatttactatctgtccttttacagaggagtttgctaactcctgttctaagtggctattttttagggttttttttttaaccccaatgctctcagataggcaagacaaagactgtcgccctcacatgtcagtaaaagaaatgcaaagcttcagagaagagatgacttacatgttcccacttggcccccttcagcagcctcttaactgctctcccattctgtagccttctccctgccttagtcttccttctctgattcattttctaaactataactagggtgtccttccccaaaaaggcagtctgcttaagtacctccaggggctccactatctaaggacaatgcttttatatgtgcgcgcatgcgtgcacacacacgtgcgcgcacacacacacacacacacacacacatacagtggggctacacagagtcctgggtggcccctgatcactcctaacctcatctggtcacactggcctactagccatcattcctttgccttgtcccatttaaattcagtggcatgctctcttgccttcagtgatttgcatacctactcccttggcttgaaggctttcttgacttactttgcaaccttgttcgacatgataattgttactcttctttcaaaccttatctcagtgatcacacattctgaaatagcataccctaagttgatttatgtctcccttcttgcccaccagtgacatcctgattttgccttgacgacagcccttattggacttatatttattcattgcctctcccatgaactactatttgctgagtgtttcttacaagccaggtattatattaagtactttcgatacattttctcatgaaattcttacattagccctgtgcagtaagtggtagtacttatttatttatttttgagatggagtttcactcttgttgcccaggctggagtgcaatggcatgatctcggctcactgcaacctccacctcctgggttcaagcgattctcctgcctcaacctcctgagtaactgggattacaggcatgcaccaccatgccaagctaattttgtatttttagtggagatggggtttcttcttgttggccaggctattctcgaactcctgtcctcaggtgatccacccgcctcagcctcccaaagtgctggaattataggcgtgagccaccgcacccagccataagtggtgttattgtcattggtttatagatggggaaacagagacacagaatagtttagtaccttttcctacctagaatcaaagaccatccaaatctaaagatgatgtttttaaccactagggaatgtgggattacatatcaatactaagttgtactcaataaatgcttactgaaaagtaaatgaatacatgaaagtctgattcagtatttttcactcactagctgtgtcatttggaaaattacatacatttctaaattttaatttctccacttataaagtggaggtaataattatctcatgaagtcatcttgaggatcaaatggaaaagagttaaagccttagttgggttggtgggcctagaggaggtacctccccactccatcctctaggtctgcaacccatgctgtgcttagcagtaatgctcagctatctggggtaggaacagagggacagctggataaatgcaggaatggggagagatttttctagttggtgggcagaatatagtgggatggatcatggatctcagcaaaacacaaaaggaggcagaaacagaaaaaggtcctgtttacatatatggttctagagatgtctcatgtttaccagtgtctgttccatctatccttgggcataggaaagagttccagtcaacttgcagttgggctgttgtcatgtgactagctctcatcaaggccatgtaagtggaagtggcatgagtcatttccgagtgacatatttaagatccaagttgccacttccatgctttctcttcccctgctcaggggttctctgagaccacatatattctagatggcacagcaacaaatatgcctttgtggtattaagctactgggagttgggtattagcttgttatgttagcaaagcctagcctagcctaactaatccagttgctgaggtagaggtctcttgctttctcctgcatcacctggtcccctgaccacatcacgttttgaggattcattacccttctctctttactgtttccaggccctgtacagtgtgtgtgtgtgtgtgtgtgtgtgtgtgtgtgtgtgtgtgtgtgtgtgtgtgtgttagcctgcaaagaaggagctcagaatgctgaatgtctcagacttcccttctgactcttgtcccttctaaagcaatcagtgttgagtgcagagagatgctgctgggctacagatggccctggagcagacaaccctgaagactaactaattttttggtttattagcttcaatatgttgtggaagtgaagaaagttgaggatttcttgagccacctcaccttctgctccaggacttagcttgaatactcctggagacaggccaaagaccatcacatgctaaatattctattatcaattattactagaaaagaggcatgggaagaggttaacaaataggtaggagacagagcatcctgtcagtggtcaatgaatctcatctgtctatagtattaacacaatggaatcagatctgatttccaattctgaggaaacttgagctccttatttaaccccttgagcccatttggcccatcattaagtaataacgatgaccactatttatttagtgtgtgctaagtgtcaggctttacttctgtcatcacactgaaaccttgtgtcagcacacaaagccctgtgactggcacacaataggtggttaatttttgcaaatcccttttaatccctcctcaaacatcacattgagatcccatcaatggggtttaaaatatccaatagagctttattctctttatttataacccttgtctctagcctaccccaaatgtgttccttcccggactcccaattttaaaaggccccccttttcctttagaagatgcaactgctttgcaataacagacttgcgatcaagtcgactcaggtgtctctcagatcttgagtagataattcttatttctagttgagaaagatggattggaactcccaaggtacatgcttgaatggcaagagttaatcctcacttgtttttctgaactctatcaaaccagcttttgtcttcctgagtggggtatggaagtggggtatggaaggggtgtgtgtggcgggggaagtttgagcacaactagagaggctagagagatgtgccagctgttgtagcaagaaaaatattaaagaaagagttgggatatttaaaggtcatatttaggctatcttatgtgtacttatgatatagttctcttcctccaacttcttgcaaaacctttaggaaaatctgtatttttccattgacattttaggacctagaagacagtcagtgagagcaaagggggccacaagtcaaggagaatttgttacactcatgtaactctgaggatcccagtcctggaaaatgtatctcatgggactcagctaaggaagaatagcattgtcctgcccaaaccctccagccacacagtctgagctttcacctccaaaagtttgacaagatttataaagactgaacaacaatcaagagctttccaatagactatctcactagagtctttcctctcacaagtgattccccattatggcccctaccctggttgctctagctagatttggacatgctatgctcctgggtccctcctgaaattgctggtctggtgatgaagaaaggacagtgtcatagtcaaggctagaaaagggatgaccacaatcctatacatgtccataaaagaatactattgctctgcaggatctcatctagagacaacaacctatcaatgggaaggtcaagtactgaaaagtgaggccaacatcactcctgtcccctctgggtttcttcactttggatctaacctgtatccatttgacaaacggctgatttgtagaactgtacaagcagtgactagagtctgggctgtggctttttccttagagaactgagagagaggatctgtgcttagtaggtctgggtctccaagtcccacattaaagactcagaaaggaagagagaaagaaggaaatatatatatatatatatatatatatatatatatatatatatatatatatatatatatatataatgttcttgaatacttggtagaaagggctaccgatctcaggcttcaaagtgaagggacagattcgtagattttaactgacttgtccaaggtctaacagctaaattttgggggacaggatttgaatccaggtgtttctaatttccaattattccatgcaacctctcaaggaagcttcctatataaaacagaatcttccacataggcttgtatcaatgggagtaggcattgcctattgatagcagaggattatcacaccacctgtggctgtgattctgtggataaacaaggcatggacacatcactcctcctctgggccccagtcttagcatctgttaaatgagagcatctcactgaaaaatggctatttagtgtccctgctggtccctgcaggagtgagaatccattatgggaaaaggagaggaaaatgccagatgaaatgctttatctcaggcttagctcttatgaaaagaaggcatatttacaaaagccagcgcccaaacctcttgctgtcactattggaacaatggcgttagtccatcgctgccaccaagcagaacaaaactactggtgacactggcccctcatcctatgcttcattattctggagttcagctttcagcacccactccaagggggttgttttaatgggatcgttagagagtgtttactagattaaaactgtggctgtcttctgcaaagcaactctgcaaatggctttatgggtttctgggtttattttgtctcaatgactcggctcagtttgcaaatcaaatcaaagctgatttttctaactgccactcgggcgcacccagcgggagtctgcagagccagctgtgttcccttgacggctggcgctggagacaagatgggagtgctgctgcctgctggcagccagagtggttccacccaatggaaagaagcaagcatgcaccttcctgaccctaaccaaggctggaggagcaggtcagaggaagcaaatttcattttctgaaaggagaaatggtagacagaatctatttgacttcaaggactgatgggcagaaaaataatagggagccagtttggactcataatgtagaagccctctcaaacggaagtgtccaaagtgtgaagcaagtccatggtgggtagagagatctctatcacagcaggaacagaaacagaggctggctggccttcttgttagtggggactgcagatcccatagtggacactttacctctgtcacttttactcctaccatttaagagaacaatcctgacatgtaacttgcatttgaaaaaaatgaagccatggaagaataatgacctgttagtcatccactcatccatccatccatccatccatccatccatccatccatccatccatttgttcatccaatgcatttcattgagtaccagtatatgctgagatctgggaataataaaacagtgctcaaaataagcacagtctttgcacttacgtcacttagagtctagcagggagatagacattaaacatgtaagtagactatatatatatatatatatatatatatatatatatatatatatatatatatatatatatatttgcaagttgtgatgagtgctatgaaggaaaagtacagggtttagtgagagtggaaaattagggatatacattaaaacagaggtcaggatggtcttctgaggacataaggtttaagaggccatcttaaagatacttctctgttaagatatttatctattaaggagacatatatagtagccaaagcatttcagagagagggcaagatgagcgaaggccccaagcttgggaggagtttgatgtgcctgaaaaactgaaagaagaccagtgtgccagagtgtaataagagaataaaaggatagaagcttagaggaggctggagggaggaagggatcagatcacgcaggcaagactggtggggcaaggcctgtgggtaaggaaaagtagcaaaatgaacagatgagtacaagaaaggagtcacggaagaattagaaagacaggacatcagtgggtaagagaacttggatggaactgggcatcagtttctcaaagggggactgaacaatatagttctagaattgaacaactaggtcagaaacaattttcccttggcctgctctgtctcagccagaggacatgaattgagatacctgggtacctcctttagcagctgcaacctggggcatcttctaccagatgggataatgtacctctcatgggaagggtcattttctctctacttgagcattagcacctctgaagtctaagtccctaccccaagcttccacatgctccattttctaaaggatcaccttaagcacctgtggctgacatcttcaacctgctacctatgttgagcccatccctcatcttccaaaggtatggttctaaatgattcccctgctcacttgccctttctaacatttcctattttaatgataagaacaaaacctgatttttaaattgctcttttttgctctgtggctttctattgtcttcctttcagagtctgaataatagttttaaatccaaaccatcacttaatgcctgtttacccactggctgcagttttctctctatggctctgatcagattgattcccaggtctagagtgtgtcaagcaaagtgctcaaaatgtcttttagcttttatattcaaggaaattcccttgctttttgctaccctaatcaaacatccttattggattaggtggtagtatcctcataaaaaggggaattttgaacacagtcaagcagacaaggagaatgtcatgtgatggtaaggcagtgatcagggtggcgcttccaaaagccaagaaatgccaaagatttgccagcaaaccaccagaagctaagagacacacgtagaaaagattcttcctcacaacactcagaaggaacaaggtctgcagacaccttgatttcagactttggacctccagaactgtgagacaataaatttgtgttatttaagccaaccaatttgtaggactttgttacagcagccacaggaaactaatagaggtccattactttgcaaccgtccaagctgggtggtactaaattagatccagagttactagtagcaacattacacaaaggaaagggttggagacacatgctggagccaggtgtgtgtctaatattcttgtgtaaggggtactaggcttggggtcaagttagaatgatcctgaatgagtgcttagggctgttacaactggcaaccatctggttctgtgggattcatgtagctggtcatagacagtggctggactctccagggtcagggaccagacagcggcaagttgcttcatcaccagagtactggccttgagtctgacatatggacttcagggtctggatgccctccatcagacccatgaagcagctgccgtgatgacagagagagggaagagccttgggagagactggtgacccatctctgggacttcatatgcttccaaagtccgtgggattctcagtatcttcctgtgttaaaaagaatactgttttcaggaaggctgcctagaggaaatttgatccgggtggtcaggaagggatgggataaacagaatattgattcccagctttaggttcttgatacaaactcctcacgggcagtggacggatttataatagatagggtttgcctttaatcaaccctaggtactctaagcatagtaccaggcaccaagtagacactcatcaaacacaggtctgcttccctttgtcctatgctccccaagcatccttcttatctgatgtggtgagaggggataactgaactgtgtccgactgacattctgcactatctagttctctaccccattcccaagtgctactggagcctcatttctttgggtttaagtgttggatctcaccaaattggaaaaccagaatgcggatgctctgatttcccaataccctgacctctcagaagcctgcctgggcttggacagctgggcattcacactcattcatgcattcctatcctttcacacacgcttactttacctgcatacacactccattcacttaaggaaagatggtaacctaaagctcaagcaagaggggaagcccttatgctaaggagaggtagagaactcttctgtctggttctttaaatgtcactgcaattctcttgcacatcagcaaagcaactctagagaagcccagcagggtgggcttctatgtctctgaggactgcagtcctgaagttttcaggagagtatagttttagagattcttccactgtccccatatgttcctattgcttgtcaggtctcatgtttccaattctcagttcagaaattatgacccagccagctaccctctaatagagcttacatcccagagggtgtccttagaatcccacctaccccatggagtgcaaatccattgcatccatctctcctggtctagaaatcgaaagccaccgaggagccatagagcataccatagtgaaggagctttctctgtgagtttccttccctctccagctgcttatttaagcaggctgcagacacctagctctcccgattgctgtctagagccctagtgctacccaattgatggtgttcttccttctacattatctgttttcttcagtggaaaagtctgccaatatctgtgatttgtgtcacttttgtttgcaggccatcaattctccttgcctcacagagagtattttatctctttccatccaggagcctgagttcctgagagggaacaagttagggacatgtcaccctctgtgactcatgtgaaatcatggtgacttcttatcacagggagccctagtgcttccgttttcttcttcctcctgcatcttctcttttgtgcctacatattgggctgattttcttcaaagttataaaagtcatgtgtgatgggtcttggtgcacatttcgtcaagtagctgtagatttttttctctctttttctccccactctgcccgtgtgtgtgtttatgttcctctgtgtggttttgtcgttgtgcatgtgtctatatatttacacacatacacatacatacttgggtcatcgcttttctctgtactttaaatctacggttatatgcctacttacgtttaccacttttatctccttggaagcagtctatgaaactatggatgctgccagtaaattcagggaacagagtagaattgcccagttctgttgtgtgtgtatggggagggtttgctgttaaaaatatcaactctgtaacaaaaagatacatctgatttctaactattcaaccctgtaataggttaaacgatagcaaaccattcattgattttgttttttaaaaagagtaataaacagaaacatgtaccaactgaaagagccaggcaattcaattacaattaggaaaacaaaagtgatgagcctgaacaatgctgccttagttttggggataagtgttgaaaatgccaaccacgtaataatgcagcgtttgtcttctcattactaaaggccccagtactaatcacctcatttttgaaagctgtgtaccaacagaacgaagtacagaactcagtagatgggtctaatagacatgcttaaaaaatacccacataaacatagacccaaatataagaaaaacatatatcaaaagaatatttgagtaaatttatatccatcactccactgatcaaagtaccagtccatccttttacaccattcatccacccatccatccattcagtaaatatgttttaaacttttactctattttacgcactgtgctactaatatacaccctagaatgtatgttctagatgcaaatgactccggtgaaaataacaattctttcttgttttgagttactgttgcctaatctttctctgtgtggctagaaagaaatacttaaatggctgaagaacaggtgaagacagacaagcagatgccaacataccttttgtagccagacgaacacagttgattttggtctcctgtgaacaacaaaaatgagatgccaattaattagctgtgagttatataaaattgttatataaagacaaaaatacatatatatttgcatatatattcatgcatatgtatttttaattataattttaaatttgccctttccatttttttccccatcggatgaccttttaattccattttttaatttttttctcaggctaggtacatatgttattcagttcacttcctgactcctaccatctcataaacctcattcccagacagaaccactttataaacatatcagataattcccagcactcatcatctttaacaataacacgtagtgggtacttggggtatgcaatgtgctttgttcagttgcatgagtgagcagatggaaggagggcatccttgggaaactttgttactagcaataatgcatctacatgcatagacgggaagagatacttggcaatagtccagtctatatgaaacatgtcaaactcaaactgcaaagttcatgttcaaaagttacttttcccctgagctcttgtgtgggcctcgcaaccttcataaataatgtgtgtggcaatagaatctttgctaggtgaactatctagttgttgttagctgttgccaaagtaaaaaggattcataaatgtgtgatgttgctgggcacacagtggagttaatgaagagtgtgcttaggaagagaattctctgcccgctttactgggattcatctcccaggaggtcctggaaccagctgaaaattccagttgactaaattatacccccaacaacagtctgaattcagtgtagcaaggaaagtaaaatgcaaagaatgcaagtatgtgagttgctgaaccaaaaatctgtcaatcatccaattcttgtcttgctgcagctcattcacaaagaaccattgcatcttgaagggattggtggcaatcaggataggaaaggttaggaggccataataaaacccctgaacttcagtggctaaaaacagcaaaggtttattttccattcaaactacctgtccaatgtaggtgtgtggctgggtctaaggggtgagattgggggtgattgggagacactctgaccattgtaaccactcagagatcatagctggtatgtccattttaacccaaggggagagagtgctaaagggtaaagcagtatcaatcaaatgctttgaatcagaagcgacactttcacttctatgcgtgctttattggctagaaccagacacatggccatgcctaattttagtgagatggggaaatggaatcctcccatgtatccagaagtagagaagacatgacaatgtctacggcagattctattccatctaggtacacctctgaatgctggaaatgatcacttctattacgtccaagtatgactccccataattaatctcatagttatcgccaatagtcttgattcttttcctcaaaatgcacagaaagtctgcttttgcttgtgtaaaaaagaggtctggataatgaaagatggttctcgggctcataaacattcttctttatcaattcctcatattataagagttcaagtcttttgagctatcctagctgctcattctaggacaaactccactttatcctattaatgtggggtgactagaacacaaaacagcagtctatacatgctcttattgatacatgattatattgatatatgattatctagactatcactattatccttacttatattgggcttctattaacatagctaacatcctggtgtttatccgtctcccccaaccaaaaataaaagtattggttagaagcctgcttctacatgtacaagtgtggctatatttttgaaacccaagtacagagtcatatttaccactacaatttccatcttcttcaactgatccaagtactacaggccatcatcacagtctccacaagctgaaaatttttagaaatcatttttttctttaatttcatccagatcattaatataagtaacaatctggataatgccaatggtagaaccttatgacatgtactagattccttcttccacgttgatattcatctgttaatcagaatcagaactaattgctaatatcctaaactgcttatgaattgagcttgagaataggttcaaattccttttagacactgatactctgtctattgcatttctccaatcagtgcaaagactgtcttaaagaaagaaggttgggttgacatgacttgttcttcggaacaagtgttttcttcttcataaaaactataagtgtctctctttaaaacaaacaattatttcattttataaagtagataatttggaaatgttaaaaaaatgacaagtcatggttcaagtatatgaatcattcatataaaatcttcacacaaaatttgaagcatgttacatttcaataacaaagttttttcagagaacatacccaaaagatgaaaaaaaaaaaaaggaaaatggctgagaaaaaaagtaacagtaaaggacattgctctaaatgtgatgtacaaaaagcttaagttacaagttaaatcttgcatatgacaattaaagtgagcaaactcatttctgttttcatgtttggacaaaggttttcagcttctgttggcttccattccaatagcaccataccctgtgttttggtttaaagagcttgagacggttaaataaagcatgaaacccagaacactgaagaagacatgcaaatgattgtacagtgtcacaatgactatcattgagaaattgtgtagactgggagaggtgccaggagactatagatggttagaatgatcttccacttcatggtaatgcaacaacaacaaaaaaagattttgaaagtaatatattagaaaacttgccagttctgtgcatgatttttgaatagagcagagggcaaaggtttgatgaggctaatactgctgagagtaatttctaaatatgtatcttcactttaaagaaattcagtcttatctgtccagacatctaagaatcttttctcagggaataactttaaatataaatgaagctttatattcaatgatgttggttccagtgttctttataaaagtgaaaatcatgagcgatatatctgtctaaccacacaggcatggcaaagaaagctgtggtctctcttattcaacacagcactgcaagtcctagccagagcaactgggcaagagaaaaatttaagggcatccaaattggaaaaaaaaaagtcaaactgtctctgtctgcacatgacatgatcttatgtatacgaaaaaccaaaaactttaccaaaaaaacactcctagaactgctaagcaaattcagtaaagttgcagaatacaaaatcaacatacaaaaatcagtaatgtttctatacatgaataaactacctaaaaaatacaaaaatcagtactgtttctatacatgaacaataaactacctaaaaaagaaatcaataaggcaatctcatttataataactaccaaaagtaataaaatacctagaaatcaatttaaccaaggaggtaaaagacctctacaagaaaaaccaaaaatactgttgaaagaaattgaagggaaacaaatagaaagatatctcatggtcatggattggaagaattaatattggtaaaataatcagactctccaaagcaatctatagattgaatgtaatctctatcaaaataccaatggcattcattatagaaatagaaagaagtcctaaaatttgtatgaaaactcaaaagaccgcaaatagccaaaacagtcctgagcaaaaagaacaaagctagaggtttcacactaacagactttaaaatatactacaaagctgtaataacaaaaacagcatggtactggcataaaaacagacacataaaccaatgaaataatatttttaaaaacgccaaaattaatgcacatatctacagtcaactgatttttgataaagtcaccaagaacactcactggggaaaggacagtgtcttcaataagtggtgctaagaaaatggatcatccatattcagaagaacgaaactagaccgccacctctcaccctatacaaaaatcaactcaaaatggataagagacataaatgtaaaacttgaaactataaaactactagaagaaaacataagggaaatggtctgaaaccaaacatatgacactgatctaggaaaatattttatgaataagaccttaaacatataggcaaagaaagcaaaaataaacaagtgggattatataaaactaaaaaattatgtacagaaaagtaaacaataaacagagtacaaaggcaacctacaaaatggaaggaaagtatctgcaaactattcatccctcagggaattaatattcacaacatactaggaactcaaacaattcaacagcaaataaaaatccaactaaaaaaatgggcaaatgatcttaacaggcatttctcaaaaggagatatacaaatggccaacaaatatataaaaaatgctcaatatcactaatcatcagggacatgccaattaaaactacaatgaggtatcatctcacccttgttaagatggctattacaaaaaaaataacaaatgctgctgaggatgtgcagaaaagggaactcttatacattgttgatgggaatgtaaactagttcagccactatggagaacagtacagaggttcctcaaaaaaactataaatagaactattatatgatccagcaatcttactactgggcatttatccaaaggaagataaatcaatatattgaggagacatctgcatcatgcttattgcaacactattcacaatagccatgacaggcaatcaaactaggtgtccaaaaccagatgaataaagaaaatgtggtatatatacaacaaggagtactattcagccataaaaagaataaaatccagtcatttgtggcaacataaatggaactagaggacattacattaaggaaaataagcagtaaacagaaagttaaatacttcatgttctcactcatatgcagaaactaaaataagttgatctcatagaggtaaaaagcaggaagcagatactagaggttaggaagtggagagagagaaagggaaagatttgttgaaggatacaagattatacctagatagaaggaataagttctagtgttctgtagccctgtaggatgactatagttaagcaaaatatatagtttcaaatagctagacagaggatactgaatgttcccaacacaaagaaatggtaaatattcaaaatgatgaatatgctaattaccttgatctgatcactattcattatatgtctcaaaacatcactatgtatcccataaatatttacaattagtatacgttaaaaacataaaaagaaaaaattccaaaaggaaaactggggtctatctacatagtagaatattatggagctgttaacaaaaatgattgtgagggccatgtaataacatgggatgatacacataagagaatattaaataaataaagcaaagtacatttttttgttacaacatgcaaatttaagcatttaaaaaatacatcctgaaggaaacagactaaatcttaataattcttgcacaattaatttgaagtgcaatatacatgcagatgagtatactaaacttaaatacagtttgacaaatttttcaccaagtaaacacacacctatgaccagcacccagatcaaaacactcaacattgccagcacctcagaagtttccctcatgcttcttctggtcacttcttctctgcaaatgtgaacattaatttgctttctgtgggaatattctcttaaaatgtggtcacaataaagggaattctgcagagtttttttgttttgttttgttttgttttgttttaagattcagagggttggtgtgcaggtttgttacatgaatatattatggaatgctgaggttagggcttctattgaacccatcacccaaagagtgaacaaatgaacatagtacccaatatgtagtttttcagcccttgcctctctccctctttccccacttgtggagtccccaatgtctattgtttccatctttatgtccatgtgtacccaatgtttagctctcacttacaagacagaacatgtggcatttgattttctctttctgcactaattttcttaggataatggcttccaggtacatccatgttgctgcagaggacatggttttattcttttttatggctgcatagtattccatggagtatatgaaccatgttttctttatccaacccaccactaacgggcacctaggttgattccatgtctttgctattgtgaatagttctgtgatagacatacaagtgcatgtctccttttgttagaatggttacttttcttttgggtatgtacccagtaatgggatttctgggtcaaatggtggttatgtttttagttctttaagaagtctccaaactgctttccacagggacagaagtaaagccacacacctacaaccaactgatcttcaacaaagatgaaaaaaataaacaatggagaaaggacacccgattcaaaaaacgatgctgggaaaaccaggtaaccatatgcagaagaatgaaactggatcactacctctcaccatataaaaattaattcaaaatggattaaagacttaaatgtaagacctcaaactataaaaatcctagaagaaaacctacgaaatactctcctgggcattggcctaagcaaataatttatgactgagacctcaaaagcaaatgcaacacaaacgaaaattgactattggaacctaattaactgaagagcttctgcacagcaaaagaaaaacaaaaacaaaactatcaacagagtaaacctacagaataggagaaaatatttgtaaactatgcatctgacagtggactagtatccagaatctgtaagaaactttaacaaatcagcaagaaaaaaaaacaaatagccccattaaaaagtgggcaaaggacacaaacagacatttctcaaaagaagacgtataagtggccaacaaacatgaaaaaatgctcagcattgttaatcatcggagaaatgcaaatcaaaacaagatactgtctcataccagtcagaatggctattattaaaaagtcaaaaaaataacagatgttggcaaggttgcagagaaaggggaatactctgttgatgatattgtaaattagtgcagtggtttattctatcttctcttgtacattgtgtcatttgtgagaagtttttaactttccttaatcttcccttccacagtttcgtgcaggaaaatgagccatttcctaaaatcaccccttcagcaccacacgttttaaagtctgttttctatgatctagagtgtatatacgattatgcttaagtcttcctgactgacaaacgtgatgccaaaacgtttgttttctcctaagttcctaacaactttaattccataaccaatttgtctctgttggtcagaattaggtacagaataacaaagccctaagtcactctcttgaccttctgagtgactagattgtcagcaagcaaatcaggtatattctggatactctgatatttatcagaggagaggtgtggccagtgtgcctatgtccaaagtgcccagtcttttcaacaaaaagaaatgagcactttctttgttctcggattatataagtctctggggaatggaaaaaaaagctgtattttctatttgatctctactataccctaattccaggtttgtaatatattctgggacagtacaatataatttcatttccttatcattttaatctcacccatgctccacttcccactccagattaaaatctgcatgcaggtataaatcaccctggggtagaacaccgtgtccttactgttgtgctctgttgagaaatgcttctactcaaggctcggccagtgcagcaatattgggtaactctctgtccctttctgtggctcaatttccccatcaatcaaatgatggagaatggggtagaaaaggccactttggtagaataggcaggccactctaccaaggttgcttccagtcctcaatgctgcgtctggttttagctactggcagtactcctttactttcagtactcagtcttcttgatactacttcctaatacctcatttcatgcaaataattttatttatttatttatttatttattttggtaggctgttacctaccttattactcaaaatgcctcatatctgtatctacttatagcctccattttaacactaggtcaagtctgactcatctaaccatccatccatccatccttcaattatttactgaaattttaggatgcctcttcaattgaggagttcacagtggaactgtttaggtcatcaaatgtctcatagctgctgtttatcatccagaaagacttgggttaggctgctaacctgatcaagaagccctaggtacctggctaatacatacaattcttactttactgctctattagactcctcatttaataggatgtagatttaaccctgatcccatagttttcaaatagttttcacattatcccaacttgtgtctttattttgtctaagactgagcttcccagttgatatgatggaatttagacctgacctcagcgtctttccatagtttccccagtaactttgactcaggccttaattctcctctaagactgtgctgagatcctgaaagtctacctaatttttgttcatgtactcatttggtcaactgctcaacagatatttattgaatgattactatgtgccacacattgggctaggtactggagctacaaatacgaccaaagtagacatggtccctgtcctcatagagcatgcagacctggggagagacaaacattagacaaccattctcacaaacaagtatctaattaaaagttgcaataaacactgggagatatgcaataaacacacataggtatgtatttacttggtgaaaaatttgtcaatctatatttaagtttagtacagtaaactaaatgaggttgtgtttaaaagtttagtacactaaagtaagtgagaagtgccaggtgctgtgcatgtgtaagggagatggcatggggtgtgggtgggaagggagatggtctgctgcttttagaaagaccatttaaccttagaagttagacacaggaagcatcaggaaggtcatcccagactcagacacagacatgcaaaggcctgaaagtgggaaaatgcatggtgctgttgaagacatacaaaattctggcatggctatcatcataatgaattacctgaggcatgatgtaaaacgaagctagcgacataagaccaggagaccttttgggactatagagttttggtctatattttaagaacaacaggaagtcattaaagagctatttaggcaggaagaattgaaatttcaggtttaaaatttttaaaggtagaggctgttacatagagaatagacttacggtgcaagagaaacaagttggtgagaagaaggtggtggtatagtcgaatgatgagatggtggtgccttagaccagaagagtggctgcagtgatcctacctcaacctttccctacctttggaaagcatatttttgctctgtttgactctagagctccctcccaccatcccaccccacctcacgcatacggatcagcctgggcttatggtattgacagcgttgggtccttagtctagccttcccacaaactgactctccttgactttcttccattgcactgacccttaagctattgtttagccccaatgggactcactcacttaacatgtttgttacctgaaagaagcactaagaatttttttttttttttaaaagatgtcctcttttcttttttctttttgaaacagagttttgctctttttgcccaggctggagtgcaatggctcaatcttggctcattgcaacctctgcctcttgggttccagtgattctcttgtctcatacctacttagcatagtttatgtcttttaatccttataacaagactgtgaggtggatacgacaatgtccatttttttctcacaagattaaataacatttttcaaggttacacgtataataagccaggctaaaatacaaagtaaacttcaagcaagtggccttcttttctgaggtgtctgtaaggcaaatacccctttgtcattgaggtcagatgctatgctttcttgggttgcaggcaggcacacaaagacaatggggcacagctttctttggaaaacaggctaagtggtttgtgatattacaaaattctgtttgacttgacgcaggaccttgaacaatcagataagatctggaatccttgagtaactcagaaccattaggactacgtaatgtggtagcctcctcctcaaaggataatgcatgaggaatgcctttaaaggggtaacagaagcagtggggcacttgagtgctagctcactagaaagcacgtatgctggattctgcagaccctcagtaaccaacagtgagtggcaaggtgcagcctcaggttgcaggataggtggctattggttacagacacttctaactggacaaatgttcactatcaactttatgagatcttcctggaaggcattaggctccacttgaggcaatagccaaggccatgagccatactctaagaaaggaagcccccaagtagcatgcaagccattcggaaaatttaaaatcaaacccaacctctgaaaatcttcttgtaagttttatctctacttgctgactccattgcctcaactctccaagtctctggaactcccttcagtgagactacactaagtccactaagacttttatatggtcagcactcatagtcactgctacaactccatcttccttaatctctcatcaacattagctgcaactgaccattccctccttgacctgtttaattatcttggctttaagtcattctaccttccagacttttctcctacttcactacctgttctttatccctttctttgcctatgtatttatcctttacttgacttcaacacactggagtgacctggagcttggttttatatcctctttcatcatttgtatcctaacttttttaggagattataataaattgcaaggatttgaatattatgttctcatgactcccaaagtactttttctagcattgatattcctgagatccaggctcatctatccatctgtctacctgaaatactcacaatcaaatatacaatcatctaaaagaattgttttctcttttattttcactccaagccttactcaccactaattttccatgtttaaataaatgtcaccatcatctacttagttgattaagcaaacaacctaggagtcattattgatttttctagatatgtgacttcccacagtcaatcaaccattaattcatgttggatctgggtagttgaagaaattggtaactatttaacaccaaattttcccacatatgattcaaaaacaacacaggaaaagaagaaaaaaataaaattgtacaaaatccacaatttcagcataattaatgtatagagaagtcttaaaatgtcataggcctgtttggtacaaaaagaagaaccagatataaatgaaatatctctaaagctttcaacacaatcacccttgtcatcctatgtggagaacaagagctatgtaaaaacaatttggaagagaaaagaggtaagctagcagagagtacatggctgatctaaaatacgttccagaaagacaaagaccacactacacatgaaagtgctaaaacaattcctggtagatcaaaactaagagtacaggaaaaggacttgaaagaacatgtgactcaaggtggtagtgttcaacaggtgaaataggttcaatgggtgaaaatgagataaaaagaagggagaagtactcttggaagattggagattgaaggaaaaaaggaagcaaagtgggaatttttagaatcacaaaagctagaataaaaacaaaaagtcagaacctacacccattccctatgacatacacacaaaatcatcgactgaaaaaaatacctgtactttactatccagtcagaacaaactgtttctgaactgagaatcgtataagccactttaaatctaaaaaattttttaaaatttgaaagagcctaataaagctactagatgaagaaaacagaaaatgtcaaaacaccacaaatgatgaaaatctacccctaacaagaaaacagtctagaagtaatattacaaactgaattaaatatcctcaaacaactttgacttacagaagcacaagtgaaaaaccaaaatatacaaaagatcaggaaaaaataaaaagaaagttgatttaactcaggagagaaatttttaaaagatcacctcagaaatgaagattaaattaccagatgtcaaaaacagcaatttaataaggggcactaaagaaagacagaaacccaacaaagacaacagaaatgagatatagaaaaaattaacaaggattggtgaaaaagtggtttaaaagtaaggcaaagaaaatccaacatatatatagtgaaatttctgagcagagagacaaaataggtaggtaaatattttatgacaataacccaagaaaaattattggaagtaaaagaagtcccaagcctctatactgaaagagtgcacagtaccctggggaaaatgcacctgaaaagatcaactccaagacacagcctagtaaactattaaacttagaataaatactctcaaagccaaagagattgaataatgtacacatgcaagagaattagactatcatgatacttctcaaaaacagcatgcaaagcaagaaaacaatgtggcagcattttccaaaagctcagagaaagtattaatattaaccaaggacttcatagctagccatgtgtttttcatatagcaaagctatggaaaagtagctttcaacattcaaaaagccagggcatgctgtacttgtctttcttgaaggatctacagaagataagttcatccaaaaaatacgactgaggaaacttcagcaaaaggactgatgggtaaaagtttaatatgtttaactgtaaatctaagactgaaataaggtaggggttggatgaaagtaggatatataaatgttatgttttctgtcattgcagaaataatacaactaaaaattgagagagagagagagagaaagaggaagaaatagggaaagagaagagtagtattaggtcatttattgttgtacaggcagtgctatggtctggctttgtgtctccacccaaatctcatcttgaattgtaatccccatgtgttgggggagggaccttgtgggaggtgattggatcataggggtggttcccacatgctattcttgtcatagtgagttttcatgagatcagatggttttataaggggctctagttcctttgcttcgcacgtctctcttctgccaccttgtgaaggacatgtttgcttctccttccgccatgactgtaagtttcctgaggcctccccagccatgtggaactgtgagtcaaacaaatatcttttctttataaattacccagtctcaggtaatatctttatagcagtgtgagaacgaactaatataggcaatatgtgaaagttaatggataccagaaaaatctgacaaaccagatagcaaaagattaaacaagaaaagatgggattaagagtgctaaataggccaggtgccctggcttacgcctgtaatcccagcactttgggaggctgaggcaagcaaatcatgaggtcaggagttcgagaccagcccgaccaacacagtgaaaccccgtctttactaaaaatacaaatataagctgggtgtggtggcacgtgcctgtaatcccagctactcaggaagctaaggcaggagaattgcttgaacctgggaggcacggtttgcagtgagctgagatcacaccactgcactccagcctgggtaacacagcgagactctgtctcaaaaaaaaaaaaaaagtgttaaataatataaaagaacaaaggtaactactagaacagaaatacaagacttcctaaataccaaatgaaattttaaaataaaagagtaaagaaagcacaccagaaagtattataaaattaatatagtaaattatgacataaaaatatatggcagagttgagatatctcagtcatatcaccaaatgttaatgatttaactcaagtactgaaatgtagaagatattcatttggattacaagacaagacccaactaccttctatgtataaaagtcacatctaaaacattgttattgtaaacagtgctacaacaaacatagtcaataataatttatttgtacattttaaaataacagagtgtaactggattgtttgtaactcaaaggataaatgcttgaggggatggataccccattctcaatgatgtacttatttcatatcacatgcctgtatcaaaatgtctcatttaccccataaacaaagaaatatataaatatatcctactatgtaccctcaaaaatacaaatttaaaaaatttcaaaaaaaggtgaacaaaataattttcttcagaaaagtaaaaaggaaggaatgaaataagctataaacagtaaatgaaaaaataataaagatatagtagtgatcctgatataaaacaagaattcaactaaaaaagtattacacatggcaaaggatactttttattgctaaaatccacagctaacaaagaatataataggtataaacatctatgcccccaaaaacataatgtatttacaaagtcaatagtagtcatatataaaaccaatactcagaggacataagggtagcaaaaccccattacaatggcaacaaagatgaaatacttgctaatagcaagaacacacaaaacctgtataaagaaaactttacagcacccatgaaagataatgtagactcgaacaaatagaaagacatcccttatctcaggtaagataattcaacatcttaaagatgtcatttcactctaattaatgtataaatttaatgcaatcccagaattactaatagactttttatgaatctggacaagtggacactaaaatttatagggaacatgcaagaagagctagaaactcactgaaaaaggaaatctcgatggggaactttccctcgcagacattaaagtttagatcccataattataacagtgtggggctgctgcgtaaatagccacatagactggtgggatagaatacgacatccagaaaaacacccaagaacatatgaaaatttaaaatatgagaaaagcagcatctcaaattatcgggacaaaaatggacttttaaatacatgttgctaagacaactagacagacatttgggaaaacagataaaaattagatccataatttacatcacacacaaaaacaaagaccaaacatcagaaaactaaatataaaaatactaaaatacataagacttagaagcaaacatgggtaaattcctttatagcctgagtgtaagaaaaaactttttaactgtgattcaaagtttaaatgtaataaaagaaaaaaaatgattcatctgacaacattttatttgctgtggcaaaaatataagcaaagtcaacagataaatcacaaactggaaaaaactgcaacatatatcacagataaagtactgatatctctgatatataaataactttaaaaattgatagaaaaagtaaaaaacaaactgaaaattgagcaaaagacataaacaggtaattcaaaaattacataaaaatggctattaagtataggagaatatagcaatttcacttataagaaaaaggaaattaaagctatattgagatataatttcttacatgtaagtgtgacaaaaatgaaagttagaccacacaaactgtttacaaggcagtgaggaaacagtcatacattgctgggacaaatgcaagttggttttacccttaaggaaggaaatttagtgacatctagcaaaactgtgtattagtccaccctttaatcctacaattcctcttctaggaattcactctgaagacgcaccttcaacaatacaaaaatatatgtgcacaagttccttgatgcagcaacatttgcaactgaaagatattgaaaacaatatagccacacatgagagtggccaaataaacagctataatcacataatagagtactgtgccgggcgcggtggctcacgcctgtaatcccagcactttgggaggctgaggcgggctgatcatgaggtcaggagatagagaccatcctggccaacatggttaaaccctgtctctactaaaaatacaaaaattagctgggcatggtggtgggtgcctttaatcccagccacttgagaggctgagccaggagaatggctggaacccaggagggggaggttgcagttgagccaagatcatgccactgcactctagcctggtgacacagcaagactctgtctcaaaaaaacaaaacaaaacaaaacaaagagtactgtgcagctgtaaaaaaaaaataaggaagacatttatgaaataatataaagtgatacccaagtatctatagtatgttagcttttctataagaaggggaaatataacatacattgacttcaaaattttcacaaaaaaaaaccgccaagaaattaatgacattggtttccaacaggggatggtagaggtgatgtaaaagaagtgatatgtgcttttctgtatgcacttgtttgtacagctaggcttttagaaccacgttataatgtttttagaaccacgttataatgttttacatattaagaaatcaacagggatgggcaaaatgaaactaaaattaaaaacaaagagtcataaacaaacctaacttaatttccaataaatacataaccatattctagtgaaagaaaaaaaataaaccaaataattttcaacacaacggtttgcatatatttagactgaagagagaacagaaaatatatattgaaccctagttagtaggtttgttttgctaagattaatatttctggaaatacttcttgagtattctatgttgaacaataagtaaatatatgaataataatgaagttaagcttctcactgtcagagaagggaattacagaaatgggaagagtgaaggctggaataaactccttgatgttggactagaatggaggtatcatgaacttttgcctttttttttttttttttttttttgagacacagtttcactctcgttgcccaggctggagtgcagtggcgctatctcatctcactgcagcctccgccttctggtttcaagcgattctcctgcctcagcctcccgagtagctgggactacaggcatgcaccaccacgcccagctaattttttgtatttttagtagagatggggtttcaccatgttggccaaaatggtctcgatctcttgacctcatgatccatttgcctcagtctcccaaagtgctgggattacaggcgtgagccaccgcacccggccacttttgccttttatgatagatagctaaaggctgggtgtggcggctcatgcctgtaatcccaacactttgggaggctgaggcaggtggatcacctgaggtcaggtgtttgagaccagcctggccaacatggtgaaaccccgtctctactaaaaataaaaaaattagctgggcatgatggccggtgcctgtaatcccagctactcaggaggctgaggcaggagaatcacttgaacctgggaggcagaggttgtagtgagccaagatcacgccattgtactccggcctgggcaaaagagcaaaactccgtctcaaaaaaaaaaaaaaaaaaaaaaatagacagaaagatagatggatagacaggtagagggatacatagacaaagagcctagaatcagtggtactcactaacaatgattcccactcgttcccaggtctgagtttctataataagtaccattccccatttaaaggaaccagagctggggcaaaggaagcacaagattctgtcagaaagaaaataagttttcaagaactgctggagacatttcagaatgacaaaagaaccatcttgaaggggctcacactagctaattctgggacaatttgagcataaaagtaaatgatgatagtactgaagtataaccaactgaataaaagaagaatctataaatttttatcaatataaataaattaatacattgaaaataggggagaaaggagaactcatcctcggaatagatgtccactaataaatgtggaacaaatgatggaattagaaaattgtcatttggcaaacatctttttatttgtattattattattattattattatttattattattatactttaagttttagggtacatggatgaaattggaaatcatcattctcagtaaaatatcgcaagaacaaaaaaccaaacaccgcatattctcacttataggtgggaattgaacaatgagaacacatggacacaggaaggggaacatcacactctggggtctgttgttgggtggggggaagggggagggatagcattgggagatatacctaatggcaaacatctttgtaatagttgatttcaacaaaaaatatcagcaaatgctaaaagatgaaagtttgaagaagattttacatagtctagaaatatgtgtgtacaaaacacttatatattacaaagaaatagtagctttatagtggagaaaaccttaatggacaacagtttaagtaatcaaagttaatgtcaccagtaatggaacaaactgatatcatgtgccacctagtatgacacattgagaaggaagcaacatcacttttgtggtattcctgacaaaaatgcataacttgaatctaatcttgagaaaacctcagacaaacccaacttgagggacattctaaaaaataactggtctgtaatttttaagagtcaagggcataaaagtcaaggcaagacagatatgagaactctaaagggacctgacaactaaaggcaacatgtgaccctggaccaggtttttttttgttattgtttaaatttactaaaaagtatatgactgagacaattggcaaaactgaggctagtagtattatgtggacattaatttcctggtaattgtattgtagttatgttggaaattgcgcattaaagcatttaggagtaaaggggtgatttatagacagatagatagacaaacagacaaataggggaagaagagaaagaacaggagagggagagagagaaaatgggatggtaaatctattgtggtaaactgttagcaattagggaatctgtatagagagcttattaacattctttacactattcttgaaacatctctgtgcatttgaaactaccttgaaaaaaaggagttagacatattggtggaagagaaagtaagttggaacaaaaacaaatttgacgatgggttgatgatcattgttgaagctgagtgacgggcacatacagatcagtctgttatcatcttgacttttgtatgtgtgaaacgtttcttagctaacaacgtgtgttttaaaggtgagaacaatacatatggagtatgtcatcaataaaaaattgagacattcaaattttgtttttcccaacatgagtgacattgggtacattccttattttttttgacttacagtgttctcatctgtagaatgggagcaataccctctgtacaactctctagggtaaacaaaattttgtgagcacaagtgccttaaggatgcaaatatatatgcatgactttatgattctaataaattgatattgagattataggcaagacaatttttttttcttttccctgttttcaacagaataaatgccaagtattttagcatggcatacaaagcccagcattatttgatatctgcctctctctgggcttcattccatatcccggaaccaacaccgggattgtcttcccaaatgtatcagggaatccccaattttggggcttctgctcaggtgcttcctttgcaaaacatacactttcctctgccccactgtctacctggaaaatatccacttaccttctaatagccaagtcaaatgtcacttcttctacaagattttcctaggcacctcctcatcccctctacctccaggtttatagctgaacacaccaggtattctgccactgggattgctgataatttattgcccacatttgtcttcatggctgtcttctccactggattgtgggttcgctgagggcaggaactgtaacttatttatctgtattcccaactgactcacaacaagcccataataaataattggtgggtttttggggttttatcatcatcattcatatctccttacagaggagctcatgaccaatgaaggcacaattctgcagagtaaacaaatgcaaatggggtgtgggagactgggtttaagccatggctctgatcttgagcaaataacttccccatactggacttcagtttccttttatctgctgaaagaagagaactggacaatcaataagctcccttccaatactgcattttatacttcccattcctcaacaataggactttgaggctgtgtacaaactatcccctaattgagaagttggaaatgtagtttctctgcacctcatgaagagggacttagactttctattaggagctggcaaccccctggtttaaaccaacccaaaccagagcagtccttcatgcttccctgcgcagctcttatctgaccttaatgattcctgctctgtaagagatccattgagctgtaattactaattgatgtttgtaaagtctttgaaattctcaggtgacagatgtaatcaaaggccaatttattatgataattgttattagtacagctcctcactatttgttgatgttaatggcagggccagcaggtgtttcaagattgactgagggacttaggctggccatgtttggcgggaggaaaagaaaaatatgagtgcataagggatttgggaccctcctggttctagtgcacccatattcctctatgaagctatcttgtgggactagggctcggcatgaaacggagcagtaaatgcataggacttttaactgcatttttcacatgcacagattcaaccccagctcgttctcttgtttctggagtatgcttcagcaaatcatagcctctcacagccttggcttgcttgtgtgttaaatgagaatacatatagtgccaatttacacttgctgtgattcgagaatctgtttgagacaagcaatcgtggatgtgggaagaagcgttaggagactgttgaggttgtccaggcagaagatgttactatccagaactacgatggtggcactggagatgagaaaagtgcatggattagagagagcttcagagtgtagaacaaagagaacttggtgatggctgaatatagaaggtgatgtatagcaggaaacccagactttgctgataggaaagatgcaggaataactttgaaggagatgaatgaatcattgcctactattttcatcagtgtcttgtacatatggttcatgtcaatctcttcaactgtgtagcccaataaattgcatttatgggtttgcaaacttgaggaccatgatgtaaaagatgacacttgatgaaaattcagcctctaggaggaaagggactgcagaagaattgtcccacttctccacttgcctctccgtaagtacgacattcccaaacttcctttgacatctcaatccctctctttctttcaggcagccagtgtgtcagctgccgtctctggaaaccctggacttcactaatttttttcctcctcctgaattccctgatcccacgtcatgttcatactctattcaaatttgatccatgggtttaaaaactctgcccctgtggattctgcttgttctttcctgagtgtacctctatgctctatcccacctgtgatatgtaatagcaatatctgacattaattggatgtttattgcatgccaagccccgtgataagtgttttattcatcttattatttaatatttagaaacattcttataaagttgatactatgggtgttaatgttttccaaaagaagaagagactcagagagcctaagtcacttgcctaaggtcatgtagctggtcagtgacaatctatgcaacaggaaagaccccatgctagacatattaatcaaaaatgctgaggtgaaacaaacttggaaattcactaatcttatttaatagcattaatgccattttatagtgcaagaaatagaatccgtgagtgcaaatgtctccattaactttttatattttaacctcagatttcataggattgatataagagggactaattgagtgtttgagcaaaaatgttctgatgacattgaccagcatcaactcagggcttcttatacaaggatatatgtgataaatcaccctcttagtgtctttcatgaaaaatatgtatgcttccttcaagtaagagaagctatgcaaacctgccacctgctctttttttccttggcttcgaggaagctcaggagatacagatagtgtaccctgcgctaaccacctatactaggcctctggtgcaatgattactctttattccactataagattcttagactaatttaaactttttattctagggcctggtgcagtggctcctgcttgtaatcccagcactttgggaggctgaggcaggaggattgcttgaggtcagcagttcgagaccagcttggtcaacatggtgaaaacccatctctgctaaaaatacaaaaattagccaggcatgttgatgcatgcctgtagtcccagctacttgggaggctgaggcaggagaatcactcgaacctgggaggcaggttgtagtgagctgagatcatgccactgcaatctagcctgggcaacagagtgtgactctgtctcaaaaaataaaataaaagtaaaaaaaaaaaattttaattgaacatgtatacatacatactcatatatacacatacatctatatatatgcatgctaaaatatttatgtgtatatgcacatatgctgaattcttgttctgtatataaatttcataaaatttacagttaaaaatttagattcacatacccaagtgtttccaccaaagatacttcaaagttttccaataactgaattgagtatcagttttaacatgtgtgtgcacgtgtgtgtgtgcgtgtatgtgtgtgtgtgtgttttagcaagtatacctttacctgaaaggtcctttgcaaagagttatcacgcctaccatttacttgttacaaaggtcctagtgagcttgaaggacacatctcatccctgtttgacagaggggaaactgaggtttggcaggcaagtattctgtctatggagctaagaaacggaaaagccagttctaaaacccatggataccatttccaaattcagaagtttctctactttttcaccatctgagggcaatcagtccaagcttcacgaggttccttacattgtaggggcctgatggaggcagagatgctgctatatagaaactgaggctgctatttccatgaactttgttgggactggagtctggagcatttatccctgaaggcccaggctgacaagattatcagctgtcaacatttgggtaaccttcatctccctttccaaatgaatttaaagtatatttgcatgggaaggaaaatgttcctgctccctcaggtctcataccatgataataaaatctgtagaaactgtaagtggatgaaaaaataaattagcaacctgggagagctcatcttggtatctgtacaaggtgacacttggggaatttctatcttacctaaggagagaagtctgggccccaacagagctccagcaggggtttagagttttaaggctcaaacaatggaatggaggcctggaagcagggatgcccaagtgagtgggtaagccccaggagatggagtccactgaggactgggaaagagttctaggcagataaatggggcatggaacctaggctctggtgacagacaagagctgtgagtggatgtttacccgattgagattttcctaaggagtaatggaaaggttgtgatgataatcctggaatcaaagtgtctagttcagtcttcctctccacttcaacagggctctgcagagctaataaaatccaggaatcgattccttacatagactatagtgacaagtcagcaaacggttacgtgggggcctctgggtcacagctctctgttgccttggctcagctaccgatgggtggtacaggtctaaggtctgctgagttatagaagcattggaagaccgttgcttttcagggtggaacaggagcacattgagtttcaggcatttctttaccattcctccatggaggtaaaggggaaaagctgttactaaaatccctccttcagtgtgaagtaactgagaccccatgggattccaggagcctctaggtgttcgtccatctactgaaaaaatgtagtcactttgtgagaccaatcaaggaagcagcataggtgaaagcaccttgcttaatatctgagacacagcagatgctcaagcaattgaaattcctcaggatttgtggtatgaactgcccaggtgcttcaggagcaagtctgggtattataagaatatgaaggggaggcttagtcatcatggaaaattgtggtagtcattggggaagttctcaaatattccagttctcctaggcatatagaaggcactgccttattctttctgaaattaagtgtggccatgtggttagccttggccagtggaatgtgaaaatgctatgcaccactttgtatggaaacttgtagaacgaatgctctatttgccacatttttctttctcagacttggtggtggtgtcaagatggacattctgttggcctgagtctctgcctgcaacaagcagagaccctctgctgacccatttcaaatatatagcagaagtgatccagtgagattttgttgttgttactacagaataatttagcttatcttaaccaatataggagttttcaaataaacttcctgatggggtatccaagacccaaactgccatgtgatctcctgatgatcttaactcgaaccctctagagcttatatctacagcttctcattccatgtctatctgaggttttcataaggacatgcgaacagtcactgaactaacacgagaaataagaaatggggtagaaagggcaatatcataaccaaaagataagatcaattgtgccaaaagactcaacaggaacagatatcaggcttgaaactgtcagagacctttgaaccagagcaactccatcttgaataggggctgggtaaaataaggctgagacctactgggctgtattctcaggaggttaggcattctaagtcacaggaagaaacaggaggttggcatgagatacaggtcatgaagatgttgttgatgaaacaggttgcagtaaagaagccggccaaatcccaccaaaagcaagatggtgacaaaagtgacggctggtcattctcctgctcattatatgcgaattataatgcatcagcatgctaaaagccacttctaccggcaccatgacagtttataagtgctatgacaacatcaagaagttagcctatatgttctgaaagtgggaggaaccctcagttccgggaattgcccacccctttcccagaaaactcatgaataatccacccctttttttttagcatatcattaagaaataaccacaaaaatggccaaccagcagctcatactgctgctctgtctatggagcagccattattttattccttaactttcctaataaacttgcgtggacttgcctagaattctttcttccacaagaaccaagaatcctctcttggggtctggatccggacccctttccagtgacaaaaccatgtatgagaagttaaactaagaggaatacagcctggggtgagtcatgggtgagtcaaggcggtcatcagctgggacacagacacaagtcctaaagtcctccaaagttaggaaggtgtgtgcttctatgtggagtttactggacaaatcggtatatgccaggtaaggatgctccaaccctcttccccctcagaagaggagcctctggaaagcagccaaaagaaaaaagaacaaatagtccaactgtaatgcgataagatactttaatatacattgtctaatttactctctcccgatttttttgaggcagatcattaatcatattttccatcttgagatgttaagtaaactgttcaagttcacatagctgagagcagccaaaattcaaagccaagtctgtctgatgctcaactctcagttctttccactctatcatgccacagaaaacccatccatgtgcaaccatttctttaacagtggttggacacaagtgaatataatttctcccaattcattcagagacacagaattttccctaacctagctctacctagataatccccactattataacgtgattatactgcaagcatcatgaccaattcaacacagcatctggtttccaagtgctctcaagaggcaattgagttcaagaactggaggaggaagtaggagagagagaacaatcaccctgctacttcccacttctcttatttagcttagcatttggcagaggcatcatccaggttaaatgtacccctacatgatggaaaggatatgacaagaaaagacttttatcctctgcataaatagaacatgcataacagcattgcccaacaaaaggtggcttctgatggatatttgcatgagtttgccacacttgttttgcatccaaccgttaattatggtcctttcaacttcacaattacggctaatggtggtgaggatgcagagaacagtagattcagcagacctcattctgggaagagtgtgaaacaaacaatgcgaaactgcacccacccgctgtttagaactgagacagctaccctgggtaccatttggaggatttggaggaaatcaaggctgcccaggagcctggagcttgggaaatgagacatctggggaaaaaaatcttactactatgatggagaaaaaaggtcctttaggactcttttatctatggtgaaaatggctcaaacaacatctctcattctacgctgaatggaaattcagactgtactgacacctacttggtgcttttcattattcaatatctttttcttatttaatcctcaaacagactgtgtgaagtatatattactatttcaatttataagtgaggaaacagattcatagacaacaagaaacagttcatagtctcattctttcattaatccatcaaatgattattaggtgtctattatgtgttaaatagtacactcagcatggaggatatagcagctaaaaaaacaaaaaacccaaacacaccaaccacaattcatcactcttggagctctcagcatgctgtgggaggcatgcagtacccaacaacatgtgcaaataaaatacatatatatctagtgtaatatagaaagatagtgggttaacatatgagtgagtgctggtgggtggttcttaggtaatatggttggactcttctctggagatgtgagattgaaactcaggcctgaaaaatgagaaggtactagctctgcaaacagtgaagaaaagacagatgtaggtaaaatgcaccctgaattaagaccccaaagtgaaaaacatgttggaatgtttgagaaataatgtcttaggaaaggttcaagacacgaggcttagttaaaatctagcaggcatgtctgaaccatatctgaagaacagtgataggttctgggcaactctttttgaggagaacatgatggggaaaatgagcctatcagagaaaagggtaagtaggatgaaggatacccagaaattatgccatgtgaaaaataaaagaagtaatagcatgttaattatcaatgagaaataacttgagtggccagaggagggtagttggtactgtcttattttctctgaaaggctaacaaaggaaagaacgttttgatttgttcaaaccaatacaagtggctacaaggggagagtcaaggagacagaatttagctctatatgggaaaaaagctttaacaattttacctgctccacaaaggaatcaactccctttcactccagcaatttgcattgatcaagctgaagcaatacaatgtgttgctaagaatgctttattggagattttttttttggcttctcgtctagactagatgacacttcaaagtccttcctactctatgatgctatagttctataatattgctatatccaaaacaaatggttacaacatggtctaattcataagagacaggtgttgtgaattaggcaccaaagacagtgtgccaggacaaatgggactacatttttatctgtaagaaggcatcaatggataaatgtgagattactaattggaacaaaattcccaacacaagtgcctgtgaacaactcttgtgtcatgaaaatgcctgcaagaaccctgagcaacatatcttatagtgcatgccacacttgaactctgcatggtgttcacatggctggattaaaatacttcatattcacagatcaacaaagagtctataaaatgtctttatcctcatgctgataatagtaaacatttaatgactgacttccacattcctaatgtgaaacctaaggattcattattcgatacattatttcacttatttatttttgttctctcccccactagaatgaaaacacgatgagatcagggatctttgcttgactcactgctgcattctcagcactcagaaaaatgccttttttgacatattgcatgtgcttgacagatgtttccttaattaatccatcatatctaattattttagtagtttactgaaagtcacacagctactagggttttgtacctaggcagtctgatagtaaaggttgaattcatagccactctgttaacctgacaaaccatccttaacatccatagaacaaagatgtccagacctcagaattctcctacccttccttgactaaaacttgcaggtagagtagggagcaatgaaatttgctgatagtaaattattccacctggctcacaaccatcctgcaacaaatgcccatttctgctttcctttcacttgaggttaatataactctatctcatcctttgtctttaatcttttagtgacagaaatatgggtaattctgatttttctttgacctaagctgttttctttctctttcacaatggagcaaaacaacacttttttacccccccgtcaccccatatcaaatctagtgctttcatcttctggctttttttatagttttgattttcatgtttacttatagttttctttattttcttcatttttcttcgttgactgttgtttctcagctttttaagtatagattggagagctgactttgtttaaaagaactatactttttagtattctcagtatcagaaataaaacagtaattatgtattccctcttgtctaacatgagaaaatgagcagatttttatttacattcatccatcttccaactttgtcttagtttttgttgataaaatagtgaattatagatccagattagaactgttaagtttttacattatgcatctttgccttaagtagttacattttacattaaccttccattttgtaacacacttagagccattattgagcattaatgctatgtttaattagttttatgctcactgtaggtcttcgtattccacatttctcaattcttgatttctttattttgattaattgctcagtcaattgctctgtgaatgatttattagaagcagggaacgtgggagcccctggataccgagaatggctttctgatgtatttgcacacgaacaacaacttggctgataaagaatttgtggattataacactttctcctcaaaaatcctccaggcttaacatcattgtctgctgccctttatgatatggaaaaatttgagagggaccaggcagagatttgttagactgagaatggctgttctgcttcaatgaccctttcacccaactcttctcagtaaaatttaatactaaagacagtcatttgaaacagtgtgtagtttttcctttgccagaaaagtacagccttctgagtgcccagctcccattgcttttcccctgtctgttcctgtgaggtcaagtgcacccgcaagacatgtggcataagcactcatccaattccattcctgcctgtgtttcgttactgggaatcttagttacaaagcaagagtacatatgcatggtgtggaatagaaggcacaggtaattaaatggccttgttcatttctgaagcagtgtcaaaactgcttctgagatgaggcagtttcagagtgagatccttttttttttttttttttttttcctctatggcaaatccctgagtcttgaagagggaggtctctgatatgatgtttggggagcaaactgtcggaggcatttgaacctgagcaactccatcttaaataggacctgggtaaaatgaggctgagacctactgagatgcattcccagatggttaaggcattctaactcacaggatgagataggaagtcggtacaagatacaggccacaaagaccttgctataaaaacagcttacagtaaagaagctggctaaaatccaccaaaactaagatggccatgagagtgacctctggtagacctcactgctacactcccaccatcatcaggacagtttacaaatgccatggcaatgtcaggaagttaccctatatggtctaaaaaggggaggcatgaataatccacccttgtttagcatatcaaggaatagccataaaaatggacaaacagcagccctcagggatgctctgtctatgaagtagccattcttttgttcatttaccttcttaataaacttgctttcacttcactatacggacttaccctgaattctttctcacacgagatccaagaaccctctcttggagtctggatcaggacccctttcctgtaacaaaacctctgtggttggctcagggccaaccactcttatggtgaggacattccttctgatgtgcatttgttggtttcccgggttctatagccatgctctatttctaggttttctgagtatcttagtgggaagaataaagtaaagctacttctttcccatctcatcatggaaacccaaccacaacttttgatatgtgccaagagcagggaaagccacaccttcttagagggttgtgctgaactgataaactggccagtgtgggatgccgagaaccgagaacaagatgagtcccagatgcttctgccaatttttatgtcttcctgctcaatacatcagagtgcttcatgcagcgggaagaccagatggacaggtggaaggcagtctggcagcttctctttgtagtcttatgctctctgtgaggagtgttgcttgaaccagtaataaatgcagaactgaaataccacagtggaatttaaatgggtatgtggacattctaaatgttaattagttcctcaatccgggtttctcaccaagcactgactgccattgacagattaaactctcaatcttggccacccagagcctgcccaggctgttccccacacacttcaccaaatcttgcttctgtctcaggcttcccttctccagcaagcttctcagttctccatgttatacactgcataacaaggcacatgacagactcccttacatttctataagctcttggagggtacatactacataaacttaatatgaactgtagggcttagcatttgttggtgtttgttaaaagaaatatgaccactttggggctgggcacggtggctcacgcctgtaatcccagcactttgggaggctgaggtgggcagatcacgaggtcaggagaccgagaccatcctggctaacacggtaaaaccccgtctctaccaaaaatacaaaaaaattagctgggtgtggtggtgggcacctgtagtcccagctactcgggaggctgaggcaggagaagagcgtgaacctgggaggtggagcttgcagtgagccaagatcgcaccactgcactccagcctgggcaacagagtgagactgtgtcaaaaaaaaaaaaaaaagaaagaaaagaaaagaaaagaaaagaaatatgaaaatatgaccaccttgatggaaaatacaaacttgtgtaataaaacaggctaaagatatttagcttgcagaaaagacaatcttatgggcacatttatatagagaagaaaagggtgttagaaaagatcttatgtaactgaaagactataaaccaagaaggtggttgcattggttttgtaggatgctaagagtgtgaatcaagaacaatggatagaaacttcaataggaaatatttcagtaagtacattaaaaagcctccttagagacacagcccactccctactccagaaaacagtaaagctacctcagagataaatgagttctctgtcattggaggtattcaagaataagcactaatgccagttaattggtgttgtagtatggatagaaccattgttttgtgtgtgtttgagattgttgaatgacctttgatatgctttccagccctgtgattttctaatattatgactggtgccaatccttgaccaaagaaatatttgacacaaaaatggttaccttgcgtgaacccgggaagcggagcttgcagtgagccgagattgcgccactgcagtccgcagtccggcctgggcgacagagcgaggctccgtctcaaaaaaaaaaaaaaaaaaaaaaaaaaaaatggttaccttgtttttgtttttggagaaacactattttctaatgtgaccaatggcaatgaaaaagggcgtattaatcactaatcaactaaaccatgattagtgcattcctagatagcaaattgatagatattattattatatatgaagaacttaaggatcagagaggtcatgtaatttcctcaagtaaagcaccatctctttactttaatacaggagtgtgcaaaggttttatgtaaaaagccatataataaatatcttaggctttgtggagcatatagtctctgttacaactgttcaactttactgttaagcatcaaaacagccatagacagtatgtaaatgaacaggcatagctgtactattatttttttaatttaaaggcatgaggtaggatttgccccacgggccttagtttttcatcctctgctctagagccctgctgacttatcatttgagaatgaaaaaatgcaaacaaggcaaggaatggcctccatgtggccatacttactccattggctttgctgagtgcctggaagtagatgctgtagcttttcaggggagagagaggagggttccagtagccattgtatgtcttattgtcacccactgtaaatggctgggtgacaggcaggttggcaggcttcaactcagcagcaaagtagtgtagagaatcgaggctggaggcattccgatagctcacgggcaccgaaaagcactcaataatgtcagctgccctccgtgacttctgaagtcgctcctccttgacaaccagctgataaacactggacaggaaagaggagacacagatggttgagcaactttctggaagaatgagcttgttagctctaatggtgtcaacccaacttctcctatgtggaagcattggttcggtctacaacaaaactccagtcctgagcatcagattttcaaacctaccacgttgtagaactttacctccacttagctgtctcagagccagctcacactagacacatctaaaactcaacttagccccaacccctacaaacctgtctgctcctccttctacatttcctttcttagtaaatggtagcagcatctgacaagtggccagaatctgaatctagggctcatcctcagttcttaactccttcgttctcactcctcatcctaatcaacagccttacagaagtctgttgatttggcttctgcaggtttgcatctgccccacctctcttttctccttccactgataatgccttggttggacactttcccacttacccagattcaactagtctctttgcctctaaggcacttgatttattaatcactcatcctaatcatatggcttcctaatcatatagctcttcaaacactttcataggccttccattgtccaaattatacaatctgaactcctaatcttggcatttgaagtcctctgtgcctgccttctgtcttccatttagaaggtcttctcatggtgttcccatcttccagctactccagaccccatgctattgcacagacatcttttggatctcacctcatgcattactgacttatgcttcctctacctgcaatgccctgcatcctggccacctctggtttcctccaaaggctgagcatgtctttcacttcctctatgaagcctgtccagatatgtccagtctggatgaattacctccctctttagttcccctagagctcatctaatctccatctgctttgttttccaatatcatgagatgggactactctttcactggctagattgtgaccttttacaaagtaggcattgttgcttacttatctctgcctcattctccacccccaccccatactgcccagcaggatgcctgtcacccaacaagtgatcaatgaatgcttgttcaaatgaattaaattggattgaattaaaattgaaagcaaacatgaaaccaaatctgcctggatgcagaaaccctaatcggataaacagcgattgccttgagttcctgtctagtgatctcatattgttcccttcaagttagaaggatgtaagaagatgctagtgtgtgaatagagatgactgatcctttattgaatatcaactgatacccaatgttagactctctttgtaaaagttcttttaaggtttgtaagttggagaacatttttcaatctctttgaatgccccacagtttatagttctctggaataaatgctcttcttttagaagagctttattgcacagatctctgggactcatgatctaaaacagaagatcgattgcccaaagagtacccactggagacttctgtgaattaatgaggtggttgcagtaggggaccccaaaccaatcatttaaacagggcatagtgaaccagcatgtggtttatcaaaaatgaaacgtgttgcaggctaccatccttcaatcagactatccatctaaagacacttgattaaggagtacaacttgggagatgacagagacacaggactatttcattaaggaaaaaaggctatggagaactgccctaagaaaatgtgacacactcaatatggcaagttttcccctgaattttcttgagcataggaattttcaggcatgcgaaaaggaagcgctgggcatatgagtatatgccacacttagatgagtgcaggtaaacagcagctcaatgaccatgcctgttgtacatacacatctgagtaagaacctgacagttcagagtgcatgtgagtgacatgcgagtggatgtggacaatctctcaagaaatgcacactacatctgagggtgtaccatttccaagtgaggatctgtattacctgggcatctaactccaaatgagtaaatataacattcagatgaacgtggctaacctgagtgtttagacttctaaataagtgtgtgtaacatctgagaaggtgttaacaatccaaagtttgtgtgtgggtgtgcaccatctatgcatgttcataatgcctgttgaagtcaataaacgtttaaattaaattatgatttcaataatcacttcctcctcaactctggggtccttctcaactgtacaattcctatgtttatcaggacagctaagctcaaagcagtcactgaaaaatagcacaaggacctaatacccaaacctagaggttgcagggcagaagtggaggggtgtttgtaacagagttttcaggacctgcactgctttataaataacaatatattcaggtaaatctttgaatctggcttgaatgctaatagtagctcgaccagttgagggtccattacttgtgggactctgatctgtgagggaaagggcaaacacaaaagagcttcatgaagcagacaacctcttgggctctcctgctgaagctaacaacagacctaagaacactgcattggatttgggagcatgcaaccaaagcagtcctcatatcctcttcagcagattagaaggaaccaatagcctcatccccaggaccaggagttggaaagagctgggagtccctgctttcttctgagggccagcctatccctaatcaccgcttgaattgatcacatctacataacaaggcctttgtcttgctttctcagacagacttcccattctaccttaaatccttctgtcatctttcccctctaaattgagacccccgaagccttgggagcttccctgggactgaatccccctccaagaatcagttcctactgtctctggccctcccgtgatgggatggatcaagaggaaccacatggctgtcctcatttactgtccacaactagcataagattccatagttgtggccaagcaagaagatgggttctcactgggctctgaacattcaaatgctgccaaggactattagacacagccataatatctctgtgagggtcagcctgtatatccccatcagctctttctccccaccaatctgattactgaagatccacttgtcaattcaaccaagctcaaaagccagattacacatgaggaggctgaggccgagaggtcaagtgattcatgagggtcaaactgcagcaaaagtagaaacccagacttttcattcatagctcagtatccttcctttttttttttttttctattttcttctcttcctacaaaccaataaaacgtataaaggggcttccaagcatttttttttaacttggcatcctaaactgcttagctctatcccaaccaactccatatgaaattacaaagaatagcaaagggtatttttttttggtttaaactgtgcagtcaacatatggttcacatacgattgtgattattgtgccaaaatatacccagcaactccttcaggcccatgcattcacagcctgtccattcaaaagcaaacctgcaatgcagccagaaaaatttaaatcattttgttagataaatctgtttgccagtggattcagcctctctcaaagaccacagaactctgattgaagaggtggagagaagaaacagcactcacaagttgtataactttcctttcctgacactttttaggaaagggtgggggaaagaaacaagaaattgggtattatttgtatttcttgcaatagcttcattctcattctcttgagaatacatttatctaagagcatgttcttttcagcttgctggtaatgataaaatcatatccaaatgtgaatgacctcccttttggggtcatatctccagctcaaaaacagtggttgcaataatctattcagaatcatttttaaagagaaaggatttttttagtaggaaaaatcccaataacatgagagaagaataacctaagacactcaccacacagcacatagcatttactcatacattttctcctcttgtgacaccctctctgtttcttccaatgagaagatgggcatttatgacctgttttttcattacttatgccaaggatctcttattgcaaggatctaagagttatactgtgcccccaactaatttcattcactctaaggtgacttctgtaaggtcaaggagagtttgtactcttactttcagtatctcctgctgtccatccaaggcaaaaaccctcagaacctctccataggctttggaaaagcctgctgcttgaccatcttcctccctctggaccctaagctaatggtttaaatggtggcttgagattctcggaccagattccactgagggggaccagggacctatcagagcctccttccatcagtaacagttcctgtggccctctttctatatctagaaaagtttctagctaggaggtgtatcctttcagaaagttgaagtcaggtgacagatggagtgtatgctttagctcacaggtacagattgcccaacttcagaaagatgcatattttagtccacgttctcccagaaggaggcatgtctgagttcaggttcttccagaaacagaccctgagccaaagtttcactgcaaatgatgtattgaggaagtagtcccagaagaaactagtaaaggagtgagagaaaatgggaggaagtggagcaagggtgtgatatcaggcaaagtcccagtcttagcctgatctcatagggagctctggagcataaattatacccccagcatttgtctcatctcaaaccaaaggcttttgaacctccagtgctggtcagttattggctatgtctgcaccagagagacataaactctaaggcactcctaactttgtgtgagggtcagacaaggcggctctggcatcttaatggcaacatcccacagcaggtcacacctggaagccatttacatcaaagcacatggaagctgggagacggacacacagcagaaaaggggaggtgacagtgtctgggaggccagcaagagtggctctgacagggcagctttggacaatgaccatatgagacttgtgaaaggatcagagacctattttatcaaggtaattttcaaactttgtttccagcactcctcatctgagagatacggtaatctctcaccaatcatagtggcttctccatcactgattcttcaagtgagggcagtgaacagtcatctcagaatctcaatggagggttgctcaagatcaatagttctcaacttgtggctgcatattataattacccagagggctttcagaatgcttattccttggctctactacagatcagctgaatcagaatctctaggggtaggaccctagcatcagtactttttagaaaagctctctagatagttaaatgtgcagctacaaaatcataaacctaggtgattctgatgtttatacgcttgcccttatgtttattctgatatttatacctgtatagccaacaggggcattcccctccagtattctcactcccttggaagacacactgatttgagtcattccaatttcaccaaagcattaatacataattaccagtattctgagtcgttgtacaccacatctcctgatttatttcttccacagcttttatcataattgaaacatgtcttatttaattatttgtttactggctttactgcttgcccccaaataggctgccaacttcatgaggtctgagatcttgtcatctaattcattgcttctaataccatactagacacataatggtttttcaataggtatttcttaaaaaaaagaatttaaggtcgagcgcggtggctcacgcctgtaatcccagcactttgggaggccaaggcgggtggatcatgaggtcaggagatcgagaccacggtgaaaccccgtctctactaaaaatacaaaaaaaattagccaggcgcagtggtgggcgcctgtagtcccagcttcttaggaggcggaggcaggagaatgccgtgaacccggaaggcagagctgcagttagccgagatcacgccactgcactccagcctgggtaacagagcaagactctgtctcaaataaatggaagaacatttcaacaaatgttaagactccgatacaaacaaatggaagaacattccatgctcatgggtaggaagaatcaatatcgtgaaaatggccatactgcccaaggtaatttatagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcaccctacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctctctaataaatggtgctgggtaaactggctagccatatgtagaaagctgaaactggatcccttccttacaccttatacaaaaatcagttcaagatggattaaagacttaaatgttagacctaaaaccataaaaaacctagaagaaaacctaggcattaccattcaggacataggcatgggcaaggacttcatgtctaaaacaccaaagcaatggcaacaaaagccaaaattggcaaatgggatctaattaaactaaagagcttctgcacagcaaaagaaactaccatcacagtgaacaggcaacctacaaaatgggagaaaatttttgcagcctactcatctgacaaagggctaatatccagaatctacaatgaactcaaacaaatttacaagaaaaaaactaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttaaaatggcagtcattaaaaagtcaggaaacaacaggtgctggagaggatgtggagaaataggaacacttttacactgttggtgggactgtaatccagttcaaccattgtagaagtcactgtggcgattcctcagggatctagaactagaaataccatttgacccagccatcccattactgggtatatacccaaaggattataaatcatgctgctataaagacacatgcacacatatgtttattgcggcactattcacaatagcaaagactcggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcacccataggtgggaattgaaccaatgagaatacatggacacaggaaggggaacatcacactctggggactgttgtggggtagggggagaggggagggatagcattaggagatacacctaatgctaaatgacgagttaatgggtacagcacaccagcatggcacatgtatacatatgtaactaacctgcacattgtgtacatgtaccctaaaacttaaagtgtaataataataaaataaaataaaaataaaaaaaagaaaatataaattacagcaacaatgagaaactatcacacacacccattataacggccatcagacaaaagacagacaaccagtgtttgaaagaatgtggaaaaactggaaccatcatacattgctgttggaaaggtaaaatggtacagtcactctgggacacagtctggtagttccttaaaaaggtaaacataaaagtaccattcatctagttattccatttctacctatctatccaaaagaaataagacatttccacacaaaaacttgaattaaactgttcatagaagcattatttataatcgccaaaacataaaaaccatccaaatgtttatcaaccaattggtgaatgggtaaacaatatgtggtatatctatgcaatagaatattattcagtaacaaaagaaataaactactgctacaatctgcagcatgaagctccaaaacattatgctaaatgagagaaataagacgtagaagactacatattgtatgattctattcgtatttattaagttatggagaaaaggcaaggccatagagacagaaatcagattagcaattgcctgggactggaagtggaaataggaatcaattgtacatgggcataggggattttatggtgtgatgaaaatattctaaaatgggactgtggtgatagttgcacgatcctatacatttactaaagaattgtacacttaacataggtaaatttatggtatgtaaattatacctcaataaagctgttaagagaaacagactgaataatcttcaatgtcctttcacacttcaaaagtctatgctttggcatttaagtatgcacaaattttaatacaaaatgctatgataaaccattggttttataggataagatgggctaagaaacaagtgtgagctttgtaatgcccaacagaatctagctttgcaattacattccctgcttaaaggtcactcagaactatggagctgaaatttacaatgatatgtcttagttagccaacctttcttccaagactctgggaattcctgtttttactcactatttgcctagtcaaaatagctcgcagaggagacaagaaaatgggaggaggtgtacattcggcagattagtgtcagaattagtgcacgtgcatctttgctttgcctctgactagttcggcgacctattgtcctatctgtctgtcttttatacatttattcatcagacatttattgggtgatgatagctcaataaagtaaacatagcaggttcaaatttgaatgcaacctggccactgggtactgggtgcttagagctcagagtggagaaataatgaactgttcactataatccaatgaagtgagggcagcaagaactctgccagggaaggattctgggaaggaaggaacctacagggcagtgcaaagactgaaattacatgtctaggaagtgcattctagaaagtgctctatgaaagttggctggagccttcacaattgctgcatgcattattattacaatattactgaattagacaccaaagagtggctttgtttcttatttgggcccttctcctatgattgaattgcatttgatacatttaatgaaagtgaattttgtgtagaaatttagaggaagaaaatatgttgggtaaaggaatcatgaaaatccagttgaagcatccaaataagttttccctcaatcatggctcttctctctttcaaaataccatagattcagtccataagcaattcccatggcttcagtttcaatatactgtatattgagaatctgactgcttctcagcatcttcatagttacagctctgaactaagcttccatcatctcttaactggattattgtaatagcctcccaactggtctccctgctttcacttttgcccccaaaatttattctcaaaacagtggctagaatgactccttaaaaacatgactcagctcaagactcccctctgctcaaagcccccttatggctctgaccttacttagagtaaaatgcaacatctttacaatgtctacaagactcactcttaagaactctctgatcttactcttctaattcttctccagttacactggcctctttgctgttccctgaacaccccacacacgctcccatttcaaggcccttgctctcgctatccccttccttgaatggtcttcccttggagataggcaacctaaggaaggcttactttttcacctctgccagggaagtctgtcctgaccactttatttaaaatagcaaccgaaatccacaatatagccaattacactttccctcttaatttttacctaccacacctaacagattaggtccttttaagagagaactgtaagcactgcaaatgtcaaccttcctttgggaaaaagcggctggatcaatatggggccagttaggcaatatttgggtagataaccttgatatggggacctttgctaaagcaaggtggaggttttagtactggcttcacactcgctgctctgtctgccatgctgagaaagtcactttacctctagaacttgcctctaaaatggaataattgtgaccaatgcaataagacacaaaacagaagagatacacattttagaaaggaaagcaattcatcgtcatttgcagataacatgactagacctaatatattgaagcaaatcaactgaaagactgttaaaattaataaaagaattcagtaaagtagttttgtagaagatggaaataaatacactgtacaccatggaaaacaagctagaagatgtaatgaaaaagccttttagaatagagtcctttaaaaatagctaaggaaaacacaaataagaaacgtataggactgacattggaaggaaaataaaactctactgaatgatttaaaagactatctccagcccctagcacacggcttggtagagtgggtgttaaataattgtgctgaactgaagatgaataaatggacagaaaggctgaaatcctggaggaaagcatcatatattgtaaaaatgtcaattcttgccaaattgatgtattgttttctttgagaaaaagcaaattgtataaaatatgagccagttaggtgatatttgtgagccctaaagatgtggatggccataatttgacaattccagtaagatttgttttgttcaaatgggaaatatggttaagaacttaaaaaaaaaaaaacaacaaaggaatgaggctgaaaaaccactactggatattaagttatattatgaagttacaatgattaaaccatgggtactagagtatgagttaaataaaaatggactaggtaggggtgtgtgtgtgtgtgtgtgtgtgtgtgtgtgtatgacagagagagagaaacatataattttatgtataaaattacacgcaacataaattaatgaaaaagaaaattttatcacttagtgtttcagaaattccataattatgagatgaaatcatcaaatttaagacctcgctacatatgaaaaaccacattatattccaatagttcagaattaatttatttactgaaaaattttagtatgcccttgccaaccaaatacaatgtgtgatccttgattggatcctggattgaattttaaaaagctttaaaggacaattaattgggagaattggggaaatttgaatgtgacctatatattagataccagcattatgtcactttgaaatttcctgagcgtgatgattgttttgtggctatgtaacagactgacctttccataggagatacaaactaaaggttttgaagcgtcatggtcactacaagtaaccctcaaatggttgaataaccatttgagagacaagagaaagagagagaaactaaatatggcaaaatgcttatgactggcaaatctatgggaaggatatgtggatggttattgtctcattcttgcaatatcctgtaggtttgaaatcaaagaaaaagataatcttgagtggaaaagaattgtttaagcttaataatagaacaatttacaaaagacaaaagaaaaatgacagatttgtctatatgtaaatctgaaatgtctgaaaacagaataaaaaataaaacaaccaattagaaaagctattcccagaaaatatgacagagaaggaagcaatattttaatattttaaaaatcatatcaggtacagcggataaaaatgacaaaggacacacataaaaatcaataaattatctgaataaaggtatagtctatattctgtatatataatgggatagaaccagaaattgctaaatcaaaattctgcacaaatgaaaacctccaactggggaaaataggaacttaccttatatgatgccttataagtaattctcatatcaaatagaaaatcaaagccacaatttcctgctctttagaaactattactgtgagaacaataatgtttaatgcttatgggacaggaccaaacctgttttcagcatctgaaaagcctttgttactaaacaaaaaagaatgacaataaattaattaagcattccataaagagaaaattagaataaacaacactagagccagatggcttttccaatgagttctttcaatcttccaggaatggataattcccatgtcatagaaacaattacatcagacagaaaaagaggaaaagcatctcaaattgttacaaactattcctctaacatactattaaattggtgctccataagtggatcatttactgcaggtacacaagacagatttagtaatagaaaatctaggaaaatatcacataaataaatccaagtagaaaaaagaaaagtacgatcatataagtagataccaaaaaggcacttgataaaatcactcattttaaaagagtcataaagataaactatagaatataaatagttttccttttcagatttcaaaatacctatttcaaatctacaactaacattatacgtaagagaaatttgctggaggtctagtgtttgaggttggaatttagacaaaaagttcagctattaatattatttggcaacgttgcccggaaagctctacccaaagcaacaaaacataaaaccaaaacaagagctattgcaactgtaataggaggacataaaattatcattattcatagatggtgtgattattagctggtaaaccaagataataaaacttaattaaagaaactcacaagaggtttcagtgaatgagatgaagaaaacacacacaccacacacacactctctcacacagtttccctaaataccagcaaaaaccagttagcaaacacaataggggacagatagcagaagacaccacaagcttaatgttagtaaaacaattttaacaaggtagctatggatggagtctacatgagagtcaatgcctacgtcctgagaaatagtcaagactcagatgaatagataggcttgccctctttcagtgtggaaaagctcacgttaatacatatagtcattttagattaagcaatagtcttaatataatttagaccaattccattggggattgtttagagaatatgataaagggatttaaaaattcatagggaaacataagtgggtaaaaatagccaagaacattttgaacaacaagaaataggaagactagatattaaaatgttttgtaaagctatattaaaatgggtgatacagacacagtgaccaacagagaggcagatctaatggaacagtataaaccaagaatatagtggcacacacacacacacacacacacacacacatacacacacacacacacacacaggcaacatcaccgttcagtaagactggaaggagtattcaataaacggtgtggaggaaatctgtcaactacttggagaaacaaaagaataaatactccccaaacatcattaaaatggtaatagctatcatgatatgtggcaaaagaaggatgcaacattatcagggaggatcaaccttacataaagcctattttttttaatttggtgactaaaaatagggaaaatttcccaaatgtcagtattttaaaaattttcctatcatttctatataagcatgcattattttgtggtgactctaacttaaacatcatttaaaataaaatgataacattgtatgaattaccttagtattgtgataaggatcaaagataggaatatgaaaatactttgaaaatatttttttaatttaatatgttacaaaatagctgtagtatcatatttttaattgatggatggatttatccacatgaacgacatggcataatctatgcctaatactctctacccagctgggcattgttgactattcaatgtttacgaaatagatcccatccctacttgactccagaagtgctattttctaagtacatgttgaaaagtataatttcaatcagtcaagaatccagtaatgtataaaagatatttgactcagcttaaaataactggctgggagcggtggctcatgcctgtaatcccagcactttgggaggctgaggtgggcggatcacctgagatcgggagttcaacactagcctcgccaacatcgtgaaactccatctccattaaaaatacaaaaaaattagctgggcgtggtaggggcacatgtctgcagtcccagctgcttgggaggctgaggcaggataatcaattgaacatgggaggcagaggttacagtgagccaggatcacgccactgcactccagcctgggtgacagaatgagactccatctcaaaaaaataaaataaataaaaaataattaaaatatccactagccaacagctctattagcttatgttaataactcaattaaacaataactttaagcaagtctatgtagtctatgtaggccaggcacagtgtctcatgcctgtgatcccactgctttggaaggatcaagtttgatgctgcagtgagctatgatcacgccactgctctccagcctgggcaacatagtgagaccccatctctacaaataataaacttgttttttgttattgttatacttaacaaatagagcattcaaagcaaacagtgctaaccaacagaagcaagaacaagcagaatgctgcaggggccctgctcctgtgtagtcacagaccagtagcatcttcatcacctaaaaagaaatgtgttggaaatgcagagtcccaggccccacctcagctctattaaattagaatgtgtactttaagaggtcccaacttatttcatttgcacattaaattttgaaaagcagtaatgtgaaacagaacacattaggggactggaaagcttgctggtttttgttttgttttgttttctaatatacattctgaatcattttctgtaccctagtggagagccaggctgttttctttaccccgggcctctcaaacctcagacatcctgggaagcaaccccctttatactcctgtcaagttctcagttgaaatgtcgttttctaaagttaccttacatggtgagaggagcaaataaaaaaaatcaagttaaacaagactagcttccatggggattcagctcctaacttggcgattagaacccacagcaatgcttttacagaggaagatgttattgtttttaaaagagtaatcagtagggcgcctggatgtctccccttgcaacaaagacatttgcttaaggaaaggaaagtatcaggtgaaatctctctgaacagtttttttttttttaaatataataccatctgaaatcaattatcttcaaaaagcccttctaagctctaaaaatgtaaatggaataattactaattaagcattaaattaatcgtaatagcaggcatacttatttgccagatagggcaaacaaatgcaagagaaaaattataacaccagttgaaatattcttcttatgggaagacgtaacctactgttgaggattgcagaagtgcaatgaggtgaaaatcgtgtatgcacagagaattggaggttctcatccatccaacaacagaattgcctgtgaattctggattcccatgatagacctctgagtgtgaggcttgggaatgcaaattttgaacaggttcaccgtgatattcttatatataccaaattccagagatgtcctttgggagttcttcagacccattcaatgattctgtaacactgacataattgtaatagtaatactaagacttcatttgcctttttccactttgttaatattgaccctggaaaggtaggcaatactgctggtgcctcaggagaactcaaggcagtggtacccaactgtacttgtcattatattcttcaccacctcatacttgctataaaagcaaaaatgccagtttcacttaagaaggtcctcgatgaagcagtaaaaagcattaattttattaaatctcaacccttgagtccatgtctttttcacattcatgtgatacaatgggcagtatacacaaattatgtctcctgcttgttcaggtactatgatttcttcaagaaaaaaacattttttttcttgtttttgagatggagtctcactctgtcacccaggctggagcgcagtggcgtaatctcggctcactgcaagctctgcctcctgggttcacgccattctcctgcctcagcctcccgagtagctgagactacaggtgcccaccaccacgcctggctaatttttttgtatttttagtagagacagggttttaccgtgttagccaggatggcctcaatttcctgacctggtgattctcccacctgggcttcccaaagtgctgggattacaggtgtgagccactgcgcccggccagaaaagaatatttctgtgattgcttgaactgaatgctaaactagccacatttttcatgaggtacctttttgttaattcttgaaagaatgactaacgaactgtggtcattcagatttgtatatgtggaaaacattttttttttttgagaataaacgaagtctctctgtcactgtaaagaaaactgacagtatttgttgtcaaagacataaggcagctttcaagtgaaaactagaatttggaaaacttgtatctgccactgtgaactgtaaagatcttcaataattaaaaattttaatgatgaaattggtggtgacagtagcaaatgtaatattttgatatggtacaacaagatatataaacatttggaatttttaaaataaatccatgaatatttttcaaatgaccaatgcataacgttgcaaaatcatgtaaggcaaagaatgcactcaagtgcaagacagatataaattttaacgtaaaagagtataaaaagtttactgatatttcattgcaactaaactttaggaaaccaccactctgagttttggtgtcatatgagaggagaatacccacaatgatcttaaatggctattaaaatattcctccttttttttcccaattatgtatctatgtgatactggattttctttatttcaaccaaaacaattcatgaggacagattaaacacagaaacagatatgataatccaattatcttctactaagctaggcattaaaaaagatttgcaaaatgtgaaactgtatctcttcaccctaactttattatttggggaaataaaaatatattatttatattaatatgtataggcttagtttttttgagatggagtctcgctctgttaccaggctggaatgcagtggtgtgatctcggctcactgtaacctctgactccctggttcaagcaattctcctgcctcagcctcccgagtagctgggactacaggcacaggtgccaccatgcccatctaatttttgtatttttagtggagacggggtttcaccatgttggccagaatggtctcaatctcctgacctcgtgatccacccacctcgccctcccaaagtgctgggattagaggcgtgaaccactgcgcccagccaggcttagtattgtttttaaatgaatttaaatatttgttaacatgtggctttaattccttttcttgagatggagtctcgctttgtcacccaggctacagtgcaggggtgcaatctcggctcagagcaatctctgcctcctgcgttcaagctagattcttctgcctcagcctgctgagtagctggaactacaggcatgcaccaccacacctggctaatgtttgtatttttagtacagatgggttttcaccatgttggccaggctggtcttgatctcctgacctcaagtgacccgcccaccttggcttcacaaagtgctgggattacaggcataagccaccatgcccggcttgaatttggctttaatttctaatacagtaaacattgatagacaaaacccacataaacaaaagttctttgatgccttcattaatttttaagagtgtaaaggggtcttcaaatttaaaagatcaagaacctgtgaatcatacatttttttaaaaaaaagtctattaagacccccatggttcagagtttctcaatcttggcactactgacattttgggctggataagtcttcgttgtagggggctggctgtgctgtgcattgtgggatgttcagcaggatccctgacccccactcactaactagatgccagtatcacctccgacttgtaataaacaaaaatatgtcctgacattgccagatatctcttaagggacaaattaacgctggttgagaaccactgccataggtaattaggaaaaggatgtaaaaagaaaattcacaaaaaagaaatgttaatagcataaaaatacctagaaaaatattctgccttgccagtaagccaagacatgcaaatcaaaatgacaatatgttcccatttaaatgcattaaattagtaaaagtaagcataaattataacaagccatttcagtgaagctgtggttgaactggtaggattctacaattccagtagcatttttaattgattcatcaaattggggaaaataatctggcaatggttttcaagacataaatgtttttatgacctggaagtaaaaagagcataggctcaggaatcagcattaaacttgaattttagctctgaatctcactggttatgtgatcttccttaatttatttaaatgatagcatttataagaactgaatacgataataatgcctccatcatttgttatttgagaactgcaatagacaataatgtaagtgaacttctagttaaaagcggaagaattaatgtactccatttacctcttctatctcctcactgttattgcagtgaaatgtgaaaaagcatagaaatccacaaggaaaaagaggacaggagaggggacatcagtggatgagcagttttaagaaaattctggaaacctaaaaatggtcagaggagaggtaccacatgtgatgagataaagaaagtcaaattgcaaagacatgtgagtaagaatggattttatttgccccacagatttcaagagagattctgatgttggagtagtcaagtgtggacagtgtggaagtaaaatgtggggctgaaaaggggtgtttatcaaaagtctgtacacaaaaccatcaaacctttgaacatggagagctatgtgtctgccctctaccccttaggcaggagataggaagaggatttcatttcagaatttgaatgcctccgcctccaaaagcacagcacctccagtcaactttctcaacaccttacttttaaatattggctatggaggttcactggttaggtaagcaatgcttccaacatgaaagagagcagtgaattaaaaaaaatgactctagaagaaacagagataatacaggagtcagaaaagcttcccccttctccaaaatcaaaatcatatcctgagatgtttgagaaatgattacttctataaataagaagtgaatgttataagaaaaaaaattcaaagaacagtaagtagctcaaaatgaaaaattatgactgccaaaattataaacaaatttgagaatttttttgagggagttgttctgttttgttttaggaaatagaagaaattggcagaaaagaaaaggggaaaaagagtatttaaaggcaaacctaaaatgatggagttctgtgggaggaaaaatgtatgaatagtttaataaataaactgcctgaagaaatgagaataattgtacattctataacgaattaaacaaaaaagcccacaagaagagtaattagaagtagtataacatagtagtacactccagactgtggggctagaccattatgttcaaatttcatatcggctgctactagctgcatgatcttgagcaagttagttaacctttcagtacttcagtttccccatctgtaaaatagggataacactagtttctacctggtagggttttgacgataatcaactgagttaatatacataaagaacttaaaatcttagcaagctttaaattaattatgtaataatataatacttacatattatattatactgtaaaagaagtaatataccatttggctctgaagtgacctgtttttatggaattgtaaagttggccattgtgtagttatttaacaaaaaactgtggcttaactacattggaaagaaggaagggaggtattggatgatttaagacagacaagttaccatctatcatagcaggaaataaatagataatgtctgcaatcgataactttaaaatagcacattatgtagtgacattgccaattcccagaagaaagagcaaagaattaaaatgcatttgcctctgaggcacaggactgggggagggggggttgtaaatggtggtgttgggaatggttgggctatttgattttccaactatgtgtatttgttactttgagattttttaattaaagaatgaaaaaggttaatgtatatgaattggctgtcagtgcctggcatattagagaaggcactcagtacactgtagttcaatttttttcatttcagtaattgcattcctggggatttttgctatttaaaggtacaataccaaaagaaaaacatgaataaatttgtgattgcttggttatttataacaaaaaaaactggaaatgacccaaattttcaaccatatggaaatagctaagaattacgcaaaaagctgacaaaatttcataaaccaagaacatgagtttattgtttcagatggctgtggattagctaaaactgactgcacacacacatacaaagtccctgatgtgtttagactaggaaatagaaacctgagagaaactggatgtctaaagagaggaggagatgtagtatatctctactctagacaactttctgtggcctccagagtccttaatagggggcctcgcagctacttcagtcactgggcaaggggagttttttcccaaaactgaagagtttctttttgagctgtggcatggtctttcatacttagagtttgcatcactcttcaggaagaatgcatactcacaattgatgccactaatagcaatgcttacagatatttagaagcccccccttccctggctctacagttagactcaccattagcaaagtcaagcctcacctggaagtcattccaagctgtagttcgacctccaacttacaatgtgtcagaaaacccatttcttagcagagctattgatgaaaattatatgacaacaatgaaaaaatgtaacataatgcatctgagtctgcatcagaacctacaagagctacaggtcctaagatactatgagctgagcaagccatcttctcaggatctcagttttctctactgagaacaggggattattttttctacttcagggctgtattgtgagtgtacagtcaatgaaaggatgcttggtatcctcaggttctcatctcaggttctgatctagaggaggagctcaacaaagctcagttagatgtgactttgagtgtgtatgacccactccttaggactgggcttctcagactgtacacacatgagcatctcctggaggacatgttaaaacacagattgctgggctttactcctagagtttctgatttagttggctggggacagagcctaaacacttgcatttctaaaaaagtcccaggtaatacatcagtattcgatctgggaccaaactttgagaattactgtcttacaggcacaaaataccagcttggaaaatggttgagactttggagaggaaaagcaaaggcaggacggaaaagcttaataagggttccttatctgccttggtcctgatgcctactaaatagagtagaaccttggtgtgatgtctgtaccagctccacctccttcctaagctcccttctaaggctctcccagcctccagacctgaacagagcctcccgtgtcagcttcctgaactgaaagatgactaccttttccatctgcctggagcctatgggctgaggcagaggccacctttttaggttccaagaaattatgcattcgttatggaggaaattaacacctcaaagcaaactataattaggaattcttcaattcagtttatgctttttcaattaggcactctataattttaatcatgggagcattaacatgtttctgtaatttatatacctgcagtataattaagcctgggaaacacattgctctaaacctgaatggaagtgattgtttcccttcacacttgcagtattacatgtccctgatagagagatggtgccagttgcagaggagccatttgtgagttggagaggccaatgagagaactcctggctttggaaatatgatggctgttgtagaccatgtgatgcctttgaacatctgcatcccaaagcttcaactcctattgtgactttcaaaacattcccaccattggaaactgctttggacaactattcttggaaactaatttcaattaagcaggaacagggtgtcctggcaggggagacgttatctgagagccgtgggaagcagatggctttgaattgaagaaattgaacaataggctgaaacttagcctggattgggaccaaattcctttttttgaaaaaaaacattgattcctcttcctactttttctaactctgtttctctctcataatttcagctttgccttttagccacaaagcagggcctgaatcctatgtgcaaggtagttctcttgggattctgagaagttctgcaaattcaaggaattcagaggcacactgaaagtttttgtgcttattcagactgaacctctgaactgtctgaaggttaaaaaccttcattttttctctcttcttcctgctctccccacaatagcaaattcagatttgctgactacaataaaaggaaaaagaacataatcaaaactggcccggggggacaatgcatacagattccaacccagctgagtgacgcgtgcatattgctgcagcattttggcactcaatatattttgtctgatctaagaaaatatggaactttttatagagtgaaagttggaagtggatttgtttctcccaggctgctctagccttccacaaaagaacacagatttgttcagattctgatattctgatattcagcctcatcaaacatccatcttctacctagtccccaacatccgcatagaagtgaccgtattcagatatgctgtcagcatgcaacaacacaacatgaattattttgacaccagttattgtcatcatcataggaaaacagaggtgtgtttttagcccccacgtggacagggatagagaaataagctggcagagattctagttcagcttttaggagctaaaactggttatcctcatgctgaaacacacactgagagagacatgagagatccaaaagctgtaaactcaacaggggcaacttcacagaacaaggcaaaactattgcttccctatatcacaagaatgagcaaatattggtgccatagaagagatgacttggttccctgtacaggttcctttctccatacctgaggccacccataggccacaccagtagtactcaagcgtggtccaagaccagtaggtcacctgggaaattgttcaaaatgcagattctcaggcattatcctatagtccttggggacaggcaggactctgcaggcttattagaaccccagctgattatgatgttcattaaagtttggaaaccttgggattataccacttcccacattctatatccagtggaagtgatgtggggaaattttagaagtctagctcggtagatcagaatctccacagtaagtaagcccagccataggtcccacgctgttttcaggacctatacctctgtctaagtcttcattacattgctcatctcttatgataggatccctggcctttacctctctccccaaacgcctgccaaataacctctctgaaaccaaacatgggccttgacctcttcttaccaaccttcttagggtctagagcaatgtagtaaaatagaattttctgtcatgatggaaatgccgtccagtatgtcagccactagctacttgtggccattgggtacttgagatgtggctaatgcaaccaatgaactgaagctttaattttacttaattttaactagcttaaatttaaatagccacatgtagctattaatgatagttactgtattggacagtgtaagtctaaagtctagccctcgattcttgcagttgttactgggggtgctacatcttgctctgggcatgaatacttatatgtttataaaattcttcgtaagcctatacctaagtggaaatgcactaaatagcaaaccctaagcagctgtagccaggtaagaaaagggtgaattgtattctgagagagtaaccacacatttttttggcccattggtggagactctaactttaagatgttattttcctaccaaaaagccagggctttcagaatcacttctctcactgttgccaagtggaggcaactccctgagcagccctcaacagctggagcaggcatcgtgcagaatgctttttggataagagcaaacctccttggattctaacatggcacagagccatgctctaactcagaagaacatcaatagatcaggctatagaaatgcacttgatggaagcagacttgaaagtctgacctttgggcagttgcggacagagaccgagagccatcggttatcagctgtgcaagatctgagacaaagcagcgatgcaaactctcatggggcccagaacagtgggagaagtaaaagtcagcagaaaaaaaagttagagaaaaagtaaggaccaggagaaggcatcttgcaaggtcaccgagttctttcaaggagtttcaccagttccccagggttggagggtttgtattataagaactacatctacttggactgcccctccatccttagtctggcctcgtgttccttgcaacatttggctccaatgaccttcaccttgaatctattactgtctgttcaccatcactgccaatgtggtcacaccgagagccatcatatcctatagaagagttttattactgacaccttatatttgatcatcttattctccaaatagcacttcctgtctttctacactctccctgctttgtaccctctgcacaaattcttcaacagcatccaggttgcctggccctcaatatatctattttctgaacagcaaccttcacattctttttaaagcaagcctacaccagatggtccattttccagcacttttgttgacattatccatcatcttcatttctctgtagtcctggatcaacttgtgtgtctttcttcttttctactacaagagcttcttgaagctcctggagaagattaaacgattaaaaaaaaattaaacgattcttcctttgaatttcttgttttaaaagaaaagaaaagtcaaaatgaaatatacagccctggttttccttctacctctttggccagtccttctccatctcctgtgtgtttccttgataaagtttcgtagctctctgttctgtttctcatctcttctaatctacactctcccaggatgaggtcatccactcccctccatacttgaaataccacctggatgctaatgactcccaaatctaaaacccctgctcagatgcctctccagcactccagacttttggaatttaaatagtccctatggtaggaggtgagcatgacaaccactcttctttccctcatgccagtaacagtccctgtctccatctctccagatggcagacagtccaaaatagaacactctttcgatcttcatgttccatcgactgctccatttaaaatattcttccccaaacacctgtttttcctccttggttggagcctaagtaatataatccagaatcctaacaccagagccaattcttggtaagctgagttgttggtggaggaaggagccttataaaaggggacctgaaatgcagtcagggtaaaagctgaagtgaatgcaaacccacctacattatttgggtgtcacctttcttcccttttgttttcctgaacaatcatctaattgcagctctgtgctatatcaccagactgacctttgtctcctagggtgatgtctttggtggtacacacataacccttcaatatgtatcccaatggttggcatatgtagactgtgggacaacctcatggagaagggcactacagtaacattcatcccttattctttatttctggttacctcttcatatatctggcttctcctatttcccaatctggtgtgatgaagtcccagcgtgattttaggcatggctaaaagtggtgttaacaaagctacgtcttctcccaggttatgtctgggtatctcttatccatgtccccctaacccccaatacaccaaagtgggacccatagcattcctcatcatcaggtcccagcaaaggtggcccagagaactggggaactaagtgaataaatgaggtttggagaaagagtgtctaaatgtaattacagtttctcatctttcccaatgtggacaaggcctcacaaactcctcaggctgccctgtgtcaataaatcctctaaatgttcgtttctctttcctaattggacaccatcatatgctggtatctgagaatcagacggtaatgattccaattttgctcactgcggcttcatggaccagcaaaacccctctgtgattgtttcatgtgctcccactctgggcttcacagttattaaaggaatcctgaaggaaatctggcaatcgtttgcttttcttcccaataaagtttcttctttctttaaaagtaggctgtatctccaattggtactgtagctaatcactgtgcagttcagaatctatggtcttaactaactgcacctgtcaaatgcaaaaggatcacagattctcatcaggaggtgaagagaacttgcaatgacctttagaagtatatatcttgttacactgtcttctagggttccatctttcatacccctggtcctccaggctagagttcccacaccctgtgcaccatgcctcaagcaacctaagaaagcaggtctcatgtcctaactgaccttgtaaaaggtcccttagaagtcccccacactctcctagaccacacgccaggttgcagctgtccttgctcagctgagttcctaactcccccattcagttcccagaccacctttgccaccattcgcctttcctggatgaaatgtcctcatagactcttccctccctcggcatctattggctcagagaatggcaccactttccatcccacgaaccaagccagaaaactgggagtcatgctggacaatgtcttttccttcacaccccaacaccctgccccttggagaagtcatcacaagccatgtccattttacctcttacaagttgtatctcatcgtcataagtactctagtggtgggtcaccttcatttcttatctgaacaatgtaactgtctcccaagggtgttgctcttaaccccgactgtgctggccctttggcaatgagatactacaagcttgtctgcttgaatttatatttcggaaaggtgctcatatctgaccaagttcacagactcataggcactttctttttctgattgtctttcctatttttaaggtaatgttgttttgaagatcacccctggagatgagtgtaggtttcctgatgtgccctacactggccagcacttcgcatgtagtagatctcacatgagtgctggaggatacacagcagataggcattggcttgcagcagggctcagagaaaattcttgcccatggctgcccatggcttagagccactctttgcctcaacagcttggccaaacacaaggactatgtttctgttttgttttgagacggagtctcgctctgtcacccaggctggagtgcagtggtgtgatctcagctcactgcaacctctgcctactgggttcaagtgattctagtgcctcagcctctcaactagctggaattacaggtacctgccaccacacccaacgcatttttgtatttttcatagagatgggtttacaccatgttggccaggctggttttgaattcctgtcctcaggtgatctgcctgccttagcctcccaaagtgctgggattacagacatgaggcatcaggcccagcccccaaagagcatgttgaacaattaccagttgcaatttacacagtttagcttattcgaccttcaaaacaatctgtgatgtaggtattcccatttatcgacaagcaacttacggttcagagaaaataagtacctgcttccagtatacccagtgggacaattggataagactggtctgattttaggagccactcctgtttcagtgtatccaactgggaagtcagctatggcaggaagagcataatggtcttaggtctgagtgaggagctccgtatgggacccatctctgccctcagggaggccacagtctagcagaggctgacaacgcaaggcactgacagagggatgaccatgacagagtggcaactcagaaggagctggtgcattctgctgcaagagtggagatggtcctggatgtggccagtgtgaaccggatgttggagaggtggagaatggcatgcttggtggagagaacagcatggactaggggcctgtttgctcagagaaggacaaacagttgggcactcaccttcccaatgttccacactcccttctgaacaaagtctaaatccagagtgaagaccttcttcacctggaccctgcctgctcctttgcttctctcctcatctctctgtccccacgcactgagctacttgtggctccccaaacacaccctgtaccttctctgtgtgcgcttttgcataggctgctctttcttctaggttacactcttcccttcttcactaactcctcctcattccctaggtctcaatttaagcaacactgcctccaggaagccctcccagcttctgagctcaccattctaccaagggctgcctctctactgaactctcatggaaacttctgaacaagctggccaaacacaggctcattggcaccttttctttttctgattgtctttcctgtagacctttaccatccaaaatggcagtcagtagccacatatggctcctgaaatttaaattaattaaaataaaaattttaaacatcagtttcctagttgtactagccatatatctggtgctcaatggccatatgtgttcagtggcagtcataccacacagcacacatataggacatttctgtaactgcagaaaattctattgaacagcactcttttcagaataagaggtagctgaaggcatatatacacacacacacacacacacacacacatatatatataaaactagttactatagatatacatatatatataaaactagttactatagatatacatatatatataaaactagttactatagatatacacatatatataaaactagttactatagatatacatatatatataaaactagttactatacacacacacacatatatatacatacatatatatgtgtgtgtgtgtgtgtgtgtgtgtgtgtgtgtgtgtatatatatgtatgatgccagacactatcccatgtaaagggaattcagtagtaccaagccttcagatttcttggagctcacagcctatagaggggtatgtagaaacaacagaaaacaaaacaaaaaatatatatatatgaacagctgtataacacaattaaaggctcaggaaagaactatgaaggaactatataggtcactgttgagtaaaacctggtaaaggggcagacggaaatgaaaggaaaccggaaacaaggctaaggacagattctgatgagccttgaattccatgctaagaagcctgtacttaatgcaatggaaaaccaatgacccatttaagaattttaagcaggaaagttaacttgatccaatttgtgcttccaaaggatcactccagcagttcagtggggggtggattgaaggatgagaagctgcagcaagcactccagcaagcatatcctggcgggtgcaggtccacaggatgaggctggaaagtgccaatgtgggagaagaagagagagcttggcccaggttctgaagtccagaggaccagtctccatgactaattagatgggaaggggaggaatgagggggaaagaacatttccaaggaagtcttcagggatcaggggacggtctgttatagaacctggggctctgcccccagcctcacttcagggactgcattataggtgactaattcatggctaagttactttcttatgaaggttagtacggatcagtcacacatcagtgtgacaggtggggcgtgggggaagaaggctcggcatgttcaagccagaactgaatattagattctagtcactatttgattgatcttttaagcaattctgggattctgtcacttaaaaaccaataaatctttgaaggcctgaggaaagcaatacaaaagcaataaatctccattgtggagtgttagaaaaataggccaagctgctgaggtggtttggctggagggatgagggtgcgggagccccacacagcaacagtcctccctgtcacatctcgcccccctgcacactcagttctaccagatagagtcagatccacagggcttcagaggagcagtaagtggcaaagcaggggctagagtttggctcagccagggttggagcatcactggcagaaagaagagcctgcctgagtggggtctgaaggccaaagtttctgtgtgagtctgtttgagaacacacagctccactcaaagagggacccactgaagctcacaagtgatagaccgggctcacacaaggcagagttggaggacccctgagaattcctcttgcccacccctcatgccctggttggtggaggtttactccgtagcacccccacaaaagggccacccggtcatcacgtgacataccaggcagaggaactcagaacttcccaggggagccatgaactcagagccaggatactaggtctatgcactgtctttaactgtaacaagccccacaagcttgggccaatcagttaacatcttagacttcagtttcctgctccaaaatggagatggtatttcccaaccagctgactcaccaggtaggtgaggatcagataatacaatggaagtaaaggaacaattcagaaaactaattcagaaaactattaactgtaaaatttattcgaagcatccttaacccagtgcatctagtgagttctttgagtcctgggatcatagagtgtccatattgttttctccatccttcacctccccaactcacacaactgcacactgctctgctttcctgggtggtgctcatctgtccagccagtctaccgcttctctcaatcactacagtcaatgtacctagtggtttcatatcatcttacagtggaactgcagaagcagctcaatacccctgggttgcaagaaacataagccgagcacaccagatgcaccaggcatgacaccattggtgggacctaggtgcttggactaaggaatggggatagtttaataagtgaacaccacatggcatgatccatgattcaatagcatcacctcatgacatgatccagtcagatcaagtctcccacatcacgacattgcaaatgtccaatcagatcactccattaccttctgcctataaaacctgtccccgcctccaaaagcctgactcctgtctccttgttcagcagccttgcaataaacttttctctctacaaaaacacagtacttcagagtttggctttctattgtgcatgggcaaacagaccaagttctgttcagtgacactttttttgctaatttcatgattttgtttgtttgtgtgtttgcttaatgtcccacctccctgcctcactcacaaacaatttactggagcctcaagaggacagaggtgtggctatcttgttccttactgtatccctattgcttagctcacttccctaaacatactaagtgttcaataaatatttgttgcatgacctagtggtcaactacctctcatataacatcctactgcccagagttcaaggtgaatgaaggtcaagataactgaaatccattgtgatatttccacttctgtccttccagttgtcctgaaattcgtgctgggtggcattggttagtcacttccccttctagtcaaatgctcaagaaacagtctggaaataattccagaaactgagtctacacccaccctcaatgctctagagccttgagaggaaaagcagccagacatttccagacaccaaccatttcccctttgagcagtgacatttcttttatttatttatttatttatttatttatttatttttggataaaaatgtcaccaaaatatatcatgcacacctttctcctaggaggtggtatagtatagtaaaatgagtgttggctttaggtcatttgaactaagtttaaattttgcctgtaccgtttgctggctttatagcctgagtcaactgacttagcttctgtttgtctcaatttctatatttgcaaaatgaggagactattatacaatgttgcgagaatacaggtagtgttatatatagagacaagctggtagcaagtgcttgttccttaaatgaaagctagcaggctcctgtaagttgcagacccatcttttcagggtaaaccaggaccaagtaataaacacgaatggctatgagggatgacagcatgtaggcctgcttgatttttgagtccctgtgtctgttttgtagagttgcgctattcctttgcaccctgacaactgtcatttctcattgctactgggaaactttcatccccttatccctcctcataatttgttgagtcttacgatatataagcttgttaagtagacatgcaaaaccaagagtatagagattcagagggaaagtgtaaagacttctctgacttagggggagcattgtccaaagacttcagactacataggaacttctaaattggtggtggttggttctgtctatttcaatgcctatcatttctagatgaagctggatacaggatagacaatggctagctagaccatctcaaaagcccccttctgggctggtgtcctagcctccagtgacacaaggagtgaggctgcatgcatctctctagtagctgcccatgtccttcaaacaggcctgagcctctcaaacacactcccattctcatcccagcactcccaccttgatgtttatgttaaagcaacaaccgccctggttgctccctgttatagcatgctgtctctctcctccatgcctgtgctcacactggacactcttacaacgttggtgaaatcttaagcatcatttaagatacagctcagtgtccccactgggaattctctcctctgagctcttatgcgtatctccacaacgacacactgtactgtaattatgtttctgtctccccaactagagtttgactttctttaggatgtgacttatccatggctagttcactgctgtgtttccaagcacttaagcattgcccgagacagggtggattcttaaaaaaaaatgtttgttgaatgaatgaatgaatggtttttaggccttgggccccgcctcattcctggtacataacatactgagtttatgcttgatgaattgaactgagcaatttgaaagttgttccactcaatgctctgcttcattttaagggactgtagtcctccttcctggagttctgggcaaaaccggcagtcaatattgctgcccttgtgcaaagtgtatcttgtttaaaagagatgcccacgctcctgatatcatgaactagcagtggtcagtttaactatggagatgcgtcagtgtattcctgatctccaaccacgtttggtaaaatcagcagttttaccttgacagcaagtgcccctatgggactccagcaccctacagccttaaactggaccagtccccaggtcttgtcagatttgtgatatctgagcaggttgttttcagtattcagcaaacctgtctatctggctgttactggcagtgacacaaagaaaagtgacctttccaggagactgtgttccaggccaccgaccccactaactaaatttaccataaacatgttccaggaagtttccttctagaccatctcaggtcctgattaggatgtttcttgttttttttttttttttttttttttttttttttgagacagggtctcactttgttgcccaggctggagtgcagtggcatgatcacagttcactacactcttggtcttccaggcccaagcaatctttccatatcatcctctcgagtagccggtactacaggcgtgtgctaccacatccagctaatttaaaaaatttttttctttgtatagacggggtctccctatgtcacccaggtttgccttgaactcaggggctccctttgaactgggcttggggctgctgacctccttcctccgaggaagctttgttcctggccagtcttgcccatgggcattgccagtcacatgattcaactggaggcccatgtggcacagagaagaaaaactgcagactccaagtgaagaaccatcctcacctgacaggagctccccgggactgagcgggtttcagcatcactgtgatggtcgtgtctgtctcattcaatggggtgtctgtgtcgtactcaggcatggatggagctggacaggaaacagagagtgcaggtgagttcagcacagattcccaactggctccccaccgccccttgctgccatccttaaagacacagcatggatagagggaggacgtttaggaaaggggttggataagaagccttccaggccttcagtaaaggaggccccgatgcccaacctgcccatagtaggtttcttcaaggtgcagtagtgtggggaagggtagcaatgatctgtcgagtaacctgcatgaaccaaaacgttccacacctaataaacagatatgtgcagggaatataagtactaacaaagaagtgaaagcagagtcaaccttgccaaacacatttaaaatgcaaattacatcaattatgaactacttcccctctaccttttttttttttccttcatgagacctcccttccctcatactcagctgataggaatgcgactatatctattcctttgggaaggtaatttagccatttgtagtaacagctattaaaacccacatcctttttaattcagtttttccaaattctgaatttattcctaaagctataatccaaaccaatgaattaaactttattttgtaacatgtttattgaagcgttattttgtaaaaacacggaagcaccaaatatatccaaccacaggggaatgtataattaaattacgtccatccacttgacagaacattataacgaaagcaatgtagcaacataggaaacacttatgggataaagataagagaaaacattaagctacaaaaaaaacatgtttttctggaaaaccatgtgcaaaatatgtatgtatgcagaccagaattgcatacatatttaggataatgaaagctgtaaaaaaggttctgaaataattctgcattgttgctgtctagtggcagagggggccctacgggtgatggcagtctgtaattttggactactgtggccctataatagtaattcattcattcattcattcattcattcattcatcaggtatttcatgagaacctgcgctaatgtcttgttctggcaaaaagaatgttcctgaaaatgaatttaataaccaacttgtgtgcaatatacattatctacacacacgtgtactatttaatgcaagcctgtgggaaaattatttagtggcttgccacctaattaatctaatttttacactttaggaagttcatcacttagattttcttcataggagacaacaatggtaactcactagggactggatcgtcctaattccacccatatcacagggtgacaattcaagaaaaatttccacttcaaggaaaatcaggaagtgggggtgaaacaaccttttttcctttttcctttctagcagagatacctgaaattttggtggcaatccgagtggtgacagggggcccaaagccctttgctgtgctggccttgatggtgaaggaataggtggtccctgggtacagacccacaaagaggtggtgggtttcattccggagcttgaacactttccccctctggctcgagaggtcagcacttgggtccagcgagccgacagccttgtagttgatctgtaggacaagccagcaaacaaacaaacaaataaatgcctcactcaggaagctggatggagctcctttagaggaaccttagggaggcgggggaaggggcaggcatgtgaacttggccagcagattctgctaagctgcctgttgctgtccactttccagatgatcccagcctccaaataccccattgctcacccactggagcaatgcatgttctcattgatttgtaggagttaaaacttaaaataattgaacttacagagatagagagtagaaggatggttatcagaggctgggaagggcagtaccgggtggggggatggttaatgggtagaaaaaattgaaataatgaataagatcttacatttgctagcacaacaggcggtctatggtcaaaaataatttaactgtacattttaaaataactaaaagggtataattggattgtttctaacagagaagataattgcttgaggggatggacaccccatctatcgagatatgattattacgcattgcatgcttatgtcaaaatacctcgtgtaacccataaatatatatacacctactatgtacccacaaaaaatttttaaaaaaagaaacagagggcgacccacagatgtcattttgaattttctgacagtctcatgaaaagaagtaaaaaaaaaagaaactaattttaacaacacatcttgttgaacccagtgtatccaaactattatcatttcaatctgtagacaacataaaaattgaatggaattgtttacattctactattcgtatgaagtcttacaaatatgtcttttaccccttcagcgcttcttcatttggactagccactgcttttcataagtgcagtagccccgtgaggccagtggtcaccatgctggacactgcagtcatagaacagtgtccaggtagagcgtcccgatgagaattatttataagtcttgttaaaaatgcagatcccaggccccatattccagacagatagcgattgctgactggtgctttctcgtgcattatcttttttgtcttcctcaaatccttgggggcatcaggatagctactctcattttaataatggagaaactgaggtgccaatggaagcaacttgcatgcaatcaccatttttcaaattgtatatggagatagtttgtctatggtatatgaagaccatgccccatgtgacatatcatgtgagttcagcaataaccaaactggtctacacctgtggaatgatttgtgtctactgttccctgatcacacacttgagtgtcacagcaaggtactagaagagttttgaagcactcactctcaacttctgcacttgcccaagggtgaaaataacaattggtagcccagcactggtcccacggatcacactttgagtgtcacatcttgaaattacacagttgtgaagtggcaaacacaagattttttgtttgtcttacctggtttgttccattaaaaatatttaattaggctaggtgtggtggctcacacctgaaatcccagcaatttaggaggccaaggtgagaggattgctagaaccaggagtttgagaccagtctgggcaacacagtaggactctgtatctatgtatctacaaagtattaaaaaattagctgggttggtggtacacatctgtagtcccagctattcaggggctgaggtgggaagatggcttgagcccaggagttcaaggctatagtgagccatgattgtaccactgcactttagcctgggtgagagagagagaccctgtctctaaaaaattaaaaaaaaaattaattatggtataatatacatacagaaaagcataactcttgatgaatttttgaaaactggatacagtcatataatcaaaaaccaaaccattaccaggcccaaaacgttttcctcacactcccttgcaatcctacttgcctacccccatcagggatcacctctgtgtgacttttaacagcatagacgagttttgccagtttttgcactgtgtatcagtgaaatcctatgaaacgcgcttttttgtttctggtttctttctctcaacattatcattatgtccatgggattcatccatgttgtcatgggtagtagcaaataaggcattcccaggtacattcaacaatctcttgcagacaccgtactaggcaggtctgactccaaagcctgtactctatattctataccacattgcctggcctgttaacagtgcatcagttgaaaaatgaattcactcatccacttatttgctccttcacagtgtttcctgtgtactcctgtgttctaggccctgcactgtgtgctgctggagaggtgcccaactgaattcaagtcaggcctcatcctcaagtgacttccattcttgagagaggtaagccagctatatacacagctgacatcacttatcttccatcaagaatggccaaacccaggcagaaaaggaagcacaccaacttcccttcaaaaataagcaatttgctgttactggcaatggcaccaagtgttttggagagaaaagtgatttctctgtcctatattaaacagtagtggtgccgcatccttgaggagagaggtcagacggtgcccagagcagagtgtgcgcaggagggaggaaaaatgcagggagctgagggctttgggctttttttcaagcagcacctgagtgtgcatgtgcaccatgcaggtggctgctagcttcaggctgctctggtgggcctgtctacagcattccctctggtcacccctacccaccccactccttctcagaggcaagtgctacaggcatctatctgcctctctgtttgaggactttctccatgggtgcttgctgggaatgggggttaattaacaccccagccctgatgggagttgatgcatacattctccaggctccccttccttatacccctgcaagctccccctccttggtattcctgcagcatcccaatttccctgagaggctcagctccacttgcctctagaggcagctggtttgaaaacacagtgatgattggctactttcctttctcttccccactccatatctctttactggtgtttcttaaacttcttggcaaactgctcatattcaaatccccatctcagggtctgcatctgagaatgaccaaactaaggaaaaatgctcgtggaggtatctcaggagagagtgcaactgacatccgaaggacaatcctgagtcagaagaggaaagagtattctagcttctaggcagagggaaccgcgtaggcaaagatctgggatgggaaaaggtttggacagagcaaagcccagagccactgcagagcagtgagcaaatgggggcaaatggagttttcagcatgcaggtggattctggtttccactgtggcagaaaaggggagatgtacagacagttcagcctgtagccaccaaccccagtgcaccagtggagaggacgtgtgcttgcattctttgaaaattctgtccccgtccccctgcttggactggtggcaactacattgatatacagacactgggaggtaaaactcatgccttatttactagccaattcctttcctgcgctccaaattcaatccaaaagcaactcaatttccaccgagctgtcaatataatataccgcgctcttctgctctcctaacctttcctggtattacaggatcctcacttacttgtaatgaaacactatgaataaatcaatgtatgttaatatagcatgtcttcaattttttatgaagggcttcaccaaatctaattcccactgctttgtcagaaacagtctttgaaaaatttaacttgcaagtttcacgaagttagtgagggatcgggctggggagggaaagaagaaaggtgagaaaaatgggatgggagggagctgtggctgtaaacgtataatataatatgaaccttcatttataagcggggaaaacggaagatttgtagaatagcaaacataaaataaagggttagtagggggaagggtacacagctgcacatcaaccctgggctcctggcatgggttctggctgcaaaaagtactcaaggatgtcccccttctcttttagttgctgacagtaggatccacagccagaaaccaaagcaggtgcttcataacaaaaatcccaggctgagcacagtggctcgcacctgtaatcccagcactctgggaggctgaggcaggtggatcacctgaggtcgggagttcgagaccagcctgaccaacacagagaaaccccgtctctattaaaattacaaaaaattatccaggtgtggtggtgcatgcctgtaaccccagctactcgggaggctgaggcaggagaatcacttgaacctgggaggtggaggtagcagtgagcagagatggcgctactgcactccaacctggtcaacaagagtgaaactccctctcaacaacaacaacaatgacaaaatccaatcatgtcgtaagagcaatgctttcccagagctctcaggatgaagaatgtgtctctgtcatgtggtcttaatcagctcagtgcgtgagctggcctcgctcgtcctccccccagcaccccaagccttacttcagtactaaaaagagccatggtcttttctgccacaggaacttgcaccagctcttctgtcagcctgggccccgtcttccttcccatgcctccttgttgcctcattcatgactcctcacccttagcggacctcacttacagggactctttttatgggtatcttctctgactcccaggttcttattttacgtttccagagtcacctgtctctcttttgagccactaactttccatgtaaccatgtaattatttcatcaataagtcccttttctaccagcccaggagctgaaaaaatatgacttgcaagtcaaattcaatctaccatctgtttttgtaagtaaagttttattggaaaacagctacaccattgatttaaatatggacttatggctactctcacactacgaaagcagagagaagtagcaacagataccctacagcccacgctgcctaaaatatttattttctggcctttcatagaaaaagtttgcagacctctgtactagactttaagctccaaggaggcaaagatcgtatctggtgtttgttcaacatttcatccttttgcatgtctaaatgaataattaaattagctgtgtagcttgagggattgcttaacctctctgagcctcgagttcttcaagggaaaaattataattctaattttagtttccattttatgttgcagagtgacccccatttctttactcctggaagacaagccattgttttggaaggaaggctccagaatgtccatgagtggctttggcttctgtatcaaggcgcagtggctcatgtctgaaatcccagcactttgggaggctaaggcaggaggattatttgagcctaggagtttaagagcagcctgggcaaaacagcgagaccccatctctacaccaatttgttttaaaaaactagctgggcatggtgatgcacgcctgtagtcctagttacttgggaggctgaggcaggaggatcacttgagccctggaggtcgaggctgcagtgagccacaatcgcggcacagcattctagcctgggaaacagagtgagaccatgtctcaaagcaagcaagcaaacaaacaaacaaaacaaaaaagtttgaaggtcatagaaaagcaaagaaagaccaagaaatggtcacaggttgaggaacaaggagacatgacaacgaaatgctatgtgagagcctagaagaaaaaagaagacctctgtggaaaacctggagaaatctggaaaaaaaaaaaagtctggcatttaatcaataataatgcactgaagtgaattcttaattttaataaatataccatggctatgcaagatgttaacattagggaaagttgtatgaggggtataaaactctctctttttttttttttacagtttctctgtaaacttatttcaaaatcaattgtttaaaagacaacaaatggcatgctgagatttggctgctgtgagcatctttgtggctgcagaacagaacctaaacagatatccattgagctcttgactaggtgcttggccatgtactaagctctagagaatcctcaggaacctacaatttggtgagggagataggtatggcccacaggaataagcgggcaaggcacattaagagctctgttctgaaggaagggaagatggctcttatgagcatgtaacagagaaaacagattgagtctctggggccagatgccttcctcatagagtgtgaagctgttaaccagatgaggagcatgggagaagggtgggaggcatgacaggagatggtggagaatgaaagaagaaaaggctcttgggcaggacaactgcttgcctaagggatgcttttgtgcaaagtagaaaaggtgcctgtctcaactcagtctcagccccctgtacttcagtgagctgatgctgcctttgtgagaagaagaagatacgcttttcttggtgcccagtcatattcttcctggcagacacagcacagagtttaatggatttcatttccttggtagtgtgtctttgtgcagtgcacaaactaagcaacagtaggtggcatttctgctgagctcagattatggaagcctttaatgaactactcaagtgtatatattttatttcgagggtaatatagagccattaaaggagagggtaggccatcaagagagacacaggatcataccacagtgctactaaacgtgtggtttgcagataaacagcatcagcaccacctgggagcttgttagagctgcagattcatgagtctatcccagacctcctgatcagaatgtccggggctgaggcccagcactctgttgtttcataagctctccaggtgattctcatgcacactgagtttggagaaacactttctcaggcaaggggatggaggattgaaatgaccagaggaacaacaccggggtccctttggagggtctggctctcatgcagatgacaaatacaaagaaggccttgtttcaaccagaagcagaggagatggagaggtgacaacagtgactctgagagattctgagtcctggctggagaagaatgaggtccctagaaatgtaagaatgagacggagccaacacatggccccagacctgagcctcctaaggctgaaaaccactggggaagacctgcaagtatccttactggcctcgtgcttccaatgctgttaacattcatgaaggcaaagagtgtgggtctcagccagcgggagggaagaccactggctgacagtcttgcagagccagggctgaaactctgacccatcacttaccaagctttaagcgactgaagctctattttgtaccctcaccagccgaagggccctggagacaacagaacagagcagcaacgcctctgaacagcatctgccaggcttccctgctttccaaagccaagcttcagggtcagaggctcagcctgcaggcttggttggctgtgccggggcctgcccgggctgcacaccttccccagcactgccagcacagggacccatgcccgtggttcctggccgtatcagccctgctgcggccctgcaggggcttcctctagcctggtgcggactttcttggttaccatggatcaaagggctgttgtaggagtggggaagttaactcgtttgcccaacatggcttttgctgatttccaatcaatgccctgctctctgacttcagctgttttcctattggctgtgggatcaaacatagggagaaaacaaactcgaaatccagctggcccagggtccttagtattcaccatccatcaaccaaaatggagggttagttagtgggtgataataacaggaacaaacattatgtgcctaccatgcatatggctctcttccctgtgtcaccatcctgctccttagctaccagacacactttaggtgagtgtattcctgtcaacaggtgctccctccaccaacacctctggcccctccaatccttagcaccgggctgcttcccagactcattgccttccctcccctgcctcacatgagagggatattctgagattcactcttcccagctgccctaaatttcaaagaatgcagtcagagtcccatagcagggccaccatcaactcagacggctctaagctctttcttcctgaactaccataatgcagcctaataatatgaagcctcaacctcctttcagcttttagtctcatgctggggtgtcctgggtgctatgattttgttattttcacagaaaccttcttgtttaatgagtctgtctagcaatattcccaatggcttttagtctgtattgcaatacttcttgggtttctgaacatgagctgcttgccttccaacttcacactcagctgatttctgttctgctaagtttaacctggttaagttgctaagttgcatgaccaattcctctccagttggctttgggcatggagatgcaagaagttaaataatcccatgatcctgctcattggaaccctgcagccatactaacagcctttctggcagacaccgcctggaacaaatccttcattaagggcaaagcctagattctatttattgattgtaataattgccaagcacccagcttggcatagagaaggagtcaataaggtttaccaaatacatgaggattaagaatgaaaatgtaacaaatcctcaatgtggtacaactgggatttaaaatgaggtcattctgatcctgaagtccagtattctccgccccaccctgccaccttggccttggctcctctgtgcacatcctgtgtgaacagtttctagggagaggggctgattgaggggaggctgcaactgtcagaacacgaggctttgtagagggtctgtctgagcccaccccactcaggagggacttgccaagcaagcccagaagctgggtccatgcctgtccggcacagagttggtgctcagtaactatgtatttaataattaaggaggcccaaggtggtgaaggtcttgtatctgggcctgaatttctaaacctgtgtaagtagaaagtccttttggtgctttttagaaaatagcccatatcctttgacactgctttcattaaaaggtggtgtttatatcccctgactccccttaagtcttaggggacttgggactgctctcaccgatacaatgtaggggatgtgatattttgtgacttctaagattaggtcatgaaggcaatgtagtttctgacttgtccacagagactcttatgtctacagtgtctaagctgctgtataagaagtctaactcccctggggccgccatgtgtgagcaaacgcagggtgcatgacagtccctgtgtagatgctctagattgacagccccagctgagtccagtcatctgggcaacagacagctaagtgaggaggctgccgtgtgagtccagttctcggctctctggtcacccctggtcatttgagtcttctcagctgggaccctagacattgtggagctgaagcaaatcatccctgccctcttgcattcctgacccacagaatatgtaagcataataaagttgttgttttattccactaaattttggagtgatttgttaccagcagtagtaactagaacaccatttgttcattagacaagagtttcttaaagagcatcggcaatattttattctctttcatatccccaaaaggaaacagtaaatgcttaacaaatacatgctacattcttagccaaatgatgaatgtcaacaataccagtaatgagaaatatggacattcaggctgggcatcatagccagactccatctccacaaaaaattttttttaaaaaatagccaggcatggtggtgcatgcctgtagtcccagctactcgggaggctgaggctgggaggattgcgtgagccagggaggtcgaggctgcggttaggcaagactggtccactgcactccagcttcggtgacagagtgagaccctgtctctaaaaaacaaaagtaaaaaataaaaataaaaataaatatgtacatcatatgcctcttgatacgatgctctgagaaagggttatgtgtggtattttttgccaaaaatgcataatctcgatctaatcgtgagaaaacatcagaaagaaaaaaaaaactaacttaaaggacagtctacaaaataactgaccagtattcttcagaagtgtcaaggtcataaaatattaaaaaaataataaagactgaaaggctgaggagatgtcccagactggaggagactaaggaaaaaatgacaagtaagtgaaacacggataggatcctggactggaaaacgacattagtgggaagataagtgaaattcaaataaggcctgtagattatagtgttcattataatgtagcttaaagtatctatcaatgttaatttcctggtttcagtcactatcctgtggttatacaagatgctaacataaggggaagccaggtgatgggtatatagaaactccatactaatcttgcaacttttctgtaagtctaaaattattttaaaattaaatattgagccaggcgcggtggctcacgcctgtaatcctagcactttgggaggccaagggggacggatcatctggggtcaggagttcgagaccagcctggtcaacatggtgaaaccccgtctccaataaaaatacaaaagttagctaagcatggtggcgggcgcgggtaatcctagctacttgaggctgaggcaggagaatcacttgaatgcaggaggcagagactgcagtgagctgagatcacaccactgcactccagcctgggcgacagagcaagactccatttcagaaaaaaaaaaaaaaaaaaaaagaactaaatattttttttaaaaaaaagaacaaaaaatgtgcactaagtctcattgattggcaaatctgtaatcatggacccacaagttagaagccaaaggcacacccctccacccctcacattcttgcagcaatttattacaattatatatatatatatatatatatatatatattttttttttttttttttttttttttgagatggagttttcgctgttgtcgctcaggctggagtgcagtggtgtgatcttggctcaccgcaacctccgcctcccgggtacaagcaattctcctgcctcagcctcccgagtaagtgggattacaggcatgcacctccacccctggctaattttgtatttttagtagagacggggtttctccatgttggtcaggctggtttcaaactcctgacctcaggtgatcagcccgcctcggcctcccaaagtgctaggattacagccatgagtcaccgtgcccggcctattacaataatattaacaacacgagaggacatttaataccactcactagttgccaggtgccttgccaagcactttccacacattactcgtttaatcatcccacaagtttatgaggctactaccgttactattcccactttgcggatgagaaaactgagacttaaggggagcaacttcccagtgtcttcacagataggaagaggcagaggcaggcttggaaccccggcagtatgaatctagaatccacctgcttaaccttggagctcttttgtcatcatgaagagtggccagtcttacttccagggcctgggagaccaaaaacttttgctggaaatctcttaaaggatcagctagagtgcaaagacatgttaggagtatttggacaggcagagagagcttttgagtgcatcgttgggggcacagaggccaaaattaaggtgaaatggggtggaaataaatctggagaattaggggcgatcaggggacttgatgctagaatgcatttccaagcaccccagaggggttttctgaccacctgggaacttcctgcatcattgtcagaggccaagtcagggatcaggttgagaggcccttctaaggagaaatccatcgatcacgtaatcacacattctgggccagtgcggggctgaaggctgaagtttcactctattgcacttttctttcattcagcatttttctcatgaaattaaaatagaattgattttctcccccactaaattaggcattaggaaaggaacgaaagggagggcatgttggagactacaccatcaattcaatccagcagagtagcatttgtaagaaattgtattcgcccctacttactatgagaaggttttgtaaagcctatttttttttgttatatctccttcttactagaagagatgaacatttttttttctcccttcttggttaaaacgatcatttatactaaccttttctccaaccctctggcctcaggttagaagcttcctttttctaactttgcctctgtggtatttccccagaagcagacacacagcaggtgacactgctgtttatggaactgtcatttctgatgaaatgggtcatctggggactctacgttctcctattctgcagtgaccccaggctcatagctgggtccagagtggaacctcacagctggaaggaactactccatttacagagtgctgaaaggagatgggagcaggaggaaactgaggctcagagaggttaggaagcacacctaaggccccacagtaactggttctactcgaaggaggcagcgatgggataacaaaggagtcagaaaccttgggtacaaatcctgatgcttcctcttagcagatggtcatttatagctgcactgcccattagaaataggatgtgagccacatttgtgattttatattttctaggagccacatggggaaaaaaggcaaagagaagcaggtgggaattaatttcagtaatatactttctttaacccaaggtatccacaatgctattattccaacatgtattcaacacaaaattattgaggatattttacattctcttttcccactaagtgttcgaaacctgttgtgtattttatattctgaacatttctattccggctagccacattttgagtgtttaatagccacttgtagctagtagctagaccagggtttctcaatcatttttttctttactatcacctcctaagaaatgtatttagactttctgtgttgtacccctatgaattttaactctacagatgtggtgtatagttgtatatggacgctatgcatacctgcatggctgtatgtgggctttatgcgtattatgcatatgtgtatgaaaagggatttttccccaccctacccccaccactaccaccaagaaccaattttcatctcttggggtcgatggcacccctattaagcatgcatgatctagagcaggggtgtccggtcttttggattccccgggccacattggaagaagaagaattgtcttgggcaacacatgaaatacactcacactgacgatagctgatgagacaaaaaaaaaattaaaatcatgaaaaaatctcataatgttttaagaaagtttataaatttttgttgggctgtattcaaagccattttgggtcgcatgtagcctgtgggctcagggttggacaagcttcgtctagagcaagcagtaacggccctgagcctcaggtccttatctgtaaaataaggatgagtgtgtggactaaatgaggcagttcttgtgggaaagcatccagtggtgctgagtgtggcaccaatgctaatattggagttgcattgctgtttccaacacattcccttccacactgagtgccaggagtcaggtccccctcctcacctgcagccagttgccaggaagacgtgctctctgcccatgacttccctcctgctccaggggacttcccaaagccctcacagggtaaccaggggctctgtccttcagcctggccacaactcagcccagggcagcagggccttgtggaccaccttcttcaatgccttctctctcttagtggacacctaattaatgctgaaggtccagaggccacccttgagggtagcccaggtcccctgacacccaaaccaagcctctcttccctcccctgagtgcccattggcagatgggtggtgcccaggcttgttatctgtgcagagacacatgctccattttccaactcctcccagacccctgccccagtctaccccagacttgggaggttgctaactgtgtgctaagtggttttctccctcagcttctgagagattctggcacttgcttcgcttcccatctcgtggcttcccactggccagtagggtccatttctgcacctgtggctcccaagaagctctaccttgtcattgaccactctgccctctctgtccagttcttcttctgtcccgttcttcttctgtcccatctgagtgagacatgcccctacaagcaatgccaggggccatcaaggaatcatctggaacactttggagacaaggaactcagtccctcttactcacctgtgattctgccagtgggcagtgctgtaagaacatgagcactggagtcatagaagactgccttttctctctgcccctcttgtgattctagtggctacacggcacatgtgaggaagctgattgcgaaggctataaacttggtgtcctaagctggggattgcagagtaaaacccacgaagtgagcagcctgattgcccagccttctgcagtcacgcctcattaggcacccattggagggaaaagtcaaactaaaaaccagaaaagaaagtggctttgagacgttgcctttttttcccttaaaatgtacttcttggattgtgtttctttatagatgtaatccttctcccgcattttatttgggaaggggttcataataggaaggagttgttttgaattatatcagtaaatattcatggagaataaaaggaaatactttgggattataaaagacagtgtgaacctgattaacaatgtgaacttgatcttgggtgtgctgggctggttttaggctgtgatgcttagcacctgggtgaccttcaataatattcgattccatcatcaagaagaaaggtttttcatgaagttgaaatgtgtccatgtgtataagagagcttgaaaattcctagcacttgggagactgtcgagtaggtcagtcagacctgaatctacaacatcagagagggtgtttgatggtatttttggggaaaccacagactcattcatgtggagtcaataactatctcttgggcagtatcagtagctgttattttaggcacctgagatatgcccaggaacaaaccagtgaagacactgccttcctagagtttaccttctagttactaggaaggtgagaggaggggagaaaaatataatgaatgtaataaatatgccatttatttggtatgttagtagatgataagttctctagaaaacaaaagaaaaggaaggagacagcagagcagggtggggaggataggtgtgcatgagcaggtgatgcaggggtgagactgatcagcctcactgagaaagtgagatttcagcaaggacgtcatggaggtgagggaattagctaagtggatacccaagagaagagctttccaggagaggagagtgggagatggggtgaaaggggtgtgtgtgggtcacacagatctctgtgagtctttgaaagatttaggcatctagcctgggtggcatgggggctgctacaaattgtgagagccaggctgagacagacttcatggtgagaactggttgcaggactgaactcttcatcctgaaaggtaacagctccaactcagaccatagatgcaggatgcagggacccctgatctcctgaggctcttctacccaggctctgggtgctgcggacctgagaggacaagttggtgcaggagtcccacctccatgcttcctgggcccaggggatgctgcacagcccagtttctagacctttccttctggttcagctgcctgactcaacaacctcccaggaggcttccttcaggggctccttctgggtgagtgtggggaagaacaaggacatagattatgccctgggcaggaaaaatgaacacaaattcagggtattgaggaggcatctgagaagatgaccactgcgtacccagcatggccatcccaagctaaatctcaggagtgtggaccttgacttgaagacatcaaaggttattgtaagcagtgctctccgaaaatgggagttccctgagctttagcagatgtaccctccagctttagcatcccagggaccccgagatcttgaaacccattgcccttcaagtatggctgggagcgtagcaggctttcagagacaaggtaacccgctggggcaatatttaaagtcacacaaactctttacaaggtttacacctagaactctaggctcttattaagattcagagttcacaaatcccccaaatgtgaggaaagcaactcagagactctctccttggcatgttgaaggtgtgtaactaaaaggtgctgggtgtttcatgtaggaggtggaaagaatcattgcattgatttggatgaagcctccttcattgaaaaatatcaaaatttgcatgaaagacttttgctaaagtaatagcaattgaaatattctttgaagtgctctgaatataaatatagaaacgctcccatggagacctgctcatactggcttcttgccttatcgctgtctcactgggttcactgttagcctcagagggggttatacagtgtctcaaccatactgccttgggctgcctagcctgtgtgtgaggggtggaggagtcctgagtctggttcttttttttcttccctttcctttccttccttcctttcctttaccttttccccttccttcctcccttctttctccccttccctccttccttcctcccttctttctctccttccctccttccttccttccctccttccttccatccatccgtccgtccatcaatccatccatccatccatcctccctttctcactgtgttgcccagactggatctgaactcctgggctcaagcaatcctcccacctcagtctccagagtaattgggactacagtcatgtgtgccaccacgtctggcttggctctttcatttaatgacaaacattctaggggcccagattttgcctccaaagaataaataactcatgaaccgtgagagcactccaacaaatgagactgtaagagaaggaacgcactacctgtctccaaatctgggtgcatctggagaattttaataccctctctaccctgaacctatgcttcgcaggctacttctcccagctcctgaaccaccattgctgttatagagtcaatggtgctgtgggaacatattcaattgctaagagggctgaatatattaagccacaaaataaaaatgaaaggtgccagagctcaaaggcccagagatagtgggggccagagttagtcccattgcaggctgaagaacacatcctttgaagtgggtgacaggggagaaaatcaacacccaaacaaagagaaaagccagcgtgcagaaaggaggatggggcagacacacttaaggaagcaagaagcagagacaatggggaagagaaaaggaagagaagcctgggtatcgggtttccaattgtatgtccatgatgccaaatcatttttcatcccctgctcaagattttctgtaaggcaatttgagctattttgagggatgttgtgtttttagaaagtatatttccctgatgagaacatctcacctaagtgaacacctcatctggatcttcaatcttttccttgctctttcctcagcaaaatgccaagagatgctggctcccctagctcagtagctgccttcatgtcccctcctctctctgtgtccaggtccatgcttacccatcccaaatcctgtaacccgtgtgttatgagccatggattcatccaaagtgcagactccaaaccacactaactcatatgggtatctggtgctccccaaggcagcacagcttgtccaagaagtggaactgaatgtcaatgccttcatttcactgccatgtaactccctgggggaaacagcccaggaagcagctgtgtgggctgataagggcttctctgccttgtcggaatcctcaggcaccagctccagataacggccagcgacaggagtcagtacctgtgccaggtgtcaagccttccccttgagctacacaaactctcaggtataccatgctgccctgcctggacatgtccctggcagaggggtgggccttttcatcagaggacgggctacgtttttccttgctacactcaagaacggtaggagcccttactcacttcttgtcaaaagcaggaggcaactgtcttcagtgattaacaatgtaagccacttactagctttgagactttgggcaaggtgcttagcatcttggtaccctgattttctcttctgttaaatggagacaatgatgtccctttcttataggtcagaatggggaataactgagataatacttgtaaagcccctataacagtgcctggacataataagcactggataaacacaatctatccttactgttaagacattaaagttcttcaatagttttccattggtcttaggataaaagcaaccatctatactgtggcctgaagatcacacatggtcttgccctggttgctgttactcccacatcatctcactgattttgcactcaaaccacatttgcctcctccctaccccaggtactggccctacatctttcaccagaggttctggccatgctgttccctcactacagcatgattttccaccctctcttggtttggttaacacctcttccttcagttctgagctctattgttatttacttgggcaaaccttccctgctcaagtccaatgtgccacaatggcttttaaaggacaagaaccatgattttgcacaacttgcaggagcattgttcacactataacaatggggatggtgacctctggagtggtacagaacagcagccccatagggcagtggtttcagccagaggtaaaacctgaccatggggccaggatctgtaccactggtcggtgaaggaataaggacatccaaaaggcaccatcctgtgccaacattttctttgtgactcagagtcaaagcactgattatttggtcttatgtctcacattgcttcttctaccatcttcccactatcatcttaacatctgctgccaaagcaccacttacagagaacacactaagaaaaagcaactgacactctacttcaagccctctcctgcagctacttctgaagcaaatattactcatgcaatttcacatttatctgtttatctgattaatattttccactcagacaagactctaagcaacacacacaaaagggccatgttggctctggtgattgtagtatccttagcacctaaaacaaagagtagatcctcaatagatatttgttgcatgaataaataagctccagtttcagtgcccagggctgttctccagccccaaattgccaagcccagtgcctgaaattctaccactatatcatatatttgagcccagtccctggttcaagggaagaaatgttaagaacctcaactacactggctggtaatttcagaatcagtcctttcatcaagggggcattatcagttgtgtccaggtgagctgctaaattgtagtctttctacccctgtccagttgaactagggagtaagactggggtcaccttagagggatcatatggcaggtggttggggctgagtctccatgtaggttggtccagaatgtagtcaggacatcagcagttttagcaagacttctctactcctaggatgtttatgcagctagtcttcaggctattttgggtactggggggagagtggagtcaccctgtatcaagagactccaaacattccttacttccctaatatccaagatgtaataaaagcatgaagagtccaaccttcaaagatgagaagatccatcagcccttggctatgtttccaagtgaagggagacaattaaagacagaggagcaagacagttggtcagaaaataggggttctggactggagagtgactgttaaacagaagacagggttttcttaactcttttttttttttttttttttttgagatggagttttgctctgtcaccaaggctggagggcagtggcacaatcttggctcattgcaacctctgcctcctgggttcaagcgattctcctgtctcggcctcctaagtagctgggactataggcatgcaccaccatgcctagctaaatttgtatattttcagtagagatgcagtttcaccatgttggccaggctggtcttgaacttctggcctcaagtggtccacccacctcagcctcccaaagtgctgggattacaggcgtgagccactatgccaagccagggttttcccgattctgataaagggtttttaattcaatttagaggatatttgctaaagtttgaaagtccccccaaattcatacgttgaaacctaactctgaaaaagataatattaaaaggtgggacctttgggagggcagaactgtcaggaaaaggattagcgcccttataaaagagaccccagagagacacctttcctttttcaccatgtgaggatgcagcatgaagtttgccatctacgagaaagagaacccaccccagacacctaacttgctggcaatttaatcttggacctcccagcctccagaactgcaagaaaaaatttctgttctttataagttatcctgtgtgtggtattttgttacagccacctgaatggactaaaacaatgtctaactaaaatataacaaaacacagaggcttctgccacatcctaggcaggaagaaatgacagggatctcagtgaaatagggcctatggaggacacgcacattttgctgagtacctactgtgtgcctagcatttcactaggctctgcagtatacattgcgttatttactttgcagagtaacaccaggagtgaagtaccacccttccaactttactgctgaggagacaggctcagagagggtgagtgacttagtcaaggtcatggaactaatggtatgctgccaggctgggctctggcttctgttcaaagagtgacagccttgtaagtgtcaccaaaggaagcattttgaggacagagttgcagaactatcagttcataaatattcatttttaatccttattttcaggcagaagcttgtgctttctaaatatttagattttttatttgtaaactgacaggatcctatcattgacaagaactctcagagggaacagaatccactcctttttgattgtcacatccccaaatgacctgtctcccgcatggatgcatctaacagcctttgatgctagcagtggccagcagcagcaacctcagactataaatgaacctgttgataccaatatgaattcgcagttgtaataatagagattatggacatacatatagaggcgtctcattcgcaatgacttgaccctgaccacaattctgtgtagcatgcagaacggtgtgacaccatgtgcagggaggagaggaaagctgtggatataccaaaaccagagaatgaaaggtcagatttcacatgcacactgtttgagtccaagtccagctctccttgccctgtaccaccctacagttcatgaatcccagaatgggtcaccagtaagacctgcatcaggaaccacaggtcaaagatgccaatgaagcacctcacagcatgagtcatgcaggaaccaggcggagaacctgagctgaggccagagggtgctggggtggggtctgtcaccctgtttgggaactgggggctccagggaggtgggagcagagagggcaagtgacagtctaggaggcagaacaggtgcaagtcagcacctctaacccctaacatctaaataaaaaagcaatgacctcagtgtgtttcagcgtctgccagctgcagggaaatgtggcagtttccctgagcagagagcatcactgccatagcccatctgtctcactctcaacaccagctctttcttctcaagaacttttcagaggcagggtctgctgccctctgaggttcaaggaaaaggtcaggtgtggtctgtggacaaggggaaacctcattaaatcaagtgtcaaacgtaaaataaataaagccacacatttattagaagtaaatagctgtggctagttgtttgatctctggtctggactttttaaacacgcaagtaaatgaagaaaatgtaccttaataaacccagtgatagagtttaaaaatcatacggtaataatgttaaaacttacaatcaaataatattaaagggaaacaacaaaatgaaaaatacataaacatatatggcagagaacgtcaatattttcaaatatgaaaaagctcttacaaatcaataaaaaagaagaacatgcaaatagaaaaacaatgataaatgacatgaacaggaaattcaccaagatacatattaccaatggggggaaaagagattccacctcaccagaaatcaaatacttgcaagtttatattagatatctaggtttgcttttctaaacagtaaagataatttaaaatgataatacagagtgttgctggagtgagagtttcatgcattgctgatggggttttatatatcttttggggttaatctcatggctggaagcttcttacaagaagttagtaacaactagaatctgacacagagagcagaatcacagcaaaacaaaaccaataaccaaaaacaaaattatagaccagcatatcaactttaaaagaataatatactattacaaataagaatctattccagaaattccaccaggattattgtaattaacattcgaccaaagtaattacctttagccatagcttgaagttaatcccaaagactccaaaatgtatttgacaaaattcaatatcaatttctaaagaaaaagtaatgtatttgtaattggggtgtgtgtgtcggggggacagggaaagtctttcttaatggaaggggacagtcatgtctgtgttatatccaacaatcctttactgactgcccatcaggtggcaaggatacaaggaagagtgagacacagtctctgccctcagagaggttacattctactaggaaagacaaggggtgccacggtgtaaatttgaaccctactgaattcatgttcaaacttaattcccattgtggtggctctaggaggtgaggcctctggggaagtgattaaaccaggatggttttgccatcgtaaaaggctacagggaactagcttaggcccttttttgcccttcagccttctgccatatgaggacatggcattcaaagtgtcctcttggaagaagggactaggccctcaccagacaccaaacctgcccccctggatccgggcttcccagcctcctagaagtttgagaaatatatttctgttctttattaattacccagtccatggtattctgttataacagaacaaaggaactaagagaggtggtaaccaagtaaaccgataaataaatgagatatagatagatggatggatagataggcagattttctttatttaaacataaaaggaagtgaatgatagatgctatgaagaaaagcagggtgaaggcttatagaatgattgacagtcaatttcatttttagtagtgaaagtcaggacagtcccattaaagcaaaaaacaaagaagggggtgcctgctcagaacattagtgttcaacattgctatcagaatacaagcaatcagaattaaacaaacaaacaaccaccataaccaataaagcagcatgggaggatataaagatagcaaaattctttgggaaaaaaatgtggaagctctacaaattaaaatagttccagaatccaaaggctgaattttgccaacagcaaatgatcacagtggatggggaaaattgcatccccaattacgtgagaaaactgtgatgaacgggactaaaaagatacgagcttgccggatgaaagatggaaacgctccaccctgcaggggagaaatagcaatcctatgttcccacagcagaaaggagagacattctacagttgattcagtacaaaactgtctcagaaatgtcatcgggaaagaatcttctcacactggctgaccctcaccacactctcaagagtctcatattaaggaatactctccctgagagaacttctccaaagcatgttccctctccaggccacagctggttgcactctatgacagtgatcaatggctccattgcggagacatgtcttctgttccattcctgtgaccagacagtccagttgcctttctggaaaagaaatgccacagggctcctgaccacagcataacaggctctctggggagaagttcacagccagaccctaaccctcaccccaagaacctcaccctttccatggccccttctgaaagggaagattcaggaggtacaatggtgaaaagctcagacttgggtgttgggcggatatcagcagtgttcatgacatgaaatgggagtaagaagctcctaagcagattgaggcaaagaattccagacagaaggagcagctcaaggaaagatccccagccacaaaagcctggggagtacgaaaaaatggtgacaaattctgggtgatcgagtctatagtgggggagatgagcaagagtagtgaattggggtcagattgcaaagggtcttgaaaggcgcgataaggaagtcaagcttcacaaaactgtgggatgccagctgtggaattaaaccagagactgacgttatcatatttccccttttaaagaaagcacacacgggtgatagtttggatcgtgtaaagagaagctacatagaaagagagggagcaaggctgtcagatgcgtgtcttttggttcatattgcaattacctccgtcctttgataacttggataaatgccattttcaccactctgtttccttctcagcaaagcgatgcatttcacctgtgcttgaagaacctttgcagaaacattcaggggcaatagaagtcaggcactgggtggagttgcccacagaagagagaaaagcaagggagatctgcctgtgagcccaagtggacccctgagctcagggtacatgctaactccagaaatcctcaagtctaatgctcctccaacaagtggtttattcctagaaggtaaagatgcccaaaacgtggtggtccctctgggcaaacaccggtcattgcccctgattgcactcccccaacacaaatgtatgcatgcataaaccagtgttttgcaagctttaacttacgaccaaactgaactctgattcagtagattgggctggggcctgagattctgcatttcaaacacattcccaggagattctgatgctgttgttaattggtggatcctacatggtgtaacgaggttctaaacaccaatagactttcagctgcaagctctttgtctcaatttcaaagtaccactgacctcaacctaaaacctcaacctaacaaacgacctcaacctaaaatcctgtgcttccggttgtgagccttgtgactgtggaggagacatttcctagcgctgagcctcagttcgccacctctgtaaattgcctgtggaagacatggctttggaggacagaaaagaaaagtgaaggaagagaaagatgaagccagagtgaagtggtagcattagtgctgtgattcacaaaaataacactataggaagaacctggatgatagtattctgaatacagcaggagcaccaatagagtagcagtagtaaaaatagcatcattataactaatagtgcagaaatagtactaggggtcctacccagaggaggactgattatttcagaggcagaggttggggcagaatagaaggcttaacagatgtggtacatctcactggttgagaattcagattctggagccaaaccgacatttgatgaaatgaagtgtgtattgaaaacagcacagcaacccccacagagtaggggaaagaatgtaagatccccaaggagagggaccgtgatggtcttgctcagcattgcattcctggtgcctaggacagcgggaggcaccagataaacatctcttaaatatattaggagtctttgattctttttctgttctcagatacctactgactgtatgattctgagatcacacctctcttcttggcttcaattctttcatctcgaaaagtcaggatttgggctgtgtggcaccaaagatgctttccagttcctgtgttttctctcctgatgccctattttactcttcctttgcaacctgatagtatcttttttggttaattgttcactcattttctgtctccccactagaccgagttctccaatgtgggaatctaagttgccatcttgcacaaccctgtaatcccaaaacttggcacaaaacctgaggcatatctcagtgagtatctgtcgaatgaacaaaggaatgaacaagctctattttcttaagatcactggaggcagcattgtgccacggttaagatacgggctctaggttcagactgcctatatttgaatattgattcctccagttaccagttttatgacctgcaaattatttaacttcctgaggctcagtttcctcatctgtagagcgcagatactaatggtatccccttcacaggattttgaaatgattaaataattcatgcaaagctgttaaaatagttctgacatgtagtaagcattcaatacttatcagcctcatttagagaaaaaagaaattccttgtgaattccatgtgtaatttgacaggtgtgacactgactcaacttgctccagcaagtctccaaggcaaccattccccacttggtgcttctaccgtgcccccacagctccatttttgcacttggaatgctgcatttcgttttgaacatgtaagcctttgcttctgccttcaggtgctcaactctggcgtgcccagcctccccagtcttatgcctaccactccctccctcagtcttgctccacaaagtgcctctgtgccttggcatatgctgtcacctctgtctgtgatgaacttccaattttctacaactggccaacacctggtcattactcaagtcccgggtcaagcccctttattgcaggaagatttccctgaatctctaggctggtgaaatgcatgacaaagttctattcatttccctgcagcaatagagaaatcccaactgtttaatcataacagaagaggaaaacaaagaaaaatgagtgggagtgccttggtataactatgacaccctaatcatcatctcatggggagaccctagaacaaccagactcaaatttgaggcatccagtgcatgcttcccagagcctctcactcttacttttcctagaggcacctgagcctgtggagggcagcaggagctcggtctccagctccaccccttctccacattcctacaaaggagttatatgccaggtacctcctttctcggccttggccctggccgggtgattgggaaaatgaaacagactggccgaggcttgatgcccctaaattgtaatttcaaggtaatttgaacttccttcttcttgggcatgaatggaaaagctaaagtctccttgaatcagtgtgcagaactcaacaaagaattaaagtgcccccatgctttcctccaaagcttgtgtgagatcagcaggataatcaattttacaattctgtgaagctgattggaaagtgattacaaaggcagtcagagcattttctcatgggctttcaaaaggcctgttgcagagggacgtgaaggatatgaagtctggccatccatagcaagcccacaaaaatcaaggactccttcactcccaaagctttaatctctggctcccatgagttcgatagtcaatcctgcccaaggcctatagagtaaacgtgtgaggctggtagtccactaagaacctaagccctatttcagtagatagctttggggtcagaatgctactgcaggctgatttttaaaaaccttgaacttcagtgttgccctctgctgcatcctgcctcagtttccttatcccactctctctagctccctgtggagactggatccctgatctaaatcacgctgccaccttctccatgtgctggagcactgtctcctaaaatggccagctttctggcaccgagatgcattaggcactgactggtaggctatgcagagatcaggtttagcccacactcactgtcctgcctcagatgtggaacaacctgggccttccctccatgcactcctcacttcccttagccccaggcctgcctggcctggttggtttcagatagttccccttctcataagcctttgggtctgagaactggaacagagaatgtgtctccctcccagacattgggccccaatcggaatggggaagatggtcacacagcaagaaacagagaagccccaggaaagggctgccaaaggggaaagaaaatgagcctgcttggtcctacggctcttagcgtagctttgcattgcacttatcatgctgtcttgagcgtgtttttgttctcccattggactctgagctccccgacagtagggtgtgtttctaattcattttgatatcatagattattaccttaattggctcatggaggtatgttagtgtgttagtccgtttttgcattgctataaagaaatacctaaaactgggtaattgataaagaaagaggtttacttgttcacagttctgcaggctgtacaggaagcatgatgttgccatctgctcggcttctggggaggcctcaggaaacttacaatcatggtggatggcaaaggaggagcaggcacatttcacatggtgggagtgggagtaagggagggaggtgctacacacttttaaacaaccagatctcacgagaactcactatcgggacaacagcaccaaggggatgtggtgttaaacgatgagaaactgcccccatgatccaatcaccttccaccaggccctacctccctacctccagcattggggattacatttcaacaggagatttgggtggggacacagattcaaaccttattgggggccttttagattcattgtagggtgatacttttgagccctttgaagttaggtatggccagatgacttgtattggacaacaaaacgtgagcagaagtgacctgtttttatccaggtaagtgctttaagagccaaagcccaatttgccgctttctattttccctctgacatgatgactagcaacgttcagcttggtggcagctccgtcagcccgggtccctgtgtgactgctccctgttgacccatgatggacgtgtcatacaggtgagaagtaaacatttgatgttttaacatatagtgtgggtgaaagataagcttttgatgtttgatgtttaacttttgagatttgggaatttgttattgaggtgtaatctagcctaacctgacagatacagtgctcaatatatgttttagggtgagtgaaaggaagggaaggaggagtggaagaaaaggagggagggaaaatgggggaagaagggaagggagaagaaaagagaaggagggagaaatatgtaaatgacccgattagtcttcacctctctttgggtctgtttccaacttagacatctgggaaataatgttcatctttactgtgttcccttctaccttcaacacagaaaacctgatacgattcagacacaaactccatgcctttttttgtataaaagaaaattctattttctcaaatctaatgtgtaacatagcgatatttatagagaaaggtggcagagaaatgaggcaggaaacaaagcaattgtgacttttttgggtaatatatccaagccataaagatttcattagattccataatacattgctaatgaaaaataagaccctttcctattttacctactttctgaacattagaatcaacttggctttccaagctttgcaccccatttacattaattagaaagttccatattaaggaaagcttttaatgggctgttattgcaaatgattttactggtgagctgcattgttctgtttaatagcacatacaatggcatctatagaggagactttgataaaattgaagttttgatggactctgggcctgagctagcctttgctgagaggatggagttcggggatattttcctactgagggaaatggctcttctctttccctggactagagccagttctaaagcatccacatgtttctgatcccaggagaaatccacactgccttctgcctgggtacaccattggcagactgcttccagatccctgtacatcacttggcaatatctctcataggtgttcatggacaagacagagccgtcctggaactgagacataagggatgaatttcataaacacagactgcctgggccaggtggagagtgtcatggagatgggtgctaggtccgtgcaggaaaacagggggagaagggggacaaagcagaataaataatggctgcacataatagcaattgacacagagagtaaggtggggaacagggagaatcggggtatggtggggggtgtaagaggaaccagagcatgctgtcatggcatggagaaccctataggacggtaaccacttttccatttgtctttgtccctatccatgccctgcataaatggtgccacccataggtggtcactattgctcctgaaggttttccttggtcttggcttccagctgcctactactgataggatctccaactatcactatagcatgagaataaagtattcagaaggcagtgcagtatggaatttaggtgtctgagctctgcaattacatctgggtttacatcctacctctcctgctaaataataagtgtaatattctgggccaagttagttaatctctctaaacctcagtttcctcaatttaaaaatgaatctgcctgaagacttcctggtatctaaagtgcactcaatacatgtgagcaattataagtttcattaaataaatttgagtggtttaaaacactgagacttcgggcagagcacaggacttctgaaattatagttacactggtggagttatggaatacaggtcctcagatctcagtgacccgtgaatggtgaattcagcagacatttttgagggtagacattctggcttccctggtgcctggactggatgctgtgatccatggcttatgtgactgtgagtaccatgggctcatgggtttttattcttgccatgctggcagaaggacactgctaagcagggatagacaaaaaaaaaaaacaactatttgaatggaccaacctggctgataaccttgaagcagtctcaccaagagggcttctagtataaatgggaggacaggagaatggccaactagttgaattcagagagtagagagagaagactagtctcaggccactgattctgcagtgtttgataagtggtaagaacccattagagttggttaccattacagctataataggaaaatacaggaataatgcaagcatattatattttgtcccctaagaatgggggaaaataccactatatcatgtgtagggccaaggcttaccctgctgtcagagcccatttagcatcttgaatttagttctagatgtgacatcttgagtttagctacagacccacacctcatctccatcagggagataaagtggtgagtgacgcagactttatgccccacaaagaataattgaaaggattctccagaagagaaaaagttattgctaggtgatgttggttgcattctagtaatcaaacagcagctgattttacgacggattatatgtattctttctaagtaggatatgtgggtagatggggtagggacgtagagacgacaatatggatggaagatttatcaatataagtttgacacagggcacatggtccaaatcaggtgaataccttgcaatgttgtgagttcctgtcactgtggggcttcacgttaaatgtggactcatccatcaaatgcatatggaccatgcactagtacagggtcagtgatactagctgggaacacaaagattaatacaatgtggctcttgctttatagtaattcactcttctgtgaagaacacagacccattaacaaattcttaaataaccactgtgtcacacataccagtgtagaaatgtgtacaaggttgtgtcaaagcaaagaagtgacggcagtggggaaggaggcaaatgtgaggtcagaaggtggctgatccttgaggatgaatcggtaggattctgatgggtggacaagggtgcgagggtgtttccatctaaggaaacaacatccaaaatggcttgaagaatagaccccattttctttatcgattcattcaccagtgggcatttaggtggcttcgatgtcttggctattgtaaatcatgttgcaatgaatatgggaatgcagatatctctttgagattctaacttcaattcttttgggtatatatccagaagtgagattgctgggtcacatggtaattctatttttaatcttttgagagaactccatactattttttcatagctccattttacatctccaccaacagtgtgcaagttttccacatccttaccaacacttatctttttgtttttaaaataatagctatcctagccagtgtgtgatatctcactgtggttttgatttgcacttccatgatgattagtgatgtttagaatcttttcatgtacttgttgtccatttgaatgtctttggagaaatgttgattcaagttctttgccccctttccaatcaggttatttgttttcttggtattgacttatatgagttccttatataatttggatgttacatttatcaggtatatggtatgcaaatattttcttccattctgtaggctgtctcttcattatgctgcttgttgcctttgctgtgcaaaaccttgtagtttgatgtgattccaatggcctatttttacttttgttgtttatgcttttaatgttatatccaaaaatcatcgcccagaccaatgtcatggagctttccccctatttcttctaggtgtcttacagcagtagatgtgagagatatttaattaatattagtacattaaatctttaatccatattactcagcctcaaaataaaaaaggaagtcttgccgtatgtgacaacatagatgaacctggagggcattatgctaagtgaaataagcaagtcatagaaggacaaatactgcatgattccacttatatgaagtatctaaactagccaaatcataggcacagggatagaatggtggttgctaggtgctgggtagagggaggacatgatttgctgttcaacagctataaagtttcagttatatgaggtaaatacattctggagatctgatatacaaggctgtacttacatttcatagtactgtgtttcacagtgtattagtctgttctcatgctaataaagacatacctgagacttggttatttataaagaaaaagaggtttaatggactcacagttccacatggctgaggaggcctcacaatcatggtggaaggcaaggaggagcaaagtcaagtcttacatggcagcaggcaagagagcttgtgcagggggaactcccatttataaaaccatcagctctactaattcactaccatgagaacagtatgggagaaaccacccccacgattcaattatccccacctgcccccctccatggacatgtggggattattacaattcaaggtgagatttagatgggacatagcaagaccatatcagaaggttaaaagtttgctaagagtagagatctcatgctaagttttcttatcacaatataaataaaataaatagatacctttgtcctaaaataaacaaactaaaacatgtgactctatgccatgcatacacatatataaagctttgaataaacaaaaacactgttattttactcacacacacgatgttgaaaaggcatgattatatgaaaagcatgcaggacatcatcagaagtttggcactgtgagagcacaggatgtaaaaggtaaggtctaagagaaatggggctggagaggtgagccaaaatcccattttagagcctgaattttagaaacccgtgggactaataaaaggtattatacagagagtgacagggttagattttgtctttggctttagtggtataattgaaaaactgtcccaggagtttaaaaaagaaaatacggggacctaactaaaaatggaggtaaaactgagagaatttgaagatcctctggaggtacaggatgagggatggtcttaggacaggctggctctcaaatttttaggggaacagccactggggatacctgagaggagtggaactggacaaaccaaagggaagagggacctttcatttttggacatctatggtatgcttgacattgcttctatctttcataccttcataacgatcctgcaaagtaagaattattatcttcttgggaggctgaggcaggtggatcacgaggtcgtgagttcaagaccagcctggccaagatggtgaaaccctgtctctactaaaaatacaaaaattatctgggcgtggtggtggacgcctgtaatcccagctatttgggaggctgaggcaaagaattgcttgaacccaggaggcggaagttgcagtgagccgagattgtgccactgcattccagcctgggcgacagagtgagactccgtctcaaacaaacaaacaaaaaaaaagaattattatcttcattacatatgagaaaattgaagctgttttatgtgtccaagatcacaagatcatatagctgagaccaaatgtgacccataattgtctgcattctgaaacctatgattttcccactagatcctctaagttcctttttttgctccagatttcaggattctaagcacacaaattaatttttatctgttcgaaattgaaataaggcaagtcttagtggaaatgatctgactttataccaagcctggttatatactctcttcatattaaacatattcatacagaggataagcggtacctataaatatcattccaataaaaatgaggccatgtattcctgagtggtaatacgctgcttgggtcagtgatataaaccaggaggctgaaggccaaacaactttaaccagcccagagattcaataagttaaaatatgttttggaagacagctttaggccagacctgctttttttcttgacaattatatgaagacaccttattcagcacaagcaggctggctacagggtgtgaatttttgtttaaaggggcagcaacaagtcatacaggcaacagtgatttgaattttaacttcagaagtagaggtgggtaaccatggtctttttgttgttgttgtcgtcgtcatttgttttgtgttattatttgaaaatccgtatccacaaaaatctcactaacagattgtttccttctcctgaaatgctctcccgactccaacactttttaatctggaaacttcctatagggcaaattttagcttcttaattgggggagattttgccttccaaggaacacttatttgaatatacctacagacaattttggttgtcacaacttgtgtatgtgtgggtaaaggacctctaaaagttagagttcagggatgctaatattctttttttttttttttttgagatgaagtctcgccctgtcgcccagactgcagtgcaatggcgcaatcttggctcactgaaacccctacctcctgggttcaaattattctcctgcctcagcctcctgagtggctgggattgcaggcgcccaccactaagtccagctattttttgtatttttagcagagacagggtttcaccatgttggccaggctcgtctcgaactcctgacctcgtgatcccccaccttggcctcccaaagtgctgggattacaggcgtgagtcaccacgcctggcccagggatgctaacattcttcagtgcataggacagtccccaaaataaagacttacccagtccaaaacattaatagtgctaaggttaagaaacgtgatatagcaataccattcaggacataggcatgggcaaggacttcatgtctgaaacaccaaaagcaatgacaacaaaaaccaaaattgacaaatgggatctaattaaactaaagagcttctgcacagcaaaagaaactatcatcagagtgaacaggcaacctacagaatgggagaaaatttttgcaacctactcatctgacaaagcgctaatatccagaatctacaaagcacttaaacaaatttacaagaaaaaaacaaacaaccccatcaaaaagtgagcaagggatatgaacagacacttctcaaaagaagacatttatgcagccaacaggcacatgaaaaaatgctcatcatcactggccatcagagaaatgcaaatcaaaaccacaatgagataccatctcacaccagttagaatggcgattattaaaaagtcaggcaacaacaggtgctggagaggatgtggagaaataggaacacttttacacgttggtgggactgtaaactagttcaaccattgtggaagacagtgtggcgactcctcaaggatctagaactagaaataccatttgacccagccatcccattactgggtatatacccaaaggattataaatcatgctgctataaagacgcatgcacacatatgtttactgcagcactattcactatggcaaagacttggaaccaacccaaatgtccatcaatgatagactggattaagaaaatgtggcacataatacaccgtggaatactatgcagccataagaaatgatgagttcatgtcctttgtagagacatggatgaagctggaaaccatcattctcagcaaactatcgcaaggacaaaaaaccaaacactgcatgttctcactcataggtgggaattgaacaatgagaacactcggacacaggaaggggaacatcacacactggggcctgtcgtggggtgaggggaggggggagggatagcattaggagatatatctaatgtaaatgacgagttaatgggtgcagcacaccaacatggcacgtgtatacatatgtaactaacctgcacgttgtgcacatgtatcctagaacttaaagtataaaaaaaaaaagaaacgtgatatagggtcttatctgattctcaaggtaaattaggtcctccacgatttatgttttcacagcaaactaaattcttctttcacagcacacatcacatgttgagagacatgttatttgtatgattactgctatggtttgaatgtgttcccccaaaaccatatattggaaacttattacccttgcagcagtgttgggaggtggggcctaatgggaggtgtttaggtcatgaggtgtctatccttttgaatggattaatgttgattataaaagcacttgaggcaaggcatggtgtctcaggcctctaatcccagaactttgggaggacaaggcgagagacttcttgcttgagtctaggagtttgagaccagcctgggcaacacaatgagaccctgtcaccacaaaaaaattaagaaatacagctgggcatggtggtacatgcttgtagtcccagctactccagaggttaaggcaggaggattgcttgagcccaggatgctgaggctgaagtgagccatgattacaccactgcattccagcctgggaaacagagcaaaaccctgtcaaaaaaaaaaaaaaaaagaaagaaagccttgaggctgccagtttaactcttctctctgtctctctctctcttcctttgcccttctaccataagatgacacagcaagaaggcgctaaactgtgacctaataaatttctcttcattataaattagtcagtctgtggtattcggttatatcagcacagtatggacttatacagccatctaatagctttcttccctatgcaacggactctaggagggtgaggaacagcattcaattttctcccaattgtatcctcagcagctagtataatacttggcacatattaggtgaaaccctgtcactacaaaaaattaaaaagttctgggcatgtaatcagtaaagacttgtgaatgaatcaacacgtagtaaaagagagaatgcaatcagtcaatacattatgcttatgaaattacatctctacttcagttgaaaaaattgatgaaaaatataaattgattgattaattgattaaggaaagtataaaccaggaatcatttgtcaccatggtgctgcagacccacacagtactaacattaaccaaagtaaatgccagcttccattaaccaacgtaaatgtcagtggtagtcagctcccaagatggtccccaaccatccctacctcctgttattcacatccagatgtagtactctgctacttccaaggctagttcatgaaatgtattataatttctttcccttttctcttggctcacttactctagtgaaagccatgtgccatgtcataacatactgaggcctctgacaatagctgtgtgagtacaccatattggaagtggatcccccagtcccagtccaaccttcagatgactgtagccccagctgacatctcaactgcaactttaagagagaccctgggccagaaccataagctaagtcactctaagattcctgactctcacaaactgtttaagataataaatatctgttaagtggtaggaaatttaaatttaaccaaagaacaggaactttcttgagtaccgaccgagaggctggcaggtaggactaagaaattaggttatggagtcagaattgagtttgcaaccttattttatttaggtttactccgatgttataactgaccctgaccaagttacttaggtcttttcattgcttttaaaatcagaataatatctacttttaagggccacaattaaacacaaattgagtaatatgtagtggggtgagttattaatgaattaagaggtatttgagaattttttagaggaaagagggaggagcgtggctaggaactctttaaaatgagaattaaaaagcaaatgtccttttcattgtgagttctgggcttgcttgtccaggtaggaattaagagttcacttttcagatccctcgactacacctcacaggaaaggaggaggagacttttgtgcttcagcagcaagagaagaggggcatggcttgattctgaacacaagtgtagaagtctgaaaagctggaggaggattacctgagttgcaagaacccagacatggtcccctgatgtcacaatctgaacacataacatggcagcctcaggaactggagccatagccaatgtcctggcggccaaacttagtgtgtggggcacggacactaccagcaaaggttccagggcacctcaggcctggacgactcccatcacagaggcaacctggagggaccaaagaccagcgattcttcttggacttcctgtagtgatagggtacgccacagttttttgtttgttcgtttgtttttaaagcctaaagagcgggaggaagggaatgcaacaatgatagagcttggatgagccactagccacaatggtgaaagacaagatgttttattaaattcatcaaaatagaagaaacctgattatgtcttgcccctggtgtcatccagcaagtcctacatactgaaaacagatgtaaatgctctgtcctataactaaatgctattggatttccttttctttcagatgccgagcataagcaagttaatcattgatgatactgtctaggttctccccaacagaagagcttctaatgtcggatgccctacaggagtcaacaacattgccacgggctctattttcctccctgccatgatgggcaatggccagagaggggtgcactgtccttgccaccacactgtactgctgcacccacctgccccaagccctcccttgttctatcccactgttatacctgatgccaactccctacctcacagttaatttgtctcctacaagcctgtgttttccctcatgtcttgcttctatttcagctaattccaggaaaaaatgttacttaaactcactcagttctaacacatatgaacatttcctgccctaccttttctcagaccttgcatgaaatgtctttgtttcctccctctattctgtaagtcaactaagaacctgaaaggtaagagggctattagcatacatcaggaaaaatgggaaaaaagtaaaataataggttttgataagaaaatagaggctgacattttcctctactgaagggcgtttgctttactaatctttcttttggtatttctcaaaaaaaaaaatccatttcatttttcttaccttaacccacatatttatctttctttttaaaaaaataactgccattttgcaatgacctacagttcacttggcttggcataggaagaagtgaggagctacagagtcaggcagaactagctttggttcctagaaaagattgcaacataatcacagctgcttagttctacccctatcttcagagatttatggcttcacagtataaggattggaaaagcctgcccgggccctgaaaactcagagggagtatcatccatatgcaagaaactttgaacagctttcagaaggtggaattcacatggaaaaggacagaaaagggcatgggtggtgcagggaagaaaagatttctttcctcatcggttgctaggttcatggctgaggcacctaaaacaaaagacagattaacaagagaaaagcatacgcatctatttaatacatgttttacacaacaaggaagtcttcagaaaagaaggcccaaagaaagaggaaaatctgattttttttaatgcttacatttgatgaagagtggacagttgtgccaaaatataattggaaaaagtggggattgtctaatggtgataaactgaagggaatttagcaagatctattttgtaacgattcttctccatccccctgtgtcttcagagataaggacgttcctctcctctgggaataggaagggcacctctggaataagggtcttaggactttcttcaggggagaaggctgggggaaggtgagatatcctcctacttctgctgtctacccaaatgccaaggtgccatatttgggggtagcatgttctgaaccccatcgattgtgaagtcagtaaatccatcttcattgtaaccctttttaaaatatgcatgtatattagggaataatttgaacataacacaaatgtttgattatgcctcatttcacaggagagaaaagcaggtgactggagaaaactgcactcagatgaaccaaccacgaaggaatacacaaaatgtatgcactcatacacctcaaacatctgcttccccactcagattacagtgtgtgtcagccacatctggggttccaactttccctcccatttcagacgatcttccatacaccatttctcaataacacacaagttggaatctgatgcccacttacacacagactgcatctctttcaaagtaaagtaccatatttattgtagtatttatgtattccttagctatttaacatgtctaaaactgagctaagatttttcctaggttcctattgtttgggtcactgataaagtttttaaatattgtatcctaacttcattcttcctataagccctgtaatttttagtgtgcaattttacatatcgtggcgatatttaggaatgtataggtcacatgacatcagaactgactgtattcgcaagcgttgggtgagtaaagagggtagatatcaacagaattgcatggaagagtcagggaagactacggcttcctatattcccgaatacaacctgcaagatgcccagtaaggcaggattgtccaaaacaaataaggaggaaggtaaaaatgcacaaagtctatgaagatgtgacaggtcttttttttttttttttaattttactacttgatggatatgccttcaaaaatggtgaaaatgtgtatcttccttagcagaagacacacttgtctatgtaatatccatctctctccccggccctcttcttcacttctggcaaacactgatttgcgtggtatttactctttaatgtggctatgcattcatcaaaggagatccccctttatcccatctcaaggtttattccacctcgagaataaatattgaagaatctcagtcaatcatgataactattttcttcaccagtgatcggttaacctatgggcatgggacctcattcttgccaatgaaacgtgagcagaaatttacattgtgcatctgggaatatttgcttaagagattcttaggaagggatgtccccaggtccacaggaaatgtctgagggcatggcagctatcttctgaccaagaggacggccagcctaaagacaaagcccacacactggggttgacagagcagaaaaacctgagtcaatcatgatgtttttaaaataatgaattaagcaattccgcagcttaggatatgattggataccttgttatatgatgtgacacattttccatatggtataagtcattttgagttggctttgttacttagagctgattattttactatttgtttagcaatactactttcagaagaatcaaaactatgagcaaagagtgacataaaggggaattcattgaatcattatttgttcagtgcaataatgaacaactagaaaaaactaaatacccaagatgagggagctggctaaatagattgagcccattttacagaatcctctgaaaccattaaaatgaaggtgatataaatgtaatatacattgatattgagaaatgttcaaaatgttcttgcccctcttgctcatttaagtcatttgtcacagtattaactctgctgaagcccatattttctgcctactccgagtctgctggacaagtgtgaggaaagcagtgacccatgctaactggtctcgttgtaactcctgtctgctaacctcaagtgctcccttggtatttcctggtgatcctttacatttccccatttcagtctcattttcagactcccacactgtttcctactttatggagtctcttcaaacctccaacacctccacgctctcctcactcttagctgataaccctgcttcctgtttcatagagaaaatggaagttccatggtgagaacacggcacatgtcagcttaactgacccatccccatacattctgtcttccctcctttttctacagcagaaggacctatgccgcatctaagaccaactcttctatgtgtgagtgagaccccctgtgctctcatttaccaaacgtcatcccaagagcagtgtccatcctctttggggctttttccctttccattggatcatttccctttagttctaatatttctcaaattttataaaataccaacaactccccaccttttgatcagagaacatcttcaggtactgtctcctgtctctgccttctttgtatctttctatacaattcctctcctgctgctctcccttgggcctgtgtaatcagatttcagtacccacaattctttataaattgctaatgttaactcaccaatgacctctctgttgctgcatctaatggtcaattctcagtccttattttacctgaactaccaacagcatttgacacagtggatcaccttctccttttgttctttttttattacttggcttcctggaccctgccctcatttttcttcttacttcattggctgatacttctgtctcatttgatgattctgcctcaaattttccaccttaaaaatccaagggtcccaaagcttagcactagaatctccctattctacctacactgagaccctttcacctcctccagctttacgtctgcaaagctcgtgcataggctgactcccctgctaacatctccgtcctctacttctcccctgaactccagactggcatatctgtctacttgatatctcacccaaaatatccaacaggaatccatctgaaacttaacagatgccaaacctaaatcccaatctttctctgaaacctgctcattccagtgtctttcctatctcagttaatagcaactccatccttccatttgctcagtctaaaatacctggggtcatttttgattcctctctttctttcacatcccaaacctactttgctaccaaattccattggctttatcttaaaactacatctagaattctactacttctcatcactccctcctactttggtctgagcctccaccatctctcacctgcattattaaaatgcctgctcagcagcctctctacttctatccttgccttcctttagcttgttgtcagcagagcagacaacatgatccatttaaacaaaaagccaaattagtttcttccactctttcccttactcactctattccaaccacactggcttggaacacgctaaccagtctctcccgtgaggccctttgcactttcttttttgtttgagacgcagtcttgctctgttgcttaggctatagtgcagtggtgtgatcccagctcactgcaacctctgcctcccgggttcaagtgattctcctgcctcagcctcctgagtagctgggattacaggcacccaacaccatgctcagctaatttttgcatttttagtagagacggggtttcaccatgttggccaggctggaactcctgacctcatggttatctgcccaccttggccccccaaagtgctgggactataggcgtgagccactgagcccggtcactttgcactttctgttctcactgcctggaacagccttcctccagacagaaatttgccttccctcaggtctctgttcaaatgccacctttaaagccaggtctttcattgaaaataaaatgtccctcccacacaggtggccagtacaccctgtccccattatcctgcttttttttacctgacagcattattgccgtctgatttactatatattcatttactatctgtcgcactcaactagaacataagctccagtgagatggtgtcagttttcccactgtcatttcagtgcctggaaaaatgctagacctacgatgcgtattcatgtgtttggtgaataaatgaaaatattgcgttaattaaaatgcacacaggttataaacaattttttgtttttgtgaaacaaatctctaggaaagccaatagttactggatatgtaatttttttgtcaacttttattttggaatcaggggtacatgtgccagtttgttacaaaggtatactgcgtgatgctgagggttggataccaatgaatctgtcacccaggtagtgagtgtagtacccaataggtagtttttcagcccttgctaccaccctccattctcccttcccctctagaaattcccagtgtctttgttcccatctttatgtccatgtgtactcaatgtttagctcccatttataagtgagaacattttctgtttctgtgttagtttaagttaacggctttcagttgcatccatgttgtgacaaagcacatgatttcatttctttttcgggtctgcataatattccagggtgtatatgtaacacattgctttatttgatcctccattaatgagcacctgggttgattccaggtctttgctattgtgactagtgctgtgatgaacatacatcacaggtgtctttttggcagaatgatttattttcctttgagtatatacccagtagtgggattgctgggtcaaatggtagttcaactcttggttcgttgagaaatctccaaactgctctccacagtggctggactaattttaatttccactaacagtagacacttactttgtaccagtcattttcttgggcaatttcttatgtcatcaaaatcataactattcaaagaaataggcacctagtatctccactgtaaatttgaggaaactgaggcttgaaaaatgtagttaacatactttgtattaaataactagaaagtagcagaggtagtatctggtttgatgatctattgtctgtggtatactacctcaaggtatgtgtgtctgttccacaaaaaaaattgtaaaaaaaaatacatacatgagaggatcattccttaataaaacaatagattaaaaggaataaccaatagatgtgtacaaatctgattaaactaatggttaataaaatgaaataaattaaaatggtatgggtttttttctattctattggcaaaaatatcaagcagcagtagccataatgtattaacaaaataatcatttacatgtgggaagatttatgtgcaaggattttcattacagcattgagcataacagccaaaaattatctaaaaacaggagcaggttaaataaagtatgtacatctcaaagatggagtactatatcgtcattaaatgatgcaaaatattatttgagatgtgaaaatgatgagtgtattatttcatgaaatatgcaggctacaaaatagcatgtatatcagaattcaaatggcgcatcgacaagaacaaaatctctttgtatatgtcttgatctgaatattaaaattctggaaggaagtcatctttaataacaataattacctcctcacagagactctatgtgtaataattttccattttaaatttatgtattttttaatttaaaaaaacatagggctgaatcaggtatctattggtactccaacatttagtggcttaaaacaacaataattgattatttcttatagttttctgagttagcaacctgagctgttctgctagaactgctcgatgtcattcaagtagccatagtcatctaagctcagctgaggctgcatgttccaagatggcctcactcatacaactggcagttggtcctgactgttggttaggacactgattctcttcatttaatttctcattttccaggagaccagactgagtttcttcacagaaaggtggccccagacactgggagggcaagagcaaacattcctagtcagtcaaggcgtttgaaaacctcatttctagacttgcacatcatcacttctaccactttctattagtcaaaaagattcacagtcagtgtggatttaaggggctggagacttaggctccgcctcttgctgagaagagtggcaatgtcacattgcaaaggggcatgggcatgggcatagggatgtatgattcactgagaaccattactataacactttatgcattgtaacagattatctatcacaaaggtcatccttcggcggtaggaactatggcaccctcagagtttatcacctatgtaaccatagctttaagcttgggcagcaatatgagaagccacccttagtgccaaggcaggggaggagaaaatggcagtgcaaaccaagaagtctaaataacagttcagaaatagcaccagaatcacctgggatggggagctttaaaaatacacttactcctagagcccacagaggattctgatttcaatgggataggcctggggttggactaataactcttttggtaaatccctcccaggtaatccagatgcttaacctggttttgaaatctttgcactaaacacaggatatcctgagggctcagactcattttgaggaatactggagagaggctccttttttcctagcagccaaattgttttgagactattgctgtgacctggagacatgagatatatttactgactcatcttgcacaagtactacaacaatgtgggttaaatacaattctctagattctagccaccatttacatcacttttcacccggaagaatgtattgtgtctttcaaatatctgacttataagatgacttttgcaatatcatcttttgtaaattgagggtggcctgtaacttggttgccttagcaacaaattggactgaatgttaacagttgagtccagatgttcattccaggcagacaagaaaacacagcctggtccactttgaaatgcactcatcagtactgcccacatcagtgtttgacatggttctcagatgcctcatgttgtctttaacccaactcggagccatgggcattacccgtgccagattacattttttctttttactaaagagacagcaatgtggagtaaaactgatcattgatttttaaggcaaaactattccagtgtctaattcagggacatcatttaaaaaatcatatgggacttccatatgacttttttttcatagcaagcatgaccctagacaagcacagttgattggttgattcaactattttgataatttttattaagaagccatattttgctaggtcctatgctatgtcctagggagatgagtctgttataatttcttcccttgaggagttcaagcctagagaggagatggtatttaaatgacttctacatttgtgagcaaggacaaacaaagatatatgcgaaactggggagtccaggggacaacagaactatctgtctctgagtaggtcaggaaagacaccaccaagaagccacatcttgctggataaggtggactgtgcagggcagagagagtatgaaggaacatccctgcaagaggaattgtctttgcaaaggtgagaactggaagctcatggtgtattgagggaataccaagcacgcttgcatgttcaggaaaaagaagagaaaggaaaggtcttgttggtcacactaagtcctcaggctttagagaatggagttatggagggaattagagcaggtagtgtgacatgatcaaatgcacatcttggaaagttggtagcaaccttgaggacgagttaaagaaagacagtgaaacagtgtgggagtaattctacagtagggataagggatcgggtttttaacagatgaagctatactgggaaggaaggaaggaaggaggatttagtggccagatgtgggtttcgggaggagggtggagccgaggaccccctaggtttctggcttgggggtgttgggtctactttttaaccaggacaggaacacaggagcagggacagttttgataagcagataggttgacgcagatttcaatttggagtaactaaaaaatgtcaaaacagtaataaataaataaataaataaataaataaataaacaaacctttatttaaaaaagtctctatcgggatggacatcttaacgcattacaggtttaatgtctccgaagcttactgatttatcccccttttccctcactctccaccatctcttctgaatattccctgacaagataatatgcaaggaaagttctgccaactcaagacaatgtttaacgtaaaccttggcaggggttacggagttaggtagtggaaaaagtgttaataatgataataataatatttatatcatattccatagccttcaaactgcttctacctaattattttacagtaataatgtctgtaaggaaaatacaagcattattttttaatcagcactttgcagaacaggaaacacacacatacacacacacgaaaggcagccatagagcactgaagaacaagtgaacagagagccggaggtggattcaaacaccttctctgcagctgatgaacccaatgtgaacttagacattgttctctccgagccccaatcccctcctttaggaaatggggttagcagagaggatggcatgttgcaatggatgtgcccagtacaggcttaaccaaaggatgttaaatccccaggcatcatctctgtcactgccagcccgatcaccagccaagtggagaagacagatcactggaacaagcctaagccgttgaaactgattgccacagtgttacattgtaagatgttatcttaaatattttgtaactgctgctttgctggggaagcagggtgtcttggttttccagagctttctctctaccctactggtcacagctggtggacatctgtcctgtcctgggacaatcagacccttagtggtgggaatttgaaattggttcgctctgattctaatcaggctaagaactgttaggtggtctacaatggcacattctgccaggtgaaggaggggagcagagaatagagaaaagtgaatgaagcaagtttgcagagagagcacagaggtgtgggagatggggagagaaggacagagactcagagccagccactgcctcagtttctgttgtgggttttggttccccaaaacatccctgacttgagatttgtgttagccttatatctttccagcaaattgtcctcttgattaagccaggtggagtgggtttctgttatttgtaaccaaccaagcctgtgctaaaacagatgagggcctattttcagataattgggcccaagaggctggaggcgagcatgcaaccaacacatttgtgaaaaatgcaaagaaatttatatgatcattctcagaaagatgccctgtttgctcagggaggatagtgcagttaaaaaaaaaaaaaaaaaaaaaaaaaggaaaagtcagcgacagctaaagacttcagtattgagccagttctgaaaggcattgagactgacccaatgacccacatccaataatatgcggcatttacaagacagagagggaggcggtggtgtgggcacacaagaggaaaggggactcaacagtctggcttccaacaaagaaaaagcgataataatgcttggtgtggattgtaaggcatttaatctggaggaacttgcaggatttgtgaaaacatctgctgctactcatgccgctttgtgttttgctctctcagggggactgtggtttgggggtgtgtgtgtgtgcatgtgtatgtgcatgtgtgtgtgtgtgtatacacatgcgtgtgcttgtatatgttcatgcatgagcatgtgggtattacaaggaccactataacatctgattctgtgaattgttaaaatatacagctgacatatataaaaatggcacagttttaagaaggcaatcattatttaattattctcaatgcaatacttacggtagagaatgtagataatacataaaagaaaacaaaaagtcttagtctgattacccaagaaatcttaatactttcatgtgttacctccccccttttctttttcctactcatttttacatagtttcagtcattctaggtatacgatttttgcattttgcatatattgcttatattatttcgtaaacttgcatccttgattattgaacatccttatcaacatttttaatgactctaatattccatggtatgcaaataccatcatttacctaaacatttctctatttgttcatattccaatagatttttcttcacaattataaatgataccacaatgactagctttgtgagcacaagtgtttttttaaccctatgttggacttgtactgttaagcatatcacagataaacagataccttcctcaagtgcatcaaatagttactactactacctacatatgaagacaaggtgacaggttgtgtggatgagctttttaaagtatgtgggatttaaaatctgacctcatggttacatttcaatattggataaatgaatccctttctgctttgaagactttcagtcttcaattgctccctttaaaatgcaagcatcataataccttgggcaacagggaccaaaaccctcttcaatgaccagatctgtagacaaagtcctgtagaaaagtgcagggacttggacctgtgggtctctgctttctcacctccactcttcttctccaccacattcgctcacagtagtgatggttctgactttctaatctggccctatccaaacctgcctggttggtacaggtgacctattctcactactcgatggcttatcctgctgccttttgtacttagaaaaatactgggctcttttctcctcattctatgggagtctacctcctcacccctctaggccctctgggattttgaccccatttccaacaaaagctccagttcttcaaactcagaacttcattctgatctccagatcaacagaagccctggactcagctgagcttcttccacattcaaattcagacccgttcacccaagaacaagatatggttgagactggctagatattcaccaaagctaattcttctcctgggcacacagttggacaaagctttgcatgtagctgtggtcatatgtttgagttctcaccaatgaaaaagaggtggaagttactataccacttctaggcttgattcatgagatcctgtgtggaatccatcactctcctttccctggtcagccatccagaccctgcaggggacttgaatgccttaggggatgatgaagacaccaaataaaaagagcctgggtgcttgaatgactgagtaaagatctcacctccacacaccctccaacattcattcaaccatcattcttaaacaaaaattatggttttctggtcattatttccattttttgcctgtgccagatcatctattcttacagcatcaaatagaaaaatttgactacagggcacttagagaatgtgatgtggtggaaagaggccagattcatcaaattcaagctgtatgactttagacaaggccattctgctctcttggcctcagcttccccattagtaaaatcaagaggctagtctacattgcacataagaattctcctaaccctaacattgtatggatttgacaaattacaagaaaatttcaaatgtaaggaactaaatatgactgctatgtcttataattttcaaaatgtcaattgaaattcccaatatcaattgaaaatcccaattgaatagacatcttgaaaaacgtaacagtcataaacaacacaaaagccaaagatataaaacaaaattggataaaaacaactgaagtatgagattttattttttccagtagtgagattaattttttgtcatgacagataaatgagacaaaagtaagcatgtgaatagagggccaattaattatatatatatatatacacacacacacaaatatataacatatcatatagcaccattatgcactaaaagaacttgaagtcctatgaatgtacagtctttatgtccttagatataaatataaatatatgtaaatttatatatacaaattgttcatttggctaaaaagaaatcatcatacattctgttatacaagtgatttcgcaggccacatttcttttttttttctttttttttattatactttaagttctagggtacatgtgcataacgtgcaggtttgttacatatgtatacatgtgccatgttggtgtgctgcacccattaactggtcatttacattatgtatatctcctaatgctttccctccccaatttccccaccccacaacaggccccggtgtgtgatgttccccttcctgggtccacctgttctcattgttcaattcccacctatgagtgagaacatgcagtgtttggttttttgtccttgcgacagtttgctgagaatgatggtttccagcttcatccatgtccctacaaaggacaggaactcatcattttttatggctacataatatttcatggtgtatatgtgccacattttcttaatccagtctatcattgatggacatctgggttggttccaagtctttgccattgtgaatagtgccgcaataaacatatgtgtgcatgtgtttttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcgcctgttgtttcctgactttttaatgatcaccattctaacttgcaggccacatttctaatcataatataattcaattaaaaagaaagccttaacttcttggaaactgaaaaactttatcttaaatacacagaccctagatcaaacaggagatccaaatgtaaattataaactattttaaaaataatcaagaaaaagagacaatttcatgccaaaacacgtggaggcagctagggatatatccagagtaatgtgatccaagcatttcaacattacaaattagaaaaaaaggaacaaaataacaaaataaaattagaagaatataagagctaaaaataatgacattattttctttttagcgaagtaaacaataataatgacataaagaaaaaacatgtatctaaataaaatcaaaggtcgtcctttgaaaaaacatggtacatttggtgaagcaaatgaaaataagagagtataacatattaaaaaagagaaaggtggtataaccataaatagacaagatattaaattttaaaatattatgtataactctgtaataagaaatttgagaatttcgagagtgataatttttctagtaaataaaatgaaattcaaccgaggagaagaaaatcacgtaacagtttaagaaagttatttaaatacctttataaaaaccacctcaggtctagatccttttttttccaaatgattttaaaaatatatcctttaaggaaagataactctgataatatttaaattatctcagtccatataaaaataaagcttttccattcattttatatatccaacataattttcatgccaaaacaggatacaaataatgcaaaaataaaactagagataaattttacctataaatacagatggaaaatgttaaacaaatggaatcaatcagtgcatccaaagtacaaaccatgactaagcaaggattattctaagcatggctcatcatcaacaaatatattaagacaatgtattacaaacagaaattaatgggaaaagccatctggttgaatcaatagacagtgaagtgacatctgttattgtgccacccagtagctattttcccttcttctggtgactgataccaaagctttcctctgggaatccacctgctcatctcctttaagcagatgtagaggggatgagatcctacccagctcaggggtgaagcttgtgatctacatttgagccaatcagcacatcacatttccctggtcttaatgattgtgatttagaggtaagactatgggcgtaccaatcagagagatgcaataaaatattttctgggagccctaggaatccctatctcttcctctaccactagatttgaagctaaatgcttacgagttttacagttgttgcagctgattgaggggccacgggggaagagtctgtaagagttacctgatcctgataacacagtttgaacccttgtatcaagctggtctcaagccagcctcattctgagcattttcagttataaaagccaatgcattcacttttcactggagtcaatttgggttaagatttcctggaatttgtcacagaggaagttttcattgatgtatatgccaggatacatttgataaaatccagtagacattcctaatgaaaactttaaccaaaacagaaattgatgggcagtacttaaatataataaagacttttgaaaaaaacttcagtgaaccccttattaaggggcaaaattctgaaaccatttcctttaatatcatgagcaagacaggtatgcttaccatctccatttctatttaacattgttttggtggttaagccaatgcacttagtaaagaaatgagatactcaggaaaaatattttaaaaagaagagacaaaatagaatttatctacaaatgatgtgactctaaacttaaaaaacttgagtgactacttaaaaaatgtctagaatttatccaggagctgataatttggctagaatctatctaagtacataaaaaatcaagagcaataataaaaaaatcagaagaaactcccaatcataatgtgacttaaataatatgagacaaggaaaaaatacatttgatgggaatggttctaaacttaaaaagatattaaaatgcaaacaactaataaattttattgaaacatataaaaacatgtcctgaacaaattttttaaaataccacatgtatgaatgagcaaactcaatattataaatgtcagtcttcccaaaaccaatacgttgatgaaatacaatttcactcagaatcttcataattttaattcataaaattaactaccaaactattttaaagtgtatatggaagagtatatgtctaagaaaaccaagaaaactgtaaaagtaggaggaaccacgatgtttctttattaagcttacaataaagtaaataaaattgtatattattggtccagaaataataatttagtagaataaaacagaaataccagaagagattcaattttatatgagtatatagtaagtgacaaatatggaattttaattcagtaaaacccgtgcgtgtgtgtgtatgtgtgtctgtgtctatcttatttaaagaaattagattaatatgtaaggtgatgttttcttgataaaattaagaaaaagtaagtattctgctggcaacaaaattagggcatgcagtcagggaatctacaaggcatatgaagaatgatcacttcaaaacaactaacctttagataggaaactggaccttttgtgtgaaatctatcctgtgtttttttttttcctattaggataaaattatatattggctatacatgggtgaacagagaattaaacctgataacagaccaatccatcttgcaatacaaaaatgaaattataaggaaaaagattatctaactatctcggtctgccttctgctgctataaaaaaatacttgagagtgggtaatttataaacaacagaaatttattttctcacagttctggcatctgataagtcctagataaacagtggcagattggtgtctgataagggttgctctgcgcttgcaagatgtgcctcttattgggtaatcacatgggtgaaggggaagatagctccccagtatctctctcataagaacgctaaccccacatgggagggctctgccctcatgacttaatcacctcctaggggtctcacctcctaatactatcacactgatgatgaaatttcaacatatgaaacttgaaggaacacattcagaccttaccactgatagatctattaaacgtgggcttgttatcctgaaatagttataccattgcaatcaaaaaaagttagaacaaaatccaaaataatgtcaaattgaaggtattatttgtagccaggcacagtggctcatgcctgtaatcccagaactttgggaggctgaggcgggtggatcatgaggtcaggagttcgagaccagcctggccaatacagtgaaaccctgtctctactaaaaatacaaaaaattagccgggcatggtgtctcgcgcctgtagtcccagctactcaggaggctgaggcagaataattgcttgaacccgggaggtggaagttgcagtgagccgagatcgtgccactgtactccagcctgggcaacagaacgagactctgtcgcaaaaaaaaaaaaaaaaaaaaaaaaaaaaaaaaaaaaagtattatttatacaaactgatatatcaacaatgtcttgcattataaaagtgccaataggttgctggaaggcaaaatatttgaaaggtggagcagtctgaaataaattgtgtctctattttgtttctgatgtagttttagaagaatgttaaaggaaatataacggaactaagatgatgcaaattagagtttggttggtcccttcaggaaagagtttggcatggccatgggccaaattcaacctttgctctatctttgtaaagttttgttagaatatagcaacacatttttgttacttaatgtctatagctgctgtcatactatctacttggcttaaaagaaaacttgtttaattctagaaatggagcagactgcagtctctgagtacaactcagtaaatttaaaaagaaatcatgaaagtaagaacaaacaaacaacccaaaccacttggaaaaaaaggaaaattttaaatatataataaaaatttgattcaaagaagtcaaaatctcggtttgttccagaaattttgaaaaacaacggtaactatgatgtttcatgcaaaaacttagggaatactgccaaaactgcatatttcattgtttcattacatataggaagggtgaaaataaattattgaaagcatttaattcaaaaatattggtgaaaaaagcataccatgaaattctgaggtactcagaaggaggaattaataaaagaaaagtaacaaaggagtaggtttaaaagacatattcagattgaatttgttggaaatcaaacatatttccatctagataataatgtagatgagccaacagctaataaaatcaataaaaatagaaatataaaaatatgtacaaatgcacctaacagcagttacataaaacgaaacaaaaatacaccaccaacaaaaatacataaaacaaaactgagaactggaaagagaaatatgaaaatccacaactatatttgaaaactttcctctcccagtaattgatagaacaagtagagggaaaattattaaaattagagaaaatctgagcaaaacttcaaccacttgacctaagtgatgttatttcagactccattcaacaacagcaagatatacattcttttcatgtgcccctggcaaattcaccgagatagaccatataccatactatgaaacaaatcctaacaaatttaaaagaacttcaataacaggaaatgtgttttctgactatagtagatttaaactaaaaattaataacagaaagatatctgaaaaattccccaatatttgtaaattatacaaaacacttcttaatccatggatcaaagagtaaatcactagaaaagctaatgcacattgaattgattgaaaactaaaacgcatcatgtcaaactatgtgtggcagtgggatacagctaaagtagtacttagaggtaaatttatggcagtaaaatacttatattagaaaacagaaaagttctcatatccataatttaagcttctaaattaagaaactagaaaaagaagtacataataaatgtaaaggaagcagaaagaaggaaatactaaaggtaagaacagaaatgagtgaacttgaatatagaaaactaatgaaaacaaatggtaaaatcaaaagctgattctctgaaaagatgaacgccaggcatggaggctcatgcttgtaatcccagcactttgggaggccgaggcgggcagatcacttgaggccaagagtttaagaccagcctggccaacacggtgaaaccccatctctactgaaaatatgaaaattagccaggccaagagtttgagaccagcctggccaacttggtgaaaccctgtctctactgaaaatacaaaaattagccaggcatggtggtgtgcgcctgtaatcccagctactcaggaggctgaggcaggagaatcacttgaaccagggaggcagaggttgtagtgagccgagatcgcaccattgcactacagcctagccaacaagagctaaaccctgtctcaaaaaaaaaaaaaaaaaaaaaaagaaaaaagaaaagatcaataaaactgacaagtctctagccagactgatcgagaaagaaaagaaagaagacacaaatcgttagcatcgagaatacaaggacgaacattactacagatctttgagatattaaaaggaaaaataaatattagaagcacttaatgccaataaatttgatagcacagatgaaataaacaaattatttgaaagacacaaactaccaaatctcactcaagaattaggtaacgcatttcaccaagaaaaatccatatgaaaacagtttcactggggaattctaccaaatatctacaaaaaaaaaaatagtatcagagaaagaatagtacttttaggaagcagtgcttaaacagatatccatatgtaagaaatcaacctagacccataccttgcactatatataataatcaactcagaacataacataggggaaacattttgtgacctttgttaggccaagaactttgagatatgacataaagtacaaaacaaagaaaggttgattagttgaaattcattgaaattaaaaactcctgctcttcaaagggcactgtcaaaaagataaaaagagatgtcacagacagggaggaaatatatacaaaacacacaaatgtgataaatgattgtatccagaatacacaaagaactttgaagttcagtggtacaaagacagttcaacttaaaatataggcaagcagtttgaacaaagatgtcatcaaagaagatatgtgaaggacaaaaagcacatgaaaaattcccaacagcatcagtcattatggaaatccaaattaaaaccactatgagctctaatcacttacacactcacctactcatgtggccaaagcaggggaaagggagacaatgagaagtcctcacaaggctatgaaatgactgggactcttcgatacagtgcaaaatggtacaaccactttggaaaacagttaggcagcttcttataaacttatactttacatataacccagaaaatcaaatcctggatatttatccaagagaaataaaaatgtatgtctattcaaagacttgtacacaaatattcataacagttttacctatagtagacaaaactgggaacaacacagatttctatccatgaatggatgaactgtgatatattcatacaatcaaatactactcagcaaataagaagtaaagtactaatacatgcagtagcgtggctaaaccttgacagcaagatgcctcatgaaggaaatcagactcaaaaagctgcatcctgtgggatatcatttacatcacattctagaaacagaaaaactatagggacagaaagcagatcactggttttcagggccgagcacagggaagaattaattttaaaggggcatggggaaactttttgggattatgaaaatattttttatttcaatagtggtagtggttatacaactatacatttatcaaaattcatttaattttcctcctagaaatggtacattttattatagataatattttttgaaacttaaacacatacaaaattatttatttgggcaaacaagcagaaacaaagatgacattagagtgatacggcacgatatttttgcccaaccctaccaccattttatttgaaaacctggatggatttccaagaaaccacaaatgaacaaatttgactgaaaacacatggaaaagctaaataaatcaataatcataaaatgaactaaaacacataagaatatcaagaatatcccagtggtttgagtgcttctcctatactctccccaaagcaccaggacattcagttttaggaaagagtattttcattcctttaagaaaaaagtaattcctatatccatgaaatggtactaggacataaaaagtgaaagacaatttaggaattcctttttaaagctactctcacccccatagcaaaacttaacaaaaggtaggcttaaaaacccccaggccaatcttacttatgaatatggacgcaaaaattttaaattaaatattgttacttgagcagctcaataaaataccatatcttatgataaaatgagatttatttcagctgtgcaagatggttcaatattagaaaatgtgcattcatgcattaccacattaagagatccaacagaaaatcacctgatcatttctgatcctactggtttatacctttcccaagatctcacatggctcaccctacaaggcattcaaacctcactcaaagaacacctccacagagaactagccttcttgaactatctttgatatgtcaccttcctaccagcccagaaccatcactctccacgagagtagagactttattttttgtttgagacagagtcttgctctgtcacccaggttggagtgcagtggcgcaatcttggctcaccgcaacctccgcctcccaggttcaagcggttctcttgcctcatcctcccgaggagccaccatgcccggctaatttttgtatttttagtatagacggagttttgccttgttggccaggctggtcttaaactcctaacctcaggtgatcagcccgcctccgcttcccaaagtgctaggattacaggtatgagccactgtgcccggccaagactttgtttactgtctacagaatgcctagcactactcaaccaatacttgatggatgaatatcagtagatattgacaagggttttaagaaattcaatctctatctatgataaaaggcttggtaaaatggaaacaaacagctactttttaaaatgacaaaagagaaaagtatctcatatccaaattttgctttctgtttaatgttgaaataatccaagcatttctattagattcagaacaaaacaaggatgtcctctattccagatataagtgccaaagcaattaaacaagagactgaaataaaaggtatgcctgtttttaaaaaggaggtaaaaacagttattatttgcaggtcagccttggtgaatcagctgaaaaactattagaaaataaatagaagatcttactaagggagctggttataaaattaacatgaaaagccagtagcttcacaatgtacaataaacagaaaatgcaaaggaagtaatgatcagttcaaaaatgtaatgcaagaagaatcctatacataaaagtcatcagaaaaaataatctaggagcaagtgaaactagaaatctgaagtacctatgtgaataaagctatgaaattctactcagaaatatgaaagattttatgaagtcagaataaattcaatattgtaaaggtatcaattcttcctaaattaatctataaattcaatgcagatagaatataaatccagtaggatttctattgcaacttacagttctctcccacttatctggaaaaataagtgtgtgagaatatccagaaagtgtttgaaaaagatagcgggagatagatctatcaaatattggtaatgtattggaaaagtacagaaggtgaaactgtatggtaatcgtgcagaacagcccaacggaaaatactacagaatagagtccagaaatagaactgaaggaacatgtaagtaaaaggcagcagtagagcctagggcaatggttgggcattaggttcaaatcccagttttgcctcttcttgctatgggaccataggcaagttgcttacttttattcatttagtcactgattttagagaagggtcttgctctgttgctcagggtggagtgcagtggtgtaattatggctcactgtaaccttgagctcctgggctcaagtgatcctcttgcctcagccttccaaatcagctaagactacaggcatgtgccaccaagctcagctgggctttttgtcttttttgtttgtttgtttgtttgtttgttttttgtagatacggggtttcactacactgcccaggctgcttttgaacttccagcctcaagcgacagtcctgccttgacctcccaaagtgctgggattataggtgtgagccaccatgtctagcccagttgctctgcctttctggaaaacattgttctcctgcatggtagtggggaagaatagtattataataatagtaatgacctcagatggttttgatataattacatgaaataatctataaaaatgctagcataggacttggcatttaggaaatagtcaatacatgctagcatacatacctgcatacatatatgaaattcttattttaagtttgtagaggaaagaagttgttagcacaactagttagctatcttggacaaagtgtgtacatgggagtgatgctgtatgaggatggtcatctccatcattatttataggggtgaaacattattgatccacatgactaagaaaaatgaacataagagacctctatatattgatacaaaaagacaatgttatcttgttgagtaaagaggttagaatgcaacatgtatatagcacaaacttgcaatgtagaactgtgttcataaatctaaatgctttctcttcctgtagtgggttgaatggtgactcctaaaagatacatctgctcagaacctggaattgtgatcttatttggaaataggctctttgctgatgtaattaagttaaggatttcaagatgagatcatcctggagtagggtgggccttaaatccaatgacaagtgtccttataaatggagaagaggaaagacacacagaggagaaggccatgtgaagactgaggcagagactggggtgatgtgtcaatgacacaagggaagccaagggtcactgcagttaccagaagctagaagaaaggcatggaacaaattatccttctgagcctgcagaagaaatcaagcccgcaaacaccttggttttagacctctgacctccagaattgtaagagaataaatctctgctgtttgaagccatagggtttgtgataatgtgttacagccgccacaggaaaaaactgtacttcccaacatcatcaaaccccagtatttatctttgaaaatccactcgttcacctcacagttcagtttctccctacctccaaggaccgactggccttctatttgctgcccctaagttaaatagaagaaattgtttgcaacctggccctatgcataattcatggctgactctggctgtatctgctttgtcagcttttgatctcctggttaaagagataaaggtgttatctgtattagagtaacagtgtccaataataggggattgggtaagtaaattagggtccatcaacttgataaaatattacatagtgactgaataagataatgattaagacaagcaatgtggaaaaaataaggtctttgacataacgctaagtggaagaaagtatgttatcagattgtatctacaatataataacaaccaggacaaaattcttcctagatgtggacaaggacttaaaacaggtggatatgttgggctgtgggactgtgggtgtttcttcttccatttagagtcttagaaatgctattataatggtgtttgtgctatagtaaaaatggaaacaaaaaaggcaccaaagcctacagtttctcacagggtgcatagaagctggagagggagaaaggatgccctatcatctccaagtaaagggccctgtacagaagctctatcaaactttgtcctaatagagaactgggcacctccatttacagtatgaagtcttggatttttgagtaatgattcaaattcatttttgaatgaagctgaaattcctcttggcagattccaggtaaatgcaaacactggataagatacaatggcagacaaaataaccccgcacctcagcccttcctatgacctggctttcttggattttacccaagcagcctcctgccattctcttcccccaaccctatatatatgttgttcttcatggagattcctccctatttcctgaacatgccttgtttcgttgtttccctgcaaacacaaaaagaggctacccctatattccttctcctcttttaagttagaacttaaatatatattttgctgggggagacaaaattcaatcctccaggagagtaatctccctggaatttttagggagaaaataaaaggaaaataacagttagagaaaaataatgaaataaaaaaaaatggacaagctaatatctgttttaaaacttcattcatactttgaagcaaacatttactgtatctagcatgcccaagatgaatgaataatatgaagatgaggaaggcttgacatttatttgtctatttatttattcattttttagagtcaaagtctcactctctcacccaggctggagtacagtgtcatgatcatagctcattgtaacctcaaactcctgggctcaagtgatcttcccacctcagcctcctgaggagttgagatgacaggcatgagccactgcacccagctaatgttttaaaagtttttgtagagaaagggtctctatatgtttcccaggctgctcgacattttttgatcccctacaatgttccagaagttctcacacataagctcattttatcctcagagtgacattcaacaggtatttgtatcccctcattacgcaaataaggaaactgaaatttgtcaagtgagcaattgaagtatgatttgtctggactgaaacatgctgtaagtggaaaatgcacgctgtatttcaaatcttagtataaaaagtataaaatatcttgttcatatttttatattaaattacatggtcaaatgatacaattttggattacatattactaaaactatacattattaaaataattttacctgttttttaattaaatgcagctaatagaaaattttaaattacatatgtgactcacataatgtttctactaaaaggtgccagtctaaaatgacagaactgagaatgatgagtctagcttagactctggctcagggctccaaaactgaccacattatcagccttacttaggtctctgcctccacagcaaggaccatgagttagaaaacaatgtttcagaaataacacataaatagttaacaactacatggaaaaaaatttaatctagccaataatcattaaatgtgtggtttatggctgatatgtgaaagacaataggaagatgaccaatagcttgcactcaaaatcaatgtccaaatcagagcagaacagagagacgcaaattacctggacacaaagatgggttcccaggctctcaggtatgtactgccgctcagatctggagaggggtagggtattcagccaggaccataggggccgggtcatgttatgggaaatccctgctgcagcacataccccagtcttgaccacaggagaggctgtcctggctgtaggacaccctcccccggcggaggaggaagctattaaagatgaatctcctatctcctcttgcctttgagaaagacttcccaaatttcatacaagctgcctcccactataagtaaaacatcagctcccagaggagagagatttgtctgtttggtccatcagcgtatcccaactgcatagaacagttcccagcatataatgagtgttgaagaaacactgaacaaatgaactagcaaatgaatgaatgggttgatttccccccacagggtgctgccaatagtgagacactgtaacagctacaatgagcctggttttctctgtgacgacttttgtgtgtccctctgatgcatgaggcccctgactttcagtgtcagtgttccaactgtacacataggtccatcccacccaatatgtggccaagacagaggttgagcctggctcaccagggctggaataaagttcaagctcagttgcacatgcacacaatttgcacgagcatgagggaaagaggggttcattgctttagcaaagagtgaagagggaggagcttcaaggtgcctacagtaccagggcagcaggggaaggttagattttgggggaaacatgaacagatggcttcctctattttagcatgtctctgctttgaaccacctccttttcttagaactttgcctcacaactctaagactcccctccaggcaatagtactttctggcatgtggtttagatgttaagcactgtggatgctggaacttgaggctggggtaaggcagctttgagtactccttttatccccctcatgccctcttttcttctccctctcctaggatttcctctcctccagccccttccctacctccctggttctggttacttcctcctataatttctgtcctgacagtagaggatcacctgaagaccttctgtacctgtgaagtgaccttatttgaaaataaggtttttgcatctataatcaagttaagatgaggtcattagggtgggccctagaccaatatgactggtgtccttataaagagcagaggagagacactgaagagacgcacacctagcgagaacgccacgtggagacagaagcgagactggagcaatgcagccacaagcccaggatgccaaggattgctcataacagcagaagctgtgaaaaagccacggcacaggttttccccaacagccttcggagggggtggggacctgctgacacctcgattttgatttctgaattccagcctctgagactgtgagagaatgaatgtctgctgtctaaagccacctggtttgtgatgctttcctatggcagccctgggaaaatcatatcgggttgctatgtctgtctgtcatcagttatgacaggtgacttggttaccaacaggcacaatttcaatgagaaaaagtgaaccattatgtaaacacatttatctgagggcctgaatacgactgtccaatgcctataatctctgagtttggggttatcatgaaaaaggaatgctgaactcgttttgactcagataaatgtctgagctccggtgcttattctggccgtgcaccacttcctcaaccccacacaaatgcttctttgctctgattgcaaacaaaatgcatgcttgttagaaaacccggagagagagagagaaaaaacaaacaaatcataaagggaaaataatttgcctcccttctccttacgccaggctaatcactgttgatgttgtgttatgttctcttcctctttcctcattacgctggtctcacaagggattcaactcaccttgctgtccagcacatactcacttggttactgatgtctgagccactgatgtagtcctcacagcccccaccttttgagggggattctggtctgtcttcgtctgtccccagagtgtgaagagcccaataaattgttagtagttaagcaattctgaaaccaacccctaccaacatgggtctaggaccaacccccgccaagacctcacaacatttgggggtgttgcagagaacactgtagtggggtttgggaattgctgcggataagtgaggcagctatggaagaagcccctgtcagtagttgaagcaacccagagtgcacttctgaaccttaggaaaggattaggattggtgacaggggatttcaccactgcctcttttgagtttaaaagctccaaccttgccctaagtcatgcatagctcacccagaggtgaatcatattagcccaggtgtctgttcttggttgatccagaactgcttcttctttatcttttaattctccttggaatcaggtagatcccatataaaccctcaaaaagtaaagtctgattacctcccatctttctgaaaaattagatgcagtctgcacttctcttctcaacgtaatgacatgtggtgtttccagcaagttcctgaccccctaacatacacacacacgcacgcacgcacacacacacacgcatgcacacacacacacacttttttaaaggagttgccaagtgcagcaggttgggtggcggtctccaaaagatacatctatctggaatctgtgaatgtgaccttatttgggaaaagtgtggagaaagggacaacaggcaggagattatcacagtcaggacaagaaaccaggagacgttgacagtcacgactaaggtggtaggagtgaagacagagttgtgggatttcagggacatgtggaggtagcacatgagggtgatgggctgacagggtgtgtgtgtgtgtttgggggaggagagcagacagtgctcatggataagacgagtcaatatcattaaaattgccatactacccaaagcaatttataggttcaatgctatccctattaaaaggccattgacattcctcaagaaactagagaagaatattttaaaatttatatggaaccactaaaaaccctgaatagccaacacaatccagcaaaaagaacaaagctggaggcattgcactatccaacttcaaactataccacagggctatagtaaccaaaacagcatggtactggtacaaaaacagacacagagaccaatggaacagaatagagaacccagatataagaccacacacctacaactacatgatcttcaacaaacctgacaaaaaccaagcaatgtgaaaaggattccctattcaataaatggtgctgggataactgactagccatatgcagaagactgaaactaaaccttttccttacaccatatacaaaaatcaactcaagatggattacagacttaaatgtaaaatccaaaactataaaaaatctggatgacgacctaaccaataccattcaggacataggcatgggccaaaatttcattatgaagatgccaaaagcaattgcaacaaaagcaaaacttgacaaatggaatttaattaaactaaagagcttctacactgcaaaataaactatcaacagactaaaaagacaacctacagaatgggagaaaactttttcaaactatgcatctgacaaaggtctaatatccagcatctataagaaactgaagcaaatttacaagagaaaaaaaacccatacaaaagtgggcaaaaaatatgagcagacacttttcaaaagaagacaacaggcggcaaacaaacatgaaaacatgctcaacatcactgatcgttagagaaatgcaaatcaaaaccaccatgagataccatctgacaccagtcagaatggttactactaaaaagtcaaaaaataaacagatgctagcgaggatgtggagaaaaaggaacacttatatactgctggtggcagtgtaagttaattcagccattgtggaaggcagtgtggtgattcttcaaagacctaaagacagaaataccattcgacccagcaatcccattactgggtatatacccaaagcaatataaaacattctattataaagacacacgcatgtagatgttcattgtagcactattcacaatagccaacagaatcaacctaaatgcccatcaatgataggctggataaagaaaatgtgatacatatacaccatggaatacaatgcagccataaaaaggaatgagatcatgttctttgtaggaacacagatggcggtggaggccattatccttagcaagctaacacagaaacagaaaaccaaataccacatgttctcacttataagtgggagctaaacgatgaaaacacagggacacatagagggacacaacacacactggggcctttcagagggtggaaggtgggaggagggagaggatcaggaaaaataattaatgggtactaggctgaatacctgggggatgaaataatctacacaattagctcccatgaaaaccttcacttgtacccctgaccttaaaagtaaaaaaaaaaaaaaaaaaaaaaaggaagagaaagactaataaaagaatcagaaatgagtcaatttctctgccagggacttttgcatagtatccctttccaccatgtggcaaacttcacagagtccttgttagtctccctgcttataggctaggtatcaggccccagggaatgacacgtcacccagggttagtggcacagttagactgcatttcccttttttatgtgattctttgcccacaacccttctaatacaccctcagtctggccccaactctctcagcctgtggcctcatcctgtgcccaggcccctcactggtctcagccttcttccagctgaagcctctttatttccagcccctttgatcagagcttgggttgatgcaatgcaccactctaggggaagcataaacccagaaaaacatcagggggttgtgctgttgacatcacaatcataattctggaaacttatttgaaggaaataatttaacaagacaggaaaaagcaagttcataaaaatgttcatggaaacctctatgattttccataatggataaatgttagaggctatgtgaatgtcacataaggtagttaaataaatcatgatagtgtcacttgatgggacagaatgtggccattaaaatgctaacaatgtaactatgtatcattttacatgaggaaaaagcatttaaaataataaagatgcaataattacagaaaaatttcatatgtatatagacaggtactaggagaaaaaaatgaaacaaaagtaagattctgagtaactgataatttgttttctgttactacattttataaatataaacaactaactttttaaaacaaatttaaagcttgtgctaaactgtgacttagcccccagtaaatctctatttatttggcatctgctaaaagaaccaaatgctcttgagatgctgatgggaccaaccttaaagcatttaggttttttattttttattttttggcccttaaaacatttttgttcttgtcatgactttggacactcaagttttccaaacctcaaaaaacaaaacctttttgtccccagctgaaatccaatgtcacaggtgcactttctctgtgcaaaaaatactcccaatttactgacagaaacttaaagcccagattgcagctttcaaggttactccaagggcattgttatcctaggacccatatgggtcaggctgtaagtttcctaccagtggattccagagccttgggcagagaacaccagagctggtagtaaacaccttccacctgcctcccactctcaaactgagggatacttgtctgagggggctcgctgtgcctcaaaagccttaaacagcaagcaaaatgagcttccctgtgcctaatttgggaatgatttactcatttacacaagcagctcaagtttggtacaattagctggtgtaattggaagtcactgtctatgaggatggatgcagcagcccccagaccacaccaagtgcagtgaaattacagcaaattgcagtgctcctgggcactgtgaaacagactttgccatagcagccatggcacatctttttgtcagatgagaacacaaatataaaacagtccttagcaacatctttcttcccaagacaagaacgcaagagggaatctaggatgcctttaaggtattatgtagggagatggttccagtaagaatcctgttaaagagagttgcctctctctgacgtatgcgtggaaaaagatggatttaagcaaatagacacggctgacaaaagtgtatggaaaaagaaaacaagaaatgctttttgttttctatatttctttgacattacggaatttactgctcagctaaaataggacaggttgagggggaagaaaggccaattctttctttgtgagttacgtattatgagtaatatgggttctgtattactcaaacatccagtatgcatccactctctgctaggtactcttctagatgtctgggaaacattgatgaacaagacaaaatccttgcctggagcgtgagatgcacacaagcaaacccacacaaagattactataacgcaatgcagtcattgcaatgacaaaaatactccagaatgttacatgaggggggtgcataaaccagttagaggaggtgagatgaagtctctttgaaaagaggtaatgcccattctactcggtgacttataagtttgaatttttaagttccaaatgtaagtgaaatcatgcaatatttgtctttccatacctggcttatttcactcatcataatgtcctccaaactagggggtgaagaaaatggggagatcttggtcaatggatgcaaaggttcagttatgcaagatgaataagttctggggatctaatctacagcatggtgaccatagttgataatattgtattctatacttgaaatttgctaagagagcttattttaagtcctctcaccatgaacaacatcataactatgtgaggagatggatatgttaattagattgattgtggtaatcacttcacaacgtatacatatgttgcacaccctaaacagatacaatttttatttgtcaagtacacttcaataaagctggggtaaaagagaggtaatgactgagatgattgaggcaagcagacattatcccagcaaacagccagtggatgagagagggaggccttgaaggcaaatcagcgttatcaatgtgcaaagaagtacaaaggtaaagaggagcttctggaaggggctgccaataagcagtttggtgctgccagaacatagaggtggaaaaagcagatgatcagaaagcaagctaaagaggtcatgaggagtccaggggtacccaaatgctggattaaagagctgtatggttcgtgaaagttgtctgtgtgtttcatagtgatacggataggagtcagggaaatactgggtagaagagggttccctggcaaaacccccaccctcaagcctggaaacccacagccctaaatgggaacaggcattcctcttttcatgcccaaatgtggccttttggctcaccacactcccctatcctgtacccatataaaacccaaaccccgggctccacaagcagacaaacagaagagaagaagagtaacagaatggcatggcagaggagagaagagaaggagcatccaaacatcaagaggagttcagctggggatgttcagagaggaaaccggctgctggatgaccaaaatccaggggaaggtcatcttcccactccatcccctttccacctccccatccaacctgctgagagccacctccaccatacaataagacccccacatttaccatccttcaagtccatgtgtgaactgattcttcctggacactggacaagaacccaggtactaagaggacactgaattggttaacacttaagccgtctgcagatggcagagctaaaagagcactgtagcatgcccactgaggttttgggagttgcagacacccacccctggatgctgctgtggggccagagcccaaaagtgctagcccgagctcctgcacctgcctgtctgtgagctccccctcccgtaaggggtttgaatgtgcacagtggctgaacggatgagtcacacccctgttgtgtgtcctgcaaggggggtcagggaaccctcttgtttcaataggttggtcagatggctgatgtggagggtggatcttggagaaaggaccaggggaagccagcaggtgatggatgcaggagtcctgagaatttgagatcccaaccagggcaaaggtaggagggcagaggtcagtgcagacagatttgccacagtagctgtcaaacatggtggcacaagagactcctctgggctccatttataaatatttcctggccccacccctgaagtttctgattcagtagcttttagaagaatttggatctgcctgtcttttaagcctccagagctttgaaagctcagtcagatttgaaagccattgatttagaaagtaaaatccatccctcctcttctcccccattcttttctttctgtaacagtctatttggcacctactgcatggcaatactttactgaggttaagaagtaccatgggagttaaagaatacacaaaaagggaaggtctttcatccttttaagtgtttctcaaacttaaaaacttgttagcctgcaaacctgtaaaacttataaaatctgtcttagtttgggctgctataacaaattaccacagactgggtaacttataaacaacagcaatttattgctcacaattgaggttgggaaatccacgatcaaggtgcctgcagattcagtgtctagtgaggttttgttcttcatcgatggcgccttctagctgtgtcttaacgtggcagaaggggtgaacaagctccctccagcatctttcataagagcactaatcccattaataagggcagactcctcccaaacatccaagcattttatcatctcccaaaggtctcacctcttaataccactgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttataatctcccccacccttaagaaggttctttgtaattctccccagccttgagaatgtactttgtgagatccactcctgcccacgagagaacaaccccctttgactgtaattttccattaccttcccaaatcctataaaatggccccacccctatctcccttctctgactctcttttgggactcagccctcctgcacccaggtgaaataaacagccatgttgctcacacaaagcctgtttggtggtctcctcacacggacgcacatgaaaaccactacattgggaattaggttttatcataagaattttggggaaacaccaacattcagactatggccacccccaggcataaatgtgtggacacctcatgccaaagggttccatagattacagttggagaaatgctaccttgaccatactaccacttacagtcactgggttcacccatcaacattgaggttatagaagcagtcatcctggtggcccaggttaggtttcttttcatttttctttttaaataattattaatttgaaagtgagaaacttcatgaactgccatggttcttgtttacagacagccctgtccattttgacatttctgtgcagatgtaagagacgaaattcttttttcaaaattgacttggtatgggaaacttttttccagtaatgaaaaatattagcccaacttgccttttgcaattttcctttgatgttgacacaccagacagtgcctatttgtgtcagagccctcccaaagccatcaggtcaagcatgccactcagcttcacaggaggggaaggatgggctctgaatatgtctactcagttgcaggaatgttcaggttgaatggaatttgcaaatacaatcatgacgatgaagtcacctccattgtgggcatgaaactcaactcatcccatttgttttttcccactcatttccctacacaagccttgttcatccaatactgacagggcacccctcctcaaggatttggcaattcaagcttgggggacaccatgtagactacatggtttccaagccaaggctagatccagacctcagtcaccctcttcattccaaaactgcgcctttactcctccccaccctacatctgcaagcttatggccaccctaatcaagtggattgatcatgattgggaaattcaggttaatttcaccatcatttattgagtgcctttggaaaaggcactgtggctaactagttaagtgggcaagctttgtattcacacttagtaggaatctaggttttgtttagtagtcaggtcatctcaggcaagtaacttccttcttctaaggctcagtattaaatggggatagtgatccttaccttgaagggctgagacaaaatgcatgatgataagcactctcagtgatacatggtaaagataatggggtctccatgggattcgagcaggaaatagacagataattcaagcagagttgactaaaggcactatttacaaccctgtgagccggttgagagaatcggggcagaggtatcgtggaggagtgaactaagtaagcgagagtgggaggggtggaggagggagcaggtcctagaacctgaaaggtcaccttgggaggagctgtgacctttctggaggggagaaagctgcagcagtcaacacccttcccttggtctcctccctctctcctcatcccctgcaaggcgctctttcagatgaacagaaggcaaggcaacacagtgatgtctgagactcaatctcctgtgccagggcacaggcagagaaaggtggagggaagacatgaaggaaggaagggcaggtagcagcaccactgccattcatggatgacctatcctatgccaggaagtctaagaattctgagccaagttgtagacagatgtagaaatccacaatcacagtatgggggaataaattctattataaactaacaagtaggaagccctcatccaggtgccgagggtcaaaatatgccccaaagaacccttgagcagggtgctgaggatgcaagaaaggaggaagagggaaaagatagcaaggggagtgtagtgtggctgtaatgtaaagtctgtgcatttgggagtggggatggaaaagcaggagagggaactgggcaagcccgcaagggctgagtcactcatggaggaaactgttggccaagttaaagaggaggttaggttttatcctcagagctgttgggatttataaggattttaaatggtacagtgtctgtataatctgtattttagcaaaatgattttggtctcttcagggagggaagtgttggtttctctgattctaacccatgagcaaggtccccacggtccacggtccagggtccacggtccacagatataactgggcaaggggaggaatttcacagcagggtgaggaaatcctgacgtagcaagagcatggttcagggaaagactggttccaaaactgaggctccagtaaatgttcctggcatgatggaaaatgcttggcctgcagacaactcagtactgtacgtgctgaacttcaacgtgcacagtgacaacctggggatcttgtaacagtgcagaccctgactcagaagacctggggtggggacagagatagcactttcctaaaaagctcccaggggatgctgataacagaagaacacagagaggttcagcttgagaggcccaactgcttcaacctcttcttctgcaggtaggctaacagaggctgtggaagggcatggctggtgatgtatcataaagttggtggcaggaactgtagaaacctggctgcgagtccttcaattcagagttcccatggggcttccaggaccctctgggagatgactggggaccaggcaatctacttgctattgaagggcaaaggggaaagggagtgaacaggaattgatgaggcaagagtgtctccagcaagtccttggagagtgcaaatggatctgccaacatgcatgatacgcttttcacacatcagcctgctctgagagtatcatgaaagctgacataaatctctggtgggctgccaaaggccttcttcccagacatgatgactggcataaaaactcaacacaatacttaaaacacacactcacacaggtgagatctatgtgcagtgcaatttggcaatatgtagcaagagttacaaaagtattcattccattcaacccagtaatttcatgttcgtgtgtgcggtgggggtgggagtgtctaatacacaaatactctaaacagaggaggaagaaaacgaactttgacattgaatggatactggacagctaggactacaatacattttgaattcttataatattcctgaattgtaggcttaatattgcttctcctacacacaattttattaaaccaataagatcattcaatttcagaggttaatttgcccaaaagtcagccacctaggcaacgttagatctaggatttgaatccaggtcaaccagatctgaaggtcatgttctttccaccatgatgcaatgccaccataaacatgaagtttatcatagtgttatcaaatatataaaaaataaagggatggataagaaaattacggtatatacactaatggacaattatgccatcattaaaaaagatgaactatttccatggttctataaaggcatcatgattgtgattaaacagttaatgaaaaattacaatagcaaattttatgtaattatagttaggtaaaagatgtgtgcatattaacaaagataaaatacaaggcaaaattagcactgtggtagaagagattataggtgatctttttctctgatatccaaacattctataatattgttataaaaattggccaagaaaggctaagataacagaatgcatttgttggtggggagagcagagagcctattgtacatacaagatccttaacgggatttcctacaaaatcttgagacctctgcacctggccttatcttcctgtggttctgcccttcagtcatgaagactctctagatgacttgctctaacatagactctctcacctctggcatcattttcaggaaggcttctatagctctggtctctttatccaagtggtaacacaggtaagcatcatcaaaaagaactgcctctcacaacagcagatagaacatttatacagtaggtgggaacggacacacagggcctttaggcattgcaactgacagcatggctgctgctgggagtgaagggctagtcttcaggggcatggctcataggatgaggagagagtagaactaactctatcttgttaagagacaaaacagctatgagagaagggagacgcccaagccatcctcagttcccaccttccccatgtcttcctagataatcgcagtctaagcctcacttaggacttgatacccaggagcctatggcaccagtctgcctaacatagcccttcctgggaggctgctgaatcaaacctgcttgcaagagtcttgacacattctctgcacctccacacacaggctagggtcttgctgtcactaggctgatcctcagagacctgagaccactgcttgttttcacttccaatatctttggtacttttgtaaactaaacgtaaaatcctaagctcccaaccaactgaacggacgccttcttggccaaggggaccccagagaaacctgaaaaccggaattcttggccatgggggaaaggaaatcacacgttactacattccctcccttttggattttaggcacaattgaccagcattaattttaaaacagactctttgtggcaatacaaaaccaaattatgaacaaggcctaaagtcatgcaaagcaagggttaagtcacagctgcaggccatcaatccagctacatagcatctttatcttaactgaaaacattcctttctgctgattccaagttttagacagagccttactcctttaaccaattacaaatttaaaaatctctgaatccacctataacatataagccctcacttcaggatatctcgtcatttggggccaaactaatatataccttccatgcactgatttatgtctttgcctgtaaatcttgccaccctaaaactataatccgactatcttgggcacactttctcaggatctcttgagactgttttcccaggccatgatcactcatactggctcagaataaacctttttaaaagattttgcaaagtttggcttttctgttaacacttttgactcaccatgttgagttcagtcatgagatgggtgggactctgacacggacatgtctggactttgctttaatctactggcaaatggaaacccagctgccgatgggggatacagtgtgtgggaagtttccccagaacctcacaccatctgctttatcttcttgttggcccataatgctgacgtccctgcagatactgcaacacagtccactaggattacaactgttgtgaaaaggattggaaactgcaacatgcttatactgcagaaaaaaaaagaaatccagaaattacctaattaccataaagacagattctgtaggatgaaccaatgagtgagggcagagcttcacctatccccctatcaaccttctgagaagaggccagagacagcaggcagggtataccttgcaggctaaccccattctgttggaaatgaccagctgcagtgctgtgccatgatgaaagggattctgaggccatgttggagtgcagtggaagagcatgccctgattgattattgatgtccatcatgggaatggtattagggaggagtcagggcacacacttgccctatattcatctccctctgctaggaaataagcaaactgaaattcaagttttaaaacaaggaggaaaacaggaccaccacttctaacctcgagtttatggatcccatccaaatgtgtatgtattgtttgactctcctccattagatccatgtctactgaacatagtgagctattatttagaccacagttctacaatcaatggaacgcatgtgaatgccactgcctgctactgaaaaatctattgagagggaaaaggaaagcagaaattcaaactctcctaaccagctgcttaaaaagatccagttcactcttatcatacccccaaaattatatctaacattctagtaagatcaatcaacacatcccgaataaagtgatttgaaagtaaatacggtccatatgttcagggaatggagagccattaaatggaataaatagattacacagaaatgagaatatgttgggcatagtgaaaattaaaaaaaaaaagtcaccataaccacgtcaaagctgttgcaaatgcacaagaactagaaagaaaataaacccacatgaagatggctagtgtgttatttccactccctatttttctaacactatatactattgttatattgtcactaacatttaatgaaaactaaattattttaaaaatcaagccatcatagcgatgtcgatatttgaatatctcttacgcctgttgccttaaccttgactcaagtttggaatgcatttttatttattaaacaaatatttattgaaccctattttgtgccaggatctgttctaggcaccggggatatacctgtgaatacagatctttaaccttaacaagtttatactttagcaaattaattctatgagttaagtataaactcactggtcactggaacctcatatagtctattagagattattataagacttgggacataatcttatgattttggatggtcctataaggtcatatatatggactaatggatgctaagagatacttctgttactctacctacgccttcaaagggatctcatcttcataagaaaagcccatcccatcttcataagaaaaaaaaaaaaaaagaggccaggcaccgcggctcatgcctgtaatcccagcactttgggaggctgaggcatgtggatcacttgaggtcaggagtccgagatcagcctggccaacaaggtgaaaccccgtctctattaaaaattaaaaaaaaaatagccaagcatggtggcatgtgcatgtaattccagctactcaggaggctgaggcataagaatctcttgaacctaggatgtggaggttgcagtaagttgagattgcatcactgcactctagcctgggtgacagagtgagaatccatctcaaaggaaaaaacaaaaaacaaaaaacaaaaacaacaaaaaaaagagaaaattttaaaaagaaaagaaaacaaaaagaaaagaaaaaaagcaccaccaaatttgagaccctattgtgttccaggtactaggtaaggtactgagttctttccagagatgagctatgtatatatataggagtgtgtgtgtgtgtatttatatgcacatacttgcttgtacatgtgtatccctatattgtgagtccctttgtttataaatgtgtgtatcccttggcacttacaatataaggctagacatttataaagaaataaaaaataattgtgaactgtggtccatgttatccaaaaatgggaagcaatggtagagacagtggtgagtgggcaaagccctacctgaaggctattaggcagggcccttctgaggtggtagcattcacatcaatacctgtagtaggagaatgagttggccatggaagaggaagtgaaagagctttctggcaataggaactctgcgtgcaataagcctgagacaggggcccctagcatgctagagcacagtaaaagaaggccagtgagaccagagggaaaaagagaatgggaggtgcaagtctttcagacctaaggtagcagtttggattttatgtgaaatgcaatagctctaaaattaaggtaataaaactatgagagatattaaagaaaacctaaataaatatacagagattgaatatcataaaatgtcaattacccacatattgttctatacattcaaggcaattctaataaaaacaacagatgttttcattaaacttgataagtagatactaaaatgaaagagccaagggcaagaataaccaagatattgctgaacaagtatgaggaggaggaatcttctctaccagagatcaggacactgtgaagctgtaataaatatgactatgcatggttacagtgcatggaggccagtggaatagagagctcagaaaaaaattcatgcatataagaaattttggcataagtcagatatggcctggtagagcagggaaggagagactgtaaaaaggacttggataaagtgtttatcaatgtaataaaaaaataaaattttcactccatctctcaccctatgcaaaaattaattgcagatagatcaaaaacttaaatttcaggagcaaaactatgcaacttttagcagaaatataggcaatcatctttctcaccttggtttagggaagaatttcttaaggacacaaaatgtgttaactatataaacaaagtgataaaattggctataattaaggacttttgtttttcaaagataccttagaagaagtaaaaacagcaaattacatttgtaactggcaaaatattatcaaaagtatattataaaactattacatatcaataaagaaaagagcatataacccagtagaaaagtaggcaaaagacatgaacagatatcccacagaaaatgaaatacaatattctacctcattaataatagagggaatacaaagcaagacaacaagataccattttatatctatttagtcaaaatgaagaatcttgacaacaccaaatgttggagagggtttgaaatcataggcactcataatttgctggcatgagtgtaaattagtgcaaccagtttgggaaagagtttggagtatttttgtaaaacttaacattcatttaccatctgacctagtttctagatagaaattcaggagaaaatcttgcacatatacaggagaaggtaggcacaaggatgctcatttcatcactgctgataaaggcaacattctgaaagcaaccccaatgtttatgaaaggatcatgagtgaaagttttgtagtatcttcgtgcagtggagtagtagacagcagtcaagatgaatggactacagctgcactcatccgtggggatgaacatttgcaatacaatatggaataaaaacgtcccaaaagcttatacacaacttaaaatcctttattaaaagttaaaacactaaaaaacaatatgcttataaggaattcacacaagtagcaaaactatataaaatatacaggaattatatacaagatttagaagagtggaggggtcaggaagatgggatggggagacgtaagtgagtagaaacagatgtgcttatgtagatcataagtaaatgttaggtgttgtcagcattctggttgtcttttagttggtgtgttactgaaaaattaatgagtaaataaaaagaaaagagacccatgcacagaccaatacagaaacagtttcatgaaactaggagtgagattaatctcattttgggcacccaagtgatagttcatagcagaaagagctttttgaatctccctggtccaagcctcctaagccacaaatgtggaaactgaggcccaggttgggaaagaagccaactagttcaagtacactctgcaatgactaaccaaaggtcaatcttaaatttactgtttgcacaacccactatttgacgtgcagcgatacacacgttaaaaacgtgcataaaataaaacagaacaagaaagcagtgaattttctttatgccatcttgaaggaccctggagacatggtatgtatgtatgtatgtacgtatgtatgtatgtattgaaaccataatgaggtagaccaagatctcatacttgggtgtcagttttaaggaattacttttctcttggtaaagagtaagaaaaagcagtcaaaagaaaaaatgcccattgacttaaggtgaggggagaaaaaccacctgctagctcccgagctaatgaaaagacaagcaacaaatcacagattggaattccagcctccagagacttcagaacagaggctccaaatgtcctgatgatagatgaaaatatgcaaacatttttcattttgttctgaccaaaacagaagcgaaagagccagttaaaagcagcaaattcatgctgcattgcccagcctaggcggaattccaacaggggtaacacggtaaaacatccgagatgaaaagagaacaacttgtgatgtttaaagagacacttcacaacttaagtgctgcctctgggcacagtttattgaaaggaccacagcagccagggagaaagttccatctctagccatgtggccatgtgcacagaaggacaccctacaaaggcctctgggtgcacacgcagtgcagcaaaatgcagtttccctcccagataagaaacatgaagaaagcccacgccctgacaaatgcagaactcactcttcatttccttcccttctctctcctaggacaactgtagatgcataggattcaatttaaccgggagacttttgttttaatccaacatttttctttagcaaaactctggagacaaattatggcagacgttcatgttaaacagctgggagcccactgaaatgaaagaaagtttctcccctggtgttaccatggcacggatatgaggtgatcacaggcccccctagtttaggagaaaacagacatagccctgtgtctctgatatctctgtcagttaactctccaatgaaatagaacaatcctaaggatgaagctggaaaaatggatacatcaaaggatgaaagcttcacacagacatgccaccaaacatacaattatatgagtgtatacatgtgacagtgtagaactacataaactcacaaaaacatatgctcatacacacaccccaagacaagcatacttattcacatgtgcgcagtgcaggaatatttttcatgcagcaacctttattgttttccacagctgaactgaatgattaatgtttactgtgaaaacctcactggcaggacaacatggtttgctatccttaggtaacaagtgctacacatctgttgatttccactgtcaagttacctggctccatcacaaatacctgtgtcgtaatagaaaagaagaaacaccccaaggcaaatacagaggcaatcctaatataccacaagtggatgaccagcagctctaatgcgaccaggtacataaatgcaagtcactcacatcagaatgcaacttcttttccttccagactctgagtgccagaaatcattcttttcaaccagagctgttgctactgaaacacctgtcagcttccctgtcagcccgaatgacctgtatatggcatctaaccagggatgcctgcatttttcaagtttctggaggggaaacatcttatggaggttgaatgatgagctgtggactagaacaaatggctcctagacatcccagggccctgacttttaagatttagggaaggcctctgggcaaatctattgttttgtgtgtgcacatgtcttttttaatctcacaaaaaaaaccacaacaggactgacttccactattcaggagagggaaaaagatttgcaagggaaggtctgtggtgggctctggcatcagagttgcaagatgccattagtaacatgcaaagggatattgacagaacgatacctccctatgtttcttcaattactccacacactgtttagcaaccttgagggaaaaaagaccaatgtttcttgaatttaatccttaaaaaaattaacacttagcaactgcctgtgtatgagtgagttggctgtagcgtaacatcagatagaggtggagtctggcagagtgagagtgaagataggttaagccaggatcaagactgggtttatttagaaggtgtttagctaggattacatatcagaggagaccgactggattcaattcatgcaatgcttcttcccaaccctggatgtttttaagaaattctcaaggaacttaaaaacaacaaacaaatacagcatatggatagcgccccctcccctagagattctgatttatttggaccgcaataaggcccatccatccatccctgcattcattcaggtaactagacgcctatttatttatctatacattgtttcaagctctcaaggtaggattttttgtttatttttgttttgtttttgagacagtctcgctctgttgccaggctggagtgcagtggcatgatctcaactcactgcaacctctgactcctgagttcaagcgattctcctgcctcagcctcccaagtagctgggactacaggcatgcgccaccacaagcagctaatttttgtatttttagtagagacagggcttcaccatcttggccaggacggtctcaatctcttgacctcatgattcacccacctcggcctcccacagtgctgggattacaggtgtgagccaccacaccaggccaaactagactttattttttcagatcagttttagcttcacagcaaaattgagcagaaggtatctcaaggtgtgattctaatcttcagccaagcttgagaacagctaaattagttagacaaaaataatcatcattgccccttgctaggatagagcacaaatccatacatttatccaaagaatatttattgagtacatactatgtgaaagctactattttaggtcctcaggacacactgaaaggcaaaaataaatatagcatatattagttgtttctttctttttttttttttttagacagagtctcgctctgttgcccaggctggagtgaagtggcacaatcttggctcactgcaagatccgcctcccaggttcacgccattctcctgcctcagcctcccgagtagctgggactacaggtgcccgccaccacacccagctaattttttgtacttttagtagagacggggtttcaccgtgttagccaggatggtctcgatctcctgacctcatgatccgcccgccttggcctcccaaagtgctgggattacaggcgtgagccaccatgcccggcctgtattagttatgtcaagaccaaatgctgtcaggctagagaactggggaaagctgatgttgcagttccagtctgaaaggcatcggctggggaattccctcttactcaggagagctcagtcttctgatctattcagaccttcagctgatgggatgaagcccatcatatgggatgaagctcccctatgttatggggagcaatctgctttactcgaagtccgcccatgtaaatgtcaatctcatccaaaaacaccttcacaaaatcatccaaactatggtttgaccaccaatctgtcaaaccgtggtccagccaagttgacacataaaattcaccaatacaggacccataccctcacgagggttcaagtctgttgcgggcctgggtgatacaaaagtacacaaatgaaacaagtgcagattgtggaaatggtatgaaggaaagcaagttgttaagagaggaaacagaggggaacctgttttagatcaagtggacagtggagggaaaaagcctcttggaggtgaagaagaggaaggagccagccctgacgagtgtagagtgaagagcattacaggcagaaggaatgacacagagtggcgagggctgccaggaactgggtgagcttgggaaatgccaggaggctaaagctggactgcagtaagcaatgggaagaggagcggcaggtgaagatagagaggcagccagtgccagatccttcagtgcctcgaagttaagatgaagccaaagcagacgaggaacaggatcagatttacctcttaagatgttctgtctggctgcagtgtggacatatggaacaggtgaagtgtggaagggggtgggcagggaggaactgaaatgctccaagcatctgaggggtgctcagaacaggatgtggcagcagagatggtgccatgcggcctgacctgtgtctattttggcaagagaaataatcaaactttctggcggattagctgtgtggctgctgggggcaacggatgacgctctcatttctggcttgaacaatttagaggaaacaagagcttttttccttgttaccagcctggctcgagttatactcaatagcggcctgcattatgcaaatcatgtgtcctaattaacgtagatccagtttgaattatgcaaatttttgctttgggctgtattagtcacaatccagctgatttcctcctgcctagactacctcctgcccatctggaacacatcccattctccacactgctcctctgtggaccagagtcatgagccagtctggggtcagtgagccctgagtggtcagtgcagcaaagctgagggatgggaggaggcatgctcatccatccagacagagccaggaaccttctctgggcctctgtcttaaagagtttcctcgtgagcttatccacccagctggtcccctctctccatcaatgtctgtgttcaggctttcgttctgttcagaactcctgtctcggaagacgctccagcctccttgtaatgcactctgatggcttgttgattcctggggcccgtgctttttgttcagattgaatccaaccatctgtgtgctgaaaaaaatattgacaaaccctctgacctattgtaccttttaaaggcgctcccatacaggaatgccgccttgttttattgaagcgaagtctgttttatttaactctgaatgccaggcacctagaatagcttgtgagataaatgccaatcaactctagcataatcaagacacccattcctgcctcattagggtcttctcattccctttaagcttctcagatttatacactgtaattagaaacttggtgattttgactgctaaacagaaaggcttactgggaggcttcatatgtctgaattttaaatattttcacacttcgttaacccagttgcaagtgtaacatcttctggcccaattccctcacactgtgtgatttttatttttggacgaagacgagaacaattaattgaattgaaacacatattgattactgttttccatgaactctgaacagcttgtctctgaatgattttattgaagggtttttagacaactgtttggttggattgcttcccttggtgacctcattctggctataagtgcctgtccgcaattgcgacggtctgtgttcttggtgagttgtggttgttcccaagagctgagtcagaatgagagaggccacaccacccttctgcacatccacaccctgattagggaaccctgatgccttaatcaaacccaaaagcagggttctggaagagtctatgcagatgtcatgatttccatattcctgatgtaaatattgtttagacgtcaggtgagcaggaatattccttactgcattaaatgatcacgttattcatgcaatgactgcaatgttttcatcaggcagagctttccagaccagttgatattcccttaccacctctaccaccctcttgtgctgatcacaattgtgagatttgagaatgtttcttaaaccagtgctttttatgctttaatgtacacatgaattatctggggatcttgttaagaagactgtgattcagtgggtccaggctggggcctgcgattctgcatctctaacatgcctgcaagtgatgttaatgatgctagtttgtggacacaaggccgttggtgctgcctctatctgtgcatgatctgtcactctgttaggggaatgatcatagaattgcattctgcatctcccactaaagtgcaaatccccaaagatctgaggccatggtctaattcatcttaatacttcctgttgcagctcagatgaggccggaaccagtgggctctgacgaggattctgagctcccctttcagtgggcagagagagagtttgaggctgctgcagaatgagacggtttcatagccctggagtggtaatagggtcagggtgagacacccatctttcagggaaggtgggcccaggatctaaaggtccatggctccagggtgctcatcaagataataactcattactaaaaagagggtgtcaaagctgggctagcagcagtaaagaggcagctgtaacaacactttcacatcttctgctcaggtataaggtcttttaataaatagttcatcttaatatcatagatgatggaaatgtccttgcctcctggtgcattttccagatgtttccaggatgcttgtgtgcccaccatctcttatccacacaacagctggatgaccttttaagaatataaattggatcccttcattcctctgtgtagaaccctcctagggctttccattcctttcaggataaaatgcaagttctaggagtcctgccatccctggccctacccaccctttcccccacacagtctcatcactgtcctctgtgctcaggaggccccagtcactccggtctcctttttactacatttttaagacttgcctaagtcatttccacctcagggcctttgcactcactgtttttattcatatgtcttcatcttcactactttaccttcagagactttggctggcttataggcaagaattaaacaactccaaaaagaggtagaatttttgatttcatgggtttgacatagatttactttccccttcattcttacccagttgaagccaagaacagtctgacaccttcatattagaaacagaggactgaagactggagacagaatgggacttaaagccactcacattttggggggcagaattgtctgaggatggactcagaggctgtgacttggacttgtgcagaaggaaatttaatctgaaccacttggacctgctgtatttaacaataacatagttatagtaatgaaacttccctccttcccctcccttattttttctttgcttgtaactttgctgaggccaaggttgtatatagaaggccacagacaatcctgaatttctcttccatttgcattatcctatttttctttgtaataaaatattctattttgaggccaaaagagggtaatttgtaatttatgaatttctctcttgaaattacaactagaacctaattttaaaaatcaaattggtttcatctaattaaatttgtaaattgcctcataaacacatgctttgttataaatgtttttaaaagcaaggtctcttgcttactgtctggggctggattgggttgagcccagagtaacagttacttctcatctctctactcaagagaacatactctcaattgccaaaagtttctcaagagtagtattttccagaacagtgcttctgaaaccgtaatacccataggaatcacccaaggatcttgttaaactggagaggcctgagctgctacatttctaactagctcccaggtcatgctaatgccgctggtctatggaccacgctaagttgcagaaaggggcaagacatctgtacctgcatttaggagtcctgggtttggcatctgggtaatatgaacttggtcttttcattttaaccctctgcactcaatttcctcatttttatgtaatgataacagctaacatttataatgttatttctaaatgccaaacactgtacaaaacctaatttaatcagatcttcagagtaatcctataaggccattttattattaccttgatttttctgataaaagacttaaggttctgagaggccacttgatgtactcaaggtcacagagcaagtaaatgtcagagctgggattcagatctaggctatataggctcaaatgtcaccatccttattttcttaggcctcactagcttttgatacacaagattacactcatgtttatgctcacaatacaatggcctaaatctacaacctccttagctgtctttacagcatccctcaataattttggcatattccgcaaaagtagcctcaaatgcttacaaacaactcaaccagttacaatactctggttccggttctctgcaaattatagcccaagtcacagcgaagaagctacctgaagatgtctttcatcatagttgtctcccatagaatccatgggaatgccaacatccctggcatctggtctctgaaaatccacaaggcatcagattcacacagaagtgagaaggacaacctgctctaatctgtacccacctttgtgcatggggcttcagagagtgcactatataataatgcctcaattgcaggaggttctactcaaacacagagtctaactcacagttgtgtttagacccttgctctccctctgtttctttcttcttgtcatggaattttaatcatgatatttctcatccagtctaatgcatcattctactagaggaaaaagtgtattactctcaaggatccaatctaatgcatcatcctactagaggaaaaagtatattactctcaaggaataatatgtgcagagatatgactccacctgcaacatagccctacagtagtagtttccaaatgcaggtatgtacaaggaccagggcttttccatgacaaagttgccatcaatccagtgcaaaattagaaaaaataatgtgactgtcatgagttagtaaaaaatcataaatttattcaatttgaaggatggacttttattctgaaattatatcctttctatatttttggaattatgtcttttataaaacgatgtaaataaaagatgttgaagtaccctaggttagtcccccaagcctttttaaatgctactggcctgtgaattccaaaagtcttgaacatctggcacacagcgtcttttacataacagtatcaagtaacttaacttcctaaatcatgggtcctttccttctgctttacaaagaaaagtttgccaggcacaacacatctttatttcatgtaaatgtgtgtgtgtgtgtgtgtgtgtgtgtgtgtgtgtgtgtgtgagagagagagagagattgtggtttctgctttacaaagaacatgtagatttgaagtgactggattttgtttcagttaaattttcgaacctctctttcccaaagaagttttgaaaatgtgctaggcaaggtgtattagtatgagtacctgccctcctctcggggtactccccaggaagaaagcttctcccaagcgtgtggcctgagaaaactcataagtgatggggatggatgtctgtttcctccttccatctggtaatcctgagagctgcgccaagctccctgcaacttctaagagggagatgttagctctcctgaggaatgctagttttagtgagataaggtgttttcttaagcaccttgtacatgttggataatcttctccctcagagagttctcaggaccacctgtgactctctagagaggttatcggtctgttagattaatcttgagtacttttccttcatcaaatactccttgactttcctccccagagctcacctttccttatggcagcaatattcttcccccaagcccactccctatacatgcatgtttctgcatgagctctcagtgacttaagcctcttcgtgggcctgtggtacatgtttcagtctgggatgcttgtgtctttccccctcgtcagattccctagagaaaccctgaagaagtgattaccacctttattttacaggtgagaaaaatgaggcttaaagagaggaggaatctaccaaaggtaactcaggaaaaggtggagctactaggacactaggctacatcattccagcttcggtatccatgcccttccctctgcattcctgtgtgtttccacttgatctagtattgtaatcttatgttgtgtaagaatacaaggggtgggaggagactcaaccttactcgtattgcaatacttgaatcttagctatatcagctctgttggagatttttttgttttgttttgcaataaactttcatacagtttgtcttatttttgcaacttttctggaaggcacattgtgttggcttgatgggtacattcctgcttgagtaggttctggttcatctctgatatggtaaggcccagctaatgcttggaatgggggctttggatgccatcacctgggtgacaaaatatgccttgggcacagagcaatttaaatctgaagaatcctgtgtccctggtgcagagaataacattgggattcttttcaaagcaaagagactgatattcgtaaagtgagcatcatgtgggtattgcagtttcccagacgaactttcagtactgtttgccaggcctgggccttctcttccacataagaacaatctgactccctgggttttggctcttttgtggatgaggtcagttgtcaccatagtcacttcaatgcatgatgtgtacaaatttctttgttcttggggctaccaggacagctccactgtgtgccattatgtttgcaccccattgtactgtcagaaaccttttggtatgtctcatcttactcacctttatacgttcagcagaatgggtattcaccaatgtcaggctgaagtgacttgaataaagctaagccaatggatgcagcacaagggacctccttacctcgtagagcgtgatgaccccattggtctcattgggaggtttccactggatgtagatcttctcctcaaagggccccccttggatggattctagaggaacagctcctggaactacagaatggaaaagttatgaacttgatgtcaccttccacatcatttctccagccccgctgacctagaacaggggttgacaaagttgctgtaaagaaccagatagtaaatattttaggtctgatgggctgtacgttctctgttacaactactcaactctgtcattttagcacaaaaatgactatagataatccataaatgaatgagtacggtggcgttccaataaaactttatttatgaaaacaggcaatgggctggatttgacccacaggccatagtttgctaacccattttcagaaggctgatcaggcttttcatctgcagactgagcaagtcggtttatgaactgaaccggataagggcagaaaggacatgagcagtttccagttctgccagaggtgggaatctgaaatgaggtgtttgcttcaggggtgtctaatcttttggcttccctgggccacattggaagaagaattattattgtaggccacacataaaatacactaacacgaacgatagttcatgagctaaaaaaaaaaaattacaaaaaaaaaatctcataacgttgtaagaaagtttatgaatttgtattgggccacattcaaagccatcctgggctgcatgcagcccaggggctgctggttggacaagcttgttttaggatttgtatttgagaaatgcaaagtgagcttcccatcatcttaccaagtatcattttcttcactctgccaagttttctctaactttaggagtgcttcatcagtttcttgactaattcctgaatccaacatgaactatgtggcttgaaaccccaatccaattagaagaagctcgccttgctccaagaaggcagctagcttgacttgttgttgagtcccaatgcctggcatgaagtagatgcataataactatttgttggttggatgaataggtgaatgaatgacctacgccagcattttgaactaataagtgcaacctttcctggggctccttctataagccggtcagtcttcctgccagcatcctcctgctggatttcactattcttacaacagtctggaagacggtgagccagaaaacaaattattccccaaactttctgctgtaaccccttagaaataatgaatttcagtaaattgttgccaaatctatttatattttggtattataaaagcacttactcttggactagaattttacctacattatttcacttaagccataaaacacctctgcccagtaggtattatctcctttgcgtcgataagagaactgaggctgagaaaatggaataacttgctgaaggtcatatggctcttaagttgtaaagagggaactaaacacctgtctgtgagttttaaagcatatactcttaatcatcacgctacgcctctctacatatagccttggccatatgttgcaatcagttcccctttgttaaattaaaatatgtttagttttgctcattatggacatgctatacagaatttgttgaatattaagaatatataaaaaggttaaaaaaggaaaagaacaaaattactcataattcacatgttcaaatattattttccaatctttttatgcatataaaattttattaaaaaaagatatgcctatgcatatatatattttttatttttaaaaaaatgttaactcctactgtgcatatttcattgtgaccttattttatcactaaagaaattgcaggcttctctggggccatacatttctctggggccatgcattttaatggctgcttagagggggcgttgcccctttatagtcactaatcctttattattgggcattaaagttggtttgaattcttcatgattttgagcaatgctggaatgagcatgcttataggtaagtatgcatgcaactctgcagatagaccttaagattaatgctttggaaattaatttactgggccaaagtaaatgaactattttatttttaaggcttttgacatatattaccagattgcctttcagaaagtttgtaccattctggactccccaacagaagactatgtctgttcttgccaacactgactatttaaaaaattaagtgcatgtgtatgtgtgtcttttttagaatactggagagtacagattttgttttcagcctaattagccattcacattgcttcttttatgaacaaattatctataccttgtgctcattttcctgtatggctcttcatttttgctcatctttgtcttatgggctcgtcattgtaatttcattttaaggacgtaagctttcttgcataggttgcaaatatattttcgccagtttttttgttggcttttgaaatcacttaggtatgcagaagcttttaattagtcaggtatcctattgctttcccttatccacccttcctttccagaaatatttattatgtatttaatatgatgaagggacagcgatggacactagagatataccaataacaaagagagatgtagtcaaatccatggtaaagcttgtattctggaaagagagacagacattaagcgattatactcaaaactaattcattacatttttttaatcaggactctgacataaagggatatggtactaggagaattattaaaagcagagaacaacctagaatggcaagttaggatattaaatggcacataagttagagttgcttgataagtagaagttatcagggcaaaatggggaggaggtgctgtagtgtggtggacagctttgtgaggttgagggtggaaggagaaaaatcagttaggaggctgtcattgtcatcctcgggagaaagaattgtaacgtggactggaatgatggtagtgtagaagtgaaatagattgtacagatgtggactcagaggatggcaacatggaagatcaatgacttggtggtgatagataagggtgaaggagggaagggatgtgtcatggagaactgcaacccttttgttttacacaactgggggatcaaaatgttgtttatagagagggagccttaaaggatgaccaattttggagaggaagctggtgagctcagtttttgtcatactttatttcaggtatacatagaacatccaagtggcaatgctgagtagcagttggatatgggaagactggggccaatgtttggaaatggaaaccgtaggcagggaatagatggcaagagtatagagcagagaaaaaaaaataggtctaagactaagtgaagaagaactccagaattaacaattaggaggaaaatgaatggagaaactgggagtcagtgttcagagaggcaaccagaaaaccaggaaggtaagccgtcattgtagcatccaaagaaggaaagaggctcaagaaggtactggtcagcagtcacaaatatggctgagtagtcgagtaagatgtggctttaaacttgcccattgaacctactgtcctcaaggtgactcgtgagccaagcaagagtaatttaagggagaatgttggcatcacaagccatcctgaagagggttgagaagagaggggaaggtgaggtgaggcaagtaaacaatgctggctgtgaaaaggaggggaattcaaaccataacaagaatgagatatggagccaaaataatgactctcttaaagacaagagaggttatgattaaagcaactaagaaaaagattcaaaatagaggctgggcttggtggcccacgcctataatcccagcactttgagaggccaaggcgggcagatcacgagatcaagagattgagaccatcctggccaacatggtgaaaccctgtctttactaaaaatacaaaaattagctgggtatggtggcgcgcacctgtagttccagctactcgagaggctgaggcaggagaattgcttgaacccaggaggtggaggttgcagtgagccgagaccatgccactgcaccccagcctagtgacagactgagactccatctcaaaaaaaaaaaaaattcagaatagaggtaagaagaagagtgagaaagaaagaggagataacttacaatggtagggtcctgaaagcaagagcaagggtgggttgaaagaagggttctctccttttgtgagagaagaggagaggatggaaatgtgctaatgctttgtacggaggaattgaagtgtcctaatggctctgttttcttgagaagtggggtgaagccatctaccaaaagtgtagtgggggacgaattacatcaagaatttggaaagacaggagaagctttaatcacagagtagaaggcaagcagaatagagagatgaaaattctattcattcatttgagggtctatctgacggaaattgaggagggtgtgtctgatggacaataagaagtgtctgtctgatgaagactgtgagcatgaaactcaagctaatagatcttggtctttccaatctggggaaaattctctttctcacaccagatcagatgaatggaaagtacagatgaatagttgttctataatttatttattttctgttttattcccatctttttctttttacaccttacacgttaatatttctgaaattactgtgtataccatacatggtagaaatctataattccttacaattttctcaattgtaaaggacaattaattgaccagtcaaaacttgccccagtgatttcaaatgccatcttactaccatattaaattattttatattctagtgtatgttgtttggctttctgttctatttcactaagttgtagcttttactgtgacagtatttctctatcgcattaaaatgacatgttttgatacttggtagaacaagtcttattcttcttttgcaaagctttttgaggtatcactacccatgtattcttccagaagaatttaggaagagttttataaaatttcaaacatatttcatcacaatttttactgcagttgcattttttttctcttttttgggaagcagagagtatcacttttaaagtgagtccttttatccagtaaactgtataaatcttcatgtattaatgcttctttttatgcccctcagttaaaaatgtttttcttttatttcttacaaattgcatttctaggactttattattgttcatattgtttttgtattgtattaaaaagtttcttttatagtgttttgcaatatattaaaaagtatacataataatgtatgaatagttcaaagaataattattaaatacacatgtgcccactatctgctctaagaaataaaacattactatactattgaagcactgtttatgcccatcactattgtctcctttttctttctccatcgttaaataaataaataaataaaataggtactacaggtactatcctgattttccttttttttctttttcttttctttttttttttttaagacagagtttcactcttgtcacccagactggagggcaacagcgtgatcttggctcaatgcaacctccgcctcctaggttcaagtgattctcctgtctcagcctcccaagtagctgggattacaggcacccatgaccacgcccggctaatttttttttttttttgagacccggctaatttttgtattttcagaagagatggggtttcactatgttggccaggctggtcttgaactcttgacctcaggtgatacacctgtgttggcctcctaaagtgctgggattataggtgtgagccactgcgctcagcctgaatttactcttaatcattctcttcatttttattcggagttctaaatatatacatatatcccaagacaatatatcatttagtttttcttggtttcttttaaatctatgtggattgagtgttttctattatatgatttgcgtttgtcactcatcattttcagattcatctattttgatgcacatagttgtatctaattcatccccatcttataaatatattcctatttattccaccattctaccgtatatgaacagtagagttgtatccaggtagggtttcttacaatataatttattggaatacttttgtatatttgattgaacatatatataagattttactaaggtacacttaggaagagagggtctattcctatgactgaagggcttatctatctttgtttttacagtgtaatgccaaattgttttccaaagtggtggcagcactgccccaagcaatgttctgaaagttcctactcctccgcatctttataaatatttggtattatcaggttttaaaattctagaccatctagtaagtgtaaaacaatacttcattaaggttttacatgcttttacctatttactagcatcttttaatgtttgttggatattattgtccttttcctgttgcatatgtttgatactaatcattttattggctatatgtgctactgaaaaacttcttttaatttgtgtcttgtgtttctctttatgttacctttgaatatggatcagttcttaattttaatgtactcaaattgatcagattttagtttttgtatgggagaaagagagagacaaatttagtagcagacactgttgatggcctgcctatatcccactgaataatgcttactgcaaagtacaaatttacctaaatgctgtgggagccaacttgttctccacgtagaagaagcaagaagtgccagagagttaatgccccgaagacatccttcaagcaatgaaagacaggaagttgatggatgaacatcccagtttccttactacttggttgggttactctgagacatgttttactagcacttctcaaactatttcaaacactgaaaccattgtgatgatgataatgataattccaaatccattgtggactcatgatatcataaaatacaataaaaatgaattaatagggaagtataatttttaagtaaaagtgaaattgaaaaagcaaaaaagaaaaatactaagctccttctttttaaatactttctctttctgtacttgtcttgttatggattagagagtcaatgagtcagtgctggtccttggaccacactgggaatagcactgttctagaactcagttattcacatggtaattttttgttaataaactttgtattgactttcttccctttcctgtttcactttccctctttcttatgagtgtgtcctgagaccatctcctaaataaactacttccatttgtatccttatctcagggtctgcttctgaataaacccacacaaaagagtttttcttacataagaaacactttctctatcctgaagtcatgagaatatttgtctaaattttcattgacatttaagagttactcttttaataaaatgtcctcaattcatttacaactgtgttactatgtataacatgaggtaggaatccaattttaattatttctcctcatcctagggagattgaaaaaatacttttaattcctcagttgatttgcctgataattttaacttctgtcacatttccacatatgtatgggtctacttctatgttctattatattcaattgtttctgttagactttccctgtgtcaataccacatcttaattaacaatgaggtgtaagtcttgctatctggtaaagtctactactttgtacttcatgttcatgactgtcttgggtactcttaccttttctctttacataaacatttgaggactagcttgtaccttttcaaaaaatgtttggtttttgaattttagttgcatgtattatagatcaaatgggagataatatcatgtctttataataatagttttctcatccatgaacatggtatatcttttatttaggccttccttaacgtctttcagtgttttatagatttatacgtacatcttgaaaacttatgttaaatgtattactaaataccttatatttttattgctattgtacataatgtctttaagaaaataccacatacttgttaggttaatagaaatggaattgactttttaatgttaatgtcttggcaaacatgctatattcttatattaattctaataatttgtttgcagatttctttgggttatctatgtagagataattgtagcatctgtagttaataatagttttgctcttttccaatcttttattttcttatcttcaatgatagccaccaatacagtctttaatagaaatgatgatatgtctatctccaatttcaaagataatgatgatattgtttcatctttgagtatgatgtttgtaggttttttagttatctttatcaggttgagggggcccatttttattccaggcatacaagaatattttgttttttaaatcatgctgagaattaactgatgctttttctgtatctactgtagtgatgatatgtatttcccctctcctagtatgttactgtagcaaattacacaaacagatttactaaagttagactaacactaattttttaaactatttttttgcatatttatgcagtttcagatcatttgctaatattttgtttaggtatttgcatacatttttttctcataagcttttctgcttttaatatcaaggttatagtcttgtcataaattgaagggggaagtgcttcttctttttcctttctcataaagtgtgtaagattaggattacaaactccttgagtgtttgactgattgcacttgtgaagtcacctgggactgatgtgtactttgttgcaaaagtttaaattactgattctatttctttatttgttgtaaaactatacagaattgcttttccttaagtcaagttttttaattaatagtttgccatatcacctaaattttacatttattggtataagattatatacactatcatcatttatcttggttactgtgaaataaacacaaaagcataaaacaatcatctcattaatttttcagtactgaacttcatactgtgaccttgcttttccttatacttttcactccttaagcacatatccctaaatacaatagagtttatcatcaaataaataagaataataaatagtgctaaactcttttacaaaggccagtctgggagaactaatacctttacaatcttaacttccattccatgaatatgttctatcccaggatttatttagatattcttactgagcatgcgtattagtttttttgttttgtttttaaaaatcttgtttcttgcttcaattgttagggggtatttactttgcactatcagatttgttctttacaataagaatgaaagcatttttaaaaatctgtccagtaacctttccgcatgcaacctcataagaagtggtgtgtgatggtctggtttaatgggtcattctgctagttaccatgtaagtccttattttaaatatttccaactcacagggaaaggaaagaatttagatatattcatacattacttggctggataagagttctgtctgacctgtggggcagtggtatgaggggcagttaaggaagggaaataattaggcagcaggaagattctccgtggcaagagggctttttaggtgttttgaggggcagcctgaagttagttaccacagacactaccccttcctgtaattgtttctttacaatgagatccttccactgaagccccttttcttgtttgccatatgccctggacgtaggcttggagggggagctctcgttctctgcatcatggactagcaaataaagatgaccagggcactgacctctctcctttccccactcccatccaccagctccaacgcccactcctgtttttagcactggttggtcaaagttggaggtacttatgcatgtagacttggaagtcttctcctccaattccctaaggggttttctttccaggcagtctcagcctagtcatctctttcccatttgggactccctctcccatgacgtcttgcattaattctttcaggagcagccatggcatcgttttacagttgtcagtgcagatacaaaggtgtttttctctatatttctttaggacagtagtttaagaagagtgatcaaattggcatttctaatcaaaagtcttattgtcatcactgagacctaaaaggcagtattgtagaattaaacaatgatcaagggttgaagccacactgcctgggtttatgtcctgttcccaccactgtattaccttggccaagctgcttaatgtctctgtgtctcattttccttactttaaaatgaggataaaaatactacctactacataggttgtcctggggatttgatatgttaatatacacaaagtgcttacctaggtgtctggcacaaagtaaatactatgtttgtctgatcctccccctggccccattgcattcactctgagaacagctctagggtagcctagagatcactaatttgatttttttgtagagacaattaagattgttgctatttcctgtgatgtccttacctcaatctgctctatccgaatgatgttatattgctaatcatagaagctatatcttctcatagcttactgagctttctacgatcttcttctgatttctatggtaaatgatcttaaatctaatttttctctgaggactcagaattcattcgttcaataatgtatttattgtgtccttatttgtctacctggcactgttcttctaagtgcttgggaagcagagtaagaaaaacacaaggaaaaaatcttgtctctgtggaatgcattctagtgggagaagacagataataaaacatatagtgaaatatacagtatgtcagatgataattgctaaggagacacccaaagctggaaagagagacaaagagtgtgctgtaggagacttccagtttttaatagaatggtctgagaagagcttgctgagaggtgacattggaaaaaagacttgaagaagctgaaggaaccatcctgcttatttggcagaaccttactgtagccaaaaaggatggcaagtgcaaaggccctgaggcagggatgtccctgatatatgtgaagagaatgataactgaatttgcatagtgaggcacaagtagcaagagatgacacagaggcaaacaaaagtgggaattctggtcacctggagcatgtgagctaccgtgaaacttcgggtttttaatgtgagtgacaagagaaaccatcagagggttgggagcagagggagtgatatgatttgcttcatgatttaacaagatcattttggtgctgtgttgagaaaagaatgcagcggccagagctgaagctgcaaagattatttagaggctgctgcaataatctggggtgcagagcacagtggtttggacctaaggggtagtagtagaggctgtgagaaatggtcaaggtcttgacatacattgcaggatgaaccaagagaatatgttattggttcagatgtggggaacagcaagactgctgctttgtacaaagccagggggtctcaatcaaaagcaataaagggtgaagaggttctctttttctttttttgagacagggtcttgctctgtcacccagcctggagtgcagtggtacaatcatggctcactgcagccttgacctcccagcctcaagcagtcctcccacttcagcctcctgagtagctgagatcataggtacacaccaccacacccagcaattcacctgccttggcctctcaaagtgctgggattacaggggtgagccaccatccccagccagaagggattttctttggagatgtaaaagccagggcctcagttctgacaaaagtgagaagtcaaggtttttggctcgagacactaataaaacagagttgccatttactgagatggagaagacagtgggaagaacaagttgaaggaggatcacaggctcagttttgaatgtgtttaattccacgggctgattagcaatctaggtggagaggttgaggagacagctggataaatgactccggagggctgggcagaggcctggcctggaggtatcaattgggaaaattattaacatatggatggattttaaagccgggagactagaagaaataattagggaaatgaatgtggatccagggtcagcaaactatggctcttgggttgaatccaaccagctgcctgtttttgtaaataaaattatattggaacactgccgcacccatttgtttatccattgtccctggctgttttcctgctacaatggtggcatcgagtagctgctacagaccctctcatggataaagcctatactttaagacctggccaacctctggtatggatacgaatgggaaagagtcccaagaactgggccaataaggttgggatgtgatatggtttggctgtgaccccacccaaaatctcatcttgaattgtaatccccataatctctacatgtcaagggagacaccaggtggaggtaattaattcatgggggccatttctcctatgccattttcatgatagtgagtgagttctcaggagatctgatgttattataagtgtttggtagtttctccaacgttcattctcctttttgccgccttgtgaagaaagtgccttgcttccccttcaccttctgccacgattgtaaattttctgaggcctcccagccatgctgatttatgagtcaattaaagctctttcctttataaattacacagttttaaccagttctttatagcagtatgaaaatggactaatacacgctgtttaaaaggaaccagcaaactgtaatcccaacattttgagaggctgaggtgggaggacggcttgaggctgggagtctgagatcaccttgggtaacacaatgagactctgtctctacaaaaaaagtaaaaataaaaataaataggccgggcatggtggctcatgcctataatcccagcactttgggaggccgaggccagtggatcacctgaggttgggagttcgataccagcctgaccaacacggagaaaccctgtccctactaaaaatacaaatttagccgggtgtggtggcacatgcctgcaatcccagctactcaggaggctgaagcaggagaatggcttgaacctgggaggcggaggttgcggtgagccaagatcgtgccattgcactccagcctgggcaacaagagtgaaactccgtctcaaaaataaataaataaataaaataaaataaataaaacaaataaattagctgagcacacttgcacatgcctatatgtgcctatcccacatgtcctagctactggagagggtgaggtgggagggccgtttgagcccaggagtcagaggatacagtgagctgatcatatcactgccctccagcctgggagacacagtgaaaccctatctttaaaacaaaaacaaagaggagaagccactgcagaaggagaaaatctagaagtgtgtgatgaattggaagcaaagtacaaaaagtgttttaaggaggatttaacaaccagctgtgtcagatattgccaactggttaagtaagaggatctgactttctgagtaatgactattggatttggtgacttgaaggtcataggtgatcttgaaataattgttttggtgcaatggcagggatctgagttactttggttgaatggattcaagaacaaatagaaagaatggatgcataaggaggggatggaatagcttgaggagaagatagagctgggtgtttctgggttttttttttaatctttttaaagatgggagaaatacagcttgtgtggagggtgagaaatatatccagttacaaagggaaattttgatgtagggtggaaaggggacaattgctggagcaatgacattgagttaaaaaaaaaaaagtaagtgggatttgctgcattaagtagcaaaactggcctttatttaaaaagcaaatggttcatccatagaaacaaggaggtgagggggaggtcaaatatgtgggcaacatgtgggcaatgagagctggagggaatttctttgaatggtttcagttcctcagtctattaggtaacaaggtcatctgtggaagtgagaacaggtggatgtgctgttagtctgaagataggagaaatattctctgggagactagagggatgaatgggccagggaaagacagtattgccaggcagctttaaaagccagctccagtggtgcttctggcttccaagtgagagtggttagcgcagtggtgtgcagcagctacggaaggaaagacctagcacaggcaggaaatcagatggagctagggttgtgaatagctggaaatgagaatgaggctgaggtgttgggggattatgcaaggatgtaactggaatgatcagtcaaggaatttaagctgggtagagaagggaatgagggcaatgaacaaggtagcaagtcctagtggggctgaatttttggagctacaatactagagggaataaattgaaaagagaagagatgtggtcagagtgaaatgtttaaaatgagattacagaggggttagaggttatttaaaagtggccttttgcccagggcaaacggaaattttggatagagctcttgttttgttttttcctgaacaccctgaaataaaaagctctctatgatgtctgatgttggccacacactacttagcaaagctcttggcagacagtaagttaagggctttacacagactttcatgtgctacagcctctgtagcgagccattttacagatggggcactgaagtgtacagaatgcgagtccttaaaccaaggttgcatagtgaagtagtggatgaagcctggatatagctcaaactcttctatttccaaggcatttcccaaatcacccctttcttctatcacctggtaggtctgtgggtccagaaggctaaaaggctgtcatcgcatctttaagcagcaaaatcaggatgtctcaccccaagtaagaggctctttccacccaccacattaccattccatagtcaagatgtcctttgcaaggagatagacttactttcctttgattaaactaggtctctctctctctctcattgtaaaaagacttctcggcaaaaaattcctttttttgtcttatcttctaattctgtatcccttttccattcctttttctttgtaattctttaatgaatccacattttccctttccacaatttcatttcttcttctatttaacagcatggaactttccatccttttgacagagttctacaacaaaggttaattactttataatttcattctcttaaaaaaaagcacactaaaattgctaattttaactgtgcttcttgtcagtgggttcatgtaaattcactgtaattaaaccagatgttttcttgtgccttaaagtcaggtggtaatttaaggaagattttcatttcaacataaaggaggacagagtgttatcaagggaagttttctcctctcctctcccctttcctcccctcccctcctctcctctctttatctccatttctacatctgaaaaggggttaacaatggtgaactttgggggtagatatgaggaataccaaggtagtatatataaaagcagatagccatgtacaattcaacaggagtttcccttgatacttgtctatgtcatttttttgtctctccacttcagttgccatatttctttattcattcattatacagaggcttggaactaacttaataagagagatttagataattttagtctcatatttcctagtcgtgttggagaaaatacatttgttccagataaatctttacatcttaattaactatagccttttaattgaactatacagttgtatgctactaaatgtttcacaacctgctctccagggaaaaataaaaacaaaaactttgccaacttccatggtgtaaatatttccaccatggtttatttgaagcaacgaatgtggtactactgaacttggaggtgggaagagatgcaagcaagtctgagttagctttgaatatagctaaaagacgtcatacatatcccccatcttcacaaacaatacccataaatgggacactatggtatcacgaaaagggcatgaacttttatgtggaatggtcatttattcatccatctattcattcaacaacgagcccatactatggattaccagagtgaacaacacaaaacaaagtttctattcccattaagcttatatccctcaaagagagataataaagtaatcaatatacagcatgaggtagagaaaaataaaacagagaacagcggtagaggttttggccaggtatagaattatatattgggtggtcagggaatgcccttcaggtaagattttgaattctatttactcctcttctgcacaactgtatcgatagcatctacatcaaagtatttgggaattgactgtaagaatggagagtatcagcacaatgcctagttcatagtgtgcacttgaaaaacataattgcatttctctttgccctttataatatctcaagaccatcttggtaaacatctcaaatgtactgagctctaatacagtgatgccttcaggactcactaaggtgtgaatagctttcactcttacactaaatgactctggactgctttacttattgccttgttgttattgctttttctgctttttctctcacttttcccttttcccggttttacatgccacatcttgttactacagatgtactcatccttagcaacatgcagcctccttctagcttactgtgacctgagaaacctgatcattggctcattagaaatgtacacttaataaaggtactcattcctgaggcatgtcagtcttccttacaattcaagtacatgagttttttaaaaagtatgatgctaaatgaaataatatatgttttgtatgtgattaactgtattaaatatcaataatattatggtatatattaagttattaattataatcaattacattatatgtaattattatatgggattctacatttccttatttgtaaaatagaaaaaaaaacactctttgctccttcacatttagtgttcagattaaatgaatctacactgctagtgaaaacacaaaatcatacaacttctatggaagagtacctctcaacagctaacaaaacttcatatgtacttactctgtgactcttgcaatcccacttttaagaatttaccctaaagatacattgccacaagtaccaaacaacatatgcacaatgctatttgctacagtattatttatgatagtaaataacggaaacaacctgggtgtccactggatattggttgaataaattacagtatttccatcaacacaatgaaataccatagtgtcataaaaaataaagagcaaattctgtagtaactgatatgaagtgatttctaggatatactgagtgaacaaaaacacaagatgcaaagtatatcaattatgctaccttttatataagaagtaggaagaagaaaagtattacatatttttttgcaaaaagaactctaagaaagatcaaccagaaaggaatgaaaatagctacctttcaagtgtggattggaatagtgaaaagagacaggaatggcggtaatattttttggaatatacgttttaatgtagttttttaatggtgtttttatttctaatttaatttaaagttctgagatacatgagcaggaactgcaggtttgttacataggtaaatgcatgccatggtagtttgctggacctatcaacccatcacctaggtattaagccccatatgcattaactatttatcctgatgctctccctccccacactcccccaacaggccccagggtgtgctgttcccctccctgtgtccatgtgttctcattgttcagctcccacttacaagtgagaacgtgcagtgtttggttgtctgttcctgtgttagtctgctgaggataatgacttccagctccatccatgttcctgcaaaggacatgatctcattcctttttatggctgcaaataccacattttctttatccagtctatcattgatggccatttgggttgactccatgtctttgctattgtgaacagtgctgcaatgaacatatacatgcatgtatctttataatagaatgatttatattctgttgggtatatacccagtaatgagacacagtttttacttttgaaacatgcaactgttttgcatattaaaaacaattaaattgaattaaaaagcataggtggaaggcaaacctttaaatggaaacaaatgaacataactgggtatcaaattgataatataaccatacagagaaaagaactgaacttttgaacatagtattctcactgcataccctcagtggtatacagcctaaggagataaaaactgaaatctttaacctaacttagtataatagctttattgttttttagagggattggtgttgtaattctgaaactattttatgtgtgtttcaggaaatgaaaactatgtggatgttgagcaccagggttctcactgcaggagaaggaagatatatgtataaaatgtgttgaatttgaatcagtatgagctcatgacttaaaacaaaaataaattatactccctagctctacctactgaaagaacctacaggcaataacgcatcaccgagcacacctaagatgtatatcttagtgccaaaataccactccccattgaaagcaaccacaaatccctaataagtggttggcctcaggtctggggcagggacattaaaagaatagtctagaatatttttgttgtgccagaagcaaggaagactaatgagaacatgtcaaaaggacctgggaatcagcttgaagagactgccactggccatatttgaggcaatttgagcatcacagagaatggcagtagaggatttcaatacacggagtcaaaaatgatctatgaatcaacagggagaccaaaaacagggaggaagatgaagagagaaacaactcttctctaaagaagaaggctaactagtaagcgtagggagaattatagatgtttaaatcacccttttgtaagcaccaacgtaataactggttcaggtgaagactctcaggacgtgttaaaaccattgagtgaaagctttaggggaatacaatactcattccatctcaaagtttcactccaaggatactttacaaaagaaaaaaggtgccacatttacagtggagggaccgggcagttcttgtcttatctaagtgaccatatgtgacatcatcagtactgggactccctgacattatgaacttcttgacaaaatacaatgagaaatatacatcgccaacataatggttttgccaaagatatacggaaccctggttctgtcacatagaatcaggttaaatattattagaaatgtaaacaaactgtatattacatgattttaaaattaatgcaaaatttattagaggttaaatagcattgtgggtatgtagcataaagttcttatttttaggtcttgtatgctaattggtttagaaatcaactgtcatgatttctgcactttactttcaaatggttaaaatattgtatgtattcataaatatatttacatagcatatgtcacctatcatgtagatataagatacacacacatgagtaaatgcagcaaagtgtttacaaatgttgaatctagatgagaggtttataagtctcctttgtactattctttcgatttttctagctttgaaaattttcacaataaaatcttgggctaaaggagtacaggagccactgtatataatatgtctatccgtgcctagcacagtgtaggtgctcaataaatagcagtcaaagtgagctgccaagcaaaaccatcaacatggttttcatctttcaaggtgcaagcgaactgtggttttgtctgagacatttgtggaaaagggaaaaataaagaatctgtttagtttcttatgaacagctgctacccaaatgaagccatggggctcagcagccatgagctgctctctagtgctggatttcttcgcaggccgtcaaatgcactgaggtgctgaaattacaaattctgcaaattccccagaagacaattttgtggcacggatgacagcagcatgaattcagccattcagccaactcaatcctaaaggttgcttgctggctcccggaggggggtttcagttaatctactagagccacgctctagcctcatcttgtccttgaggtgaacgagttacccagccaacagaagtggtgcttcctctctctttagaaagaatggaacttaaccctggcatacagcagggtcctacactgagactctccttcagtccagtgggttttgaggcagagcctcagaatacagaactgaggaatcatgtctcgtatgttggtgtttttagtaatgataatgtccacacatctccatagagcaggaattgatgctttattaatgatgtttaattaaaatttaatttcaaagcattcctgctctcatgttgttttgataaaggcttttttttcttggtgacaggaagaagaaagagagaagttaaggaacgccttaaagctggacttggggtttgctgaggcacagggaggtaatcctcaaagagcagctcaaggtgggcaaagaatctttaaaaaggtgccctgagctgctccttgggaaaaccttattgttcatctcctgagtcctgaattttcatgctgattttcagcagtgacttctccctctctaacaaccaggaattccctgtgaatatgagtcactaaaccatccttttgccctgactctgtttctcatatcaggcaccaagcacactgccactttttgagcatctacagtgtatttcccacaaccagttagatttctagatgtctggacatgtctacagctctgaagaggtttcctaggggagctgggaagtttctcaactgccggggatagatgctcctttgtgaatacctttttgttttttttttctcctgtgattcaccacaaatatagtaccttataacatgctgggtattagtccaatttctttatataccatgccacttaatgtgcacgagaatctataagataagtactttaattattccttttttgtttgagacagagtctcgctctgtcacccaggctggagtgcagtggcgcgatctcggctcactgcaacctccgcctcccaggttcaagcgattctcctgcctcagccttctgagtagctgggactacaggcatgtgccaccatgcccagctaattttttgtatttttagtagagatggggtttcaccacagtagccgggatggtctcaatctcctgacctcatgatctgccctcctcagcctcccagagtgctgggattacagggtgagccaccatgtctggccaattaattccattttacagatgaggaaacaaaggcactaagaggttaaacaacttgtccaggcatgcttggctccagagtgtacattgtctgacagcgcacaattctacctgctggaggaaggggctacagatttctgaaacaatgaagtcagatctagggaaatcttcctagaactggaagttttacagagtctactccaaggatgaccccaaagaccagtgtgtggggtctgcaaagaggatggctacgaggatgaactggaagggtgtaagggagggatggatcatcaaagtagactgtgtaaaacttccagatctaggatgggacatggtggaagtgagaattaggggcagggtgagaagaggctggcactatttcccttgtcttctcatgagattttgcagctgagaatgtgaatctgggttctactcagggtcataactctgaagtatttagaactcgcttagatgaaacaagagtactagatcctactgaatcccaggaacacacaaagaaagaagaaaatgaaaatgaaaaaaagaaaacatgtcctaaacagaattgccacagtagaggctctgtcttcaagttctaaggctaatctgagtcaagccgggtattttctttatgcagctgacaatgccagtgctctggctagacctttcagacctctttatacaatttttgtgagactctatcctttacctgcacatgcagagagacaaaagttactgaaattttacctctgaatctctcctccccatcccagaccctaactgttggctggcagcttccttgcctaacttaggacatctgtgatgcatggcccaccctgaacagttccctgaaggctcaggttgcagccagtttttgctggacttggccaaaagttgcaccttggctttctccccttccttgtcccacttccctcactcccctcccagtctcccctgggaaaactttcttaatcagtcacatgcacacgaatcttcatctgagtctgattctcaggaactatctaaagccatcccacaaggcaagaggcagcctgggctggctggaggggaaactgaaatatggtcatggggaagtgtttcttaggtaagccctggaactggcgaattctatgctatcactaaggtaactgcggtgagcctgggaagaaacatccaagtcaatctggggcaatcaaggaaagcttcctggaggaagtaacatttgagcaaagacttgaaaggtcaatagaggtttccttgcaaacatggaggacaggtcattccaagcaggagaaatggcatgggtaaggacagagaggcaggaaaagttatgtgttctagcagtagtggctctaggttcttggagtctcaagttatgaggaagataaactgcaggaagcatacccattagaaatgggggtatggaggtggggtgggtttgggagggagacatggaggctcctaggctggctttcaggtctctatcttgagttactaggtgcagttcattgagataaggaatacaggaaagtcagtatagaattggagattagttcaatttcagataccttgagcttgagatgactgtcatccagccagatgaatattcagttctgggtggatccaatgtgtacgctaagctttttatatctattttctgtttttaattcttacataattcagcattgtctgacttccaaattcaacatgtttaaacaatgtgatacatgttttatctttctggaggcatcagtgcagtcaaaccttggacagagaaggtggttgatatagtttgggtatttgtcccctcccaaatctcatgttgaactgtaatcttcagtgctggaggtgtgattggatcatggaagtggatccctcatgggttggtgctgtcttcgcgacagtgagtgaattccccggagatctggttaagtgtgtggcaccgccaatcttttgcgcctgctttggccacgtagtgttcctgctcctacttcatcttccaccatgagtaaaagctcctcagcctccccagaagccaagctatgtcagtgctatgctttctgtacagctgcagaactgtgagccaattaaacctcctttctttataaattacccagtctttataaattacccagtctccggtgttttttttgttttgttttgtttttttggtagagatggaatctcactctgttgcccaggctggagtgcaatggtgcgatctcggctcactgcaacctctgcctcccaagttcaagcaattctccagcctcagcctcctgagtagctgggactacaggcacacgctgccacgcctggtaatttcttttgtattttagtagagacagggtttcaccatgttgcccaggctggtctcaaactcctgagataggcaatccacctgcctcagcctcccaaagtgctaggattacaggcatgagtcaccacacctggccacaggtatttctttatagcaatgcaagaatggtctaatacactggtataaagcaagaagagggatgggggtacaaaagggccaaagctgagtgcaagtctatggcagaactgtcactgtgatgggaaagcactccctggagttgtgcaatgcacagtttacatagtccttcattgaaggcctaagaaaagaaaggtgtgtgtgagggaattaaaaatgtaggaaaaataaaagcctcataactgactgccatggccctgtgaatagattcaatatccccattcccatgtaagctctcctcccttgctcaccgtcttcctcagtctgcaccaccagctcctcgctctccattcggccctcggggttagacagcaagagtcgcagccggatggtcatgaaggggcgcaggcctcgcagggtgtagtgggaggaggtctggatgacctcctcggcctcgtactgctgctggttgaacacatactggtactgcacggtgaggttgtagctatggcagcgggtcaccgcgtagccgaagggctcccactgcagggtcagctgccgggctctgatgtctacgatttccacgttctgtgggccatgtaccggatctgcaaaacatgcaggcaagaaacaagggttctgaagagaccatcgggaagctggggtacatgttctgctacaacagggaacacagcttttccaaacatatctccaccattcaatcactgccatcatgatttttgacacaggcaatataatttagagaacatttttctttacatcaatctcccttgtcttatttaaatacatgcatctaatagaaaacataaatatataaaaggaaaacatcttaaataaatgttaaccataaaaataaatgtgaaattgttaaattcttaagggtgcatcaaagtgccactgaaaaccttcttggtaccacacacagcacactcctcgcttctgggatacgcttatttagacggctgctgagagctgacctgcctccttatactgaattcagccccagcctgtccccttggaggtcagcctctcctcttcagccaacaacatccagatgcactagctggaaactgagtcacagcctcaacccgcaacacccagtttatccatgcgttcatcatgacccattaaccctgctttaggatttcctctcctttccttgactacacagttcatcatttcctaacctcctacaacagtcttccatccctctttttctcccctggtccctctgggaacatcattctaaaagctaatctgagcatgccttctcaccctaatgctgtctcccactccatgcctcctattgatcttggtcccagatcaccatacataatgttgtctatgtctaattttattaggaatattctatttatactttatgcacattaaatagatttttttaatataaaacaggttataataaacatgatgtttttcaaaaatcctcacatgtaaagctcattttatgttgaggtttaggcatttgtctttggggtggcttgttttgtttctttgagatgggagtctgactctctatcctaggctggtgtacagtggcacaatcagagttcatcccagcctcaaactcctaggctcaagcaatcatgatcctctagcctcagcctcacatgtaggtgggcctacaccatgcttggctaattttttatttttattttttcacatatggggtctctctatgttgcccaggctggtctcaaactcctgggctcaagtgatcctcctgccttggcttcccaaagtgatgggattgcaggcaccatccaccatgcctggctcttgggtcaggcatttgttatgttagaaacataacttctcatgtgatagatacacccagaaattcttgtgtcagactttcttatctgggaggagtcaggcacaggctggagattaaatcagtacttctccccatacctacagaactttgcccaattatgtatcctctttggatccactttttaattcatttgtaaaatgatgataataatagtagctaacctcatggcagggggaagaggaagttagatgagatgcttgtaaagcagttagaactcaaacttaataagcactctacgtatgataactggggtgtgttgtttgttttgcagtaatagtaataatatatatgtaatagtaataataatagtgttccgcatgctgtgtctaccttgaatgccttgtgagtggcagtgctgggagcacccttatgcaaaatgatggactaggtttccatcattgctccaatcccctcagagcatttaagggtaaggctacctctgcaccaatgcagcaataagaaagaggggatgctattggtgctagttgatctgtccctatggggaaaatatcctgtaacttgtgtcggcgtcctaccaaggaacatagttcacaggaatgtcagggaacctggcaagcccgcacagagctgcccacgtggctgcaggagtgagggtgttgaggatagtgggcagccctggcccctgatcaactgaggaattcatgatcactcttacagcccaattattcatgctcacaggtcctttgggcaaagcagagccagcatccccaaatcaaatgggtgaccctgagaatgtgacattgaacaagctgttgctgagggcctattgtggaatggaaggtgaaatgtggtccctgtagctggggattatgattggtgggattacggctgctggctaaacatctcgcagttgtaccgactgcaatgagagcagatgtacaggcacacagagagcaataaatggcttgcctgggaagccccgagcatccccatcagcgttgcctagctggggcctgtccacttgtccaggtgccagaactctcctggcagagagccactgcccctgctcagggcctcttcgacactcctcccctgggtttgccctccaaactgatgccaagccccaatacaacagtcacccacatggcactctcacctccctcctgaggcagggagaagaggaacacttaagacccatttaaacccaaggctaagaccacatgttattgaacatcttaaaatgtaccatatctcatgttaaatataatttttgaggtctttattatggccttaacccacaaacaaagctataaagacaaaacaccactgatggaactgtagccacaagtgctgggctctatcttctgaaccatcttatgaccctaggagggaaggatggcccaccccacattacagatgaataacctgaggtccagaaatgtgcaggaattagtacagagtagcaaggccagcaggtgacaaagtgcggttttgaacttgtgtctgcctgaccccacatgtagtgtgcaaagtaaaaactctctgtaagctatcagttgcactctctatgttgaaaatctcactacctgggaggaaggcatcactagctctgtcctagaggaaaccaaagctctttgagacaaaataattggcctaaagccacagagtgagaggcacagccaagatatgaggtctgccagagtagaaaacctgtgttttctcagcaccttgacgccaccggagactgagaccagggaaagaacataaatatgaggcatgtcgccttcatcagaagtctggggagacttgaagacaatagtgagagaaagccaaaatactacaaggcaaaaatgacttgggtctcaggagcctaggacctgcgggagagagtggtacagtgatgtaaacacatttagtgcaaagctgaccgctggccttttgatccctggtctccattctccctggagctcacctctggaggtgtgcatatacacacatttctgctcctcttaaaggactaaacaggagcatctttttaaagaagacaaggatatcgtgatcttgccacacagcaaagagactctttgagaccgggaaagttgggatacaggaaaagccacttgttccctcttgagcatgtgtgactgtcacggcgggccccgggtacagtgctgctgactagagcgtggcttgaagcgagactctggcactcactatctgggtgaccttgggcaagggcacttcattgctgagcctccatctcctcatctataaagtggaaattattacactagtctcaaaaggttgttaatgagcataaaatgaactgtaaagagagagaaaattgcctttggctaacagtaggtactccttttagagagaattgcctttcttggagaaatgcctttggaagcttgtgtggggtagaagctgcattcttggggcctcagtatcacttatgctgagactccagtggaagagaaaaaataaacccactgggggcttggatagcataagagaggtgtgagggtgaacaaatggcagaatattgggtgaagcccaatatgatcactccccaggtgatttttagatctccagcaaggccctcaaaatacaacaaagacctttgctgtgcctggatctcctgtgggttctagaaagggttgaggtcggcatgccttgggcctaataagataccacgtgggaacacagggaccagaggcaaaggaaccttggaaaatgtgctcatgtgtgttactgaaatcttgggagatgattttggggagatgatttttctactggctatgaaaattcagagattcaaggaaatctcagtttgtattccaaaggcaagaaggactctggtgaacctagagattcggtacctgcaggtgaaagcattttgtaaatctgagaactcgcattcaggaaagggaaagacaatggctattaagtagcaactctgggctaggagctacccttagcacttgtgtcctaaaaacaactcgacggtataggaagttgagactcagtgaagagatgtaacttacccagggccacatggccgagcccccattctctgggctcccatgaatgggtcagttacacatgtatgcacacaagcctgtcccgaacatgtgcaaaatcacagatgggtctgggataagaatacacattttagtctgtagccccttcccccttctccttccaccaaactgcatctcttcctgcagggggcctcacatataagtgtgcagcgacctcagtcctcaggtgcaagctctgtccacttcccccagacatccactctttggccatggcactttgcactgttgtccaacacacacttagcatttgtcacactgcccaggaattgcttgttcatgtgtttgtcccccctctcaggctgcaacagaccatgttctgtttgccagtaacctcacaacgtggcacagggtctgtcaaggggcagttcctgtgagatgaacagatggtgacctgttcttgggaactgagctcagactctctgactccacagtccttgttctgtccccttcagcatgtcagccaggtctttaagggtaatatatatatatatattttttttgcattcaagcaagagaatatcctgaaatcctattcaatggaaactaggttttagagtgtgatggaagcattcatgctttcagtccgacccctctaaacctcatctgccaaacccagcttctgctgggtaattgcctgcagcatggagaatctggggtttacattcgggttggtgcaaacaagttggaaattgctaagaaagccttgtgtgtgcagtggagattggtttgttgaatttacatcccccgtgtaaatacagccaagcctagagcctatggtttctgcctccagataaagccctgtccgtatgaccttcttgagtaatagcccacaggccaagaagatgacaaacagtgggaagagtgtggcttgtctgggaagctggaaaaccatcctctgatagaaaatcaaagtggctctacctctggatgcaccttctgtatgctcttaggctagacaacagtggccttgtcctatgccctgtactttagagagccactttggcccacttcagactgtccctcttctcggagcaagggatcgggggccaatgggctggccaaaggatctggttctgtcctctcccttctggtccaggctccacatttatgaccccctagaattccctgccacgaggccctacactcagtttcttcctttgttctgtccttcctgtgagtggccgttggcctaaggatggccaaaggatggctgtctgggggcagtggacagaacttgcacctgaggactgaggttgctgtgcacacacatatgtggggcccttgtggggagagatgttgttgggtgaaaggagaagggggaaggggccacgggctgacatttttattcctatctcagattctgtgattatgcacatgttagggacaggcttgtgttcatgcatgtgtgactgacccactcaggttttcagaaccttctccattcttactgtggcctcaggaaggcacggtggtcctcctcacctctgaaccctgctcctctttctacatcagctcttattaaagcaccatgtccatcctgaagtaccattttcatcctaatacccgagcccaccctgcaacaggtaccttcctgcccccaaatgcccctgagtcattttccacttctcacttatcaaatcctgtattcttaaagcaaagcaagggattataaatgccttcacacctccaagcctctgcccagctatttcctctgcttgggatgccaccaacaaatcctcattcaatattttcaaggcccagctccaatgccaccctttacttgtgactttctctaacagtctcccttgcccataattaatgcctcgatgacattttttttccttaacctgctatcatatgtctcccatagctcttatcagacttcagggttattgttcatatgtttggttcatgttcacctccactgccaacctgtgagcccctagatctcctcattttataactataacatacagctgctgaataaatgaatgaataagtacataaatgaataaatctagaaagtagtgatagctgaagaccaagccacccgaatttaggtgctaatagagggcaggggaaaagcaataagtagagggttgaatcaggatctccttacactccaattgttaagggtaatcatgtggttaagtcagaattggctcccttttttgttctgtatggactcagcctccatccctgctgtcaaaggcaatagctgtagaatcttctaatgaccttaatcaaggcagaacatcttattaaaaaagaagcagcaaaacagattttcaattcatgaatttgctacgtattcatgtttgcatgtggagttgcctgtagcatatgtactgttcaaagttgaacctaaattaagataatttggggatggggctgaaaatgtggaggtggatagcttgtatgcaaaattaattttttatccatttggagatgcaatttgagttcttttcaaattaaattgcaatggagtcctaggcagctggaaacattattgccaacataatttgatactgcaagagcagaaatatgttgacagatagttcgatgtgaccattaatttgcactttctgcatggaaatgatacacgaagggaataaaaaggtaaggggaacaaaaataaaatccatcttctttccagcatcatcgaaacccactctcttgcttattttccaccacctcttctaatttattgcagatgtttggtggacaagaatttgttgaatactagttcactattcctaaaccaaaaatctgaaatctgaaatattccaaaatctgaaactttctgagtgccagcatgatgctcaaaggaaatgcacatgggaatatttcaaatttcagattttcaataacagggatgttcgactggtaagtataacacaaatcttccaaaatctgaaacatttctggttcaatcatttcagataagggatattcagcctgtattatcatagatatcttataaatataagcaagcataggaatccaggagctccatttggagatgctggtaattccacaatatagaagcactagatcctacccgtgctgatgattagaatcacctgaagctggagcatgtcaccttgtgagaaggcaacacggttgctaccctcccatagcaatgccacagagaaggtaatccactcacgtgttcattgtctcatttcttaattgaaaactactcactgagcatggaggcatcatgacatggggaaaagaacattggttctgtgatcacctgaacctaagcacatcacttaccctacctgtgtctgtgccttatttttctcatgtaggaaacgtagatgatactccttcactcttagggctatgaggtgaattaagaagataatatattccagagccttggatggtactaaatacagttgcactccctcaaacccagagtgggaggtgagacagaacagccactgagacaaacaggggttgtggaggtttctgtggatctctgacctggttctgagtctagttgactactggcctcattcttttaaccaactatagtttagtgttagaaagcttccattaatgcccttgcagttattgctgtatctactccttccattctacatacatatcctgaacctctgagatgggccaggcattagggatgtaggtgaatgggacacttgcttgcctttgtgaaactgatgctagggggatgcaataattttgaaggatgatatgatgaagcttgataagtcttttgcaggggaagtactgggcttctggacaatagatacagtacagcattgaaacccagctaagccaatttgatgatgacgcatgcacaaccctgacattcgttatcatagaaaccaaagccatcaaagaaatttaaggtgaacgaggattaacgattccccaacaactgcattattagatgataataaaagcaagccttaggccaaattctactacacagatggacacagtatacaagcatttattagcaaatgggcacaaaacagctcaaacaatctatttcataaagtcccagcaatagatgaatcagttaccatttttcatgaaaggttcattcgaggcaagtacaacaatactctaaggcagaagtaggtgagcttttttttttttttaagggccagatagtaaatatttaaggttttgcacctttgcaggttagacagtctctgttgcatctttccatctctgctattatagtgcaaatgtagccatagacaacatgtacgcaaaataggtgtggctgagtttcaataaatgtttatttacaaaaagctagaaccttaggctatagcatgcttactcttgttatggaggtaaaataaatgactatgattgtcactttaggcagccggcaatcctcctaatctcatggctaacacagtactgtttaggaatcaaggttttgacaccatccctaaggtcgaagactagaggtcttacaggattattctttataatgtccttctggagagtattttaaaaccattttggccaacccacatagtttaaatacctttcatttcaccaattagaatttacttctaacatttattatgctagtccacaggcccttgatttcaaccacagtaatcaattgctaatatttagtttgctaattagcaacatggaggttgttgatcaagatatggtatcagaatagttgggaaaataggcgtgtactcatcacatctggttagttttttttaattttttttttagaggcaagtatctcactatttgcccaagcgggtctcgaaatcctggcctcaagtgatcctcctgcctcagcctgggagacagagcaagagcaagaccgtgtctctaaaagaaaaaaaccatacacacacaaacacacacacacacacacacacacacacgcgcgcatgtatatatatggttatcatatgttattttgatatatgatatcaaaagcatgtggtgtacttagagttttctctgaggtatgggttcttgactgcaacactagtgtacttatggtgtgttcttgattgtaaggctcttaataccggtactagctctcaatagcttgaccaatacaactcacccatcacaccccactgtgtaagcttaaatatttgagataaattaccaacaatgtaatatttagtctagaggccaagaattctttcctgaaaaagggaccttgggcaaaggatggataggattaaaccaggtaaaggggaagagtgtgtatagaaggggacgagagagggagaaaagggagcgggaagattaagccagagataaaggaggcagcacatttaaaatctaagagacaagagcaaggaggctaatggccacagagattgccatgcttgagtggaccgtccacaagagcaggaatccctgcctttcaccacacatgcacaccccatagtgatgtgctaggccagtctgggtgttacacattggtcctcctaccatccctaagaagaaaatgaggataacaactagggcagttgtaacagtatggtaagagtattctttgccaaaagtaaagcactggacagagtcatttgttttgtattttgagtttctaccatgtgctgagaactatactggatgtaggagtgaaccaaacaggcaaaaaccctctgtgcccttatggtgtatatattctagtgggggtaggagattaaataatatatcagataaatcagaaaagtatgtaacacatcagatagtagtaagtgctgtggagaaaaatcaaggagggaagagagactggagggttgggaaaggcttatgtctacaattttacttctttgatttgaggccttggcatcagctccttgatctttcctgatctttcttcttcatttaccctgaagtttttactttttttcccacggcttagctcgaaatattttttgagcatctatagggtggcaagctagttttgggggacatagtgttaacaaaaatagacataattcctgcctcctttgcactaaatctggtgagaaaaacagactaaaacaaccatcatggcagccaaacacatgagctaaccaaattgcatgtgttttgaaggaaatatagatgttataatatgatgataatgcaaataaaaagtgttctgaaggaaacacaagggatcgattggataaaaatggcaagctatgtacagtagtcagagaagacaactgaagaggtgacatttggactgaaaggtgtcactcttccctctctattcccacttctctcccagttttcactcattcttctttgtttttgagacagtctcgctctgtcacccaggctggagttcagtggcgtgatcttggctcactgcaacttccacttcccaggttcaagggattcgcctgcctctgcctcccaaatagctgggattacaggcatgccaccacgctcgactaatttttgtatttttagtagagatggggtttcaccacattggccaggctggtctcgaactcctgaactcaagtgatccacccgccttggcctcccaaaataactgggattacaggtatgagccatcgtgtccagcctccactcgttctttaggccttcctttaaacattagttcttccgagaaagctgtcactcaaaagcttctctcgcccagttgggtatgtgtcccaccccatcccactcagatgaatgtaaaattgggtccaatcagggctagtccaacagccctatcccataggtcctccagtcagtttggggtacagagggggaacccagagtcaaatataatccagattcacaaagcagcctattgactgaggtcatggccctcgggcccacagtaagcacaaaaactgcagcccaagggccttcagccagttattcagccattgtctttggctccaaacatgccctctgtatcttgctttacggtgctaaggctaggatggcacaaatcacatgtgctctactgtctggctgcatgctagtatctgcccatagggggcgatagagggagcctgcggggcaggaggacggggagacttcagcatcaggtatccaagtagccagttcattctgtcacagcatttggatctagcttgcagtttccccaacacttacagagccagcctcattgcagcacctcagagacaccagcaccagcctcttttcgttcttttcaaccctggcagtagctgctccccacagttgccacctttgtctagtgttttcatgttctcttttaatgttttccattttctaggcaattctttatatacagttaaccagaggttcacagtgcccttggtgttttggtaatttttttttcccacagatcctaagccaaaaaacatacccaacagtttcatgtattagttgttgcaaacaacttaataagtatttgcgtcctaacaaataagaagtggtttgagaaaacagtacacacaaatcaaaataaagctatttttttctttcttaactacaattactccctaaaaggatgcatgtatctgttgagcattacacaatttctcaaactgaagattcagattagacagacactgccactttcgttgcctgttccatgttgattttggcacaaaacttgcatttcatcatggcaattgccagaagcccaattctgccaagatatgacatcagaaggaatgtagcccaatctcatgttgaaactctgggccccttcaagtagtcatttgtagcgtgtctgacagatgatgctgtgttttccacaatactggtactaccggtgctcttgtgagttaagagtggtgtcttacactgtctcaacacagtttgaaaaccaggatagttaacaattctgtataggcaattctgtctgttataagtgtcatgatttatctccaaaatagaccttgactgatgcaggaccccactgcctaaacttccttaatattccacgttcccatctttgtctcccagtattccactcagcctaggcacctcatgcccagaaatctgatgtcctcctagctgccacattctgcttcccagctccatctcagaccttgatcttccctctctgccccatccagatgcagtcccctggactgtggctgagccagggagcagggtggtcagctgtgtgcctcctgccacatcaactgctcaagtgctcaaatgctgggaagaattaaaggaacagaggcaaaagactgcagcctgaagacagagactttggaatgtttaaaaattacttttgcgctagaggaaatcgggttgggaaaagagaagcaattttgaaattacgtggtttcagtttccagagaaaggaaaaaagatttggggtgaagaaaaggagaagtcaaacccataacatctgggttagtttcacttcaattcccacttgattcatggcaagtcgctttattcatttaaagaaattaaaggaaaagaagaaaagctggagaaagaataaaacctgaaacatttctgatggtcaaaagccacctagcactgggccctggtgaggtattaaacattctaacactttacttgtcctggctgtgaacaatagggcactggaattagaaaagtctcagcgtagctaatttgccattactgcctaagaagccatgtgtaaatcaaattgtttctagactatgtaaaaacaaacaaaagtaatatctcctaattggactctgatcgcctcccttctagaagtactacctttttttttcagctggagaatttggcttttcatattcagatccagggtttttcaaagctgaggctgctcatagctgacaactcccccatcccaggacattcttgatcttccaaggaatcacattaatctacagacactactcaggactgctggaccttgaagagccctgctgtgtcagcagccccagaaatgcctaccaagcttttttatgatgtccaaagctttattctttgaaatgtacaagagtgtcattaaactgaaggaacactttcaaatgaaaaccactgtcagttgagggaggcttattttctgtcgaatctcatttgggacttacctaggcaatgaaaaaggcaattgacaaaacaaagctgtccatctcagttaacttgtggcaaacaagaatggaaccccagtagaacacggatcacagtacaacagtagctagaagacacattatctgactgcttgcctcactcacttgcgaagtacctgctggccttgttgagcacctctcagaaaagatgaggggttaaaatgcacatggtctgtttcctgactgacccctctaataggggctgacacttggccatgacattgtgagacacaatcctagcacaggcttttacataagccaccaaatgatacttcttcatatcagaatctcaaaaatgatagctacttttcctccttgactttcatttttgacttagccttctaaggatggcctctacaaaatatagagctctccttaaatgtcatcagtctcgatgccttttccactttccatcttcctccatctgcaaatagtcttgctcagatacttgatgttttcacattttctatctcttgcacattaaaacttatttatgaactgtgtgacattgaaaaaataattttacccttcctggccccagatttatatttatacatacctcctacatttcttgtagggtttaaataaaattatatgcatgcattgttagtgggatgttgtcaccatagtgctgtataacaaatcacccccaaagccacgggtttacagcaacagacatttattctcaagctcatacatctgcttgtataatctcctggtgtggatcagccaggcatggctccaggctatgagttgtgcccaggtctgcctgatgtatgcttattctacaaaccaggttgaaggagcggtagcccctcagagtaagttctttccatgatgaatgcaccagagccgagccaagccaacccatgtaggagctcttaaggcctccctcatgtcaagcttgctaataccatattgagagagcaagtcacacaggcaagctcaacatcaatgaagccactcgtcccacagttggaaagggtgggagtagcagaggtgagtgaatatttactgaaagataactcaaactatcagatcaatagatgtgtatgttttggttaacatgaccggccaacactccttcacatagtacaggcttgatcccccgagggaggaaagtctgactttgagtcaggtgtgtggagagccagaagattctgctaaagccataagatttaagcagtttcctgttctatgttcattttaactattatggaatgtgtctcttggagagaagggcagaagtctaatagagagatctggagaagccaccctggcatttgcagtctttgtcaatctcaatatgaacattctcatctaccagccaaactggtcagatgagttcttcctgtcctcaactcccaaatgctgtctcagaccacatccctgcacacacaccctgatatcctctgccccaaatcaaaactctacagtaggcaaaaatatcagcccccaaagaggttcacatcctaatacccagaacctgggaatctgttatcttacatggcaaaaagaacactgtgaacgtgattaaggatcttgaactggggatatgatcctggattatccgggtgggccccatgtactcataagggtccttataagagggaggcaagagggcagagaggagaaatgatgttaggctgacagcttcaaggatggagaaagaacagcaagcaaaggcatagaagtggcctctagaagctggaaaaggcaagaaacagattctcccccagagtcgacggaaggaacacagccctgcagacctatctcagacttctgacctccagaacaataaatcagtgttaactgctacgcttatggtgaattgttatagcggcaagacgaaactaacacaaacctcaaagattgctctgcttatttctgtatgtttattgacactcttcactttcactgccttccttctgtagacccattatgttttatacactgtcttctgcccgaatgagttcttgtaaaatacatgtaattgtttactatgcatgtatttttaattatgtagattggaatgtgttctagctcgtttacctttttgtcactcagcactacacttctgacatccacccaggctgctgtgtgcccttatttcatgattttcaaccattgcatggggttctggggtgtgttctctccatcatttatcaatctgctccccactgacagacactgtttgcttcttactcatcactgtcagaaatcacactgtagtagaccttctcaggtgtctccttctagatttgtgtgaattcctttgtggtctacattcctaggggcagaaatactgacatataggctgtgtgtaaacttaatttgacaaagtactgtcagattgctttcagaacagcagccccaaaacttttagctgtatgtaaaggtacctgtgaacccacattcatccaacctttggtattatccaatttttctacctttttaccaatctgatgggcactacgtattttttaccattactattttaatttatattgtttcagtactaaggagtttgagaatttcttcctatatttttcagccttttggatttttatctttataaactcgttgttcaaatcctttgcacaatcatctactcatttgtagaattctttgtatattctaggggttttttttgttcatgataatctctaataagtaagagtcctttatttttgatgtaataaaatcaaccaagtgccaggcgcagtggctcatgcctgtaatcccagtactttgggaggccgaggcgggtggatcacctcaggtcaggaattcgagaccagcctgaccaactgagaaaagccccatctctactaaaaatacaaaattagccggacatggtggtgcatgcctgtaatcccagctactctggaggctgaggtaggagaattgcttgaacctaggaggtggaggttgcagtgagctgcactccagcctgggcaacaggagcaaaactctgtctcaaaaaaaaaaaaagaaagagagaaagaaatatgaaaaataaataaaatcaaccaagtttgtgtgtgtgtgtgtgtgtgtgtgtgtgtgtgtgtgtgtgtgtgtgtgtgttctttgctgattctcaaggttttattttatttttatctttttacctttttttaaattatactttaagttttagggtacatgtgcacaacctgcaggttagttacatatgtatacatgttgttatttttttgaaatgtctccctaatggtagacatgaaatctgttctcaaatattccacgtcccccttgttccaggcacatggtcaggttgtactttcctttgaagttaggtatagccatgagactttccttgcccagtgataagtgagaagatatcacctgtcactttcaggactgttttaaagcccaagtgtaattggcccatttcactttcccctgttgacctatgtgatcacaacacactagcgagagagagatttctgttgcgggttaagccatcagattttggggtcatttgttcctcgagcatacctagcctatcctgacttttttttttttaatttattttatcccattccccactctcctaccatgagcaaccattttaatatatttattttgtgttcttagaaaatgcatcctattacatgtgcatttttaaaatttagataaatggtgttgggttgtctcactgtttcttactttattcactcagcattatgcttttaaggtccagccacactgctacaactgcatatcaaatctgttgttgttaaatgctgtgtgggtgagccacagctgtgatttccctctcttcctttccctatgaaagacacaaactttttttgaagaaatctttgcccaactctagtctacaaagtcattctgcaatattcttttctaactttgtagctttatcattcacactgacatcttaggtctccaaagtccattaccctgggagtaggtattaaggtggcattcagttttattttcccctgcacagtaaaaaaagttttcctcaaaaccatttgcttactattcagtccagttgatctgtagagccatctctatcacacatgaagtttccagacatacatgaaatggttcttgagctttccattctgttctattgatccactgcctattacagcatgcatttttatagttatggcttaatagtatattttatagattcatgtatggaagggtacatcttctgtgtttttaatccctccttgaagttgactactatgatttttcccctctatatatatttattagagaaagtttatcaagttcgttaaaaacttaacagaaatttttattgacactgaattaaattcatagataaattcaggggggattttcacttgtgtaatatcttcccatccatggccatagactttttctccatctattcaggtcttcttttaactctcttattaaagttttctccattgagattttatatattcttagactacttaaatcctaaatatttgatcatttgtattacaattgtcttaaattagattttctagttcattattgctggtgtacagacatgctattgatttttataagttaatcttatatctggcaaccttgttgaactctcttattaccacaatttttgattgcaattgatttttctaaaaggattatcatatcatctacaaacaatgagttttatttctttgcaatcctcatacatcttatttctttttctttccttaaagtttgggccagaaactccagcattatgttaaatagcaatggtggctccactcttctccctgctccaaaaaggaatgcacctgcattttctacattaggtataatatttgctgtagaattttggcttataaactagcaatctaacaaaagtttccctttattttctaagggttttaaaaaataatcataaattggtgaatacctttatcaaatgcttatcacctattcactcatttaaggacatttaagttgtttcaagtttggggtaattataagtaaatctgctatggacattcatgtatcaaatgcttgtctcaaggattgaaataatcatatgatttttattctttagcatatttaaagtagtgaattgcacgaacattgaaaaaaaacttgctcctgggataagccccatataattattatttttgtaaaacagtgttgacttcgttagttagtatttaacatacgatgtattttctatacattcacgcatgaaatgggcctgtattttcttttcttgtattcttatctgatttttcagtctgataaccaagagggctactaagcgactaataagtgagtagcatatatagcatggatatgttggacaaatggatgatgcacattctggcaggatggagcaggatggcatgaggtttcatcacagtattcagaaaagtgacatttttaaaagttatgaattgtttatttctggaattttccatgtactatcttcacactgtggttgactgtaattgcaaccaagaaaagtgaaactgtggatcaagggggaatactgtgtcaagaggtggagcctttaggggtccaccttcaaagatgggatcagtgccttagaacagggcttgagggggcaagttttcttctcccgtccgtctgccatgtaaggacacagcgtttgtccaccctggatgataaagcaacagcgtgccatcttggaagcagagagtgaatcctcgtcacacaccaaatttgccagatcttgggcttcccaacttccagatctatgagaaattaatgtctattatttctaaatcacctattctaacatattgtgttataccagcaggaatagactaagacacttatgctatctttttatagacacaccctttctctcctccctgccatctaaaaccccaggcagccactaatctgttctccatctataatttttttatcatttcataaatgttatataaaagaaataatatactatgtaacattttgactcagcataatttttcacttagcataattctcttgaggctcatccaaggtgttacaggtacaatagtttgctctttttattcctgagtagtatatcatgctataggtgttttacagcttgtttaactattcactcatttaaggacatttaggtagtttccagtttggggtgattgtgagtaaatctgctatggacattcatgtataagtttctgtgtgaacatgagtttttgcttccctggaataaatgcctaagcgtataattgctggatcatatagtaagttcatttttacttataaaataaacaggcaaagtaccttccagagcggctatatcattttacatttccaccagcaacgtaggagagatccagtttctttgcatcctcgctataatctggtgctatcactactttttatatgagccattcagataggtgtgtagtgattcctcactgtggttttaattttcattttcctaatgactaatcatgttaaacattttcttcatgttccttttttttgccatctgtatatacaggtcatttgtttttaacttttgtttcctgttaaataaatttaaacttttagactttcctctaagtgttgcttcagcctgttgtgcaaatatagacttgttctgctttcattattattcacttcaggattcctttatgatttcctttgtaaccaaagtgttgtttagtaacatgttatttagttgtcaaattcatgagatttttaaatctgtcctttggttattaatttctaagtttattgcataacagttggggaacatgctctgtgttatatgaattatttggttttaattgggctgcttttatggcctaatacatgttctatttttgtgatgattttgagtgtgctcaaaagaatgactttctctgtttgcatttggagttctatatattaaaattatttaacactaatttgtcaatatgttaataagcttgagtttattcattctatttctcagatcttcaatgtctctagttattttttgtctacttgatattgttctgcttcaatagattgattccctagtatggctgctaacttgtatccaccttaaatgataaccacaaaaacaaccataatttgcaaatacctaactgcctcatgtaaagttttaaatactatgtgccagggacttggctaagcattttgctggtgtcacatttacctcttacacttacaagtcacaaagttcctgttttacagatgaggaatccaagagtctagaagcaaattaaccatggcatgcagccagaatggcagagctggcatttaagtgcagatttgtgttctaagtccatgtttttaatgattgtattctatgcctcagtttactcatttgtagaaggaggaaatttggaggactttgaggggtttttttttaagactaagaaactcatcatcattattattgtctgggttaacatttattgaactcttcctctgtaagttctaggttctgtactaagcacagtacgtcagtgatcttatttcatcctcacagccaccctataaagtaggtgttgaaaacttagtgttacagatgaggaaacgagggcttagagtgagtactcagttaggataagaactcattggtgaggtcaccagggcctaaggtcctaatcacaatgctagactttgatcttccacactgaaccggggactttatagatgacatttcacgtagccccacaacagctgtcagagggaagaagtggtgtgccttcttaaccacatccatccaaaagttttttggttgacccctgggacttcagaaagaagtcttctgtctttcttatttgattgaaatgttcctttcaattgcttggactctgaagcccagcatcctctttttctctccccaagctgctcaacacattcctaaaggcagcatttggcccagctcatttcttcctcttcatacccctccatttaacctccccatcttcagtggaggtacacatactcaatcacattgcccatcctctcctgttgtcttccagaaaagtcttaccctaaaatggactgataagcccatacaacttatagtatattttaaatatgaagataggggcttttctcaatcatctcgaccctttcatctacctgtttttttcagagtaaagagagagaagcagtgagttattgtcatgttaagctgcactaaatggctgtatattatggttagagacctctggagaaataatgatgagatcactgcatcttttgttcttggaaaaataatgtggcaaaaagacacctctaatcctctattttaatttgtttttattgatctctttgaaaattagggaaacaacgttttctcattgcaaatgttataagaatgcatggggaggttctagttataaagaataatgaagtagaggctatgaaagagagtctcttcataaggcatggatttagcggaggacggtgggtgagaacatacctgtaaaaggaaatacacagagtaaagaaacctctcagatatcaatgactaactctcagttgtgggtttgggaataatgtgtcatcaaagaggcattccatgagctcagtaaaaactcccgcccctcccccaactatcatttcactatcatatcaatctcctttattctcttggcacttgcaggaattaccttgtttatttacttatatgattgtttacttgtattatttcccccaccttagcctgaaaaattaattgtacaaaagaaagaactttgtgtatttgttttctgccatttcctggtacctagaatcatagctggcatataataagtagtcaaatatttggacagatgaatggatggatgaatagatggatagatacgtgaaataaatgtttcctctatccccaatcttctgtgatttccaaattttctataatgaacaaatgttactgctctaaaaagaaaacattaatttagcatcacatctttctagaaacctttcctgtttcctcgggcacaagtgaatctccctcctctaatctcccaagaatattcaaacctctcattggacactgggccttgtcatcctgactctcattatttgcctacatttcttgtcttcctcactgaaatttaaggcctctgagtgttagactcataaatttccagagcagcaaagaacttaaagatcatcaggcctaacgtccccacttatagatgaaaacagtgagactcagagatgtgagctatccagacccaatggcaaaagataatccaggaaagtgctacactcttaatgccatattttctttgttcaagttgtcttaggtcactgggtaagctgtggtaggttcagcactttaactgggcacctagccctctaccctctcttctctaggccagagggcagtgccttctgcatttgcaattcatatttcctacctcagtggctgaaaggggcagaaagggctggaaagtggaggagtctcacctatactttctctctttatttggcatgtccatgcacctggcatcctaccctttatgcccaaagaattaacaaggagaagaagaaataaagcaataattctctggcaactgtcaaaaggcacacagaccatccacaagtggtttttctgataaatatgtgcaaagcctctttcagttttcccgttagagtctcagcgctcccttgaggaagaggtagctcaattctaaaagaattttagataagctatttaagacataggggaaaatacaggttaaaatataacaaattccccaaacctagcacctaagatactgaatttagggttcagcatttccatgtaggtatccatgtttccttttcatatataagtttctaagaataacatagtattgactggcagacttaaaaactacatacagttgacccttgtatataatgcaagggttagaggtgccaacctcccacccccacacagttgaaactccatgtataacttctgacctccaaaaactttcctactcttgaccgaaagccttactgataacatgaacagttggttaaaacatattttgtgttatatgtattatacattgtattcttacaataaagtaagctagagaaaaaaatattattagggaaatcataaagaggagaaaatctatttactattcattaaggggaagtggatcatcataaagctcttcattttcattgtcttcctattgactggcctgaggaagaggagaaagaagaggggtcggctttgctgtctcaagggtggcagaagtggaagaagtggaggaggtggaaggtgaggcaggagaggcaggcataccccatgtaacttcacaaaaacacattgcaatttgtctttttcacttttttatttctctcaaaaatgtttctatgtggtaccaatttttcttccacctcttgctttagtttcagtgcctgtttcacagaagtttccatgtcctaaaagaagtcaaaagtggtcttgaataattggaaccgttctgtcagataatctaatgtaaatctgttttctggcaccgctccttctatgtctttcctcatcttctggcaccagttcagaagagctcatctctaacaagttgtccgctgttaattcttatgatcttgtgaagtgtctattagctcctgaatttctccaagatctgtatcttgaaatccttcactttcaccaccttttttttttttttgccatatccacaatctctttcataatgtccttgattgcttcggtcataaattctgtgaagtcacacacaacatctgcacagttttccctagcagtaatttattgtttcaagcgtggcagttttcatggttttttgtataacgatgatgacatcttcaatggtgtaatcctttcagactttcatgggctctctttataccgttgacaatgcattccatagaatacaatgtgtaatgaaacttaaagatcctcatgacccctgaattagagacgttgtgtttgggggcaagcagaccacttcattgcctgtgatgttcaactcattgggttctagggggccagaggtattgtctaatagcaaaataaattcaaaggtagtcccttaccagcaaggtacttcctgacccagagaacgaatggaaccaattcagaatttgttgtccaggacttcttgtacaatcagaagtctagcagctggtgtttatcttttcccttcaaggcttagggcttagcagctttacagataagggtagtccttgtcataaacctgagtgcatttgcacagaatcatagatttagcacatctcttcctgtcttaaatcctggtgctcacttctctttcttataactgaatgtcttttatggcatttttcccccccagaataaggcacattcactggcattaaaaacttgttcaggtagatatcctttctcctcaattattttcttaatggcatctggggtattgtctgctgcctcttggtgggcaaaagctgcttctcctgttatcttgattttttttggtttgtttgtttgagacaaagtctctctgttgctcaggctgacctcaaactcctgtgttcaagcgatcctcctgcctcagacttccaagtagctgagattataggcacccaacattgtaccaggctcttttcttgacatttttttaaacgaaatctttttcaaaaattaacaagccaccctttgctggcattacataccccagctttagatcctttaccttccttttgttttaagttgtcatataataattgccttttactccaatgatattagagtctacagatatgcctttcttatagaaatcctgcaaccacataagagccgcattctcaatatgatataaaaaggtattttgcaaaaagtgcaaggttttcatgcatgctggtatagctgtggtgatcacttcacaaatttccttttctattctttttttatttacaatggtccttgtgctggattcatttatcttgaaatggcagaaaactgcagctgtagacctcaatctagggtacatatcaagaatttaacctttcttttgtaatgtcatgacttttctctgcttctttggagtgcttccagcatcactagtggtactttgtatgggtatcacggtgtttttcaaggtttacactattgcaccaaacatgatgaaaaatacacgagaacctcaagagatcactttttattgtggtaagtgatgtactggaaagatgaactgatcatatggagatgtcagccttgtaaatcgaaaataaaattctaagccccccagtcaactgaacagactttccttttggccaaagagatcccccaaaacctgaaaataaactagttcaggaaggcagggggcaggggcggttggacatgtctcattacaccctcttccctctggaggttagacaaaattgactagtgttaacattaaaatagagatcttaaggactgacaaaacagactctgtagcaataagacaccaaattccaacctgattctagtgtaacatcacatgacagatagtgggtcctaaaggaaatcaaagtattttgctccaaaatatacttccctgacatattttgaaatgggcctgaaaagctatctcttgcgggggaagttatattctatagagactctccttcccctacgaggtcttttcaggagattttgacatcttttagctctaataagaaacatgcacatctattctctctgaactctgctacttggaggcttcatctacatgacaggaaccttggtttccacaactcgacctctcttaccttaccttaactcaagctgactcaactcttcaggaagagcttaattctttcaaccaattgccaatcaggaaatctttgactccacctatgacctggaagccccacactctacccggctttgagatgtcccacctttccaggccaaaccaacatataccttacatatattgatttatgtctttgcctgtaacttctgtcttcctaaaatgtatacaatcaagctgtaacccaaccgcctttgggacatgttctcagaacctcctgaggctgtgtcacaggccatgattttaaccttggcaaaataaacgtctaaattaagacctgtctcatactttttggtttatagcctcaaatggcattttaaggagatactcatgacatttgaactcacagcaatagcaacaggaagtggctacaaaattaactgtagtacatactgtactactgtggcaattttgtgcagttatgatctaatactgcatctttatatttgcttacatttctctcgactgcaaatggtgccatgtacagtctgtatatgtgtaagttttgataaacttttttttttttttttgagacagagttttgctcttgtcacccaggctgaagtgcaatggcacaatctcagctcactgcaccctctgcctcctgggttcaagcgattctactgcctcagcctcctgagtagctgggattacaggcatccaccaccacacctggctaatttttgtatttttagtacagacgcagtttcaccatgttggccaggctggtcttgatctcctgaccttgcgatccagctgcctcggcctcccaaaatgctgggattacaggcgtgagccaccatgcctggccaattttaactttttaataacagattttagaatattttatggtagcaaatgataaaatagactactatctacatctttcatgacatacttaaaaattttttgatttttgatatttctgggctgcatgatgcgtctgcaagtttttcaaatcattgcacacctccaacaagatgtccaatatatgtattgaaaataacccttgtataagtggatgctttcagttcaaacctacattgtccaagggtgagttgtaattggtatcatatacatacccttcttcagcttctatcattttagttagattcattcattatgatacatggagcttaagttcattaattctactgctatccagttttccattgtatgactatatcacagttcattcattattcttttgatgaatatttattttaatttatttttagttctgtttgtaatttgagtttttttatccactaacatggtatgtctcttaacttacctaggtcttttaaaatttatttagcataaattttataattttctaggtcttacacatttttcacttgttttgatatatgttttatttttgttgctactgtaaatggtgtttttaaactttttatttgaatataaagtacagagaagtacacgcatctctgaatttccacaaacttcacccttgtataaccagacaaaaatcaagaaagatgttaccagaatcacataagcctctttatgccggtctactcactacccccatcagcaaggtaaatgctattttaatatttttgaattaaattttataattattatataaaaatgtaaatgacttgtatactgatctaatatccagagactttgatatagcatattactatttataatttgttgtaatcaaaaatttgatttatattgtaatcttttttcctctctagacaatcatgccacatgtgactagtataacattgttttgcttcctttccagtaattattcattttactcccctttaaaaaaattctctgcccttactggctgtctttaacaccaagtgaaatagatgtagtgttggtgcatcccttcctcactttcccttggttttcaaggcaatgttttcatatttatcatttattatgatgcttattgactgaagatgtccctcatcagaataagaaagttcttttctattcctagatttataaggggtatttttagtttaatgattttatgcacttagcaaataattttatgcacttaggcagctataatttttctattttgtttgattaatgtggtaattacattaatgtattttccaatgtcagacaaccctcatagtctctcaatgaacccaaaattgccttcatctatttactatttttacttcttaagtttaaacttttaattgataaatacaagcaggtcataaatcataaaaaagcagcaaggtgaatttccacaatactgacatctcctatgtaacagatcgataacaaaatattaccagccctcagaagcccaccccatcacgcctttccccgtcactaacccccacaagggtagccagtatcctaattgataacttcattgtttgtatttgcctatttttgaacttttatctagaataaatcataagcatctgctcttttgtgtcatttgttcaaccttaggtttgggagagtccaccacagtgttttaagtaacattacttcatccattcccattgctgtataaaagcgcattacatgaatatcccacatttattcatttattctattgttgagaaacatttttgtttcaagttaataaacattaggaatagtgctatcatgaacgctacacatattttgctgaagatatatatgcatttctgtgagaaatatacctagaagtggaattactggggtgtgggtagtatatatttactttctatatacaccaaggatctacaagctacaacccttctcttccgcctgccaacaatttttgttgataaagttttattgaaacacagccacacctatttgtttatgtatgtctatgctgttttagcacctcagtggcagtgttgaatagttgtgatagaaacagtacaacctgcaaagcttaaaatatttattatctggtttttacatagaaagtttgctgttccctgttgtatactgtcaaacagtttttaaaagtggttataccaatttatacccccacttctctagctttgccatgatatgttttaatatgcattcttgaattttgttcttatgtataagtgacattaagctaatatgccttcattttttttgtcctggtgtggttttgatatcaaaatatcctagacttacaaaatgaattaggaaattttcctatatttttcattctctgaaagagtatgcaaaaagaaagaaagaaattatattttctttgaatgcttggtcaaatttgcttgtaaaacaatttgggcttagcattttgagaagattttcaattattgattcattttttaaaattatattcattttgtttacttcttgagtcagttttgaaagttacatttttcaaggatatacctttttagtctcacttattgacaaaaagttattatattcattcatcattaagtattttaataggaatcatttcatatataaaaagagcacttacaaagtatatgtagtgaaaaataaaattcacttctgtctatgaaacatcttccttaagaaacagaacaatatcaatacatttgaaattcacttgtgcccctccctacagtatccacttccaattgcttttggagggataggcactctcctagaaaaaattacatatgtatacaaacacacacacacacacacacacacacacacacacacacacacatctcaaatgagatattcaaatattattggaatatattttgcacgtttctgaaatatatataaaaggaagaatatcacatatattcttctttgccttgcagttttcactaaaacttcacgtttttgacaacagttatccatattgggtaactcatttttgtgctggcttactcatttttactgtcttacaagatcagactatatgaatagatataaactattaatacaatttactcatcaattctccagacataaacatttatgttggtgccagattttttagctattagtgagcaaggctgctctgaacattcatgtatttatctcctgagagtacatgtgcaagagtttctctagtctaggctacatatctgtgagtaaatcactggatgttatgttatacacatcttcaatttaatagatgattgcaaactgcttatccaagtggttgtagcaatttgcattctcatgaggagtatttaaatatttgctgttctaattaattgcaaatacttggtgtttcaggctatttggttattaccaatctgtaagtttatttcttggacttttaatattagctgtatgttaaggtatcctcttttattcctaacaatttttgtttgtgccaactttttttctggagagaaaaaaggagtttggtgtgtttttttatgccttttcaaagagttttggctttgttgatacactctgttttagcttttcttatttcattgatgtattctctaatattagttatatcctctttccattacccttaggtttaatctattgttcttttttaccgtaatatgattgcttaaatcattaaatatttggatattcttcattactgtaagcatgttaaagctaggaatttccctgaaattgtgagtttagccaaatcccaagagttttatttgtattatttttatgatcattcaattctaaatagcttatctgttgcctttaagacattttcatgacataactattttgtaggagtgctttcaaacttccaaatgtataaactttaataaaagtaaaatttttgcttttctttctaacttgatctcattgtgattagagaatatagtttgtgtgatgctgactcaaaatttttgagacttgctttattgattgatttttgatttttgtaattgttttatgtattcctaagctaaatgtatattctctaatctcggagtgcagcattttatacttgtcaactggattgttcttattaattgtgtcatataaatcttttctttatttactagttatttgtctactttgtctgtcaattacagagatgtatctggtatctccaagcattcttcttatgccttctgctcataccagtctccctgcttttcttaaaacaggccaagaactctgccccttcagagccagtaaacttactgattctaccgtttggaatgattttctcaaatctataacctgattgactccctcacttcattcaggtcaccttatgagggaatcctaccttcatcacaatctaaacaatagctcccttgctccttaattttctgtccctttaccctcatttgttttttccttttcagcccttaccaacatcaggcatattaaatatttttttcattatcttttccatccagaatataagcttcaggggaattgtgatttattcattataatttcctcagtacctagaaggatgcctggaataaaatagaggattttatttttaaatgtttctaataataaaatgttattggtaatcctaattatgtgtgggcccaaactgttgcacaacaacttgtgtaatcccatctattcatttattgttcaattaattcttgttcagcaaacatttgttcaatgaatgaatgaataaatgaatgttaaaaaaaaaccatctcactgacagatttgcaatttcctctttgcaactgtctcaaatttggctttacatattttgagatcaagttattatgtgcatacaggtttagaattgttggaactttcagaataaacaaacattttataactgaaaattaaaatcttattttaataaaataatttatcattttgctttcagtctaatttatctgatattaataatgtttcatcaacttttttcctattaccagtttcctgctatatttttcccacctgtgacttccagcctatttgcattattacattttatgtatgtgtcttttaaaattgtataatttggattttgttttctaatcaaatgtaacattttcacatttaaattagggagtttagtttaagtacattttttgagaatactgataagttgaaaattctttctcacatcttacgttgtcttgctttttaaaatgccctttccttcctttccagcctttctttgaatttactgagttttaattatgttttattataaatctagcctttggtcctccaaatattttactaggctctgcaggtcagtagaaataagttatgcatacacatctgtgaaatttatgcatgcaaatagcctccattcgataggtccgatattctgggagctgggcagagcatacctacgatatactatttcatggaattcaaatcccaatgaccccctataaaaaaggcactttcaagtttctactgaacttgctcttccctttctttcccctcttttaaccccaaccaaacaagttagccattaagcctactgctctgtgtatcaagtgattcttaagttacgtaaatatgcctggtagcattcacgacttcattcttttaattattttatttacttagttttattttattggacagcctccaccaaccctctggaccagaataagttcagagctactcctgtctttattattattattgttattttgagatggagtcccgctctgtctcccaggctggagtgcagcggcgtgatgtcagcttactgcaatctctgcctcccaggttcaagcaattctcctgcctcagcttcctgagtagctgggattacaggcgcccaccaccatgcctgggtaatttttgtatttttagtagagaccaggtttcatcatgttggtcaggctggttttgaattccttatttcaggtgatccacctgccttggcctcccaaagtgctgggattacaggtgtgagccaccaagcctggcctcctgtctctactattttaaatagccaggtgacaaattgaactcttcaattatttgttgaaatgacagaattttagggtcatagaaggagggtgagtttcatatgagcaacaggaactactggcttaaatgtgaaaattaatgcatctctgcaaatcaagctgtggctatctctctgcttggtctccaaaggacatatggtttacaatcctctgtgacactgaaaagagaaaagaagcaagactatatttgccatttgactgcttttcattggaattggattaaagcatatttcactttgttcattgtcctttttaaagcattcagctccacgaaaggttgagccagagcaagtagttgaaaagattttctatgcccctttcctcccgcgttgtatgactggtggcaataaagtcactttcaggcagaaagatgcaaagccattaactcagggttacatacatcccaaaccaggctcaatgggaagaacacatttgactgtctccttctgtttatttagccatcttcttaacatttcttttttggtgtatgttttatgtacccaaattgtatatgtaatgtacatataatacattactctagtaatgtatacatacatttatcaataagtatgtgtacatatggggaatatgtgctcagaaatgttttactaatttgatttgtgatttaaaaatgagtacactggtgtgtgtgacagatttggaagcctggtttctcatccacacacttcaataagcatagccctatagaccctctcaggtgtattatcccagttcatatcttgggccttctttattgacttaattccttaaggtgatactgatgctttccagttgaatctatttccagagtactttcctcctatcttctcttttttctttaatccctttgtccaaggcccagattactgccacttaaattcagttgtatctcttacctttttctccattccaggttgtgaacaatgttgcacaataatttgtgtaatccctgaatatatctttcctgacttgagaaaaaaatgagaatatctttcagtatcagggctccttggaggtcagggacattgaataatggatggtattattcccattatttatgtgaaaaaaaacactgagattaggtgatttttgtgtaaggttacagaatcaatccgtacgtttttaacctcaccttgagattctgagtcttgtacttttccctgctgggatcctcagtgagtctatgttttctcaacctctgaccagaggctatgcctgtgccctgtccttgtttttcatatggtaaggaaaatgtcctcctggatcctaggatctgaccacatcttattaatagagttcaaggcagtagaaagagcaaggtctttgaaagtagacagaagtgcattcaaatctcagctcccaggtccacataagttgtgagacctcattatgcaggagtaaaaacacgccccaaatcttagtggcttgaaaaccaccaatatttgtttcccactcactttatatatccatgggcaggttagaaggcccaagatatgaattgggataatatacctgagaggacctatagggctatgcttattgaatcgtgtggatgagaaatcaggcttccaaatctgtcacacaaaccagtgtactcatttttaaatcacaaattctaattatatgtggacccaagctgatgaagcagatgccagaggaggagcacatggtgacccataactagctctttaagcttccatggagatgagacatatgtcacttacactcacacggatgcacccaacccaagaagggagaagccttcttggccgagaagggaaagcccatcgtgtgctcaggaggagaaccaaaaacattggagatacaccactcataattatcacgccaatgtatttagcatctctgagccccagtcttctatgtaaaaacaggacagtgataaggatagaaatataataaatcagaactaatgtcttaatacatgaaatgtacagcacaatgcttggccagcggttgagtcttaacaaatattagttcaatcctgtctgcattttgttcctttctctctagacctgagaatagagggaattggtaggaaaatgccagcgggccggtttctaattccaccaagaagacaaggaaaatgggttgcaacagcagccagaggacagaaggccagggtagccggtcaggtcccagggatcaggtagaatttcattactcacaggactttttttttttttttcagcacaaaataaccttctagaaaacccagctgaggagaaagttcacaaaggggtcacataggtagcccaagctcttcgaggtcaatgcatggtgtgcctcttgatgcagcctggcactttcattaacgtatttaatcatgcttttatctttaatcatcaaatggcttaatagcatgcattgtattcccaggcctgaaataacaatggttatgtggctctgtgataaatgtttttaataaaatcagtaattaccctttttgtgtgtgtgtgtgtgtgtgtgtattatattaacatctttccatttccttaattttggcttttagatatgcaaaaaaaaaaagactaaggtagaatactcaaaatactgttttatgtttggttttgtttctaggagcgcctgctgaatagcaggaaaggtgaattctaagctgtggattttaatgcaaacttcatctaagaacagttggggttgggagagagccctggcttcagggccaaccaaaggtggggtctgaatcccagctgtatgagagaaggctactcataggaactctccaagctgaatttccaaatctgtaaaatggtagagcactattctttataaagttgtggtggagaatataaagatgcttaaaagtaattacatttaacaaaaaatagaatagcccttactatgtaccagaagctattctaagtgacttataaatattaactcatttggtcctcaacgcaaccttaccaagacaggtattttgagatgatagataaataaaaagagaggttaagtaactttcccatcgtgccatagctagtaagtagtagagctgaaattagaacccagacaatctgcctagagaagtacattcttgatttcatactctaaacaggtgagctattattactgttgttattggtccaataaacatatttttacttaatagacctggcttttgtactggaaactctggtcattgtacatttaatgatggctgtttatccttacacttaatttatatttaatttataaatataaataatataatttataaatataaataatataatttataaatataatttatatttaatttatagatataaattatataatttatatttaatttatagatataaattatataatttatatttaatttatagatataaattatataatttatatttaatttatagatataaatcatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatatataaattaatatatatcaatttatatttctattcaaactgtttgtgttgtaaggtgttccttattcatttatcaatgcccgatatagaattggcctttatttatactcactgtatgtcattctgcagaatagctcaggattcttttaagtaagtctcatcctctctacttatattgttgaaggcaaatcactctgaaccttagttcatctctctgtaaaattaggctacaggttgtacctgctgtttcagactgatgtgtcttatttatttagcaaatatgtattgagcatccacttagagtaccatacccattcctggcgggaagtgtcttggtaattttaatcaatcctgacataccacccacagggacctctgatcatatagataggaacagtcttggataaagaaggaacctgggctgtgaagtcagaaattgagctcctccacttgtagaaggacatgtcacctcacctgaatcctatctgtaaaatgggttgacctaagagaacaagaatctgagaaggaaaaatacatggcatagtgctgggcacacatcaaggacaaagagggagactgtctagtctacttctaatttggttttatgaagcccaagagacaaggacacatggtttgctgagtccaaaagcaccatcatgtgcataagttcagggccccgttgtgtttccaatacctaaccccccttgaaaatgccccaggaagaattggcttgtatgaccacagcagtcccagcaaatttgcaggatggtgcagtcctacagcccttccctacctaggaacaaaagtttgtagcctatattcttcttgaataataggaattatttattttgaaatgtattcctggaactttgcttgggttatagttttaacttccataggcatgaattcacatgctataacgtgtgtgttttttaaaaaaggagccccaatacagacctgctcacagcaagatgaagggtatttactgggtcatacaagatgtgctatggtgtccagataagagctcagaccccaagaggaaagttatttttccagccctaaaggatagagtaaaacaacctttcccattatcttgctaggcaagaaaccaagacaaagcggtagaactaaggggtggcaggcaagaatatacatacaaattacacagactggaagtaacagaaccgtggagtcctgcaagcaggtggcaaagccatttctctctattcatcgtgcagaataaattaggggaaagccacatttcccagccagagaagcaataaaaatttaaaatgtaaaataaccttgagcaaaagcattagcaaaggccttgcctgttgctatggtttgaatggcccctccaaaactcatgttgaaacttaatccccaatgtggcaatcactgagaggcgggcctttaagaagtgaatgaatcatgacggctctgccctgatgaatagattaatccattcatggattgatggattaaggggttatcatgggaagggaactgatgactttgtaaaaagagagagacctgaggtagcacattgcatattagtacagttagcacatggccacatgatgctccatgctgccttgggacttctaaaggagtcctcaccaataagaaggttctcaccagatgtaccctctgaacctcagacttcccagtctctggaactgtgagaaatcaattttgtttctttataaatcacccagtttcaggtattctgttataagcaacagaaagcagactaattaacctgttctgcaaataataataaactcttgatacaacagacttatcctagccaagactagtgtgaggcagtaacagtgggaagtctaggggaatggagaccaggaacactcaaggggaagagaaactcgaaggaagccaggacaggacttttgtcttatttggagttgattgaaggctttcaccaaatgcactgaatatagtactcatcgtttgtggacttttttttttttcatgactatggtcaagaagttgagggtaaaatgtattccttttcagtcaataatttgaatctgatgctattacttctggtgtggttccttaactaggagctcgataaagatcacgaaacacatgtatctggagatcaggattagatatgcccaacttaactcttactctaatgattttggtaccaaatgagtaataactggtaaacaccctattttttttttttagataccaatgtcttggcaaggtctatttccttctgaaagggctacaccctgggcctttgcagactcgcctcctgctttctaaatctagaccaagttcctaccaatgacagcaaagcactccattctatagcaacctcttttcttaacttagaacgtatagtgtgtacattatcattcaaagtttgtacatcatgaatgaacaaggaacaacattccaaaggcaagaagagtaaataggaaaggttctattcctccctctccctgagctgagccatctgtcttgtttctctccctggaggcaactactcatagcaattttggatgcaaccttctaaagatattctttacttaaacatatataagtaaatgtttaaattatcataccaaatattcatgaaatttaatacacaatttatataaatttctatgaattttaatacatatatagatttcatgtaaccaccaccactatcaggatacagcatggtttcatcattccaaaaaacttccttgtactatccttccatagtcacagtgtccctaaaacttcccacacaactcctaacccctggcaaccaccgaactcttttctgttactatggttttatctttttgagaacatcacgtaagtggaatcacacaatatgtaggcttttgagtgtctccttttctcagtataatgcctttgagattcatccagttgtgtgtattaatagcttgtcccattttaattgctgagtaatattccaacatgaggatgtaccacatctcctttatctattaacttgttgaaggccacatcttcttggtgattatgaatagatctgctataaatatttgcgtatttattttggtgtgaacatactttcatttatctaggataaataaccagtatttgggttgctgggtctaacaagtagtacgtgtttaatttattaagaaattaactaaatgttttcaagctgactgcatacactgttctgcattttataaaaatcagtgatgcatcctaccaatcattttggatgtgtcagtttagttagatctacctcatttaaaaaatcaggctgcaatgttttaatgttgtcattgtgatgttttttgttttttgttgttttgttttgttttttgagacagagtttcgctcttgttgcccagactggagtgcaatggcatgatcttggctcaccacaacctccgcctcctgggttcaagggattctcctgcctcagccttttgagtagctgagattacaggcatccaccaccacacccagctcatttttgtatttttagtggagacagggtttcaccatgttggccaggctggtctcgaactcctgacctcaggtgatccacccacctcagcctcccaaagtactgggattacaggcgtgagctaccatacccgacctaatgttgttattgtgtttttcatatgttctctattgatggggtgtgtgtgtgtgtgtgtgtgtgtgtgtgtgtgtgtgttttccaggtgcaaaatcactgggccaattacccccctagcttccttgaagaagccattgtttttcttaattttgttaatttctggatacccaattttctttcttctacttttttcagtttattctgttgaaaaaattctaatttattgagttaacttcttaattcacacagattaacaaacatgagagagtagacattaagtccagaagttcactgttttagttgtatcccatcaggtctgatatgtattattttatacctatttgtattattttgtgttcttattttctagatattttgcaattttaatattggtttcctcttttacttgaaacttgcatgagataattttttgttattaatattctattacatttccaggtgctgggaaatatatatgctacacataaagtgtaaagaacgatcatcagaagaacactcttcaccagcagtttgagaaacaacattatccatatctctgaattccactttgctgcactcttctaattcatacatttctttaccccaagaaacacccatttttctgaatttggggttagtcattcaactgcttatatacataagcagtgataaacctccaatgaaaaatgaacgtttaagccttgatgtcaatggaatcatagtgaatgcattccgctctaatattcatttttctctgaacagtatgtgtggaattcatccattttgatactggtggctatagtttgctcactttcactgctgtgtagtagccccattgagcgtaaatatgacaatttacttctcattttttctatgatggtccatttagattgttatcaatttttagcttgtacaaacaaatttgctaggaatgttcttgggcataatccatgataaacatgggtttatttaggttagctcctccaggatggaatggctaaaatatacgatatattcatcttttgctttataataaaatgccaatgtttgcctgaagtggcttgaccaattgatcctgcatgtatcggcaccctcctgctccccatccttgctcatgtttgataatgtcacacttttaaacatttcttacatatgggatatgaagtcatatcacctagtacttttaatatctgtttctaagattttaatacaatttctcagttctttgtgatcatccaactttataaaatgcattttctttgttcacgcttttcttttcttttcaaatgcctttttaaaattgattcactgagattcatgatttactctagatacttatttgttgctggctttgtatgttgcaaatattttctgccagtgtgtggtttgtcttttcaattgatttgggggtgccttttgaagaagagaaattcaacgttttaacacatttgattaacattactatttgtataatctttaagaagactctacctcacagtcaaaaagtattctgtctatatttttctcttaatatgaaggtttaccttttataaataagacatttattcatcaaaaattgattctgtgcatagtgagtgataggatcccagcaatttttccaagtggaaaatcaattattctatcgctatgtaggattgttgtcataacaatttacaaaaccgttccacatatgtataggcctatttctgacttttcatcctgctctacttgtaaatccctgtactaacttcacattctcttaatttctgtaacttatagtatgacctcattaccgggagggcagcaatcttcatgattttctcttttggatatcctcttctgtaaaaatcagagaactctcttgtcaagttccactgggggttttatcttaattgccatcggatctatagattagcttgagaataatcaacatcttaaacacactgggtatttttatccaataatctatctctctatttaggtcacgtttaaaacttttcaatgcaattttataattttttttcataagaaccatggacaagtttgggcatggtggctcatgcctgtaatcccagcactctgggaggccgaggcaggcggatcacaaggtcaggagtttgagaccagcctggccaacatggtgaaaccccatctctactaaaattacaaaaattagtcaggtgtggtggcatgtgcccgtaatcccagttactcgggaggctgaggcaggagaattgcttgaactcaggagggtgtggttgcagtgagctgagactgggccactacactccagcctgagtgacagagcaagactccattaaaaacaaaaaacaaaaaacatggacgagtgttgttcagccctaggaagttatattttgctattatacttattatcatttttaatactttttctgtttgcagctggggtacagaaatgcaatgactttcttgaataagctttttattgaagtacaatagatcaaaaatgtgcacaagtcataagtgtacagttttttaaattttcaaacagcgtggtccatgtaaccagcacccagatcaagaatgaacacatctttgccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggagggggaatatcacactctggggactgttgtggggtggggggaggggggagggatagcattgggagatacacctaaggctagatgacgagttagtgggtgcagcacaccagcatggcacatgtatacatatgtaactaacctgcacagtgtgcacatgtaccctaaaacttaaagtataataaaaaaataaattaaaaaaaaaaagaatgaacacatcaccatgatatgagaaccatcttaaccagtgacttcccctcataaagataaccactatgttcatcccttttaccacatattagctgtccatcttttggacacttatggaatgacagagaatgtattcatttatgactagcttttcccccttgtttttgtgagatacatcatgttgaatatggctacagcttgttcattctctttgctgtataggtttatattacatgactagactataacttatgcacattaatgttggtagatttttaaacagtttacatttgggggatatggctagtatgaacattcatgggctcatctttttacatacttaggtgttcatgtctgctcatttgtacttagaagtagaattaatggttaagcatatacttagtttttgtagatcctgccatacgcttctggttttccaaagtggttgtaccaagattcacttgtagtagataagaattccaatacgaaatacagcctgtaatttgacattttaatatttcttattatagaaacattggcaaattctcatatgaattctaagattttatctacataataagctagcattctgagaatgaattcgccttagtcatcatgtttttctttgcataaacctggctcttgcaatttttttgctaataaattgctaactaactttggtttctgaatgtgcataagaaaataaagctataatttcctttctcatgctgtccttatctacttttggcacaaagtttatgtttactaagtataattaatcagagaaagtttcatttcttttttgtaagattttatgtaagattagaatttccttttcctcaaatgtttggtaaaacttgcctattaaatcatttgtacctgatgttttcattttggggagattgttgacagattataaagtaatcctttaaagattacaggactgctcagatttttttttcactaagttttaatatttttctacaattcactcatttcaggttaattctttagggtaattagcatagagattataatattatcttttacatcactgatgcatttataatcgtattttttcacatataatatggcttatttgtaccttctctctttttttcattttaccttggcagaggtttatcaattattttagcttttattatggaattaactttgactttgccaatctttctattgtacatatgcattccatttaattaatttctgtttctaccttaattatttcttcctttctgtgttctttgtttattctaactttgaagtgtgatgcatagtccattaattttcaactttacatctttgctaacataaacatttatggcttaaacttctccctaaatactgctttaactgcatttcacacattttgacatataatagtttcattatcattaagttctacatattttccaattttcactgtgatttctcctttgactccagagtaatttaggagagatttaagtccacacacagattttaaaataaagttactttttattgattttatgttaattataaacaaggaatgtagtctgtgtgataacagattgagttgaggattcattcctaacaaatggtcaatttttatgaattctcatgtatgcttggaatgaatatgtggtttctagtcattgaacactttgaaattgttcaaatcgtcatcctgatagtatatattctcctgattaaaatgttacttactgagagagaatatattaatattgcttataattataatgtatttgtcacattctccttgatgttctaacatttgctttgaatttttaaaggcatgttaatactgtcatactcagtttagaggtggttatatcttcaggatgaatttgacttttgtcggtatattaatggttatatttatctctggtaatgcaaactgtcattttaatagtgtttcctagtgtcccttttcctctaatttatctgtaacctttccatgattttatgttttaagttgtgactcctataaacagcataaaactggatttttttttaaatctaggagacaactttggtctcttctcagataattttgtatctttgttttagatatatttctaccaccctgttttgtgttttctattagattgctgtcaagattttactgtctggatttctttcatggtcacagttaacagaatttaggtattcctttttgtgttagtgatagtattttatttttcttgaaagttatccatttcacataaatttttaaatgcattagaatatggtaatcaatagtattctcctattttaaattgtgccatatctgtagactaactataattccccttaattctttgtgtgtgcgcacgtgcgtgagtatgtgtattgtctttcttccttttggctttgttgatcttctgggattttttctgttccattaatttttgttcttatgttaataatttccattattttactgtctttgaatctataaaatagtttctttttctggtttattagcttgaaaaactagcttaataattttcagccttttaaaaaataaggattaaagaaaataaatcttgctttcactataccctgtgttttaatgtacagtattttatttattttccctgaaattttattttgaggtaactgtagatgtacatgctgttgtgagaaataatatataaagctctcatgtaccctttatccagtttcccccattttaacatcttccaaaactatggtgcaatgtcctgatcgagttcttcatgtttatacagtcaagacacagaacatctccagcaccagaaggctccctcatgctgcccttcatagccacattcacttctttttgttccgcaactccttcttaacattggcagccactaatctgttctccagtttttttaaattattgtttcaagaatgttatataaatagaatcatacagcatgaaaccttttgggattagagttttccacttagcctaattctctgaagattcacccaggtttttgtatgtattcctttgtattgctgagtagtaatcaatggtgtgcaggtaccaatttgtttaactattcacccaagggacatctgtcttgtttctagttttgaggttgttacgtatgaaggtgcaatgaacactcacatgcaagcttctgcataaacactgcttacacaaaatatatagtagctttatttagagtaggcaagtagattttaatttattatgatgtctttgttgacccaggagtggttgtttggaattaaaaaattactaatctacatttaatagggctatatttttgttgttgacttatttcttctgtctttccagatagacagacagatatagatattgatgtgtgtttgtgtgtattcatgttttgaattaattgagtccttatttgatcaattttatgcatccatgtgtacttgggaagaatatgtattctgacgtccaaacatagaattctttaattttttaaagattttattaattttgttaaatcttttaactcctcattgtggtttatatgcttggtttacaaattactgagatgtgtaaaatctcccactatgatgtgtcatttgaaaatttttcctcctagtataatcaagttttatttcatatgttttaacctgctttatttggtacatacaaatttagaattattgtacctgactagtgaatttatcctttcatcacatagcttcattttttcataataattttttttgccttaagctctgttttgtctgatattattataactacaccaactctctttttgttagttttgcccagagtatcttattctattcaaaaatattgtatgaaacttctcaacttttttacttcctgtctttttgaatacttatattggcgatgtgtctcttaaggaacatgcagcttaaaaaatgaaataaaactttctattgtaaaatatagtataactatagaaaacagaataggacaaatatagagcttaatgaatatttatgaagcaaatagtctcgacatcagcactcaagtcaacaaatacaatttgctggccatcatggaatccccgtcccagtaacatacccttttcggcccctcaaagtaaccagtatcatgacttttataataacccctttcttcttttatttatagttttgtcttccaaatacacatccccaggcaccacggcttagatttttctgttttggttgtatatttttaaagacaatgccttcagtctcttctagtctatcagtcctgtctccagcctactactctccaattttcccagtgcaatttatttgttaaaatacagggtcattgcatctacatgcttactctaacttcatcttgtattttctctgccccagctctgagatgaactatttatctaaggatgcctagttccttttatgggagatggtatttagaaaccaagatctgcatgctagttgtgttcattgttactaggatatcattctttccagggcttgtcagcagacagagcttggaaagacatatatatatatatatatatgtatgtatgggtgtgtgtgtagatagatagatagatagatagatagatagatagatagatagatagtaactcatgcctaaacacaaacccatatctatttatctatctacctatcatctatctatccgtccacccaccaacctacatacatatgtgactatctgtctgtctgtctatctatctatcatctacctatctaatccatccatccatccatccacccacccacctacctatatacatacatacatatctctctctatgtgtatctacctatctaacctacctagtgacctacctacctacctacctactcacctgtctatccattctgatatttctgattccagttcaacaaatttcattcatgctttaccaagattttggccatttcatatgagttcaagataaaataccccttaagctcatataaaaacttacgatttaaatttaggactacaagttctcctatcttacaaatgtattgcctttcttcttcaccaagaatcctggttctcacggagataagggtaaaatagaaattagaatgtcatgctttctatgttgtacacctaacagtctcagaatgacagaagtaatttcaatactacgtccatttatttgattattaaaacaataaattgatttatagatccttttccaatattcctgcatctttaataggtgtgctgaatttatgttgtcagagcatatagccattcaatactgtacttttttccatagaatatttatttaatgttcaccagtagcctttatgctgatatctctctaatcatgttggttgactgaaactcattgagtagattattcaggaagaacccattagaacaatattatctgatttcctgcatgttgatagcaatttgcagtttttaatgcttgaaagtcagtcttgctgtatataaagtgcttggtttacatttttttacttgagtataataaatatatcactttattttattctggcacaaagcattgctgccaaaagactgataacattctggttttctttcctttttgtatgacttagtcgtttttcctggaagcatgaaagaattattttcttttgaggtccaaaaattttactaaaacatggctcagtgttggcaatccaggttggtgttctcaagtaggtatgaccgccctttcaataagtaattattgaagttatttcagaaaaagaaatagtacaacaagaactttttcttaaattttactttttgatatttgtgcctttgctttgggtttcttctttgggaattccagtataatgattttcttagcctgtcttgtaactttttccttttctcttggatctagttgcctcttgcttttgtaaaagtttccttctttaacttagttttctccaggcactagtggttgtgtgaatttattcgtgtgtgacttctaccttagtctccatttcttagatatattttcttaaatttataatttatttcctgagtcctatgactacattctgagttttctaattctgatttttgttgttgtgtctcatatcattttcttaatgtctttaacgctttctgaaatagttctcatctgactcgtaggcacatttatttggcaaactttgattttctggaggggtgttattctcctttttctttgagatggagtctcactcactctattgctcaggctggagagcagtggtgcgagttcagcttactgcaacctccgcctcccaggttcaagcaattctcctgcctcagcctcctgagtagctgggactataggtgtgtgccaccacacccagctaagtttttctactttttgtagagatggggtttcaccatgttggtcagtctggtctcaaaccctgacctcaaattatctgcccaccttggcctcccgaagtgctggtattacaggtatgagccaccatgcccggctttctttttcttgacactaactttgcatgtgtttttatttcgattatcttctgtcttcccatttatatgaaattggtttccctgagcatttagaagagaatatagtccaaaatttcatttctaaactcacagagctctcttttctcctgtatatggtatgcacgaatatggtggctcattttctgatactcgcagatcttcaatttcttgtcactgttgtctctgtgctactcaatttagatccttaatttcattgtttattcctggaagggaattttgactggttccttctgagagtccacagggcctagactactccagacacataaggtcttactgttgaccccttgtttttatcctctactgaaaattgcaagatccttcacagttttagctacaattctcaaatttgatgtttgagctttccaggaagtacctgttagttatgtgtgactctgaagcccatacgatgccttattactttcctctccttctccctgagtagtcctgacaccatgcagatcttgtagctgtcagtctcataataatttgatcgtctttccttgacaagtgatttagttttgccttgaatgaacacagaattcatttttcttttaaagtccagaaattttatttgaatgtctcattgttggacaacctgattgtcaatagtttgaccctctctactcattatttgtaatttatagggataacttgcctcctaggtgttttgtaaatattgttcatggggttttgttttgctgtttcagtttgtttgtgtgagggaatttggaaaatttaaaaactaagtcaccagtgtcattttccagccaattgcattttcttttctttcaacaacttaatctgacaatgtctcctttgattggtaagtttagtacaatgacgtagacatatattgtagttattgataagtttgatattagtttttcaacttattctatatttttacttcatgtttaaatttctaaacattttttaccctctctttaattccattttttccctctcctgtttcagaaattaatatatatatatctgcatcttttagttaaaattgtagccaggcacagtgacatgtgcctacagttctagctattcaggaggttgaggcaggaggatcacttgagctcaggagttgaaggctgtagtgtgctatgttcacacctgtgaatagtcactgcattctaacctgggcaaaatagggagaccctatctctaaaaaaaaaattgcacacatctcagttgaagtctaagtagtatcaatacatcacttccacagcaatccaaagatcttggaatacattaaatagaaactccctctcagtttacatgttatggttgaccaatagtttagttgtatcatgttttctacacacacatataccaacttgaactttactattttttatatagtcagtgtttatttagatttcccattctgcttaccaatttccttgctcaccactgatttttgcatagtaggcttttcttcctttctggggaaagagattgattttccctttcctcagctaaaatgctttgactttcctatgagattttattggcaatttactcttaggttttgtttattacaatacctttctcttacccatactatcaaccatgtatgcaatttaaggtttgtttctttccttctctcttcattttgcggatttttcgctgttttctggctttcattgctgctgttgagaaacctgctttgagttagtcattccatggcaagtgatctgtatacattttcagcctctttgaagacctttctgttgctatgaaatttcctgtaataaatctaagtgtcttttgattctttcttatttatcccgcttaggataaactggctttttgaaactgagaattggtgtctgtcatcagttctagaaagtacttggtcatctcactttgaatattgtcccttccttcagtttctacttacagaatacatatgtgagactctcatcccactaacatgtttctttattcccttcatgttttccttttttttctctctctctcttcttggctacaatgagggtattaagttctagcctccaaccaattcattaattctcttctcctgtatgtctcatttccttcataatatgtctgctgagtttgtcatttcctatctaaattatatttgattcttttaaaaatatgcctcctcaacatttggtgttctcaatccattatcccattattcatgcattttgagacagggttttgctctgttccctggagtgcagtggtaagattactgatcaccgcagcctgtacctcccgggcccaagctattcttccacctcagcctcccgctgggactatatgagcacaccaccacagctggctaattttttaatttttatttttgtagagaggaggtctccctatgttgcccaggctggtctccagcctgaattcaagtgatcttcctgcctcagcctcccgaagtgctaggattacaggtgtaagtcattgttcccggctcatcttttatttctgtaaatgttttaaatattttttccatatttggtcattcactgagggtatatgatttcaagtacataagctttattcagggtggagcctttgttctaactccccttaataaaactgaaactcaaggttctttttattgagaaattttcctagggcaggcagtgctgtatattcacttacaactctattctcagctctcttttcacttttgtcccctggatatttcccttaatttcacaagcatagtcattcacttaaaaacacacactcgtcctctcccaacatatacgtaattgttacagaaggatttttttaggatacacggttttcaatattggccatagtgaaagtaagttgggtaatttccacatttccatttccctaattatctcttcaaatttctctgattacctcttcgagtctctataatatgaagagttgtgatttttatgaatgtagaagctacagcaaaaagactaggcagagaacacggaatctatctgttgttggctagagtttatcttctaataatttaacaataaacattaatggggaccatattcctgaaattgtgtgtttatattgtccatctcctgtacttatatgtgaatggcaattttgctggttgcagattttcagggtcaaactttatttctctgaaatatttacagatattattctactgtcatttagcatttaatgttactatggagagtgtttttttttttaattttgtaggccattgatatgtttgcttgtacaccaaataattctttgtttagatttaaagtccattaattttacttgatatatccttgttttgaatattctaaagagtgtttccccagaacacaatgtgatatttccttctttaggtttaagactctcttaatttctgcagcaaattcttgtgttctatctggattttttctcttatcattcttcagtgttttctttggggccaccacatatgtgtatgttagactcctttgtcttccatgtttatcattttctctctaatgctttctaacgttttactgatttccatttccttttcctcattgttgttcatgcctttaatgttttcagaagtgctcattcttctttgtgatgcttccaatatggcccctttgtttctgtgatgactttattttgctattctacttcactcctaatggaagcaagatcatactttatcctctgcttgatacttctctgtgacatatttttggtagaaaagataattgcttaattttcttttaaaattagtagtgataaatttggtcccagtttttatctgtgacaacactttctggcaagtgttctttttttaacttgtctttttcctatgcttttccatgattgtattataagtttttgtgtagaatctgttctggtatctctaaaataactgttattaccaatctctgattgagttgagtcctacttgaatcagctatttgtagaaggttttatttgacgtggagcagggccaagttctaagatagcagaaattctctccagtttatagtaacattccttatggtacatagcattggttgtgtacattgcttattttagccagcaaagattaatgtcataggattaagtctcttctactctaccgttctaagagactgacttcttggttcttttttctttttttttttttttttttttttttgagatggagtctcgctctgccgcccaggctggagtgcagtggcacgatctcagctcactgcaagctcctcctcccgggttcacgccattctcctgcctcagcctcccaagtgactgggactacaggcgcctgccactatgtccagctaattttttgtatttttagtagagacggggtttcaccgtgttagccaggatggtctctatctcctgacctcgtgatccgcctgcctcggcctcccaaagtgctgggattacaggtgtgagccaccgtgcccggccgacttcttggttctttattcagtgtttccttccttgattctccatggtgccaaactgtacccaggaattgtcccatcctatgtgctttatccctgaaattgacatcgaagggattattggcttatggtacactgtcagtcttgcagatatgctgactttgtttaaggtctgcagccacagatgtcatctctcagcatctgaccacacccttaatgtacacactgcaacctgccacctttcctcatcattattttccaacataatatattcttcctagttttaccacagcacttgcatttccttttctgatttttcttcttatggagaaggggaaaaaaagcagaaggagcagaagggtctttgctatctcaaaatcagaagtctgttcctcacctttcttaacaacctttgatatggaaaaatgttggaggcttttcacaagcctaagtagattgtaggctgtccctgaaaatgtcatttgtaattaggttgtctggaatttggaatgaattttcttataggaaccaagttgtaagtggtatttggcaaccaagaccagctttccaataggcagtttagctggatgcattgtgttaatagcattattctggctccatagaactaccatttattaagttatttctaaggaaaaaataaattccaagttctagttagtagaatatagaatcttttaaaatgcaaaactatgccactctcttgtttaaaatccttcaacagttttccactgttcataggccaaggatgaaatcctcagcatggcctcataggcccatgatctggctcctgtcggcccttctaaatttgaaccattttccaaactggccttcttattgttcctggaacatgttatgcttcttccagctctcgggtgtttgcatatttagttccttctgcctagaagatctttctctcacattttgccttttcatgcttacccacccttcagaactcagctcaaatttcatttatttgggtagctttcacaggccgaacagccctgccatataccatctaatagcaccagatttccctgtctttatgtccactttatgtctttatgtcccaatactgctcacagtgtctggcgtatactagatgttcaataagtatgtgtggttagatgaatggataaatgaatatccattcattatccattcatctaataaatggataatgaatggataaatgaatagttcaatatttcatgttaaagacaaagctcttaatttcaaacctacttttctgaagttaaggaaatgtttgtcccccttccactcctgatgccctgcctggaatatcttgggtctgggtctctgatgaatcatgtgtatgttacatacaattccaagtgtcagcctcaggataaccaatgctataagtagtccttacgacaattaagggcaaactctgaaaaaagttactaaaaacggttcattatctgaatcctcacagtgttacagcttaaatccctgaaatataaatactaagacataaaatcaattgcattttatgcttgcttaatcttagatatctctatctcaaaacattccaggactgtggccatatatcctggatttttccgggatagtttcatttttaaaatagattaagcctttgctgctagaaagtgcatctcacctgtcagactttgtgtcctgactttttgttcatacaactcgctctctatgaccgtgtcaactatcagtttgtcacaagtatctttttgaaccattgtatgcttcctgcgagaactagctcttgtgaaaagttggagaattttaaaacctcaatatgaaacagaaacgaccttttaaattttaaattaacgtgctcaagtttcactacataaccctgattcagcttcctcacctataagatgtcacgcatggtgcataggacttcgaagatcctcaaaaatggtgtagggaatataatttctgagttcaaaaagatgttagtttaaaaatccgcttggtaaaggtaataaaaggtatctgaggtttaaaagtcccagtgaatagtacggggaagggcaccgtgagaccacgactgtctaatgagccgggtttgacacatgtgaaacaaggatgaccttgttggatcatcagatatggatggaagaatgggagaaggaggagccaactgctgataacaggtatcatcaagtctgaaaacactctctaggcgccttgcacaaagtcaattttattttatttttttggagatggagtctcactctgctgccccggctggagtacactggcatgatctcagctcacggcaacttccacctcccaggttcaagcgattctcctgccccagcctcccgagtagctgagactacaagcatgtgccaccatgcccggctaatttttcgtatttttagtagagatgaggtttttccagttggccaggctggtctcgaacttctgaccttaggtgatccactgtcctcagtctcccaaagtgctgggattacaggggtgagccactacgcctggcctcaaagtaaattttaaaatatcaaaagacctaactcttattcctgtgcaacttgttagaggaaaaaaaaaaaaaaaaaagaaaaaaaagacttgatggttttgtcctttgggcatacaactgcctttttattgaaacattactacctgagccaatggaaattgatttatttaactcatcgccttctcccaccatctccctgctttcttgtctcgccgtttctttacctgaaagagcacagcaaggctttttgttacattgggttgtgttgatcctggatgagtttataagactgtggacttgctccttgcttctagctattagttgatttcatctatcttgagaaaagagaaggcttgtacataggccgatgaggtagtttccacagattcactgagaaattagaagtggttcactgtagcaagccctgaggcatatctctgaaaggagcccagcctttaaagatcaccttctttcacagaaagtgggtccaaccaagcactcctaccaaccctctctaagtcacccagcgattcattgctcagtcactgcatgcccgctgcatgccaggcaccatgcaatgtggctcctatccataaggagtgtggatcctggtggcagagacagacacagataatcacaacataatgtgttaagtgttgggggaggtataaactgctgcgtgagcattgaatctaaaacagttagcttagcctgaagacaccgtggaaggctttgaagaggaagtggcttttgggatcaggcttatgggaagaagagttaatcagatccatgtgggaaaaggaaattcaacctctgagtaccacgttttcttgttctcttctttatgtttttgaacttgcatgtgcttctcctgtggaccaaggcttctttctgatccggtggtttgtcccaccatcatcaccccaggctgtcacttgaggaaaaaggtaaagggaatagagcggggagattcaggcatccagctttgcagtacttgtgcatccaggagccctacttctgacttggtggggtgggatagtggccaagtatttgctttttcaactagaacctgggataaattggatgtcagtggtttccggagaaacatggcccagcaccttccctgtgacacagtgcccagcacagtgttccacaccttgaacccaatacaaaacacaggaaatgcttaacagagaagcaaacgacatcatccttagaactaaaatttccaaatgtaactcctactgccacctgttggtggtatggagatgtgacccacctgcggtttggaagctatctttctttgtaatcctgtcaagttggcaacttaaaacctgaaatttccggagttaatatatactgaagtgccaatggtggttttcttcaggggtactcttttttattatgggctgtgaagttctgaaatgttttgcaatgagttactattttgcaatgagtctatctccttttctattcagaagaacagagtaaagataagagaaaattaaaaatttacctatggggtagacaaagagcaatctacttagttaaaaggggttatgaacaggcaaaagggcatcaccagaaattgagaaagaaaggaggtttctataaattgattaccttcttattaattatcatttttacttggggatggcagatatgcccgactcactggtgctggttaggcgaggccttaatcaaatcgtcaacagccattctcaggcactcatttagcaaattcatactgaatgcctcctggctgccaggcgcccttggctgcagcctccaacagtttcattttggggtatagccaaccttgagaacaagtggctgtcagtggaattcagactatggataaatgctgaagaataacgccacgtgcaagcaaccaagtacaggagcaaggactcccagtgctccgggaagtacctgtccctctaaagagacagtcactactttggatagatgttggctgtcctccacaggcttacagatgcagcttcacagcacatgagagatagaggaaaccgcagacctcagcagggaggccagccctctcattttactgcaagggaaacatatacagaaaagggaagggactcagccaagcatgttttatttgagaagccgtgctattgtctgtctgctggagctgggaagatgagcgtgccctcatgggagcctggtgggatagacagatgcttaaactaacaatgtcactgtagtgtagtcagtggccgtaacttgggctggggataggcaaggctatggggacgagaggaggcagtgctgtgggaccctttgtctctctcgtgcttggggatgaagaacaacagagctttctggatacagacccttggaagaagtgtgtggcttagggcacaaggtcagctgccatgggtccatgggttcaagtcccaagttcattaggttctttgagcctcagcttccatctctgaagtccccaccccatagggctgtttgtgaggctgatataaggaatgcacaagtgcttagcacaaagtgggatgtcagtgcatggcatgattctagaagtcctccagcaatccattcacatccttctataaaagggctatatccagctatggccagttccatctttttttgagacagggtctcaaatccattacccaggctggagtgcagtggcatgatcatagttcactgcagtcttgacctcctgggctcaagcaatcctcctgcctaagcctcccaagtagctggggccacaggtgtgcaccaccatgacttgttaacttttaaagaaaatgttttggtaaagatagtgtcttgctgtgttgcccaggttagtctcaaattcctggtcttgtgtagtacttccaccttggcagttccaccttaaataactaaagaggccctgaggaagtgcatttgcttctttgtgtcacaaccatatccttagacctgaaaccattcccccaacatctctcccacgaccctgggaggtgcttaggcttgaccagtcatgggctccaggtataaacccagtcctttcaatacagacattttcttcccaaagcagacctacagctcacgagggagaggcccacagtctacacccccaataaagatgccccactgagccccagagctagttatgcaagtcgtttagcagagcctctcaaatccccactcttaatgcagggagagttatgggagccccagcagcgccttttaatgcaactggattaattgcctgctcggaaaacagctcgattctaaatgatcctaaatggcctctaatacctgtaatcttccctccgccaggttgccctgctgcattactaaagcgggactggttctggaagcccatttgcttagtaaacagcgggcagcattgcaggaggccaaaggctgagaaattgatgaaatcgctactggcctattcaccagcctaatttgattctagaaaatcaagcagaggcatttggactggactgttccacaagctcagtgttcctttgcaggactgggtaatcaaatgcgggtgtgccgccgggtctcaactctggtccttcccagcccggcagtgagccgtctctctcaggaatcttgatcttctttctgaagaccacagatggagctgacaaggaaccatgatgtctttcagtcaatcaattacctggaaaccaggagtaggtgggggatggcacacaatgggcagtgtgttctcgctttgggtttgcacttatctggtaaacaggtgagcaccacaattaagagaaaaaactcaagttggtgttttagctctgccattactagctatgtaactttgggcaagtaacctctaggtgcctcagtttcctcatctctaaaatagggatgattacaatagtacctacctcaaagggtgacagtgagaattaaatgccttaataaatacaagatgccttgaggtctggctaacagtcaattctataaacgcatttgctgtcatcgcagcttcactgcttccatatgggcaggcacatgccctccctcagcctcagtccctacttctgtaaattgggtcaatggttgttgtgcaagggaatgggggtgaagggtgcataaagtgtggcattgaggtgtccagtaagcaggcttcctctcctgccattctcatacacgctaccactctggaatgcttcttctctgcagctgccctctctctgtccagatggacagtttccatagagatccatgtgaacactgaaggaagacaggtcacctggccagggaggcaggtcgggagaaggtgagccagacccacttggaaaacaaaagatgagcagacaggtgtctgcattttcttcctgtagaccagtgagggtgagggaaagaaatcagacaggctgtgttcacttgaaatatccggcatttgagcctgacattgccttcattgggagctttcaccaaaccagtgtccaacagtgagaacgcttttgaatccttggcaaacagataccagcagacagtgtgtgtggatttccacaaggacagcatcttgcatgacaaagacatcaagatacaaaactaggctgggcatggtggctcatgcctgtaatcccagcactttgggaggccgaggcgggtggatcatgaggtcaagagatcgagatcatcctggctaacatggtgaaaccccgtctctactaaaaataccaaaaaaatttagccgggcatggtggcgagcgcctgtagtcccagctactcaggaggctgaggcaggagaatggtgtgaacccgggaggcagagcttgcagtgagccgagatcacgccactgcactccagcctgggcgacagagcgagactccatctcaaaaaagaaaaaaagatacaaaactagagtgctacagaccgcagccaaacaacactggccatatcttaatcaacattatcatgagtgactctggtgccaaaagccatgtttgtcctcactctgcagtctggatgcctatttatctactgactggctgccacttgatcactctgctcgattgctccctctgtaaaatggggccaactatcaacctacaacataaggtgactgtgggaataaaagcagcatatcaacaatggtacgtatttgttgagctctcagaatgcacccagtgctgcgctaaatgtttaatgtatgaattctaacccactgactcttcccactcgccacggaaagtgagccctgctgttaatccctattatgcggataagaaacagagggaaaaggaggttaatgaacctgcctgaagtcatatatagctagtaaataaggcgctgttaccaaagtccctggcacaaaataagtactcaacaaaaatatgcagacacacaaaaaaaatgagatcatgtcctttgcagcaacatgaatagagctggaggccattatcctaagtgaaccaacacaggatagaaaactgaataatgcatgttatcaactataagtggagctaaatgatgagtacatagggacacaaagaaaggaacagcagacactggggagtacttgagggtagagggagggaggagggtgaggatcaaagactatcttatagggtcctacgcttattacctgggtggtaaaataatctgtacaccaaccctgtaatatgcagtttacctatatagcacaccttcccatctaccccagagcctataaaataaaagttaaaatacatatgatgtaagttggtagagccacttaggagaaaaatttggcaagacctatatctaaagcattacttctagacagctagctatccaagaacatttttgcaatggctaaatagagctattgtgggggctaccatcagtgctaacttttggggaataaaagggcctcatggcctcagggaggcaccagattagttaagagtgaatggttgatgggaccaagtaatgcctgagaatggccctgcagtgatagggccctgtataaagaggttgagtgcacttatctggggtccctgtggcagggcaaagtttgaagcgggcttggttcaggcagggtttggagttgcagatccatagcctattccatggccattggggtggccagatcaggggcaacacaaagattgcaggtactgccagaagtcactttctcatcctgagttcagtgacctcatctataaactgcatatacagataactaccctgtctattaataggaagcttatgaggactcaataagatcggctagtctggttattcctcaccatccctcagggaagaaagaataatctcctgcactaggtttaaagcagaaacgaatgctgcaccaagcagaagcctcagagctctgccagggacagaaacttgagtgtccctgccccggcagagctctgttttaaccatttcataagcaacagcttcccatgtgccaggaagactttattttttcaattcaaaagagcacctaacatttctcgaaagctgcctatgccctatacattatctcctttaatccttacagtaacaccatgagagaaatttccttctgattttatagaagtcataactgatattcccaagaaattaaatgatgtacccattggcagatggctgacaatttggaaactctacatttgcacctaagactatctaccaccaattttcttattaatgatttttattctacctgcagtccctaatacttctttactctaccgtagcacatttgtcaggagatacctgcattcctgtgtgtgaacattttaccattattcactttatgggctatgggaatgtcatgactgttctgggccactgattacacatctctaaaatgaagacagtaacagtttactcattggattgtctcaagattaaataaggacatacataaagtgtttatcagaacacatgagaagatgttcaacttctgtattaattaggaagatgagatgccatttttggctcattagactggcagaaatgaaaactttttttgtaatattaagtgtcaaaaaagatagaggaaatagacactcttctatcactggcagaaaccagagatttaagttggtagagccactgaggagatcaatttggcaagacctatatctaaagcactacttctagatagacagctatcaagagcatttttttgcaattgctaaatattataaccaacctaaatgtctattgatgaactaatgactgaataaccatgatatatctcttgtgtgaaagataatatcatgtaataaaaagaattgggtaaatatgtagtaactaagttgaaaatttctctaagaagtagagacaagtggaaaaaaaaaaccctaagttttagaatattatcaaatgtcacttaggtcaaagaaaaaactcgaaaatgacaataggttttacagatatatatacgtgttggaagtgcattggatgaagcctgcaaatatatacattacactggtaagagcagtattctggaatggtggagaacagccacgagtttaaatggacatagtattacctgatgttataaattttacaaagtgaatatattcatatatgatttgtacacttataaaggtaaaataataacaataaatgcagttataatctgtcaggtgttgactctgaatcttcattttctttcaaataaaattattcatttagaaaacaaacttattgtgtgtctactctgatttactttcatatgacatctttcaacagaattttttcactgaaagggaaattatgtttttattttgctgatgatgaaagtgaggtttggcttaagtgacttgctcagttagtaaggcacagagccaggattgaaaaccagctgtttgcctccaagttcagttctctttcaattaatccagcaagtctttactgagcactgtgtatgtcccaagctccatactaggtattggggatgcaacaggagacaggatagacgtgctccctgttttcatggcatcacggtccagcgagaaaagcagacagagcaacatgtacttacaatgcagtgtgcagtgcttagatttcacgggtaatggcttattcttcactgacgtctgaaacaaagtatggacgcacaactaaacaactagtttaggtctgattcatcagcataaggtataccaccaatgtatcctgctgctccaaatatgttgattctctaatagatctctgaatcaatagtaataatgaagatagttattgagtattaactatgtgtcagatatcattccaacatttaaatataacagatgacacatttaattctcataatatccctattaagtaagttctattacaatctttatcttacagatgtggaaaggtgaggcacagagattataaaaaagaaaaaaaaaacaaaacaaatacacatctgcttaaggctatgcagctagtaaatgctagaaccaggattcaactcagggctgtctaccttgcaaccctactctacactgccttcccaacaaaaggttccaagctgctcagcaggacacccctctcaaggttccttttccaagtcttctctgaaatccgaacatactaatagagtatcagatgtcatccttgtacaagaatcaggagtaggtaaagagagagagaacaggtggggtctttgggctaaatctcatgtcccctgttggaagaaattaataggtcctagaaagagggaacttatttttcagtaaacacaagcatgtaaaagcatcttgacctcagccccctaatcagaggagcatcttgctaattgccactaatgtgattagcagaattaattggccgctcagaaatattacacatcaagtcacatggcgattaatctataccaaaattgggaacatcattgctcagtacagagacagtgagacaactgacctccaaagggaatcctgatgctctcatacattcctcttatgcatcgtgagtatgttgtgcattagacaaaggcagggagatctttctaaccactcacggaggctgcttcactaatagtaatctgccacttccagtccagctagaacttcttcctgcccactctccacattggacacattcatactcccactcatttctccatgttgtttgtgcactgtaatgtatcctcctgaatctttgttgcattttggcaaactcctattcattttccaacaagaggttcaaatgtcaccaatccatgcaactatcactaattctccccctcaggtatttcacattgatttatgtacaaactcctatttcactagcactgttggaccaccgtgtgtacacctaccagtctcttccattggcaatgggacctcagagtcagggatcatgttgttcttaatactggatcttcagagcctaagtacagatcttggtattcagtaagactcagtagttgctgaatagttgactctgtatctccagactaggcgtggggctgagtacacactaactgtggttcctaggcttgagggtatagacttaggaaatatgcagattgaatcaccagggaattatgtgaaaataaccctgttgctcctaccatgtgtttctgatcttggtgaattacaaaagtggaggatcaccatcactttttttttttttttttgtggtaatcgcagggttgggcctggttagtacttgaatgggaaaccatcactttcttgatctctcattgcttaaataaatgatcaatttatcaatgtccttaattgtgatctaatctgccctctccccactagacttgtcttagtctaggtttcacatttctcatcagacacagatacctggagaaagcatcaaacatgaaagatagagatcaaaacaaacaagcagaacaaagcaatttggagggacttgttgacaactaaaaaaaaaacccacatgcatttaaaaaaaaaaacaaactattactaacatccccagagagataacagaccatattgcaaaactgtgaacaaaatattagaaaccaaggaacattcagaaaacaataaaaagctcttggaaattaaaaataggacactatatattagaagccaataaaagggttagaggatgaagctgaggaaatctcttgaaaggcagagcaaaacatccgaagatttggacaataacaaaagtgtgggtattacagaaccaatccaacagttccaacatccaaatactaaagttccagaaaaagaaagcagagaaaatgaagggagagaataaccaacaaaacaggtcaacaaaattccctagatgtgaagaatgagtatttccagagtgaaacagcccaccatgtgctcaaccaaataaatggataaaaattaatccacattaaggtagataatggagcaattttataatgatgagacactgatcatgtcatacaagtttggacagggaattgggaaaaattcatacttaggaatcagaatggctttagctttctcaaaagtcacactggatgctgggatgtaatagaacagcaccttcaaagtagtaaaggaaagttatttccagtcaaattcttccctgagtgtgagagtcaatgacggaaggtcttcacatgctgacctgctgtgaacactttcttaggaagctactaaagaaagtgcacctccaagacaaggcaggaaaaaaagaaaaaaaagaagtgaggatggagttattggcaataggagcaggaatacagcaggagtaaagcataatacccttcttgaaggtagagtgaaagtggaggaagatcccagaggacggcacagagagagcacaacaccagcacagagcaagccagcagctctgggagagctttctgtaggaggatgaaattgaaaaaataactgaagcatctgaatatcttgagtagagctttagataattggcaaagtgttggggctgaattagtaataaaaacataaaaatgaagcaaacaaaccataaacaagtcaaatattagcttcagggaaaacataatagttgtgcaggaagggaaaataatcataatttactgcatggttcagttttgaatagcatttacatagtcaaaatagtgtaaacattgaatgttgatctagccaaaattaggatataacttcatcgggaggatggggaaggtaggtggaagggatgcctgtatgagtgatgggtggggagtacagggaaagcaaaaccattaatagataatggtacagtggaaaagtcacaagtaccaataaaggtagctaattcagaaatatgttttgcataattataaccaggtgaaaagtgtttgcaactgggtgagagaagttggagtctacacttgctcctatcatatgccaaagaacaatttgatgatttaaactatgcgcacatagaacttggatagatttttaaaaatataaaaaaatatacaatgtgatgtcaacaccccataggttaattccaatttaatgtgatgccaataaaaacaccaacaagataattctaaattttatgtgaaaaatgaacaaccaacaatattagacaactgaaaatgatgagcattacatggggtgaaggtgggtgttgggggtagattagctatctatgatattcaagcatactttacatttcagtaaataaaactgtataattccagtatgctagtagacaaaggaatacagtcaaaacttagaagtagacaaaattacagcatggatttaggatataataaaggtggaatataaatcagtaggaaaagagatacactagtatctagtactagtgtactagtaaatagtaaataagtatttactagtaaatactaatactagtaaataagtatttactagtaaatactaatactagtaaataaagctgagtagccatataggaaaaaaaatgcagctggaactatagctcacacaaaggtaaactttagatggagcaaataatcaaaagtttaatggaaaagatgaacctataaaaataacaagagaggctactatttatttatacacttggagagaaggaagcccagtgtgatacaaaacccataaaaggaaagatggataacatatattgaattaaaattttaaaattttaaaaaattttaaatttaaaattaaaattttaaaaaaatctgtgtggctaaaattactgtaaaactaagtgatacggtttggctgtgtccccacccaaatctcctcttgaattatagctcccataatccccatgtgtcatgggacggacctgatgggaaaaaattgaatcatgggggtaggtttttcccatgctgttctcgtaattgtgaataagtctcacaagatctgatggttttataaaggggcagttcccctgcacatgctctcttgcctgccacaaggtaagttgtgtctttgctcttcctctgccatgattgtgaggtctcccaagccatgtggaactgtaagtaaattaagcctctttcctttataaattacccagtcttgggtaggtctttattagcagcataagaacagactaattaatatactatgtcaaaaactttaaactgaaaaaagcataactcatagttttcctaatatagaaagaagtactacaaatcagtcaataaaaaacaaaccttatttattaataagccaacagaaaaactggcacaggagatagtttccagggggaaaaaaaatacaaatgactcataaacatttgaaaagatggtcaaattccagacacataaaatgaaattttactgagatacaatttttcacattttagacaggacaagttaaaaatgtatactttgttgtgaggatgtagaggaaacaagcactgttatgtaattctgtaagagctgagacgtgacacaatctatgtagagaagataattgaacaaatctatggaaattacatctgcaattaccttaggacaaagaattctacttctaagaatttttcctactaatatactcacacatgcatgaaataatgtttataagaacaaatgactgcaaactacttatatatctattagcaggggactgttaaatccaccaagtttcattcatatcatgaaatcatagccattttaaaaagctctttatgtaatcaagtgacttccaagatatattgagcagtgactaaaagaaggtactgaacaagaggtctataaaagttatgtgtacactatagtctattaagtgttcaacagaattatgtctaaaatacatgaacattacttactgaaaaatactttgttgctgaaaaatgctaaggatcatctgagccttcagcaagttgtaatctttttgttggtggagggtcttgtctcgatgttgatggctgctgactgatcagcgtgctggttgctgaatgttggagtggctgtggcagtttttaaaaataaaacaacagtgaagtttgcagtatcaatggactcttcctttcacagaagattactctgcagcatgagatgctctttgattgacagccttttacccaaatgtagaacttctttcaaaattagaatcaatcctcttaaaccatgccactactttatcaagtaactttatataattttctaaatcctttgttgtcattttaccagtgtttacagcatcttcatcaataaaagattccatctcaagaaaccactttctttgcttgtccataagaagcaattcctcatttgttaaaattttatcatgagattgcatcaattcagctatatcttcaggcttcatatctaattctatttattttgctatttccaccacatgtggaacgacttcttccattgaagtcttgaacccctcgaagtcatctgtgagggttagaatcaacttctcccacactcctgttattattaatatcttgacattctcatgaatcatgaatgtccttaatggcatctagaatggcgaatcctttcctgaaggtttcccatttattttgcccatatccatcagaggaatcaatatctatggcagctgtagccttacaaaatgtatttcttaaacaagacccaaaagtcaaaatgacttcttgatccatggtctgtagaatggatattgtgttagcaggcatgaaaacaacgttaatctttttgtacatctccattagagctcttgaattaccatgtacattgtccatgggcagtaatatttagaaataaatcttttatttctgaggagttggtctcaatagtgggcttaaaatcttcagtaaaccctgctgtaaacaaatgtgctgtcatccaggctttgttgttccatttacagagcacaggcagggtagatttagcgtagtgtttaagagtcccaggatttttggaatggtaaataagcacagtcttcaactcaagagtcaccagttgcattaccccctcactagagagcaagtctgtccattgaggctttgaagccagacatttgtttctctctagctacgaaagtcctagatggcatcttcttccaacttaagacttttgtctacactaaaaatcatctgtttagtctagccaccttcatcaattatcttagctacacatgctgaataacttgctacagcttctgcataagcattggctgcttcaccttacacttctgttatgaagaaaacttatttccttaaacctgatgagccaagctctgctggctctaaaattttcttctgctacttcctcacctctctcagcctttatggaattgaagagagttaggaccttgctttggattaggctttggcttaagggaatgctgcggctggtttgatcttctgtctagaccactcaaactctctatgtatcagcaatatgactgtttcactcctgttgtctggagcatatcacagatatgtaagaaaacccactgtatgccagactttgggtagaggggacatttattgtctcagcacttgggagactttccactcctctctcaggagagagcacagagagtagcctggctgtttatgtgagaatgcaggcaccaaaagcctagtaagcaagtaagatcacatggtcttgcattcaagtcttgtgtaagctatacattcctgagcttttaagaataacagacatgggtcttctttttttatttaaaaacatttttattcttaagagagacaaggtctcattatgttgcccaggctggtctcgaacttctgagctctagtgatcctcctgcctcaacctgccaaagtgctaggctactggtgtgagccactgtgtctgacccagacatgggtcttctatggctgtacactccccagcttcgcctttagatccaaggcctgggcagaaaactagcagtgctgtgaaggaacatacggccagacaccaagccaagtgcctcagggctctgttttccttcctggcttgcccatgcacatttaacttctgccacttcagacctgcctggatcctcagaccaggccccgttaaggtcatacccttatctatccacctgtgctggcaaagtaaactctgctggacttttaccttggaattccgtagtaccggtcaagccacacaccttttcccatgcttcttatatgtgtgaaacaattctcagttacctggcaaacaggagtttttaatccaggggttcatcaaaccaccctagtaggattctgcaagtccagctagaagcagccagagccagctgacagcagtgtgtgcagccctccacacaaacggccatttgcctgccaccaaaagccactttttgcactcaatgcacacccactatggcgagattctttttttcccaggtaccattttgctcaacccacactttcaattccccagcctatcctgaggaaacaaacctaggctttactcccctacccagaaagagtcttctcttcctactcaaactgaaacacaatgatttatatccacatcacatgtttaataaaagagaaccaatcttgattgaaaatcttttgagaagtggtcagcactctcacaattggttgaaggcacttgggctgggtctggttaaatctctattctgggtttgaccctagggcaggtcacatggagctggcaatgaaagactcccataggctgttaggccatcttcactcacagaagttagcaacaaggtccacaagaatagcaacaagttaggagaaattaaatgcatctgtatgtttctaagtgtgtgtcttcatttcctgttttagatattgtttatatctcagatagacatttatatgtatatgtgtttttttctatattagtttaaatatctatatctataaatagttatacataatatttcttatatctctttcaatacatacaaatacatgtatacataggtaaacattcctggtgtatttgtgtgctcattatagtagcacttttaattttcttcaagaactttccatttgcactgataaaagaaaatcttcagccaaattaaatttaaaggtgtttaattgagcaatgaacgattcacaaatcgggcaaaccccagaattacagcagattcacagagactccagcgcagccacgtggtggaagaagatttatacacaaaaaaggggggaaataatgtacagaaattgaaggtgaggtacagaatggctggattggttacagcttggcgtatgcattatttgaacacagtttgaacactcagcagtgtatgattggttgaagtacggccactgggattggccaagacttagctattgttacagctgcatactactagttaggttttcaattctaacaaacaacagacaaaaaaagaaaaaaaaaacaagaaagaaagagaaagaaatacggagtccttctcaggccatatttaatttcctttaacagtgtttccaacttaactaactgctttgtgtaagaggtccagcttggtgcctgtctgtcttggctttcagcatgccttcctcactaagcttaatcacgtctagctttggatttaaagtgagagacctgtgactcttcctttcacttgaacacttagaagccatcgtagggtaattaattggcctaatttcaatatttttttgtttcggggaatatgggggcccaggagagggagaatgacaggagaatggatggtcagtggacagtcagaacacatacaacatttacccactatgtttgctcattgctagaaaggcaacgtttgtgcatccccaaacaattacaacatcaaagatcacttattacatatcactgtcatagatctaatagtaatgaaaacgtttgaaatattaagagaattactgaaacgtaacacagagacataaagttagcacatgctgttaaaaaaaatagtgccttatagacttgcttgattcagggttgccacaaaccttcaatttgtaaaaacatacaatatctataaagctcaataaagcaaagtacaataaaatgaggtatgcctgtgtacgcttttgtgtgttttgaattttgagcctcagaactctaacacttatttagaaaattacatgttacattagcaaaaatcttgtaaaaatgctacctaagaagctctacagtaagtgaaaagttcagaaaagtggaaacttgctaacatggacaccaagaaatactaaaattattttctatatccttgtaagttatctctttccttaattagtctgagtgacataaactttctatatgtatatgtgatagaaacactgtaaaatgaaaaaaaaatatattatttagagactttatagtcacagaagggaatagatgcattattttcaaatgaggaaatatttttattaatagaaaagcaagtcgagtcttagaataaaaatcacatcattaattgacagataaaagactgataaagttcaacctctacttttgattaaatctttcagcaaactaagaataaaagataacattcttaacttgttaaaggttatacctaaaacctatagtaaatagtatacatttttgagaaactgtagaaatattccctttaatattaaagaaaacacaaaggtccctatatcccaggttctgcttatcaaagaaagagaaaaggatcagaatgaggtgtaaatattagaaaggaagacatataattgtcattatttgcagataatacaatcatatatacagagaatgccacacagtcaacaaactattagaatcaataagttttactaggtagctagatataatatcaactccagaaaatcaatagcatttttctacaccatcaataagtaactaaaaaacacagttaaaaaagataccatatactatgataacaaaaactataatatgtttaagaatcaacaatcaagaactcctaagacctatatgaagacaactttttaaaaaatctgataaggtaatggacatgaaaaaactcaacaaatccaggcattctatgatcttggataggatacaatgatataacaaatgtgctatattattattaaattaatttacaaactcaatgcaatcttgtaaaaattctaattggactcctataagaactagataaacttagcttaaaatttataagaaagaataacaatccatgactagctaagatgaaggatggtgacttgcccaatccaatactgaaacagaacaaaaggcacagtaatagtggaattgaataatgagctctgagaaaggccaatgaaaatataaaaatatatcatgtaataaatgttaaattgcacatcaataaaaaagtgatggacagatttgtagatatgttggaaatactggatcaccctatggaaaaaaataaaacatgcaaagatagatttcaaatggatcaaataacaaaacataaaaactgaaactataaagttattaagagaaaatatagaagactatacttgtgacttaagggtggaggacttaagacttgaaagacacacatcataaatcaaagcactgaggaattttattatctaaaaattatggatgtatattcagtaaaataagcagaacacagattgggaaaagatacttgtgatgtcttaaatcgacaaccaaataatatccaggatataaatgcaactcgtgaaaatttaatagaaaacacaggaaccctttctccaagaaacgcgcaggtgttatgtgaacagtcaataaagaagagggaaggcaaaatattaaggagcattggactgatgctccaactcattagttatcagagaaatgaagatgaacacaatgtacagtcatttacactgaataggttggcagagaaataagaaagctaggtagtgctactccagggcagagctggggagctctagaaactcacctgcagctcgggagcatggactagtgcaggcattttgcaaaacaatctgttatacttagtccaactaatctaatgtaaacccagacattcaactccaatttatagtccagagaacttctcacagggccctctgggtgaaagtgtatcagaacatcataggcagtagcggtgatttggagacagtctgctcaccgattacggggtaatggataacaaaagtgtagactatgatgcaaagcttagaagtaatgtgtgaaatgtacatacagtaatctggatggaagttaaaaaaatagtactgattgaaaaaaaaagggtgaagtagaatgagtgataaatgatttatccgtgtacgtttaaaatactcagattaacaaagtaaatttttcctgaacacaaacaaagcagtgtaaattaaatgtattaagtgggcagtggggttggggagggacacgggagcagagaagaaggagataagagggttactcaataaaagaaacaagcaggagtgctttgtgtaccaatgtgattgaatgctataaactgtggcccatcattaactcaactacctgcactagagatcaacagaaaagtcaggttcatctcacctccatgaaataaatcttggagaactatccatgtgaagaggcacctgtttattcatctgcttagagccatgtgtaaacacatgcccctcagtggcaaaccctcgccacagctggtgaatgggaggggaaggttgtggtttatgtgatgcacagtctctagtagccagctgcgacaacactgccttatttcccattgatcagacacacctagggcatctcaacactactgtggaaaatcgtggtagtgggtcaagaaaatctccagggcagatatctactttgatttatttctatctcaaaaattaatggaataaatacttcaaaactttgccaaaagtgcttagacaaagaccagactgtttgtttcaaattgaaaatgggcatgaactgtgaatggctcgagattttgtaatttttaggaagactgtgggctaatttgcaattgaaaaatcacgagagccatttatagaatgaccactctgtattgaatagctatcgctttgtcttctgtacgccccttgcttttgtgaattgtcactctcctccatgttatcctgataggttgccaatcacctccccaactttcttgccataggggtacgtatgtgactttaggaaggacagtgagagcctgccattaaagactagaagtatctccagaccaccgttccaatttcttgaagggactcactagcaaatgaaaataacaaagagaaaagcagtgatgtgagtgggaagggaaaggggagagagggagagagggaggaaatgaagataggcataaggcaaatgccacccctgagcttttaaattatatgaaccatgaaattattctttggattagggtttttttttagttgagtttctatcagttgaatccaatagaatagatatcccacctcaaaacacacaaccagtgaatagcagacctagttgcattcttgatccaaagccaagttaccccctattaacccatggtatctcttgcctagacacaaattccgactggtacaaaggaaccactttggctcctggcacagacatttattgcattgcggggctaagctgcatcctttataggtagatctaagttttagaaattgctcaagattacacctgtggaaaaaaagagaaaacccagattacatctgtggaataaaactgaaagcccttccagaaaacactgaaaggaaataagcatgatgcactatgtatctatcatacacttggttttgaaagcatttctcagtgtgtctaagtctgatttgagccatggcctcctcattaccacaagtaaattgccaccaaaggaggcttctttgaaaagatacagggcacagaatgtggtcatcggaattggactcgattctccccttactgtgtgtataactgggtaatgtacttaacctctctatgcttcaggggcctggtgtataaattggggtaatgatagcttcttcatgcattgtttttcatagatgaaaggtaatcaaacacataaaacatctggaagaattcttgcacattgttgaccctcaacaaattatatatctctttatataaggggtatgttttatggatttatgcatattagacgttttaaggcattaatcctggtgtattgattaaaacatctgccttgttactctatcatcataccctgcaaagagctgggccactcccatttcatacacttccccgtgggctcattcttttagaaatagtcatcaggcacacacaaaaagcaatttaaatggttcatctttcctcttttcatccatagacaaatttcaataattatcttagtcaacccattaattagtctaaatttgcccaagcataattgatgctgcctacactattttctataaaaatttgaaatggatggctaaacagagattttttttgtttgtttgactaagtgcattttccctctatgcaaaatgtgttagtcaatgcttatctggtgtaataagcttagcttttagtgttcgtgtctacatctgtgatagaaagaagtttgaatctctaagttcaaattatgcattggcaatttctagcttgttgacttacggtctgccccttgaactctctgagaaaacctgtggccttacttgttgaatgggggtctggctgactagccctgccttctggaacccttcacctacctaggttttcccagataaacattggtatgactactatacccacatccttgagtactttgttttcctggaccttccccattccttgcttgtttgttttccctagggttccagtcattcttaatccctttctactatttagcaattcctggataatctgactgatctcaaactttcattaccacctatacatgaaggggatgcttctcttatgttaccatcagtctataacaccaactttgctgtgcatcattcttttctaacctctagagaattcttttcaacaggtgctgtgttcctcacagaaactattaagggaataaatatagggaaacctacaacagcataaaagcctcaaggtttgttgctggactcatgatgaagatgagaccagatgaaggaatacatgaaaggaataactttcaaaccagcttcctgagcaatttcagataccctgggaatcagatataggcaaacaatacctccttaacctgaattgggaagagagatggcagatgccactgaagacacatatgaagcacagagcaaaacatccagaagcaaacacaaacataaataaaaattcagaatctaaagatcgatcaatgcagcagaacaatgttacattattcaatagtcttgccataatgggttaagtgtgtgaaaaatatccaatcttatcccaaaataaatgctagatgaaataaagctctcagtgtagcacaaaagcaaacaaaaatgacaccacaatttagatgaatataaaattttttgcacgaaaatgtttttacaatacatcgaaaccaaaaccattaaaaataaatacatttaatcacataaaggatcatattttctcatgatcctaggccatcaacacattcaaaggcacatgtctaaattggaaaatatttgccatgcatagaaccaaccaagattaatgctgttaatacataaactgttcttacaaatcaatgagaaaactaatgagtatccccaaagaaaaatgtacaagggaagtaaattcgtagtttagaaaagaagaaatacaagtagccaggaagcatgaacaacagttccactttgggtatcaaagaaatgaaaattaaaacaataagatttttgatatatgatgtttttattcattaaaatgaaaaatagtctcaggtactggcaggcaagggcaataagaaccgccttgagtagcggtacagtcaattttagaggtcagcctggccctttttagtctatatctctattctacatctaaaatttcaaaatgtgaataagttttcacttggcaactctacttctaggaatttacctgaaagaatcatgtgaacttgcaatgacgcatgtacaacaatgctctctgaaatggtataataatggaaaattggaagtagcataaaattcaatgataggctagctcaaacaaaatctcttcccaaaagagttctttaaatttatttcttcttcctcactatgtgccattctgtgccaaacacacaccagtctttcttctccacacatttttcctttctttctcccacatatgcatttactttctctcagcccattttcactctctctcatttttaccttctatctcccccttccactcacatttactttccttcttactgaccatttttcttttctctaagccatttttgcttttcctctcatgcatgctgtcttcctttctcctttcccccaacactttttctttttctctgtcactgacttttaccttctctcttatatccatgtttacttcattctcacagttaatagttttacattctctctcttgcactttcattttctttcttacacatacttttacttgacctctctcccccacactttcactttctctcccacaccgtgacttttacacacacctttttatttttgttctcactcagttttcctctgtaacccagagaagagggtgaaatgtccagattagagtttatccagtcacggggcagccaggactgggttgagacctgaagcaggaggctgttgcagtattccaggatggagcttagttttttctaccaagcagcagtagcaggatggaggggaaaactgtggatgcagaagacatttctaaggtggagctgatgggtctgagcaaccgtttggtgaatgaatggtagcatctaagatgatgtcaaagtttctggcagggacagcagagtagaaaatgtcaccaaggccgcagaaagtggtaaaaggaaaaggcctgggtgttccttgatcctagagcacctatatctaaggcaatataatctttgcaggattttcagaccaaaaaaaacgttcttgggagaagagaaaagagtccgtaattgcctacagagagtccttgaattttgtttcttcaactgagcaattctccctcttgtatgccattcaggggcatccttaaaatatttttactccaatgtctataatactaatctgtatgtctttgtgtatccaaaaagcacttgtacccccaaacctactgaaattcttaaaaaaaaattctgtaaaacttaagcttcgtgcattaatggattttttaaaatagagctatcacaggataacaaattttgcccaccactagctaaatgctggctgcatcatctctttgcacaatgtcattgacacaattatatccccaaagggcttgcagactctgtgagggcagggaggctgtcctcactgctcagcacaggtcccaattgcctacaagagtaacagcctcttagtgggtactcaggaaatatgctgggatgaataaatatttaaaatctttctcatgttgtcagtcattattgttctgtaaaaactgaaaactgaagtgaaattatggaaccactcgcatttttgatgataagtgcaggcccataaacccgaggcaatgatggaaatcattaagcatcattggaagtggtacatttttagtttcaattggatgcttattggacttaagctggtcaaatttgtgctcaagtgtcaatgaaaagaacaaaattaaagatatattgaatgttggaaacagagctttgaagattttatgtaaaaggtgaggcaagttggggagttattattttttagatttcttgaagcaaacctcctcactccctaccacaaaaagaaaagctaagtcaaccgttccaacacagacatttgacttttatgcaatttttcaggaaagtattgtgttatggagtaggagctgcctgtcccaattgcttatcctagtatttcatctacagagacaggtgaattcttgtcagcagatcagattgtgggaggtgacagacagtccagctctccaatgtgaccttcagaataattcagagcattgctgctacactcctggggacagatggaaatctaatgggtacagaatgctctgggcctggaaggaaggatttaatgctcagagaggcacttggtacatcatccattgtttatcttcatgtaaaagattgtttaattaatcaactcaaagtattcatgctactttcccagggtctgaggatacagtcatagaaatactgataaaaatccctgccctcatggagctgacagtctagggcggccaggtgcagatagaaaatttaaaaactaaataagtaaaccatacagaacgataatagaacatgatgagtacgagagaaaaataaagcagcaatcacggcaggcagtttaggtgttgctagcaagcaactgcaactcccaatagggaagtcagggaagttgtgctaggatgtgttattgttcaatatccattatttcttccactccaagatgactatgcatcccggcatcccggacaccgccacgtaacttatagtccttccccgctggctgaggagacctccttgccccagagacaggaggtttgccatatgacttgttttgacaaatggaatatgagcaggtattgctgtacagaacatctaaaggaatgtacctgtgtcacttagctcaatctcttatgtctatcgtctaccatgaaaatgaaatgtcctagacaagggctggtcctcccacctgcttgtggaatgagaaaacatgtggcgagagccatgcctccagcaagcccacacctaggagggacgtgagcaaggaaaaaacaagtttgtcatgtaagccaatgataggatttttctgttaccaccataaagccgattaatataaaaaagcctttctaagaggtgacatttatgccaagactggaaagagataagatgataaaactgaggcccagagaagtgatgtaactctctcaaggcacacatctattaagcgacaaagactctattgaaaatctttctctctgcgtttgttcacactatctcctcaggcagggacttgcctagctcagatcacaaaacccacagggtcagcaatattttcccatcctggccaattgtatgtacagcctccatccttaagttacttgaggcacatggccctctcctgcaactgaagagaagtgtgactgagtctgcagctgaattcttccatctccttctcatcttttacatctcactagaaccctgcaattagcttgtgagacagggcaggatggtgaatatcaacatctcatatttacaaatgagaacacttaggctgggagctaagcgacttccttaaaatcatgaagtaagtggatattggcggtggaaaccccaccttcctgaaaccaagaatatcactgcatcacttgaatttttatatacttgagtatttgagcatcaattcgctatccctatatatatatatatcccctatctataatagatagatgaagaaattaaagctcagagacatgaagtaactctcagaagttctcacaacttagaagagcagattagaatcaaagatttttctcactccagaacctgtgcatggtatgagccctgtcctctttgtgactttctatgaggatgcagaatgatggctgttggccacgaaacacattgcacaatgttgttagtttaaagaagttcaatgaacattattgcttagtcaattcatcctcaactgagtgacattgctggtgcccagggagagccagattcaatgttcatgaggaagctgcatatcatgatgtgccttcaatcagaaagagctactccgcaccagggtctgagaccaccaccagccaaatgtctaagggaataacagtgagagggatgcgtgtctctctcccctgcacttttgctttgccagacacttttcgctactgggaaagactaacatcctatacatacagaaggcaacccagtgtggcagaggcaggatggttagggttggaagttcagctcttccatggaaaggctgtattgccttaagcaatgacctcaaaggcttgttttgcgggctcaccccacaactcattcattgattccttcattcacttatttaaatgtatattaagtactcattatatatcagttattattctagaccctaggaatacagcaatagcaaccagacagtctgctccgtgaatacctccaaacccttaccactgtttcactctaaatgtacagaatggctactctgctcctaccccttgctctgcaaaaagggcctctgcaactaacacagtagtcccccagatcacaggaggtctcagagccagagacaggtcatgggcaggtagaattcccctagaatctccatccctctgctaatacaagtaaaactgactcataaccccacctttcatgacacccttgggcagcccagcccagacaactctgctaccagaggtcaaactattagcccttctcaccatttttttaatgtttccaggtgagtagaagagcaaatggatccagacaatcaatagcaaggggacagaaagtcattgtggagtagcaacttttgcttgtataaaattgtaaaaacaaaaacaaactatcaagcaaaaatagacatacgaagaaaatggttgagtttcctatgtagagaaaaactggaaatgtgtacctcacctttgcttcctttacctggataagcccaatagcccagctccaatgttgaaattctcaggaaggctggaacagccattcccctgacccaggagacctttcccatggccaacccattgggcaattacaaatagaaatattctttcagttaaatgaatgaattacttgtttaactgaaaggtagttagtattgtcactgttggtgtttgttttaaacttttacattcaggggtataagtacaggtttgttatatagataaacttgtgtcatgggggtttgttgtagagacccctggtgttcatcactcaggtattaaacctagtaccctttagatatttttcctgatcatctcccttctcccaccttccaccctctgaaaggccccagtgtgtgttgttcccctctatgtgtccatgtgttctcatcatttacctcccacttataagtgacaacacacagtatttggttttgtcttccagcgttagttttctaagtttaatggccttcagctccatccacgtccctgaaaaagacatgatctcattcttttgtatggtacatgtaccatgttttctttatccagtctaccattgttgggcatttaggttgattccatgtttttgctatcgtgaatagtgctgcaatgaacatacacatgtatgtgtgtttataatacaatgatttatattcctttgagtataatcgtaatggggctgctgggtctaatggtatttctgtttttaggtctttgaggaattgccacaaaaagtaatctcatatactgttggtgggagtgtgtattattagcccagtcactgctgatcttgacaaacccataaagaagaaaatggactcacacggcacagaggggtatctcaaacccaactctactaatctcaaacccaactcaccctcatggattttccgattcccatcagtaccggcttagagttactcttctgacgaatattgcactgatgtaaccaccgacaatacagccacgtgcatttaccttaaagtgttgctccatgccagcttgtggctgatgcaaagctagctggccagaaataggatccttgggattcacgccagcttggggatcaacatccctaagactctgaacagaattctccatgtgaaggagttggacacactgtgaccaagatggaagctttcatgtgtcgactggatggtccccatcaaggctgtgtgagttttctgggtgaactccatgaggacaaacaccccaaaatgaggccaaaggccagatgttcctgcacggtctttccacagtcctaataatatccttagtgcttattatgaactatgggtgattatgctgatggaatagaacattgtagaggcttaaatctatataaatttctgcaaaattctgccctttgagcaggatttaatgtttaattccatgctgcctgatctgtgatgtatacaaggattccaagttataccattcacctgaaaatctgcaaaccaccctggaatttgtcttcatcgtctttctttttgtggccccagagaccatagttacagggaagcaaggctagatgggggaagcttctcgtcttagcaacatatgtaacttatgcaaagcagctagtagagtcctggcacccactaggtgagcagcaaacctgttttcttgtctctatgccatacttttgttttccaagaagttcatttgatagatttctaatacattccaagtttctgcctcacgatgtctaaaggcatgccattactattaaaggagggacagtaagtgaccagcaagagaatggaatgattaatctagagtctacagggcacggcatgacattatagtctcttccattgatgctctttgacccctgacttgaagaagctgggctctgagaagggagaacaacttggtctccaaacatctctgctgatgctattctaaatgcaaagaaatgtcaaagctgaaataaccataatgcaattgtacttagcctgtttgctgaaatatcagtcattgctttgcacagcaattccatttttaaagttcattgtgctagaaaaatgttgcagctccttaattcttacgttctcatccaagccgggtgggaggtgagaagtttttgaactgtatgaaaatccatatttcagcagcattaccgagctctctttcagcatcctgcacattttctcttccctgaacccagagaaatctcccacttccatggcctgccctcattttgacagcaaacattaaaagagcatcggcagaagcacagatgaaaaaagaacaacacagggttgctgagcacccatcctgttgtctgaggaggaccaggctcactgggaactctgggttgagtctggttcgctcaacctctaagggtatcaatgactgatgttctggaagccgacttctacaggttgcctcaatgggctcttggtttcgaacttctggttatattcagccaataggaggtacaggcatgggattggagaataggaggatggcgaggttgggcagtgattctctccctgcttttccatggtttgtacagtggctacattctcctacagcagcatttctcaacctcagttctattggtatttgaggccaaacaactgtttgtgatggagggtcatcttgtcttgtgtgttgttggatatttcaaagcattcctggcatctactcactgtgtgccagtagcacactcgccaggttgtgaccaaaatgtgaccaaaaatgtcctctgggggaatattgccaatttctcatagggagcaaaattgcctcagggtacatctctatagacggccctttcatttaattcccactgctaacccattcacaatgctctctgcaagtagctgggaccccaaggtaagtgaatactagtatatgtggtcctcaatatggattctctttgtatgtaattggaggtgctgtgtcctttagcagactgcaagccttctgagggcagtgactagggctcccgcataaagcacaccccacccaggaggcttcaagcacaatgtggccactggaaggaaacacttctaggtgctgctagaatcccaggggctttagtgaaactctctctttcctggattcctcctcagtggaagcagaatacacagggacactgctccctccactctccacccccagcctctttttataatgactcttcctgtctgtgggctacttcctcctggggaacagaaggtctaggaggcctctgaattggcaccagcgccctgtggttaacttgtgtctggcagcaaaagctgctggtccctaggatgcagcaatcacctctaaatgaggtctgcctttgctacatttaaggactgtaacaattgctttttctcccttggaaatataaccttagagatgaactgctcttgattcagtaaacgtctgtgccagtttccttagaggctaccatgagaaggtactagcctccttccacaaactcaagaggaaagcacaaacctgcaatcattgcccattttcctaagtccctgcatagggctgaggccaagggcagaggctgggccgggactctagaaggcagcagggaggtgtgttgggtctgagttgtttctggattgcaagtgtcattgatgcatatttaataccaatgacactgctctgctgtcactatcagtgccccatgcaagccttggggacatcttaaggaaaaaactggcataaatgatcccataggtgtgtccctgtgaagctgtgtttaaagttctcctagattatatttagatcctggcatggcttctccagttatggaactgtgtgtactgctgtttggttcttgccaggtctggtttttcatggagtcagggtgtgggcttagaatgctgatctccacacttggtcatgctgcttgcctttgccaagctagatgtgctaaaggagtgagggatcaggagaactctgttcctggcccccagtaagcaggtgctgccagttcacactgacacgcaccgctgaagagcataaaactataaaatggagtttctgcctcagtttccacatttgtgctagatttctgttgggactgctgcctcattgactgtaaccctcatactggctgttgttccccccaaaaccctctcagggatggaacctagagctagctgtacctccatccgattggtgatggaggaaatcacagttttattctcccctggctccagcgttgaaatcaggcagccttggtctaaaacattaactcagagccagtcacctcaccttctgggtttcagttgcttcgtctgtaaactaatgttgaatattttaatcctttcccactattttcttctgagctgtaatttgcattcagtaaaataaacaaatcttaagtgtacagcctaatgaatttctatacattcacatacctgtcatccaacccaatatagagaatacatttccagccctccagaattatcttgttccctaacctaggtaatgccacacccccatagggaaccactgttttggagttcatcaacatgagtagttttgcctgtttgtgaatgtcatatatatggaatcctacagtatatactgtttgcgtccagctttgtttgttcaacatataagttttgaggttaattcacattatggagtgtacagatagccagtccctttctgttgataaatagtattccactgtagcagtacaatacaacaatgtatccattctactttggatgtcatttgggttgttttcatttggagactattacaaataaagctattaccaacattcttatgtgggaatgtttatagaaatatgcattcatttctcctgcgtttattccatggtccagtaccagggatttaagcaccaaaattcattccacacttaagttcctcatcagcacattttgatgcccagaggcacctgaggctcagcaggttctacatggagtccatcaccctcatcactcagccctgacaatccctccaggctcagggctaaacatctcctccagggctacaggccagccatcctcagcttctagtgctttgaatatgccttattctccttctatcttcctggccttcagaataaattaaagtcagatgattacatcccctttatacagaaatatattctagaaagattaaaaactcgaaggcaaaacaaaacaaaacaataaaagtgctagaagaaaatctgaagtatcttttcatattcttgctttggttgcctaaaagtgtaataaggttaaaagcaaggaagaaagactgaaataaaaattaaaaacatctctatataaaaagagtataaagaagacaaatctgttaaaaactaaataaatttatttagtttattctttactactaatgtgtcgaaaaacacatattatccttaatacgcaaagggctcttgcaaaataataagagatgtgtaaagctccccaaagaaaaaaatgcataaagaagtagcaactggtaatataaaggtccaataagcaagaaaaagttgctcaacataatcaatcaacaaagaataacacattaaaacaagctattattttttactaatcagattagttttcagacaattgatggttttgggaaattagacctctcatatgctcttggtagaattataaatcaatacctcttttccaagaagatattcctatgatgatcaaacaccatataaatgtggccaagtaattcaatttctaggaagatgtcccaaggaaatggttgtatatatacacaaagatatgtaccagcctgttcataacagaagtgcataaaaatttaaaacctgaaacaacccaaatgcccagaaataggaaaatcatgaagtaaagtagggtacatacatataatggaattatatgcagccattaaggtgattggataaatatgtctttatcatggagagctgttcatatcctttttgagagactgaagtaggttgcaaaaaataagtcaagatatgattccattattgtgcatgtgcgtgtgtgcacacacatgcccacggcaagtgtttggaaggtgttctattcagggtaagtgaacctcagtaacctcaaagatttaacacaagaaagatttctttttcgctcgtgtcacagtcaaaaatgaatctgcagggtggctctgcttcactttgtcattgaaaagcccaggctccttctatcggtggctccactgtcccaaagagtcttgaagtccccctctggaccctctgtatctcaccatcagaagagggaagaaacagtgggggtggggtgtttacagggccagggctggaggtgactcatttcttcccaaataccactaaaacataaccacagggtaacccctaactgcaaaggggctgagaggtgtagccttgctgtatacccagcaaccgcctagtctccttcacagaaagaaacagcaaaattctaacatgattaggtctggctagaaatatttgggatcaactttgctttctcctttcactcttccacattgcccagacttttcccaaaagatgtgggctacttttagaataagagcagaaaagcccaatacagctattgccagccttccatatttgcaggttctgcatctgcagattcaaccaatcatggactgaaaatatttgaagaaaaaacaattagaaataacaatacaacagtaaaataccagcaaactaacacaggaacagaaaaccaaacaccgcatgttttcactcataagtgggggttgaacaatgagaacacatggacacagggagggtaacatcacacactggggcctgtcaggaggttgttggggggacaagggaagggagagcattaaggcattaagacaaatacctaatgcatgaagggctcaaaacctagatgacgggttgatgggtgcaggaaaccaccatggcacatgtatatctatgtaacaaacctgcacgttctgcacatgtatctcagaacttaaagcaaaataaaaataataataatacaaataaagaaatacagtaaaacaactatttacatagcatttgtattgcactgggtgttgtaagtaacctagagatgatttaaagtatacaggaggatgtgtataaattacatgcaaatacgacctcattttatatgaagaacttgagcatccaagaattttagtatccaaggagggtgccggaaccaatctcctgaggatactgagggtcaaccgtatttccattctgatggctttgcagaggaatcagacagtcctccactgtaaatcaagctgcaattagtgccctggtgttctggcgccccgggtccttcgtgttagagctgggacatgaagacagcacccgagaagaagggggcctgaaatatccctggctgcccttcacatctcaaaagacacagacactagtccccaaggcagctcacagcccacccacctggaactttctccatgcctgggaggcctcaaactgagaagcaaaccccacgttgctgtgtgacagggcctgcttctgtccgcctaggtgcacaagtgcatcccaccactcagaggaatactccccacaccaccatttgtcactgtcagcccagggagcaattatattccatccggccagaaataaacagacaccagcatcacacaggagatgacaggcagacacactgcctctgatgcacacacgtttttctcatgcccagctgtgactgagcctctgggcacagatgcagcccagagcctggtgggaaaagcaaatcaatgagggcccttagaggatctcgtaagctctctcaccacttgctcttttcaggtagaatgaacgaatttggggaaaagcctaacttttaaattaaacagttgtaaaacttctgataaaaatgccattaaagaaatttatgagattaaacacatctctatggcttctcctgcagatcagcctgtgggtctgaaggcctttggatcaaggggatgagcgcattggtgtgggagccggggcagggagtggggtttgagctcctgcagcactgcttaacagctgtgcagtcccagctgggtcctgtaaccttcctgccttccaaagggcaatattaccacttgcccttcctccctgcttttattaatgcaattttctctgcttcatatacactcctacatcctccttatggcagagacgacttgctctctcccaaattcactctcaccttccatcacacagggctgtagctaggaagcagctactcagctagagagtatatttcctaccctatgttggctatgtgtggcttcaagacaaggcttttttacattgtgcacatgtaccctaaaacttaaagtataattaaaaaaaaatagattcaattttatttatttattttctcttttgagacagagtctcactctgtcacccaggctggaggtctgtggtacaatcatggctcactgcaacctcaacctctcgggctgaagtgatcctaccacctcagcctcccaagtagctgggattacgtgtgtgcagcaccatgcccagctaatttttgtatttttcatagacacgggttctccctttgttgctcaggctggtcctgaactcctgggctcaagtgatcctcttgccttggccacccaaagttctgggattacaggcaccgcagccagctgactttaacgtttttaagaggagctttaggttcacagcaaaactgagcagaagattcagaacctcaagactagttttcaccaatgaaatgggaacagaagtgatggctgtgactcccaggccctgccctaaagtgccttgcaggtgttcctccaggcacattctctctttcagcttgctggggtggaaatgagcaggacaaacttggaagccatgcactgaggatgtaagtcagggctgctgtccacctaggtgaccgagtgaccaagtaaaggactattgctcctgttgccaatccaacataccacactgaatgcaatgaggtatctttgattgcatcctggaacagaaaaagcatgtaagtaggaaaaaaacacaactgattaaacctcaacaaaatctggtgttaacagtaacccacaaatgtgccatggcaatgtaagttgttactatttggtaaaactgaataaagagtagatggggactctctatattatcttcgtaacttttccatgaatctaaatttattccaaaagtaaatgtttattaagaataatttttaggcagggtgtggtggctcacacctgtaaccccagcactttgggaggccgaggcaggtggatcacctgatgtcaggagttcgagaccagcctggccaatatggtgaaaccccatctccactaaaaatacaaaaaattagccgggcatggtggcaggtgcctgtaatcccagctactcaagaggctgaggcaggagaatcacttgaacccaggaggtggaggctgcagtgaaccaagatggtgccaatgtacttccagcctgggcaacaagagtgaaactccatctcaaacaaaaaaaaataaaagagagagagagagagagaaaaaaaacgatttttaaaatagctgtattgagccattgtgcctttgggtctatttattactgcagccacgcctaccctaacaaatgcacttctcttcacctgtaaagctcctagtcacattttaagacttggctttgacattatctccattaagaagcttcctgtgattaccagggggtgaggtactgtacactttcttcctcgatcacacccaagagaagtaactcatagaactgcctatttcccaagccacattgaagtcttccttgagtcagaagccttgtctgcttcacagctacaacattcctcatggtgttcagaaatatttgtccaatgagttaatgccagcctcacctatttgttgtgaacattcactataccaaccagaataaaactgcttcattaactctgaagcactgcacagatgtaggggatgattaatcagttgcaaagtatttattgaacaacagacctgttttataattgtgatatattttcctggtggcctggagtgtatgcattgatacatggcacttggtctcatgattctgactgtcttaattagtattgatgaggcaaaatggcttaaatagtcaattcaatgccatctgttgaacacccaaagaccaaagacattataggtgtgggtttgcttttttttgctttttttttttttggagacggagtcttgctctgtcacccaggctggagtgcagtgacacgatcttggctcactgcaaccgccgcctcctgggttcaagcaattccctgcctcaggctcccgagtagctgggattacatgcacccaccaccatgcccggctaatttttgtatttttagtaaagacagtgtttcaccatcttgggcaagctggttttgaactcctgaccttgtgatctacctgcctctgcctcccaaagtgctgggattacaggcgtgagccaccgcgcccggctgagtttgcgtttcttgaatgcctactggctgccaggcaaacatgtgttgggggctttcactcctattatttcactgaatcccagtagtgaaatactccaacgttggtattattatcctccactttacaggtgagaaaattgaggagcagagagaacaagtgatgtgtttaccactgctcacttcgtaagtggagctaggtctccgaagtccacctataacctgcttcttttcaaaacagcatcttgacatatgattgatcgccaggctgtgctaagaactgtcataaaaataaattcaatttcttccatgcccctctgggttggctctcaaataaaagctgaatgccagaactcaaacaaacttccataaactgaagtccagttgttgaagctgggacttggggtcagaggtgaccctcctggcctacagagagctgtctgagctgctaaacccaggatgcttcaactgtcctggattcatctgggaataagaattatttcggctaggcacggtggctcatgcctgtaatcccagaactttgagaggctgaggtgggtggatcacgaggtcaggagttcaagaccagcctggccaatatggcaaaaccctgtctctattaaaaaatacaaaaactccccaggagtgatagcagatgtctgtagtcccagctacttgggaagctgagcagaagaatcgcttgaacccgggaggtggaggttgcagtgagccgagatcgtgccactgcactccagcctgggcgacagagcaagactccatctcaaaaaaaaaaaaaaaaaaaaaaaaaaaaaaaaaaatatatatatatatatatatatatatatataatttcaactttcatgccatgccagtactgctctaagtattttacacagcatagctcacccaacccttacaaccctaggaggagactactatgattccaatttcaaagatgataaaataggctcagaaatgttagtcaaaagttactgtgagtaaatacttcactatgaaattagatgctcaatgtctcctttcccaatagactgcaagccatttgagggcagggacagtcctgccttattcttcttcgtatctaaagtgtacatcacagagtcctgcacgcagtagctgcataataaataattgttgaataaaggcatgaaatgataaaagtcatacaaaatttggggagccacagaatctctggaaggcctgtaatgaatcaactaatgattgttgctatcacgtgaatatcagccaaatgcctgagtctgcaccctgtctataaactcactcctgcctgctcctctccaccagcctcaccctcaccagtccatgcactttctgagagcacccagggaggcagaactcctagatgccaaatgagaatgggttccattcagagctctctgcaccagagccatgctatgctccaggcagaaagaggcagagggctcttagcctgattctttcacacaagatcacttggccctcagttagcatgacttgtgttcaaggtctcaaaagttcccccaagaagacgtttatcatcatttagccacatttatgagctaaataaatgttcatttatttatttgtgtattcatgttgtatgtcactgatattttgtgctcggttccttacatagcaatagctgactattgcaaactactaagtctatgttacagaagaagacactgaagaccagaaggtttaagtaacttgcccaacattttatagaaagaatgaagctagtatataaatttaggtctgtctctaaagcagacaggcttctgctaccccacatggctccctctgtcctttggaaggacatccagtccttatacctggcaggacagccagtgtgtgtcgccagtgtgtgtcgtcagtgtctggggcatctctcccatctgtacctccttgacagtagcacaaaggtgacccttggacagatgctgtactgagtcaggatgtcacacctggaaacccgccgtgtccctgctgagtaactacccttcactccagagctctcctcggcacataaggatattcctcactttaatgtgtaaatgccattccaaatcagcaaccaaatccaccagccaggggagctccaggtgattaatgcatctctcaggtagtgaaaaccacttaatcttcagctgcaagtttctgactccaccaaacacagatctaatcgcccacaaatgcactgcctgatgggtctttattgcttaattaccaaggtgagaggctcataattaataagccatttactcctacatttagatgtctccagaaaatgtagccaaagattttccaaggaaattcacattatttgtcatctttatatctcttggtacctgaattggtcacctatctcattggtttctaaacttttctgcctacaactaaatatgagagggagagggaaaaaaagagacaggaagaggagagagaagatttcccctcttcctcctgactctatttttcatttataaagacccttgtgatacattgggcccacctgaataatccaagctaatcttcccatcacaagatctttaacttaattgctttaattaacttaattaacttaatctataaagtccttttttgcagtgtaaggcaacatattcacagattctggggattagaacacggacatagacattttttatcgggggtgggggtgggttattctgcccaccctaatgttcagcactgcaacaacctaagccccccacagaagaaaatggttaaataatctctccccacacattgcatgtgctgccattaaaatgcttataaagaactcttagaacatggcccatgctgatgctgtaatatttggtagaaagctgggcaaatttcaaaagtattacgctttgcataacaagtgtaaaaagcatgaacaatgatgaacaaataagatgacagggaaataataattcctatttattgtacttggtagttgaatcatgtacacttatttgtttctgtctgcatttttctaaataggaaagaaggatagagaagaggaagagagttgaagatgctgcattgctcgaggaagaggccatgagccaaggaatgcgtacagcttccagaagctggaaaaggcaaggaaatggattcgcctctagatactacagaatgcatcctgccaacacatcaattttagcccagtaggatgcatttcagacttctgatctccagaattgtaagataataaatttgtatgatttcaaaccactacgtttgtggtaatttgctacagcagcaagagaaaactaatccaagtgcccttgtgaatgaaactgttcacgtagttcagatttctattacaacagatctctagaagtggaattactggatcagaggatgtgactgttttgagagctcttgactagatgttgccaaactgctatccaagaaggctgaggggcaactttggtagatgatccaggaagaggaccccaacccccactgccccggggcagtcattcacttctttccatcttagtttcccacacccttgtccaagccatgccctcacctcccctggaaagaatgccccagccccttcactggtcttcccacttcgcctcttggcagccacagcttgtgtcccacatatcagccaggagaatctcattaacacctgagttagagcctggtgctctcctgtattcgtttgagctgttataaccacataccatagacagggtaatttattagcaacagaaattcattgctcacagttctggggactgggaagtccaagactgagactccagaatatatgatgtctggcgagggtctgttcctcatagatggtgactttatgcatgctcacagggcagaagaggccgggggctccctcaaacctcttttacatgggcactaatcccgttcatgggggtgggatcctcctgacataattgcttcctaaaggtcccacctcttaataccatcaccatggggtttaagtttcaagatatgaactttggggtggacacaaacgttcagaccatagcacatccttcattgttttcccattactctttgcataaagaaaactatccctgccctggcctctgctggccaccctctggcctcaccacccaccaagaaccctcaccccttaccttctctgctgtggccacatgggtcttcccccagcttccacccacaggccatgctctcatttactccagggccctggcacatgcctggaatgctctcctcacattcttgttggccccaacatctctcccttgtcctttcgagcccatataaaatgcacctttctcaggaaagcccccttcacctctcaggcaaggtccacttctcatgcattcccatactgtattcttctccttcatagcactcatcatgattacaattaattaactttttaattagttgtttagcttttaatcaaagtttggtatctatccaggaacttgcacatagcacaatctctatgaactttcacaaactgaacacacctgtgtaaacaccacctggagcaataaaacattctctgccttctcgggcatcccagaagctcacccatacctcttccagttactaagtcccctaaggcaatgcctaccttgacctctaacactagagataagtttttgtttttttttttttttaacatctaaacacaattgatagccttttttttttttggcatatatgtctccattaaaatataagctccataagagcaggacccatgtctgttttgtttgccatcctattcccaatgtccagcaccttagctcaacaaatatttgtcaaattacagaatgaattaattaacaactaattaatgttgtaggaattgggcaacaaggtgtaggaggtacagtgagcagggtgcccacaggaagatggaagtaagagaaacaaggtgcatctagccaaggaggggccagcaggaaggtcaaaggaatgcccctggctgcacaagcccagcctgcactgggcaaggcaagcaccctggccactaggggccttccacagtggcatgagtccaccccccacccacccaacctccaactccctgcccatgatggtctggataagatacccttcctccatagataggagcttttctggaaggacacaagctgttgagctccagagagggattgtccttggcaataaagagggggcattagacagtgttgtggtgagaataagctggcatctgttggtctcagactgggagaaattgtagcctgtagcccaagtttgaattgaaggacactgactgggtgactaccccatgatctaagttctgatttcaccagatcctgcttgcctccctactttccctccttccttccattcaaacttctgtccacacttatcagagcaggttctcctatgtgggggatgatacaaccccgttatcagcacagtggtctcaaaatggcaagacggaccctttctttctttctttttttttttttttttgagatggagtctcactctgtcacccaggctggagtgcagtggcgcaatctcagctcactgcatgctccgcccctccaggtttaagcacttctctgcctcagcctctggagtagctgggattacaggcccgtgccaccacgcccggttaattttttgtatttttagtagagacggggtttcaccatcttggccaggctggtcttgaactactgacctcgtgatccaccacctcggcctcccaaagtgctgggattacaggcgtgagccaccgcacccagcaagatagactctttctatgcttctgactgagggcagtttgggctcccaagttggagaagcattgagcctgcctatgtgggttgcagagccaggcagagcatttgacatttccggttggagggccatggcagccagtattttatttaaaacactcagagtttacagtcaaaaacccgtgagtctgaacaaattctttaactggcaattccctgcaaagggctctgcagtttgcactatttcaatcatgtgttcaatcaaaagggtattggagacgtaactgtacattatcactattgacatttcccagcctactccactttggttaaaaagaaagtgtccaaagatgccacttaataactttgggtatcatgaaaatgtcactttggcaagcagaaaagtggatttacacacccaccaaaggtgacctgcttagaaagagacagcagggattgtttcctggcctccaaaagagacagtgcacccaatgtccctgcaagttaccattgctccaggggatggagggagggagaggaagaacaaagggcagtggcagcccaggtgctactcagcccactggagcaggctcgggtggacagaaaggcttctagggcttcagcaacaaagctggggtgggggtaggggttgggcgaagaaaggtgatatggtttggctctgtgtccccactcaaatctcatctcgaatggtaatccccacatgtcgagggagggacctgttggaaggtgattgcataatgggggcagtttcccccttgctgttctcatgatagtgagttctcaagagatctgatgggtttataagtgtttggcagctcctcgtttgttctctctctctcctgccatcctgccatcatgccatcatgtaagacgtgccttgattccccttcatcttctgccatgattgtaagtttcctgaggcctccccagccatgcagaactgtgagtcaattaaacctcttttctttataaattaccctgtctctggtagtatgtttatagtagcgtgagaatggtctaatacacagggaaaaaggaccgactggtgcaaagctgataaaatgactgcatccggttctggagtcccagatgggggtaacacacacatagaaagacgcaggaaggtgggtcccagccaagagacccgtcccttggtcaaggtgatggggggcagcaagtgatcctgtggcccggtgaaagcaaggtcaaggttttggaaggaccgtcaagtgttagcagagctacagctggacagagaaggaagaagaggggccattttcccagaggagaaggctgtgaagagccagccaggcaaagtggcagggctcagttaaaaaccggtagaatggcaggctgaggcatggctgcaaagactgggttatccccttctccacttcctgggtttccatctcagcaacacgcaccaacctccacaatctaggtggcaacctcaaatctttctgtaacctcacttcccacagtgctttgcacctaacccaggggcagacaaatattttctgtaaaggaccagacagtaaacattttaggctttgcaggctctgtttattggaacattcaccctactcaactctaccgttgtagcgtgaatgttccgagaaaacttacaacactaggcagtgggccacatttgatgcatagaaaactgcttgccaacccctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctggggtaagtgcctgttggagcatctgcatgagttctccctcctgggcctttgtccctagataatctggcaggggcgcactttctctccattaacaattccacccttccctctcctcattttgactcatctcagtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcggtgagtcaatcaattaactctctctcacaataggaggatgaagctcagagaatatccaattggccatccttccccagaggccagaaaatgctgtggcttgagttccctggggctttgcctgccctggttgggatggctttctgccccagagttctctggaacttgcaagtctggagttttctgacccaggagttatctgtgtcagaaaaagaacctggctttcagaatcttctgtgtattataaggtggactaaggtttagaaagacacaaaggaactaatacgtttacacattttcctgggtaaaagcataagtaaattctcaatcatcttttctttagtatgattattcatttattaatttcttcacttatttattcattctacaagtgtcccctgagctcccaaggggtttctgcccctcaactagctgcttcatccacagagatggctggtacccaattcttgccttaccgtcagatgaggaagacagtccattttgatacagtgtggcaaatgctatcataaatgaatggtcagggacaatgtcagggagtaaaatgagggagagtaaaaatgacaataaagtacacaagaaagttcaggtcaagcagtattttagaaacaagtagacttaacaagctgaaaagaaaacaggccattaccaaggaagagtatatagaggcagttaaaaataaaagtagataggtcaggttaatgtcaacaatcgctataacagaacagtaaagaaacatcaggctctttacaaaattggatcacagaagcataatatggtttgcaaggaaatcaactagcattaaaaagattcactcccccaaaatggccatgcaggtgccagttttggccacacctctgcacaaggcggatgagcaaacctggtgggagggatacatcgcagaagccagcatgaaaggaccaccaggctgtgctgcaggctcttccaagggaggggctaaggggacacagacggagacccaggcatgcaggtttgagaacactggaaggagtgaaacctgttgtttctctcctgacctggatgcaacagagtaaataagatgatactgcagactggggatgtttagctcctctcttaatgaaactgcttcaaagaggtcgggggagtattcccttggcagtgattgtggttaaactgggctaacggtgactgcctagactgctttctccatctagttcggccaccacagagggtcagggctacccagactaccggccagggaggaaggagatcaacagcacggagatgtgtgtgtctcaaattaaaaatggtctggccagatgcaggcactggcatgctcagggagaagcagtctaaccaaacaagagaaaaaccttcagacctgagcaaggctgtgtgtgtgtgtgtgtgtgtgtgtgtgtgtacaggcatacccagtctaaccaaacaagagaaaaaccttcagacctgagcgaggctgtgtgtgtgtgtgtgtgtgtgtgtgtgtgtgtgtgtgtgtgtgtgtaggcatacccacatgtgtgtgaattcccattaggaggtgggacgctagcaaactggaaggcagagcccatctgaccctgagatcctcacactcatgcaaccttaatgccaagacaaactgaatggttgattgtgtcaactctcttgttttagggatgggaaaacaggcccagagtgggaaaaggagttacctcgagtcaaccaggagagtctacgagttgagattaggattgatccctggcctttctggaagcacactaaccagggattcactccttttgcttccaggacacactctattatttaatcctcatctcaatctcccagtgcagggtaaatggagaaaattatctccatgttaagagtataaaagctgaggctcagagacagtaagtatttttctgagggtcacagaactaatcatggtgcagatgtgattgcaatgaaggcctgtttaactccaaagcctttccactgtctcatgttgtctaatagatagccagcaaatgtttcaaacttaacatgtttgaaactgaactgctgatcttccccaataaacctgctccatcgacattcttccccatctcacttggcagcaatctcatccttccagttgcccaggcctagactcctctctttttctcacttccactaccaatccaccagcaaatctgttggctggatcttaaaatatatccagaatcaaaccatttcaaccagctctccctttgcagatgtcaccatctgccctatctcggatctgcaatcgcctcctacagtctattctcagctctgtagctggagtgatcttcttcttatgcaagcaactcatcttactctctgttcagaaccctgcaacagcttcccatttcatgcagagccaaagcctaagcccttacaatggcctttgagtcttgcaagttttttttttttgggggggggtcggtttttattatactttaagttttagggtacatgtgcacaatgtgcacgtttgttacatatgtatacatgtgccatgttggtgtgctgcacccattaactcgtcatttaacattaggtatatcttttaatgctatccctcccccctccccccaccccacaacaggccctggtgtgtgatgttccccttcctgtgtccatgtgttctcattgatcaattcccacctatgagtgagaatatgcggtgtttggttttttgtccttgtgagagtttgctgagaatgatggtttccagcttcatccatgtccctacaaaggacatgaactcatcattttttatgactgcatagtattccatggtgtatatgggccacattttcttaatccagtctatcattgttggacatttgggttggttccaagtctttgctattgtgaatagtgctgcaataaacatgcgtgtgcatgtgtctttatagcagcatgatttataatcctttgggtaaatacccagtaatggcatggctgggtcaaatggtatttccagttctagatccctgaggaatcaccacactgtcttccacaatggttgaactagtttacagtcccaccaacagtgaaaaagtgttcctatttctccacatcctctccagcacctgttgtttcctgactttttaatgatggccattctaactggtgtgagatggtatctcattgaggttttgatttgcatttctctgatggccagtgatgatgagcatttttttcatgtcttttggctgcaaaaatgtcttcttttaagaagtgtctgttcatatcgtttgcccacttgttgatggggttgtttgttttttcttgtaaatttgagttcattgtaaattctcgatattagccttttgtcagatgagtagattacaaaaattttctcccattctgtaggttgcctgttcactctgatggtagtttcttttgctatgcagaagctctttagtttaattagatcccatttctcaattttggcttttgttgccgttgcttttggtgttttagtcatgaagtccttgcccatgcctatgtcctgaatggtaatgcctaggttttctcctagggtttttatggctttaggtctaacatgtaagtctttaatccatcttgaattaatttttctattaggtgtaaggaagggatccagtttcagctttctacatatggctagccagttttcccagcaccatctattaaatagggaatcctttccccattgcttgtttttctcaggtttgtcaaagatcagatagttgtagatatatggcattattgctgaggtctctgttctgttccattggtctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaggaaagtcattggtagcttgatggggatggcattgaatctgtaaattaccttgggcagtatggccattttcacgatattgattcttcctatccatgagcatggaatgttcttccatttgtttgtatcctcttttatttcattgagcagtggtttgtagttctccttgaagaggtccttcacatcctttgtaagttggattcctaggtattttattctctttgaagcaattgtgaatgggaattcactcatgatttggctctctgtttgtctgttattgatgtataagaatgcttgggatttttgcccattgattttgtatcctgagactttgctgaagttgcttatcaactaaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccgagtcttgcaagttcttgtctccaggtacattcctgacttactctcctcccattttctccttcacacactcagctctaggccccctagcttccttgctgttctttgaacattacaagcatgctcctgcctcagggcctttgcaatggctggccgtatactagaaagtcttccctcctcccttcttcctccacccttcatgatccacgcgactaaatctctctcatctctttcaagtctttgtcaatatatcacttcctcaatgaggcctactctttaaaattattaaccacttctactgcaagaatttccaatctgcattctctctgctgcgttttctcttactaccttttagcataccatgaactctactcatttattatgctaattggttattttctgtctcccacatgaaaatgtaagcaccatgacggaaacgatttgtttcttttgtttattggtgcatccaaacctagtaagcagctgacacatggcaggtgctcaatgaatatctattgaattgcactatctctctaattggtggctgcataaaaaaaaaaaaaaaaggcttaaactcacaggagaggaaatttttctaagtcacaaagtcatttttttaaacattactccatccctaagtcttccacagaaggagctgaatgtgtaattttgacaaatgagtttgcatagagaaggaaataaaacatggaatgagactatgaaaggagttcttgggaagagaaaattgcattgcctttaagtaggaaaaggaaagtaatatttaaaagcaaagatgtttaaaacatcgcaattgtaggtagaaataactcagaggttgaagggggagggtgctgcaagatgcagtggaattctttcttatctgggctcctgcctaaagcattactgggcaattgacaggccaaatcaataagcaacttaaattctggtctaaaggaataactgaaatgaatgcacaacagcacagggaaacaaatcggcacttggaacaaaaaaggggctggaatgctggctttgactggcttgttcaccccagtgaaaccagcactccaggttacttgctaagtgctgtgatgattataataatggtggctttgtggggagagtgtcagcgcagccctctttccctcctgggtcccagtagatggatctgaatctggtctgttctgtggagagaagagaggagggaagcacctgtcttggtcttgtctgcaggctccctttcctggggtgtgaaggagctcctgcaggcttggtgtggagggctggtcccaaaggcaaggcctggggtggaggcccctggggagaagagaatgaacctcaaactcagggttggccagacgaagctctgaggctagaggtggaatcacaggctggaacacactgtccagaattcagatggacagagacaggatcacagcaggtcaccaacgaactggaaaaatccaagccacctgggctgccacctatagttgtgcacaaaaccacaggtcaagggggtgagtccgcctgaaattaaattagcctaggggccactatccctcacgtgggttgagccagttcagagggagggacatctttttgcaatctgttcacaaaaagaggttaccttttcaaaatttgcacagagactccccaaactctggcaactgtggttatctgtgatcaccctttagtggtttgttttgtagagtcaggcatgctctggtcaagagaagctgcaggaactggaagaaattaactctgatcttctcagagctcgcccaaaaaactggacctatagagaaacctatggaacatttcaggcttccttttcccaatccaaatttgagctacagatttgagccccaaattaatccccaaatggttctcctactgattcgttcatttcgttcatccaggtattcacagggttactaagaagtgcttgtcctcggtcaggccaggaaagagagatgacagacttggtcccatcggcaaactctttacagacaaaaaatccacctcactcatctctacagctccagggctcagcacaggggctggcacatgaaggctccctttccttaccttttcctggcacatgcaaatatatgttttttgagtatataaatcaatgaatgatgagaatatcttgcaactccttcaaaccgacaggtccacagagatgatcttgctcctgaccttgacaacagaaatacattcttagagactctgtagtcctaaatagaactttggggaatccttttaaaaatcaaacgcatacttggtaggagaactgacaatggcaaccagttgctcagagttatttgctcaaaggcctacctgcctcctaagcctcactgttcttcattaactgtcaggggttaaactttcaagagctactcccaaaagagctgcaggaaaattctgtctaaacagccatgcaaaagtgtctggggatcactacggacagaggatgatgacagagggcccatgacattgggccttgtcatggctgaacactgaccttccactgtcatggctgaacactgaccttccagtgcctacagcttttaaaaagagtaaaaactatgttcatgggtacacaaatacaaacatgcactcccccacacacacacatacatggacacacacagaggcatatcatgcattatcttctctcattcatcgatattctcaaatggcttattacacagatttacattcacaaatattctattatgtaaatgtaaatctattctattatgtgaatgtaaacctatataatatatttagccattttctcagttggatattttggttatttctatgttgtcacaattttaaatcacattgaaataaactaggcccctttgactcctttctttctctcttactccatgtggtagactaaatgtggctgctaagtttatttctcccactatgtcttccagccaattctagatttgagtcaattctagagaccaccatggtggagagtgcatatgcaggcacgccagttaactgatctggctgagcccagccctccagccatccctgccaaggtgtcaatgtgagtgaaaccatcttgaactctgcatattaacttattctccagctgaatatcaccaagagacctgtcttctgatgctacatggagtggaacaatctcccagctgagctctgtccacattcctgaccacaaaatcatgagatattaaataaaatggctgttgttttaagcatcaaccagtcttctcaatgctgccacaatcctcacaatggcccataaatctctacgtgatctcccactattctctttgatctcatctttggccttcccatggctgaacctgctccagccccactggcctccctgttcctccctgaacataccaaacatggtcctcccacctcacggcatttgcacttcctttcccctctgtgaggataatcctcccccagatgtcagcacggcatggtccctggcttcatgcaggcctttgcatacatttcagtcaatcagagaggtcttctctgatatcttacctaaaacaggagtccttttcttccacctcagccctctggagagccagggaacacctctctctccttatcatgctttatttttcttcataccactttcacaatattaatatttatatgtttattgtctatttagacctcctctcctccccacaaataaatgcacattctttagtacgaattctccgcaaacagaaacgttgtctgcttttatcattgctgtattcccaggacctaaaacagtgtcctgggtgtaggactgatcaataaatatttgtaaatgaatgaatgaattaattagcacacgttcttggatagaaatctctctattcatttctaattattcctcaaaataagttcctatgagttaagttgtggaggtgtaggaataacacatttcaaaatcttttagcacatattggctaaaattccctacagacaggctgcactggtgcttacccatcctgctagggatgtgtaagagtgctaatttccttgcatcatcaccaatataggataaagtcactcaaaaatatttgctacgtggatacatggaaaaaaatggttaccctttattttaacttaactttcttgatcctgtgtgaactgaactccttgttccacgtgcttattggccactacaaagtaagttccttgacagcaggggtttagatttgctcactgctatcccagcatcccagatagagtctaggatataagagatacatgataaatatttgtagaaagaatgaattaatatagatgttttcttttgttattgaaaggctattgactcatgtgtcctctgagaagtctgtctcttttttcttactgacttgaaataactccatgcatatagaatattttactgtcatctaggttgaatttttaatgtgtcatttgcactctattttgtatatgctattttttgacattcagaaattctagcattttatgtagttacatctatcattttattttagttcctctatttggtaccatgtttagctacagtcataatagttaacactgtatagcacttcccacatgccaggcacttttctgaggattttacatacattgtttattaaattcctacagcaatcctataaggtagacactatcattatctaatcatataaagaaactgaggcaatgagctatgaaatcaatcatctcctgtacaagattttatataaatttacctgtagattgctttatgatttcagtttttatatttgtgattattatgtaataatagaaatctattgggttactccatggagaagtgagggtctaattattttttcccaattaattgtcaagtgctccaacacagtttattgtaacaatatgtaacatgtctgtaacatattgacatatatatatgtatgaatagacatatgtatacatacatacaaacatatgtacatgaacacaatcacacactatatagcatttgctggtattcttactcagctcacttgtactgtcggtcctttttagttgtttagtaatttttgtggtgtgttcagtgaatcaaatttataaaatagaaatataaagaagaaacataaaaggattaccagcgattccctacaaatcctgattaaaggcacgttcaatgttgttctcatgaaatatgcacctgtcaaataaaaacataagcgcctccaaattgcattataaatgcacaatactttttggaaacagtttgcttcagaactttggcagccacaataataacacacacaagcctgtttcaccccaaaggaaatatctacaatacaaggatgtttagctccatcatttttcactgctttgggtttcttgcaaaaccattttgatttcagttgaaactaatgacagcaagcagtttatggtcaggttcacaaagtacatttctacccctgctgtggggaagggatcacaagaaaatagcttccagtaggttacgactcatctagctcccaaagtggggactcctccaccagagcctgcattttccactttttgccacactcagagaaggacttcgacctcaacatgtgatccagataaagagcatcctcctacacaacctcaaggtaataataacattttattggtatcttgtacatccgttggcattggcatttatatttttattcctatatcttcttatgtcaaagagagcatgctatacatcctgttcccaccttgcttttctcttaatgatttatttgaaaatggtttgtcattcatttctacagctgaataatagtttgctggatggctataccccatgtatataacccgagacagggtgaccttttgtggcccactgcctggcacttggcttggtctaacaaacagaaccttcatgcaccaagctggtcatgccaccaagtcagcgcagtcattgggagtgagtggtatgtgagtcctggctccctgaatgccctgatggaccccatggtccagccacactggctgggtccctgtaagcttagcctaccttgcctgagagccaaggaaatcccatcttctgcctcaccatcctcaaccacatttcagcaccaatgcaagatccagtacagctgctggaatccttgtttcatccagggtggacatggcagaggagtcagcaaccattttgtgccccagtgttcttcagataagttcccactcatgacaaactctagcccatactgcaactgaggtcccaaacatgcaattgcattgtttcccacggtgggctgggtcacttgctactgcaacaaggcagaggaaggacagcatcccagcatttacagacacattgcccagcatggggtctggctctgccagaatccaccgaaaggtatgagccctttatgaactagctgcactctgccctttggtcataagataaactcatatcttgacccaaggcagagccctgacatcagcatcagatcaaacttttgtctcaccacagagcaagccctgaccctggtcagactcaactctgacccttgcacggcctgagccctgacttgggccacggactgcaacccgaccctcagactcacgctgagtcatgacccagatcacagacacagctccaagccccagacttatcctgagccctaaccctgggcccagactcagccctcaccttggctgtgactgagcccagctggctatcttcaaatgcggtcacacaggaggtacttggcacagtaggcagatggctctgtgtgagccctgcctcggctctggatggtgcttatgatctactgcctatcacgagcatctagtatcttgccatggggaagaaatctcagtcccacagacctgagttcaaattctgccactgtttagctgggtgactttgggcaaattacttctagtccatcaaattagatgccttctgaagaaaccatttataaaatgggcacaaaatacctgctgtcatgatggtcatgattaaattatatgattgtaaagtacccagctcacagtagatagagttcatccctttccccagtaggcatcttgtcagctgcagctgaattattggtataggaacaagccctccagagctgtgctgtcctatactgtggccaccaaccatatggggctattttaaacaattgaaatgtggctggtacagccgggcacagtggctcatgcctgtaatcccagcactgtgggaggctaaggtgggtggatcacttgaggttaggagcttaagaccagtctggtcaacacggtgaaatgccgtctctactaaaaatacaaaaattagccaggcgtggtggtgcacgccagtaatcccagctactcaggaggctgaggcaggagaatcacctgaacctgggaggtgaaggttgcagtcagctgagactgttttgtgccactatacccagcctgggcaacagagccaaactgtccccaaaaaaaaagcaaataaatcaaccaaccagaaaaatgaaatgtggctggtgcaaactgagctctgctataaggaacacaccatatttcaaagacaaaaaaattcagaataagaaaaagaatgtaaaatgtatcattaataagtttttaatgattatgcatttaaataatatttgaaatatattagatcaaataaaatatactactagaattaattgcacctggttcctatttttaaaaatatagctactagaaaattttaaattacatatatggtttgcaggtccagaggtctgggaagagcagttcatgggtaataaagacagttaaaacagaaacaagagcaacagtaaaattaatacctaactaagtgtttattgtgtgctgggcacggcactaaacacttaagtcctcacagcaacctctgaaggtaggccctactactgtccccattattgagatggcacaactgaggcaccaagacgtaaagttatatggtccaaggtaaagagccagtaaaaggcagaaataggatttgagtccacaacacctggatccagaacctatgtcctagaggaaatgacacattcattaaaggctgcctcagtaaagtgcttcctacaaatgagtcacccacagggaagaaacatgccctggatcaattaaatgctgtcattgagacatgggcagcagcgaaccccactctccaagctcttacctacccacattgctaggcacttcactgcccatcagactggttggcactcaacagggtctttatggaggtgggggagttctctcatttaatcttgtgcatttctcagacatatgccaagttatctttatctggagaatcaaagaggacagctccttcaaacctttttagctttctccattagcaagaggtacctctgagagcaaaaatgataaactcaattgttcaaaaagcaagttccgttcttcaatttgtgtgccagtcataaacacagcaacttccatttgagcagaaatcccacatttcagcagaaatacttaatgtgtcatttctcctgcatccatcttcttcaaagcacttactttagaaagtagagaaggaaaaacaaactctaataacctgtactttgaatgggagatgggaactttatgataaagaactcaaaatgctttattgacatggctgcacacatcccccttcagctcctgaaactgctcctgagatgagaaaactttcctaggagccttgcaactcgacttcacacccagctaggctctgggggtaggatgcacactcactccagctcctgatctgttttgatcagccagaagtcctagttcaagtctaaacccagaatataaccatcttttttatcttaaatcatgcatttacaaatatctggcaaatacatattgagcactgtggcagattatattttccaaagatggtcatgaccacgccacttatcccacaagttcttacaatgtgatcttgtcactccccaccaggaggtggagtttatgtcccctcctctgggacctgcgtggacctttgtgatgggctggaccaatggagtatggagaacaggcttctatgtgacttctgaagctaaacataaaagttacaacaagtcatgaaagagaaaagcttttgctcttggagcccagccactatgctgggaggaagcccaagccacatgaagaggtcagagataggtgttccagctaacagccccagttgaggcccccaggtggcagccagcattaacctccagacttgtgagtgaggagtctggcttatatataactccagctctagccactgtcttatgcaaccacaggaaggagcccccaaatgaagccacctacctgagctagttatggttcatcaaaaaaataagacataatgaaaaatacattactgtcttatgccactaaggttctggtgacttagcatgcagcaatagataactggagcaagcacctactatgtgccaggcattgtgcaatctgctttaacaacagttgaagcagactttgtccctgaccttaaggagaccatagcttagtggggacataaaaaagtaaccaatcacaagcctgcactgtatgaacaggtgacagaggggcatgcaagatactttgggaacaaaccaggcttcgggaatgtaacaaggcctgaggacatcagggaagcatcctcagaggagaagattgtttaattgagtcttcagaaggagtcagtgtcaattagatgaaggaaaacagagcttttcattcattctaaggaattttgggaaaataatgtagcaaaaatagatagaaaaaactatgagaaagcctgctcacttaaaaacatattataaaacctcaataatcaatacattaataattaaaacctcgataattgattggcttattgacagaccatttgactaatgaaacatcaaaaagtgcagaaatagatctaaatgttacagagatttagcgtgtgtgtgtgtgtgtgtgtgtgtgtgtgtgtgtgtgtgtgtgtgtgtaatggggcattccaaagagggacttttccagaaatgcattgtactgcatgctatatacaccaagataatatccaaatgggtcaagattttaaatgcaaaaagaaatcccaatccactgaaattttagaagaaaatacagaaaaatagaattttagaaagaaaataattttgtataactttggaagtatctaaagtcttttttaaatcaaaatccagaaatattaagggaaagattgataaatttgactacatgataaaaaaaaattgtgtaatgccaaaagaaaaagagagggaaagagaagccttaagctaagtctaaaaacaaagacttctatgaaggttgaagataggtacaatgtcaacctgaaaaactgcagcttctccttagcaatcctaagatatctatagcttcttgaacctcttacagagggcctgaaacagagtagatgtttaataagatatattgcatgatcctgttacagaaactctcactaagatggaagttctggtttaatcttgactcagttatgtgacctggaacataaatgggtatgtgcacacacatgtgttccatgcactggggggaagtagagcaggtgattgcttccctactgccctaccacctcattcctggaaaaaacacatcaccactttcaaggtaatacattgacgcagtgatcaagactgccaggcaaggccacagaggcagcattaaagcaagcccaagaatcaggcattgttctatggatctcactgttcccctaacctgaggctcacttcttcaaaagtcaggatctggctgcatcttgctgaacctcaattttcccatcagtacagtaaaatgggcacaatgaccatggcttcagaaaccagttgagcatttaaatgagaataatgtatataagagaccgagcactggtggaggatatagcacaaacttcgttcttagtctctgtggccaccagagtcattatggtcatggtcagtttgctggagattcttttttttttttttttttttttgacatggagtctcactctgttgcccaggctggagtgcagtggcacgatctcagctcactgcaagctctgcctcctgggttcacgccattctcctgcctcagcctcccgagtagctgggactacaggcacccacaaccacacccagctaatttttttttttttttgagacgggtttcaccgtgttagccaggatgttctcgatctcctgacctcgtgatcctcccgcctcagcctcccaaagtgctgggattacaggcatgagccaccgcacccagctttgctggagattctattacgataaatatgtaggccaggcgccgactggataaataggcaacctccacttgtgcttctctgtctggaggagtttcttgcctttaaggtacattgcatagatgaacagaacacattaccaaagatgcacaggaacaaaatgaaagcatcaagaacaccctgacctgctactcaggatactgggccataggccccactctcatgatttcaggctgagagataaggagctgttaaagctggggttttgtttctcattcctccctaaacacagtgaagcttgggaggcattaaatggatcaagcatttttcagaacaaggtagagaaaaaaagacgtggaggtatgtcatgcttagaaaacacaaggctagcccctctgaaggtgctgaccgactccctggagtttactatttgtgtagaccttacaaagctcaagtttggggtgtctgcctgtcagtttctgcttcctggtttccatcatgaggcctctgaggactccacctaaccatgttatccagtccctgccactttaaatcaaggatctgaaaggcagcctctccatttagctgacaggagaggcagctttcaagagtcttctgtatcctttgtcagtgaaagtcacatgggggaataacccaaacttttcttccctttccagtgtagtgaaatggtaagtttcaagcatatgaaaaactcagccattggaacatcatggggtcgattaagccagtaatgactcaaaccaaagagctggggaatcttccgactaagtaatagggtagtgaatgcacagaaaggcagaggcaaaaaccgaattgtagcatctagttcatgagcctttgcatgactttggtctcaacaccggcacagtaatcatcatggaatctcagaatcactggaggagcaggatcccccaaaacccatctctgtgatcgctattggatgccaaaatcctccgcacatcttcatctagtggtcacccagcctctgatagcctccaggcttgaaactctactctgaaatattaagaagggaagctgtgttcaccactcagacacccactcctatttcacctccctgaagaaaccttccctgtctgccctctcagtcactctctaataccttgtctgactttgccttcttaatagatgtgttaggtgctgacccaggcatggaggttctgactgtgatgtcatgtagcttacttattgccatttagactgagctggcgagctcatttatctaatctgttaaaaccagatttggtggaaagtgaggacctcaatatttccacatttgctgacaaccttaaactctcatcgaagagtgggaagttgttgcttggaatcacattaagattaataatgacaatagagataatgacaactgcaaatatagcaactctcccactcacaatggcagtcccgattgcacaaagaatccagtaccaggaagggacacattttaagctatcttggaactgtttcctaatctgtgggataaagatagatcaaacaccactttgcattttttaaaccttgaataaataggtaaatagcccctttgttaagtaggagaaaatattgggaggagacgagtttaggcttctcaatatgtttccatctcattggccagcaggtctatggttcagagagaggttgaagctggagacagggatttcagaattatctgtagagtctcttggttgaggccttgggaattaatgaaattgcagtaccagagagtaccggaggagaagggaagtggggagctgtcctagagaacaagctagaatagaaacagtcaagacagccaaagcaggagtatccggagaccaacgtgaagggaaagaagtgagagacatgtggaagaggtggcaactcctgccaaaggggattaagaacaaggagttctaagaactttctgcagggctgttggttggagacgctgcctccatgcaaatctcatttgccgctgtcaatccagatcctgtcccaccacgaccatttctgagaaacagactcaagacatgaaaaaaaaccctctttctgtaaaattggttcgtgaaacagactacaggcattaatatcctttatgagtgacaatttagggccaatatttacactttgtaatgttcgttctctttctctcgggacagaaaagaatgttgccaatatcaatgaataaacattaataaaatcaaatataatcttgttccatctggaatcaacctttaaaaaaattcttaacatctgtatataatatacatacacctctatgtacaatagggaaatcagattttgcctgagagatgtgcacagtatttaatgccaatttatttggttccaccttttctccagactgctttagaagggtagcgtccctagaattgagattctgaattagtttcctctgactctcaggtacagaatgtccagctcaagccaagacatatcaaatatttatccactcccagattttcaaaaatccagctttctgtctcctcctgcagctgacctcctctggcagaaattcagcctcaaactgggagaaatgagtggatcaccagaatcaaagctgacgtcagtggtactgtgggttggtgtatgacgtgggaaccctgacaaacagaaatgaatgtttataaatgttagatctcaggtctgcaaggaaagatcttgctgtacttcacaaatggacttgctttttaatatgtctcctgtttcaggacaagtaatgttggtcagaactctgggggtgaacctaggggctcgtaccacttggggctgcgttgtcactcctgtcctcagcatcgcagaggccaaactgtacccagatgagaccccagggaaagagaaaagaatcttgggcacgggggtcattattcaaagaacctggtgtagtgcgtgggagatactgcatgcacctctaactcagacatatcattaattcacaccatccctcttgtgcctactaaaccaggatttctcagcctcaccaccattgacattttgggccagaaaattcttttcttgtggaactgctcagtgcactgtaggatgtttagaagcatccctggcctctacccagaagatgccagtagtactgtcccggttgtgacaagcagaaatgggtccagatacggtcaaatgtcctctggtgagagggtagcaaaatggcccctggttaagaactactgcagtgaattattcaagggaccatgagtgaagttttgaataatccacacctgagctaagtggtgccagagagatacttgcaggacctcagctttgttagtctgacatctctcctataagcccaccgactggagaccccaagcatgctgcagcccctacctaacagatcttcatttattccattacaggctgtgggcagcatttcttcatttcagatagaatcttccagagtttaggaacagagcaggctgccttctctcctcttgccaggaatttcagtgcgacattgaacatgtcactggagtttgcttgttgcaaggacaaacacttctcctggcacctcacccccacacctgcctagagacaaggctgcccaggctgtttaaagggaaatcagtactgtgccaggcctgtccaagtgaattttttctttgagcaaatacccctgcctacttgttcatttttaaaaccataggtcttcctggtgagggggcttcaaataaactacaacaaagagtaaagtctttatcccttagtaggaagagaagaagagcctccaacaataatttattcattcatccactggtaataaaggcagggctgtgatcacaagagaggagatacagacttcttggtctcaggggatttgcaaggcccagagtgtccagtggtatagatctatcaaggagaagcttccttggtaaacttagtgcctactgatccaggaaggaatatgtgctgctcacttcatccctctgtctccatgtcccacctggtaaaaatcagtcctgacaataccaaaactttgccaattctacttctgaaatatctcctggctcagatccctccatctttgcagttcctaacgtattaatagttcaggtatcatcttcgtttgttcctctgaactaatgtaattgctttctcatgcctttccttcccacttccatacggaataccacggcggtctttgtaaaacccaacagaatgagaaaacgctcatatccctcctcaccaaataccataaacaatgtttgaaaataaaaacaaaattgtcacgtggaagaaacaaaaacacttgcaatgtttgtaacagaaaacctaatatctatatttctgactctctcctggcttccacatatgtgaagaactctcacaaatcagtaagaaaatgccaaaaataggcaaaggccatgattaagcaaataccaaaaatgaatttttaaaacgaaaaatacaaatatgagaaatgtgcaaccttacttctaattgagggccacaaattaaacaagtatattttaacctcttagattagcaaaaatgtaagaggttggcaacagcaggtgttgacaaaaattcacaaaaatgggagctctcataatggttggaagtgtaaattggtgtataatttatcaaaggcaattttcctacattgtgtttgttttctactgctacataacaaataactataaatttagtggcttaaaacaacacacattcattttctcacagttttagtgggtcaggagtccaggcagaacttaactgggttctccgctcaaggtcccacaaagctgcaatggaggtgtcagccagggcttagatctcatcttaggctgagtcttcttccaagcgcacataattattggcaaaattcatttccttgcagctgcagactttttgaggcttgcttcttccaggctagcaggaaagagggtctctgacttccagactcttttaaaatgtctcagttgattaggtcaggaccactcaaaattaactctgttgattaaagtcatctgattagaaaccttagttttatcccaaaatcccctcacttttaccatatattgaaacatattcacaggattgacacccattgcctttgccatattctatggcgatatggtttggatctgtgtccccgcccaaatctcatgtttacttgtaatcccaatgttggaagcagacccagtgggaggtgactggatcatggaggcagagttctcatgaatggtttaacatcatcttcccttggtactgcatagtgagtgagttctcacaagacctgattgtttagaagtgtctagcacctcctccaacctctctttctcctgctctggccatgtaagatttgcatgcttccccttaattccgccataattttaagtttcctgagatctcctcagaagccagactgatgctgccatgcttcctgtacagcctgtggaacagtgaggcaatcgaacctcttttctttataaattacccagtctcaggtatttctttatagcagggtgagaacagagtaatgcatatgggttagaagcaagtcacaagttccacccatgcccaaagggaggggattaaagaaagacacagatcatcagagatcatcttataattctgccaacagcatatatagaccaaaacttaaaatgtttacaatctttgccatagtaatctcacttgtaggactatatcccaaagaattaagtggactagaacatatatatgcccacagaagccttttcatcattctgctatttgaaatcatgaatatatatactatagtagcaaccccaatatccataaaaatgagttcaaataatttatgatatatgcacatggcctatcgtatagctgttaaaaaaaaacacaagtgatcaaaaggtatttaagtaaaaagagtgctatgatgtattaagaggaaatagcaagtttaagtccatctacacttatatttatatataactgtgaaaatgaacctaaaattgtaaaataacatacagctattagcagacagtatcttcaggtatgggaatagatggcaatctttattttctgtgtagtttttatggtgtgaaactttttgaaatagctgtgtattccttttataacaagacacaacaaaagagctgttttttaaatgcgagagtattggtttgtaaaatgagtagtgtacaaaatagtatactcaagggcatcttatgttttgtaaaatatagatgagaagaagaaaacttgttagggaagacacaaaattttaatagaggctagatagacgttggtattatgggatgtcttgaggttctattttagctgttttctgcatttttccaatacaacatgtacattattttcatagtttttcaaaccaattcctgctatcttttttttaagtgtagaaaaggaaccatacatagggaaaaaaaaaatagccaaatgcagtctcacttccctggtctccaggcagagatggcctccaacatctgagcactcactgaccacagcttcctcccatggcttaacagtgccttctattgtggctgcctcgcccatcaggctgtaagggtactgatggcagcacccctcgttcacctctgcacctccagtgcctgtcacagggcctgccacagagtacttcacggcggctaaataaacgaatgaagaagatactggcaggctagaaccttgtaagcaaatcaaagtgttccaacaatcatcttatttgcaatggtgaaggatggagttgagggagcaaactggaggcagggagacaagatgccctggtttattaggagtaagatattgaggacctggtggcaagggagcagcagtgcagatgcaccggaagtggaaaggacagaattcagggaataatgggagtaagtgtccacagcagccaagcattgagggtaatgcccatactctggcttggacaactgggtggtgacatttgcctgaatatggagcaaaagcttttgagagagaaaacatgacaacttcaggtttgaacacacagggtttgatgagcagagacatctgggaggtgccacaaggagctccttatgtcatcctcccagctgtcaccacacacagggttgattctgcaaaccaccggagcttaattgatgcatgtcttctgagtaaaattcatctatccctcctcagggatgaaatgccccctgccttaggattctgtgacttcctcaagcccagagagatggggtgcaatgggagggttgagttacagtgtcaggcactgcataggctaaggagctccagggtctgctactctgctatctgggaagatgctcatttgcattggttccctctgcagtgggatgattttgtccttcatttgccttccctggatgatgcaggctgcctgcatccccactctgaaaactctttacacagaactggccgcacatttcataaagccatgagtgatgtcaaagagcatgtacaatggggagaagactgactctgggcattaattttacatttgtaatcaggggatcttaatcaaatgccaccaagctaccattgcaagacagccttccacaaacaccaccccttgcacagctcaggttctgcctggcactcaaattatctgcaaaatggtccctaccaccgtgcccacttatgccccaggcctctccatggagccacatccagtttcctaagcttactacatcactctttgtgttgtcctctcagccttgattgcccttccagatgtaacctaactagttcagccctctgcagccttcaaaacctagctcagtcatcatctgtcctgggggatctttcatttttattttttaaaattttacttattttggtttttgttgttgttgttatttttttgttttgttttgttttgagatggagtctcactctgtcacccccactggagttcagtggcactatctcaactcactgtaacctctgcctctcaggttcatgcaattccctttcctcagcctcctgaatagctgggactacaggtgtgcgccataaagtctggctaatttttgtatttttagtagagacggggtttcaccgcgttggcgaagctggtcttgaactcctgacttcaagtgatctgcctgcattggcctcccaaagtgctgggattacaggtgtgagctaccacacctggctgggattttttattattattattttttacatttttaattttatagatttaaaggtacaattgtagttgtgttaaatggatatattgtacagtagtgaagttggcttttagcgtccatatcaccggatagtgtacattgcgccgataggtagtatttcatctctgaccctgctcccaccctcctaccttttagggtttccaatgtctcttattccactctgtacgcctgtgtgaacccgttatttagctaccagttataagtgagagcatttttgactttatgtgcctgagtcatttcatttaaaacaattgcctccagttccaaccatgttgttgcaaaatacatacttttattcttttatggccgaatagagttccatggtatatatgcaacacattttctttatccagtcctctgttaacggacactaaggttggtttcatgattttgctattgtgaataataccacaaggaatatgtgagtacacctcctggcaatcttcaacccctttctaacagggtgggtttggatccctctgtcctgagtcaatgtcaaggcactgcattgaacctttctgtttatgattctgcatctctcacactactctgagttcgtaggttgctgtgccttgtctcagtaccatgctcagctccatccccacatctaccatgttatgtactagtgagtggtagctcccgcctgatagaatgagctactctccatagtggaaaattctttcccattgattccaaacagtgcaaaagaccccctttcagaatgaaatttgagggtcacctttggctcttctctgctgcatctccaacatacaatctgccttctacctgcaccatcacccctttcattttcccattatattattccagtggatgcaagtgattgcaaattaccatctcacccgtcacaaaagcattatctacaaatcgctttgtaggccatcaagcatcagcacatgtcacgattatctgggtgctcataaaatccttgtgagatttgaaggccagaaaccatcttccacattttacacacaagaaacatgaggctcagtaaattaatctagtcagatacaaagtttagactgcaaatcaagacttgtaattctcagacttggtctttttacatgttacctccattaaatagtctactataagagttcgttagggatggtttactctacaagaaaaggatccttttgtttttctccagtgcctagtttgggacgcagcacaacaaatcaataaatcaataaatcattactaaattaatgaatacatctcaataaatcattactaaattaatgaataaataaatgtccctttgcatcatgaccttagttttctcatctgtaaacgagcatgtttaggtgtgctggttcccaagaacatctctggcactcttttgtctctagctatcaatttctggctagcagactgactgtcaggcggaggtctgtgccgggcaggatgcaggcatggtgaacaccaggtgccctgggtgtgaataacaagcaacaaaaactgaactgagaccatttatgaaaataataatgaaaccacacattccttgataccagaaataatacagggctccatgccttgttaccggctctgcttctcaatgtctttgccatcccaatgtcgttcattcccactttgcctgaagtccatttttggtacagaaatgtaatttagtgggtggcttttcccacaactctgggccactaacacattcattttcttctctgcttttaaagtttatgttcctttgtgcacaacaggcagcacatcaccactttcctgcaaagtcacaggcaacagagaaactcctaaaagctcctgcaagtcttgggagagactggagcatttccattaagaccctcatgctactagattgttcttaggaacccctcagaagattcagcaacatgcaaagtgacttgtagaatgggataataatcataagggtaataaacgcctatttgatagtgcttactttctgccggacactggtcaaacggctttctatatatcctttcatttaactctcctgacaactctgtgagggaaatgctgtcaatatctctatgtttcagaggggagatctgaggcatagtgacattaggacactctacaggtcacattattaggaatgggcaaagccaagcttggaacccaggcagcatgattccagagcaaatactcttaccactatgttctttttttctcctatagctacatatgctcctctttcatgaagccttcctggccaccccacaaacaatgctaaatactagatggtgacagaacaaggagcaggggcttcacagtcagttagaactgatttccacccctggctgtgccaaattacttatatgattgtgggcaaattgaataacctctttaaatcttaacttcctcatttgtaaaatggaaatgataaacatttcacagtaccttggcaaacacttaagacttaagagtcagtaaatgtcctgcatgctctgaaatgggaagtcccaaggcagaacagaggggtgctctgttcccttcactcctcattcatttattcatttattcacttacccaacaattctttaatgagcaccaaccacataccgtgcattgcctggggtcctgggaaggttcctgttctcacggagcttacagtctagtgatgagtgacagaagttaaaaggcaaatacaccaatggcacacacaatttcagagacaatcagcgcaagaagacaataaacaggagatacgagtgatgtagtaatggtatgctggggaggagggtgtgagggagagaactgctttagactggcctgggagatatttgagccgagactaaaatgagcaaatgagcagcatcagccagccaagtgaagatccagggggctaggggtggggtggagaggggacaaacgatttagacaaaggaaatgacaagtgcaaaacgcaaacaggcaaaaaacttagagggttctaggaaaccaaataaggccagtacggctggagcatagtgcatggccaggagaatagaaggagatgagctttgagaggctggtgcgactagatcttgctgggccttgtgggccatataaacaaggagttcggatttcattgtaagtgcaataggaagctcttagggcattttaagtagggaactggcatgatgtgatttatgttttcagaagctcaatctcgataagaagtgaagaatggataaaaggagtggaatacatttagaagtggaacctggagattgtgataaatgttagacctcaaagcttcactccatagacggacaagaatgacatttcttctttatccccgtagatgtgtttcccaagacatccaggagaggatattggcgcaaacagtgagtcatcactctccacccaccttccagactccctcctccatgcatatccagctcttctcaacctggggctcccttagaaaatccagacaaaacaattgccacagagccaacatcttccttttccctttgtcttatggtaaaaacatatttgtagaagcaaatccaataataaaagattagcacataaatacactgaaaagtaagatcactgacaaatacaccaagtgtcggcaaacagttctcagtgtcttggcacatgcggagcccatgttgcaggtggcatcaggcagacatggggcctaatcagaactcccactgaagctggacggccttgagtcagcaatgttctagttaatatctctcctccatttgtccccccgctctgcatttcctggttttttcaacagagtcatctggggaaaacccacacattttatgatattttgtcttccccttcctctctgttaaaataaatgcctgtcacatttgatactcatctgaattactgatgttgggcatgagatggtggggccatgcgatccctctggagacaggaatctggtttatttggatccccaggagctcatgaatactgtgagttaggcttttggctcttaaagaagagagtccataatatcccagaacaatgcctcagtagcagatttagttctcttttttttttctcctgattgtgttcctttttacctagcactaatgtgggtggctatggtgagagaagaacatgctaggaagaggttctctcattttcatattcttctcatgcacacatccactagggagctaggtggagatgcttgcaccccaagagctctgggcccagccactcattggaatcaataagccttcctaagggtttagagttgggggaactgaggcccagtgatgttctatatctctcttctataccccgaagacattgagttccataattgtaccatactttgcctggcatggcctgcactggcatggctcatgaaacatgataggggcctgcccagttgacccaggccccccttgaggcttggtgtgtgctgagagggtgactcctgtttcaggcattgacaagaaacccagtccaggggtttgtgttgctgacagcaggcaagctatcagcaggggtgtctgatataggctgtgagactccaaggtcaaaggaggaaaagcatctcagagtctctgtcggttggagagggcagagatgaaagtagaactcatggagtgaggcgtgacccaagcactacagggagaggcacatgcaaggcacaggcctctatgaatgcctgaggagtccattcagaatccagttagacctgccccggagcaggtgaaggtgggtcacgtggtcagagctggacccatggctgaatccattcagccactttctgctcaggccaggactgaccccaggacacagcctgcagtaggggagctcactgcccttgcttaggggcaggcaaagagattcaaaagccaaggggggcctggtaacactgacatcccaggctcagttctgctcatcagtccctgagtgagaaaagctgcaggtcttcaggcccttgtcactccctgctggtgttaatttactcacttcttagacgtctccgcagaaaggtcaagggctagatgagtaatcatggctgagctaatgcctcagcctcagccatcgattctcgacctcaattttcacaaatgtctcactatcttatccaaatatgcttcataccttggaggaaagggtgttcctggtgaagtttgcaaatgattgatttaagtggttgtggctttcagaaactggcataaaaaagaatgtgagcaaagaccgatctgcacaggaaccaaccattggatgctgctgtggggaggaatgtggataccaggaaacgggctctctccccctcctacaggagcccagagcctcctacctcagtccaccgattagagggtcacaggtttcaggatgcatcagaattacctggagaatgtgtcaacatgcaggttccagggccctggccctagagtcagattctatagatgtggcgcaagacccagaaatgtcatgtggccacgatccttcatgagcctgatggaggcatggtctcagagccttgctgctcaaagtgtggttggtggactgcaggcagtagaacagaaatgaagaatttcaggctacaggatcagaatctgcctttaacagaatcgccagtgattcttgtgcacgatgttgagaaatgctggcttagaccacattgtgagccccgttggctcttctctgggcccagatttttctctggctgtgttttgtgactccacttcactcacctctaattccctgagggaccccttccaccccaagataaatagaactgaccttctgggccacacactcttgcagggagacatgtacacacacacaggcacctaccaaggctgatgtggtagggccagcccagcagatctgggacctcagcaaagccaatctgagggcaagagaatgagaacagaaaaagtatgggggctacagccttgccaactgctcacagatttcagcaaagaaaacagcaataattaattctgccaatactttttgagcacctgctatgtgccaggccctgggggaatgacagccgccattcatataataccttttggttgataaaacatgttcactccattctgtcagtgaactgcacatacgacagagaaatgagcctgtgatatagaaagcatgatccccattttacagatgatgaaactgaggctccaagaaactgagttacttgtccaagatttaaaaatagcttttgagctgggatccccacttttttggctttcttccctcacactcaatgtgattaatttatttgctctacatggtcatttgagcattacccccgacatttttttctgccttttctgccatgatgactgtccagcatggagaagcattgtgtccagttgccactgaatttccattagatggggccactcatcctgaactacaagtggcactgagtatgcccatgctcacagcagctattcatcatagctaaattttcatcacagctaaaatgtggaagcaacccaagtgctcatggatgaatgaatgaataattaaaatgtggcacatacatagaataaaatattatttagccttaaaaaggaaggaaattcttacacatgctactacatagattagccttaagctaattgaaataagtcaatcgcaaaaagagaaatattatataattctacttacatgagacacttaagagtagtcaaaatcatagagacaggaagtagaatggtggctaccagggggtgggagaagagggaaatgaagagttcgtatttaatggacacagagtctccattttgcaagaaaaagagttttggagatggatggtgtgaaggttgcacattatcaatgtatttaacgctactcaactctacatttaaaaatgattaagatggtatattttatgttacctgtattttaccacaatttaaaaaaatgggaggtggaggaagagattctaagcagcttcctgtgtaaaggccagatcttggaactggaagttaggactgagccaccaatcatgaacggaatgaccactgggactgcacagaaatatattaatatgtcagccaaacccaagattcagaggctgagcagggatacgcaagacattgctttgaagtgttgattccttatcactcatcagtgaaaattcttaaacttggagcaacaatgaaatgcttcctgaacacaagaaaataaaacaacaaaataaagaacaaaacaagccctgaacatgcctgaaccaagaaagccaggatgtgagggtgatgagcatgagggtgtgggcatgggcggattgcatggggctgggagtgcacagcgggggagcctgaatgagcaggcagagggacctgtgggcgcttgcttttgcttccgggtcttcttcattatcatgggcccggggaatctgagagggtctcacagtgcccacagccttacccttatcccaggtgcaactgctgatcctccctgaaacaccagctcataagggcatcctcatgtggaccagaagcaatgacactggccgtgtgtcacagcttacagagcatcttcatgtgccacccaatcatctatgccctggtgggagtactatctccactcattttacagatgatgaaactgagactcagaccagtaaagctgtctgtccaaggaataaccagagggtagacttgcatccagactccaggctccaaggcccaaactctgcatctggcacctcatggtctcatgtctccggaataagtactcaatagccacagctgaggtgcctcatgcatcatgggcagccacagcccctgccccagtccccttgtctgatgaacacacatcatgatgccactctataaagaggaccgttgccagaaaggattaattcattaatgaatatgaggtctctggaaacccagaacgtgatgtaaatacccgtgctgtcaaagctgcctctctgttgcagaatgaaaagcaccaaaatccctccattgtccttggataatagctttgatttggggcagggcaggaggaaggagactctgtctgggggataaacaatgctgggatgttccaacatagcaggatttgcacacaggatccagcagagatggcgtgcttttctcaatattgtctgggatatcaaatgggaagactggaacagccaggggagatttggatgcctgagatctggagctgctggagctgaaggaattgatttccaactagatttctcacacgcctcgtgcttgggctggatggctgaaggtcagcccagctggcactgtcacctggagcacggacttagggtcttgccatggggtccaggcttctcaccgcatacagagtgagttctgaaggagaagatcttcaagggaacaagtgtcctaagagaccaccctcaaatgccatgtggttccaacttttctcaaggggaaggtacagttttagccagcccagacccaagggaagggatcagagacattcttgatgggaagagtgtcaaagatttgggggccatgttttaaagccatcacagggaaggacgtcagggtttggtataggattgagtttgaataccctagtcccagacacccaccccgtctctatgaggaagataatacagaacactccaacacttttttttcttttcatttttgagacagagtctccttctgtcacccaggttggagtgaagtggcgtgatcttggctcactgcaacctccacctcctgggttcaagtgattctcctgcctcagcctcctaagtagctggtactacagacacacatgaccatgccgggctaatttttgtatttttagaggagacaggatttcactatgtgggccaggctggtctcgaactcctgaccgcaaacgatccgcccgcctcagcctcccaaagtgctgggattgcagacttgagccaccgcacccagcccccaacactttgaattaaaccattttcatccttgaggcataagttttagggtccttaaggaacctaggtccttgcctttatttattgatgacaaaactgaagccacgagaggacacttgttatggccaatgtcacatgtctgctaagtgtcacagccagtgttcaaaaggaggctgctgactccaaatccaacactgactctttgctcccaggtctggctgctatagcagctgggctgcctcgttctttctaccaagatatggaatccatctttagagctgagtaaccagctgcaaaccagagccttccagcttctcttcctctaggagaagggcaaggaacagggcggcccagggatgtgtgctgtctagggaggctgtaggctggcagacaaataagagcagatcagctgacccccactccccccagggcgggtctatgatgggcaattggataaacacattcagaacaggatgaatgtgcagccgagcgtgagcacattttaaaatatacatttcacctccatatgcagatcccagtgacatgtgacaaatgtgctgtggcctccaggagctgttctccaaggaggcacttatttcatttgactccaagcatccaacctcaacagatggcagaattcagatgggtggcgggaagcaggcttcaattactgcaggaagactcaagttagacaatgggaagaactttccttctctggaacaccagcttttttcagcgactattttgcaatgtgatacacagactcaacatagacactttcacgtgaataaaagtgctctctgtagaaatggggggaaaaaaacctggttgatagaaacttagacttttagctcagactcccagattttctgcaatacactcattccacaaagggtgtcacccttgtgagcacttttggcttaaatgaaggctcagtgtctctttttggagagcagacaacatgttaaggacataaatatgtagatctgcgggtttacttgttttgttttttttttttgtttttttttttgagatggggtctcactatgttgaccagtctggtctcgaacttctggcctcaagcaatcctcccatcttggcctcccaaagggctgggattacaggcgtgagccaccatgcctgacctgaaatatgtagatttgaacttgaaaacctgagaactgaagccctgtaaccttttccaaactaatctgtgagacaggaaggggtttagaattatataaataagtcacctgcttgtgtgtcaggcacattttttctttttctgttgttgttgtgggggataacaccctttgtgagataaaactcacaaccatacaattatacaattcatccatttaaagtgtataatgcagtgaattatcgtatattcacatagttatgcagccatcattgtaagtcaattttagaaaatgttcattaccccaaaaagaaattccatacccttcacttccacacaaactctttgcctaggcaaccactaatcttctttccgtgtctatagacttacctattctgaacattgcaatacactagtctttcgtgtctgacttctttcccttatcatgttatttcaaggtttgtctatgttgcagcatgtatgccttcattcctttttattgtggaaaaagtgttcactgtatggatatgctatatttaatttatccgatcatcagctgatgggcatgtgggcggtttctattttggggtgatcatgaatactactgctatgagcattcatgtacaaggtttcctgtggatgtatgtcttcatttatcttggatatggacttagcagtggaattgctgagcatggaactgtacatttaacttcttgaggaactcccaaactgcttttcaaagaggctgaccatgttacactcacaacaacagtgtatgaggatccaattttttcacattctctccaacacttgttattatctgtctttttcatggtggccatcctactgggtggggaggtgcttcttttatgttatctcatttcatcttcagaacgctgccataagggcaggcactaccatcccaatgtacagatcacaatagtgaggctccaagaggttgagcctgtcaaggttgcaaagctggtaaagaggcataaagatgtgttgtcaggtttgcctgacacctctcccacttccctgtatcccagtccactctcaggcccgtcacgccacctgcatagccctctccatgtgtttatctttgtgttccacgtgtgactcattgctgagatggtcaggaatgacagcgactgaactttctatccaaactcaccttccttccctgagccttgagatggaaccatcccctcctggctgtgggcattccttctgtcaagggtgagagccagcccagactgccatgaaataaaccaacatgcttctcttccccaacccctccatcagtgcccagatccagccccactaggctccacctggctccatagctatttcacccacctcttggagcacatgaggctcttgcctggtccatcaatggcttcagggatctcccacatcagacttccaggaaatctccctttggttcaaaaaatcgtaatgaacaggaccctaaacaacctagcacctcctaagacccatgctgacatgggcccttggtcgtgagttgcatcattcagcctcctgctgaatgaggtcagcacctgctggacccacccatctcctgactcttccccttccccaccacacaggaagacaactgatgcagggagcatcagtgtcaggtgtgttgtatttatgtgacgcacacagttccctactctcccaccattgttcttcgatatatgacaaaactcccaatttgtcaaatgcttaacagcagtcaggaaaatgtattctccacacatccaccgagcttttcattttgcacaactgtcagcaagaacagtttacaaattttctgtcatggagattctgaaagaatggggaagaggggagaaacaccccccaccccaaccccttctgtgagtcacagcctcaacttgacagaagcccaggcagcagctgagactcccctgttacattacacgtcatcactctttgcatttaagcccattttccatgcagccatttctgaatgcatttctgtttccatcaaatccctccccatggtgtaaaagtaaatattagacagtgccctcctcctaaaagaccttgtatttcaagctcaaaaaagtctcctagagggactcagtagtagacagctgtctgctccacagatgccagccagcttccctggctgacatgcaacagattatcatgcaaacccagaagcctcaagcttttaagacattatatattgaaaatatacactgaatcatctttaacagaaaaaaaaaaactaaaaccaaccaaaatttccaaagagagacaatcgattaaataaattatgataacccccaaaatggaccatggtccaccatggaaagagtgtttctgtggtgtgggaatgtggttaggatatgttaactaaagcaagtttcaaaactgtatttacagtatgattcccatttagtaaatgtatgtatgtatatttatgcatagggggaaaaaagaccagatggatagacaccctaaatgttaacactcaagagattatctgctttttaaaaagatttttattttcatgtattttccacattttcttccatgaagcaaaaactttttttgaaaaagttgtttctgctcaacagtctattcatggaccattccaaaaactttaaacttggcagactgcggccagttgtacagtaaacataatttacagcccaatggctttctggcagtgagcactttttcattcacaccaggtgatgccatactgaacagcagctgtccatatgattttaatcacagtaacttttgaaaccacaacttgcagtgccccttattttgttccattaaaaagctgtcttttgaagctaatgagcaaattctctgagaactggaacctagcaaatgctgaatcactgggcgaatagcccgttaaatccatactagttatgcagctctttgaagacacacacagcttaggtaacttgaaacttccctctgagaatatataagatctctggttatcatatgtaaatgtaagtcaatgcctaacaagaaatgattatttgcaaataccttggctatgatctaagttgcagatctaatttgaggagtagcagagtgatcactttagcacagacctggaggctaagattaccctttacagggaaatcctgaatagggttgagacttcccaagagacagattctatgagctactcacaattacaactgtctaagctgaaagaaaatttcaacactaaatcccttagtctttccttttcctttctattcagtctcttctgttttatctcctttcctacccaccttgaatatttcttgagctatctctttaataatacttttagaatgtgctttcaaaacgtttgctttcagtccttcacaaccacttgaaggggaaaagaaggaaaaggacaaaaaaatatacatcccttgtgtatgagtttgctagagctgctataacaaagtaccatagactgggtggggggtgggggcttaacaataggaatttatcatcctattgttctagaaactgaaagtccaagatcaaggtgtcagcagggtggattcctttgaagggctgtgaaagaatctgttccatgcctctctcctagcttctggtggtttgctggcaatctctggtgtttcttggcttgcagaagcatcaccctgatctctgcattcaatttcacatagcattctccccaagtgcatggctctgtctaaacttcccctttttgtaaggacacctgtcacaatggatttgaacacccccaacacacacacctaatgaccttatcttaatttaactgcatgcacaatgaccgtatttccaaataaggtcatattctgagatcagagggttaggacttcaacatataattcaggtccatagtaccttgtaccaatccaaccacaactttctttgaacctatgccccaatcagggtcctgagcactgctggagaaaactgtacaatctccaagtgatagcgtgggttccagtgtcagccgagctaacactcctttgtcaccacccccttctattccccactgcagcttttttcaactttcaccatgctcctctattccctcaacttcaggaaatgatcttacctcctacttcacagaagcaaacagaggccatcccaaaagaatgttctgaccaccctgcaatgaattatttccctttacttgctgtgttagttcattttcatgctgctgataaggacatacctgagactgggcaatttacaaaagaaagaggtttaatgcacttacagttccacatggctggggaggcctcacaatcatggcagaaggcaaggaagagcaagtcacatcttacgtggataggtggtctcaggcaaagagagagcttgtatagaggaactctcggttttttttgttgttttcttttttttttttctattttttttttaattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacaatttcttaatccagtctatcattgttggacatttcggttggttccaagtctttgctattgtgaataatgctgcaataaacatatgtgtgcatgtgtctttatagcagcatgatttatagtcatttgggtatatacccagtaatgggatggctgggtcaaatggtatttctagttctacatccctgaggaatcgccacagtgacttctacaatggttgaactggattacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtgaattttggcttttgttgccattgcttttggtgttttggacatgaagtccttgcccatgcctatgtcctgaatggtaatgcctaggttttctcctagggtttttatggttttaggtctaacgtttaaatctttaatccatcttgaattgatttttgtataaggcataaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttgggttaggattgacttggcgatgcgggctcttttttggttccatatgaactttaaagtagttttttccaattctgtgaagaaaggcattggtagcttgatggggatggcattgaaactgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagaatttgctgaagttgcttaacagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagttttccaagggaatgcttccagtttttgcccattcagtatgatattggctgtgggtttgtcatagatagctcttattattttgaaatacctcccatcaatacctaatttattgagagtttttagcatgaagggttgttgaattttgtcaaaggctttttccgcatctattgagataatcatgtggtttttgtctttggctctgtttatatgctggattacatttattgatttgcgtatattgaaccagccttgcatcccagggatgaagcctacttgatcatggtggataagctttttgatgtgctgctggattcggtttgccagtattttattgaggatttttgcctcaatgttcatcaaggatattggtctaaaattctcttttttggttgtgtctctgcccggctttggtatcagaatgatgctggcctcataaaatgagttagggaggattccctctttttctgttgattggaatagcttcagaaggaatggtaccagttcctccttgtacctctggtagaattcagctgtgaatccatctggtcctggactctttttggttggtaaactattgattattgccacaatttcagatcctgttattggtctattcagagattcaacttcttcctggtttagtcttgggagggtgtatgtgttgaggagtttatccatttcttctagattttctagtttatttgcgtagaggtgtttgtagtactctctgatagtagtttgtatttctgtgggattggtggtgatatcccctttatcattttttattgcatctatttgattcttctctctttttttctttattagtcttgatagtggtctatcaattttgttgatcctttcaaaaaaccagctcctggattcattgattttttgaagggttttttgtatctctatttccttcagttctgctctgattttagttatttcttgccttctgctagcttttgaatgtgtttgctcttgcttttcttgttcttttaattgtgatgttagggtgtcaattttggatctttcctgctttctcttgtgggcatttagtgctagaaatttccctctacacactgctttgaatgcgtcccagagattctggtatgtcgtgtctttgttctcgttggtttcaaagaacatctttatttctgccttcatttcgttatgtacccaagtagtcattcaggagcaggttgttcagtttccatgtcgttgagcggctttgagtgagattcttaatcctgagttctagtttgattgcactgtggtctgagagatagtttgttataatttctgttcttttacatttgctgaggagtgctttacttccaactatgtggtcaattttggaataggtgtgttgtggtgctgaaaaaaatgtatattctgttgatttggggtggagagttctgtagatgtctattaggtccgcttggtgcagagctgagttcaattcctgggtatccttgttgactttctgtccgttgatctgtctaatgttgacaggggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttagtatttttatatgtgaatttgatcctgtcattatgatgttagctggtgattttgctcgtaagttgatgcagtttcttcctagtctcgatggtctttacattttggcatgattttgcagcggctggtaccggttgctcctttccatgtttagcgcttccttcaggagctcttttagggcaggcctggtggtgacaaaatgtctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccctgtcactttcaggtacaccaatcagacgtagatttggtcttttcacatagtcccatatttcttggaggctttgctcatttctttttattcttttttctctaaacttcccttctcgcttcatttcattcatttcatctttcattgctgatgccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctgcatccagctttgttccgttgctggtgaggaactgcgttcctttggaggaggagaggcgctctgcgttttagaatttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctggggggtgcctcccagttaggctgctcgggggtcaggggtcagggacccacttgaggaggcagtctgcctattctgagatctccagctgcgtgctgggagaaccactgctctcttcaaagctgtcagacagggacacttaagtctgtagaggttactgctgtctttttgtttgtctgtgccctgcccccagaggtggagcctacagaggcaggcaggcctcctagagctgtggtgggctccacccagttcgagcttcctggctgctttgtttacctaagcaagcctgggcaatggcgggcgcccctcccccagcctcgttgtcgccttgcagtttgatctcagactgctgtgctagcagtcagcgagattccgtgggcgtaggaccctccgagccaggtgtgggatataatctcgtggtttgctgttttttaagccggtctgaaaagcgcaatattcgggtgggagtgacccaattttccaggtgcgtcagtcacccctttctttgacttcgaaagggaactccctgaccccttgcacttcccaagtgaggcaatgcctcgccctgcttcggcttgcgcacggtgcgcgcacccactggcctgcgcccactgtctggcactccctagtgagataaacccggtacctcagatggaaatgcagaaaacacccgtcttctgcatcgctcacgctgggagctgtagaccggaggtgttcctattcggccatcttggctcctcccccgaaactttcgtttttaaaaccatcagatctcatgagacccattcactatcaggagaacagcatgggaaagacccacccccatgattcaatcatctcccaccaggtccctccctcaacaagtgggaattatgggagctgcaagatgagatttgggtggggacaaagagccaaaccatatcacctgcctcctttctttccccctctgccctgtcctaaagcaaggtgcatccttccccctgggctctagatcgcctgccctccagctcctcgggccttgcccacaccaattaccctcttgcttctgtcttcaacctccccatctccactggctcctttccattagcatttaaacatgtccaaatcttttccctcaagaacacccatagctcttatctccaggtctctccaacaacctcctgtccccaccacatagccaaattcatcaaaagagaaaaataagttatctccacttttcttgtcctcaacccattctatcagactcttgccatcacctgtggattgtaaattctcctgccatggattcctccattgccctcttaaggggccgcttggcaagcatacaatgccattgacctcatcctcctttaaatatggaattccttggcttctgagtgatcctatagcctctcagttttccttctggatttgctgtgctggccactccctagatgttcaatggttgcatttcttggcattgttttcaagctctttcccttctctttctgatctcatctagtactatgaattaaactactacctagatcctggtgactctcaaatgtctacttccagtctacttttttctcctaaattgcagatgcccacattcctctctaatattacatctcccatgggtgacctacatccaataatagttatgaaagagaacagctaatagcagtaggctgagtgatggacttaggaagggcaaagacccctttggcagggttaagaaaagcagaggtgaaatgagagaggtcaggacagtcacctgaagtatttcatagttctctaaaaagtactctcagattcaaatttccttgacactttgctaaccgttctgcacacctacatcctaaaggacagggctctccttaacatgaattaaatttgaatatgcctctaccttagaaaatatattgttcctctaccagtgtcctggcatatggagactgcctactgaaaatcatgggtatgacattgatttgtgtaatgctagctttggagtacatgtagctttttctctatggacttaaattttttttttttttgagacggagtctcactctgctgcccaggctggagtgcagtggcgccatctcggctcactgcaagctccacctcctgggttcatgccattctcctgcctcagcctcccgagtagctgggactacaggcacccgccaacatgccggctaattttttgtatttttagtagagacggggtttcaccttgttagccaggatggtctcaatctcctgacctcctgttccacccaccttgacttcccaaagtgctggcattacaggcatgagccaccgtgcccggccagacttaaattttaagggaggcatttacattaaattatacttcccacaatccactcagcttggtctttggctccattgttgggtggaattacaattgctagtacagtagctggatgttaaatagaagtcagtgtagaacaatagatgtcgaaataaaaaacaagattagaaacagaaaagttcatggcttcaaaatgcatgttagcctggggtaaaaaaactgcatggatcttacagaacatggagtccagcactgatacggacaggagatagggaaatactggtttgaagaaggcagttcccgggcaaaggccccccaccttcaagccaagaaacccacagccctcagtgagaacaggcattcctgtttttgcatccaaaaagttgccttttggcctgctatgtccccctatcttgcatccatataaaccctgaaccccaggctccagaaagaaatgcacggacgaatggcaaaatggggcagcagagaagaagagaaaagaaggaaaatcatcttcccactccattccccctctagctccccatccatcccacggagagccacctccaccactcaaaaagacccccacattcactctttaagtccatgtgcagcctcattcttcctagactccaaacaagaacccgggtgccaagagggcactgagctggttaactttagctgtctgcagattgcaaagccaaaagagcatgctgtaacatgcccgctgggcttcaggagtcgcagacacccacccttagagacaaccagggggccagaggccaaagtccttgccctggctcctaaacctgcctgtctgtgtgctccccctcccgtaaggggtttgagcttgtggcagctgaacagagaggcatacccctgtcacatgtcatgtgggggaagcagggaactctcctgtttcagcaccttcatttttaaaacaaggatactaaggtttagagagaatagttacactttctcaaggttaaactctacggaatgggatgaaatggtgatagaattcagtgcttattccatctccatgtgagaggcctgagggacatggcatcattctgctagggccttcgagttattggaatttttgcaaagcatgtcaacatcccacccggcagaaactctggcatattcacttcatccacgtgcttcttctgggaccccttgttttagccaactccatacccatacttcaggagactcctgattttcctgaactctgagtcctggacttgtgttcccacacccagccttggctcttctctcaggctaaccttagccccatttgctctgctagaatgtccctttctgttttcttcctcctttggttctactgcaaccagcctcaccaaacagtattctgctcatctgtctaggagctctgcaatacacctgagctcataccctgccacacctgccccagccccacgaaggaaaacaaaacaatagcaacaaacaaacaaacaaacaaaaaaaaaaaaccctgctgaactcagattctgattcagctagcatgaagccatgacttgtaccaggcactgtcctaggtgctggggtgaacactgtcatatttaacttaacctaccagcctttcatagaatcctgctctgtgaaatttgcacaggggccaaagggaaacaaggcattatttataataattggcttgccattatccattctgttggcgctgcctgcaacaacatgatggacctgtatgctattcacagtctataaaaaagtagttctgttgtgattcaacatatagtaatctccattttaagaggacaatagaaacactcagctgttattcatcccagagccttaaacggcagagaattcctttatcaggaacataaggttagaacagcatgagttattaacattgaaagtagcccaatgcatttattgaggtgctcaaactattgaaaaaaattaacgatttttaaaagtaaaaggctagacctcaagtagcactttgggagaagtgtgtcaaaggcacaaactattcagaactgcttaggttgaaatgaggatggggaaagagtcttggtccccataacccaactcagttctgaatgttctgaagagagtaaaggagaaacgccaggcatgttcagaaatccagatttgaggggccaggagtggtgggaaatatgggagcagctgcaaatcatagttaattaacaatcattagggatacatgcataacacattttgtattcagttagctatttatttatttattcacagccacattccacaaagggcttgaggcagcctacaatggcaaaatgcaaacaagcgtaaaaagtcaggactagcatatacggtgaggaacaccttggccagaagggcacacatctgtcagccctaagggactccagaggtaccacagtcaagttccaaatttggcttgaggcatcctggcagccaaagtgaaaaggagacagggtcaggtccaagcattctctttaacaagacactgttaaatgtctttctttcaaagcaggtaaaaagctgaacactgacacagcggccccacaaataactgcagaatcagtggtctgcaactgcagtaaaatggatgggacaagggacaatggcaaaggagttgggttctggagctgaaagtcctcactgtgaggtccagcttaacctctactagctccagggtcctggagaagatgtttaatttctctggggcacgttcttattatgcataaaccagagatttaaaaagacttaatttgctaagtcgtgtgtcagaaagaagaaaaatgaaagagggagaacgaataaaggaatgaataggtatgtactatgaagtgaattgaaacatatagagcacctagcatatgaaacataccagaaccttttctagtttttttttttctttaattctttctgtgaaattgagtctgggtagcagactgttcctccatctgagtggctgtttgtcagtctctgtcttccctctcccatcctctgcccctaccactctcttcaacctcaactccagaggtagctggggctatgccacatctcaatctcagaacaccagggcacagagaagtaaagagacccaagtgatggatgggtgggtgagtctataattctcagaggaacattattagaaacaacaagtggtgatgggcacaggatcaaccaacacaatgagagagaaaaacagtcaactcggagatcaggtaatcagtgattgataatctgataatggttgaacactcacaaggaagggccatatactgaaatgagtccatttattttacatattcctaccttgagtgcttgttcacaaatatgctttacctaatccattctgattttgatgaaaagttccattttgtagaaatggaacttttgtagaacatttctacaaaatggaacttttcatcaaaatcagaatggatgccagcaatccatccaaaaccagaatagagccagcaatactggctgtcttgatgctaaacacttttcgatatcagctaacagcatgagactaactatcgagcttttgtgttttcagtgaccgtatttttctaagccaaacatttaaaaaattcacataaaagtcaaattacttgtatatattttgaggctcatctagtttaagaaaaaaaagctatcaaaaactgaatatctcttggaaattctgagtcatacagccactgcattaagctacttggacaggtgatcttcccatttttcagatgattctccttaccttcaagcttaggtaagaagtctctgctctctgttccctttgaacttgcacacatctccattctaacacttaccactctacagctgagtttctgattagactaagaacccactggccacaggatgtctgccctattcagttgcatgtttccaaaatttgctcaataacaaccaaagggaactgttttgcaagcgtagaaaatcagttcttcagtacactactaaatgcagcaagctaccctccttttttctacattgccctctacactttttagcttctagacttctcatcctgccttgaccagccccagctaggcctctttagttgcaagattccaagaagtcagagaggacctacattcacagggcctgagccagctcggagaaacgggccccctgggagtagccacagagggtcaggtggaatccatcatggtgcatcagggctgagagttgaatctgtacaatagcccaggccatgggaggccttcctaaggcccgacttgaccactaaggatctgttacttcttgggtccccaatctagcagtgagagtgaaggaaattctcaggttccttggccaaaacctcaactctctgccttcagaatatgagcttaatgagaattccctggatgagaaccactgtcattcatttaaatcacagctacacattaccgtgaagccttatcacactgggcctctctgatctcctgtaaagggtcatcaatttctgtatcttttacttttttttgtctgaataatgaacatactgctgaaagcaatgcccgggatgaccgggcacatctaggagattctaaaagtgtgagtttcagatttttggtacgattttattttcttcatgcttaaagtctcataaaattctggatccatttaatcatactacctaatcatatgtttatcatgaaaagtagcactaatgtggtaggcagactgtttttccatgtttctttctttctttctattttattttattttttatttttttaagagatagggtctctttcacctaggctagagcttattgcagcctcgcacacctgggatcaaacaaccctcttgcctcaacctcccatgcccatgtagctgggactacaggtatatgctaccacacccagctaatttttttaatttttttgtagagatgaggtctcactgtgttacctaggttggtcttgaactcctggcatcaagcaatctttctgccttggcctcccaaagcactggggttacaggcatgagccaccatgcctggccccatgtcctgtttctaaactaataattagcaaggtaaggcaaaaacggtccttttacctgtatttgagctcacatctacggaggcttcaacagaacaattccatgtcctatttttggaagaaagctccaatttctagccctagttttcagtgttgtggagtagttttatttcctgtctttcgtattttttttttaaaaaaagcttctccaacattttagttgcaatctgagacagtctgtttcagagacaaaattttacagccagatgctccagtgtgagccgctgcagtttgtttctaaggatgatcagtaacgaatggggaatgcttgtcatttgctcaaatattgtgaagtcttgtcttttcttgggcacatgcacacttttataggcaaggtttcatccatccgtaatgcctgctgggacaactgggagaacaggtcagtcatttgcagaaacagacctaaaaccctaaggcctaggagccatcacagcccccaccccatctggacattaacaagacacacagggtggggaaagaaggcaaatgggagtgcagtggagtcaggagataggcaactctgggcctccacttccgtgggggattttaataatctccctggagtcacagtgggttgttataaggaggcagagggaaggtaggatggttctgatacagaaaatagctcctcagtgggacaggggagatgacagcagagaagctttcaaccacctttttttttgtgatgccacaagtctctgcagctcacctgtatagcgctattgctctattccacgtgacaaaacatgagtcacctgctcaattagtttcattcagtccattatccctatagctagggagagctctctcccataaactggcaaatcattgttcaatatatttaatcttaatatggttgatccttccttttctttctttttacctctcttcctctctccatccttcttattcatccatccacctatctatccatccatttacctgaaggtatgttgaccatctactttgtgtcaggtactattccaagcacttaatatacaatatctgattaaattttaacaataccctggaagttagctcttaatattctttatgaatattatatgaggtttagagagtttatgtgtcttgtccaagattcagcaaaattcagcccatgggctaaattcaacctatttttgtaaataaagtttagttggaacatatccatgcccatttgtttacgtatgacacaatttcagcagagtggagtagttacaacagagaccatttggtccacaaatgctaacatatttactaactggcccttaactgaaaaagtttgccaacccctgttcttgcccagtaatacttagcaagaaagtagcagagtcaaagattcaaacccagatctatttaactcaaaaggccataattcttcaatgctgtgtcatgcaacagaagtatgtgagttttgtctacatgacttcttgacacctagggtgagatggccaggctagatttatggtaagaggaacagatctgacatatattacttagtaagtagccaattactgtggaagactctcttcatttgtaagaaaagccagtgaggatgctttttttttttttcctggtgaagtaattatagagacgagtgttgatgcatgttttgactttgctgcaaaagtagttctgtcttctccagtttaagtaattacattagtttctaaatagagcagatggaactatagttgtcaaagaatgcaaagatcagtcaactgcatttatggtgtgacattctaagcagagataccgcaaagtatcttgtgcaaaaccaactaggtgagtgctattgagcacctgtgagccagaagaaaacaggagaaaaatgtggctaaatggaaatggaaatttctacacaatgggatctggtggcaaacacattttcctaccataatgccccaacaattgcttgttttctaatgttgcctggttgggggaagatatattctgagtgttcctccaaacttgtagaactcaatttttctgggggagagggttgtcctaagatggtctgcttggtactcagagtgcaaagatgtctcctgcaagaagcaagcagcttatgaaggaagcaatgacttaaagcagacacgttacctctaaagaacagggagaagatcaaatccagaaccaggcagtagtaataagggaactgacctggcaataggccaaggatccaaacgacatgggaaccaggcatgattcaaaacagccactgctgaacacctacaccaatggggggaaaaatgatactcttagcgttagagtccacaactgctacagagtctcagctgtgatttctactgccgggtgtccccatagaagtctgcatcccaacccctgagacctgtgaatatgttaccttacttagcaaaagggactttgcagatataattaagctaaagatcttgagatggggagattattcttcattttttgggtgggctcagtgtaatcacaagtgtccttgtaaatgaaagtgggaggtaagagggtcagagtcagagagagatgtcaagatgctacactgctacctttgaagatagaggaaggggccatgagccaagcagtgcagacagcttctaggagctagaaaaagtcagccgacagattctgtcccagaacctctagaaccaacacatccaggcaacaccttgattttagcccagtgaaacccatttcagacatctgactcccagaaggccagaagataataaatttgtgtggtttcaagccactatgtctatggtaatttgttatagcagcaatgataaactaatacaacagccctgacttggggggagggtaaaggaaagagccacacaccaccaccctctcaccatgggaggaatagttgaaatgaacacatgacttcaggtccccaacaaagagctgaatgggtttcaggctagcttgctaattcattcaccaattctcagctctggtgttgcttgattcagaaggtaaagacaatttttaaatttccttaatttcaaaacttaattcatccaatgcatttaatttaaaatcatacattatttatccacaaatcctgatacacagggaaagaaacagaaatatttgctggacaggtggcatggaaacaaagggttattagcgattgccatgcaggcctaagtgaattcacaatgaccatcatgacatcatgtctgttgttactatcaagagcgttgctcttggataagtatcaataacctcagaactatggaaagaaccatgtgtggagtttggcaccacagatattctctgagtgattgaagtctcttctaccatggtgagtggtaccatggaagtaatcttgtccccaggcctcctaagcttacttatgatgaagtgatgagactcttacccaagaaaccattacagaaaaaaaaatcctcgcctaataaaattgtgccagtgaacaaactctcagatatatggccatattgacaagatctgcaatggtatcaaaagaggtcaagctaataacctgaggaaacaggaagaaaactccaattgtcttatacagaaggtctacaatcaataggatgaagtctaacactggcgagagtggggtgagatggatgaacttctctaccacctggtgatgaaatacattgggattctatgaaaaagcatttttttctaaactcaatttccatattaattttagagctatatgtaattagttaaaaatgttcctgaagacttaaatcaagataatcttttagaagtaacaaaatgatctacacatgaaaatactcaattcagcttcacatattgccacatgttatgttccctgagaagcagactctgagagtttagcatgtagatgttttaagtggtttccgtggggtcaacagctatgcagaataggggaagttagcaggaatggggcagaaatagaagtcaagctgtgaggtaggcccaataacatcttcagctaacctgctggggagctctaaggctggaatgtgagttgtcctgttttggggatgaaatggtaaaacatttaaactcttgattctctgagtcagtgaacattggctgccccaggaaggagcccaatcttgggcaaggcaactctctaaagctgaggggattcttgaagaagcttgtgtaaatgaatgaatgaatgaatgaatgcaagcttgtgcaaggttaacccagtggacttggggtactcaaactctgcacattttaaagagaagactggccccttgaccatcctgggagataacctataagcctttggaatacctagcctgatacaaatgtctttgtgtatctggggtcttgggatatgccagatagtttatgcaaacaatgtgatttatggtgaatgcctgtttttgttcacctggggccctggtcatgctgtattggttggacgccggagactgagcagtcatggaggtaccccaggcctatgtgactagcccccagtagaaaccctagagaccaaagctcaggtgagcttccttgttggcaatccttcctatgcattgtcacacactgttgctgagaggatgaagcattgctggcacaaccccaagatcacacatgctttctcctatgctgtttttgttgttgttgttgttttgtttttttgtttttgagacggagtctcactctgtcgcccaggctgcagtgcagtggtgcgatcttggctcactgcaatctctgcctcctgcattccagcgattctcctgcctcagcctccttaatagctgggattacaggcctggctaatttttgcatttttagtagagatgggatttcaccatattggttaggctggtctcgaactcctgactttgtgatccactcacctcgacctcccaaagtgctggggttacaggcgtgagccaccacacccggccactatcctatgcttcttttaaaaccagccgttcactgttaatctgtattcttttactatattatctatatttactatgtttactaatttttactgtattactaattttatatattatactaaatttatgtaatattactaattttactatattttactatatttattaatatttactatattaatatatatcttttactatattaaactggaacatgagtatagcagctttcctgagttctgtgagtccttttataaatcatcaagcctaaggatggtctcagggacccctgacatagggctagcacttaagagcagcctgctagctgtagtctcagcagctagggtaacaaatcctttcttgaagggatagccaggtggcacatcacagtatgtacctataaaagctagaaacaagtgaaatattcataaataggacatctatttggcaaagtagaagttaggaagtacccagccaagctctgcctcatggaataagagtgctttttgagaatgattccaatatctatcttcatttgctatacatatggagaaaacagtcctctcagtttggggagaaactctgaattattcttaaagaatctctggttatcccctctagcttacactgaacattctaggtccttgagaagatcctcatttcaaaggcaatagaaaccatctgaaattgattcattggaaaatgtatatgctattaacaccagagagcagaagtagactggctaaaatatagcaacttgaaatatattttatgtactggaatttgatcaaatagatggataacttctggaatgatgacagcaaacaatctttggaaaaacacatgactgtgcttggagaacggtatcatagtttttaagaaatgtacactgcatagctagatagcatagcagtgtccatttaaaccccaatctaacacttcgttgtaagttgacagtaggagaaaatggttattagaatatggtttgacaggccaggagctatggctcacacctgtaatcccagcactttgggaggctgaggcaggaagatcacttgaggccaggagttcgagacagtgcaaaacctcattgtctttacttaaaatacaaaaattagctgagtgtggtagcacacgcctgtaatcccagctactctggtggctgaggcacgagaattgcttgtacctgggaggtggaggtcacagtgagctgtaattacaccactgccctccagcctgggcaacacagcaagactctgaaaatatatatatatatatatatatatatatatatataataaaatattaatatattataataatataatttattatatataattatctataatatattataatataattattatatataatataatatataattatatataatatattataataatataatataatatataattatatataatatattataatatattatatattatattatatatattatatatatataatatatatataatatatatattatatatattatatatatattataaatatataatatatatataatatatatataatataataatatatatattataataatataatatattatatatataattatatataatattatatatatggtttgatgggttacttgataactgccaattcagtcttgagatgaggaacaaaactgaaatatgaaacatgactggtctggtagaccacaggactgcttctggtccaccgactgtgaacgttaatgatgtgtgttcattgctgggttgaggtaagtatgagttggtgcactaccccctatttctctctttctttgtcacagaggccttgaaagctccatgatagagatgacagagctataagatgaaagcagcccaaatccctgagtcaccaatgtttgaagaagagcttcccaggagaggtaccagacccacatgagacttcacatgattataaaatgaacttctattgtgttgaatctctgaacttcagggttgttttgcagcacagactacattatagtgacaagtagaggaaggtacaggcatgctaatttcattttaaaattaatcaaggattgtcaatggaaaataaagatttcagattccttgcaccttaaaaaagacgaaaaatatgtcttttttcttccccaacccctgcttatgtgaagcattatagtctaatagctggcattttagagagatgaaaaagatgagtttgcttcaaaatgtatatatgaccagactgtaaattcacatgcaacgcagtctgctttgggagttaaacatattatttaaacaaatcattataacttgacttattatacctcaatttgattataaaacaaacattaaagtgaaatctaaggtaagtcttttttatttccagttccaaagccatttccatttcttacttatctttgaatcctcagccccaagcacagtgcctgaaacacagcaggtatccacaatctttggatgactgaatgaaaaggaaagtttaaagtcaattacctttaatcttgcttgtggtttctcagagctaatttgaacactagatggagaaatactgaaaaaaaatatttttcagaaaggcaagcatcctcttggtctgagaggtttcataacaagttaattttattttaaatcagtatgaatggatggatgataaactttggaaagtcacacttagaactacattgaaaacaaatgaatgtgtccccagatgaaaaataataactatgtaaataaaatttgaaataaccacttgatagcaaagagaactccagtatcaagaaatattttaaattccatgcaatggttaattatattcctgaaatctatgcacaaaagggcaaaattgaagaaaaaaaagaatataggttaagatgaaattcgtgaacaagaacctgaaaaatataataggcaacaatgtgctgcatttccacatttaagaggctttaacatccatatttttctcccatgtgcaattacatgaacttataatccttgaaaaattgttattatttttgttgctaaaactgcttgtaataggagtcacagatatgtgtagtaatatgctcagatgattacatttgaacaaataccatggtaataattctcatatttggaaatgctagaatctgaattacacatacagtttgtggcatctcttttttgaagccttagattttattttattttttgttttaagaccaagtaaaaatccaactttcagctaatggaattctaggtctagttggtagaacgagatccagatggagttcaaaacacctgctgaatagtatctgtaaactgccagcttgatatcgtcaccaagaattctgcaagctgagtgtccacattggaatcttaaggacttgcatacagtgtagttatatataactcataagaactaattattaactactagactgtgaggactctttctttggcttttaaggaaagtcaccgagttaatgctgaatatatttctaaaaaattgtacttatgaaattaatagagttgaccgacaatttgaataatattaggctacagtaacctcgaacttgattactcttatacatggtaaaacaatccagaaatcctggggaagggttgtttattatggctgcatggaggttgcccaagccctggcattcttttacagtttcaagggagggcaaaagtctgaagtgggtagggactgagccatacttaataatttaaacttagtatcatggaacaattcacacccgttacatacaagttaaataaccttcatgctgtgttgcaaactgctcttcctgctatacttcaaacagatagaatcattttacaaaataaaattaccaaaatgaggatatacttcataaaactgttcaagggagaagcaaacctttggtgaagagtgtgatataatcaccaatggctttaagaatgccattgggaggatcttaaaatggagatgggccagatgcagtggctcacacctgtaatcccaacactttggaggctgaggtgggggcatcacttgagatcaggagtttgagaccagcctggccaacacggtaaaacactgtctctactaaaaatacaaaaattagctgggcatggtgacgcatgcttgtaatcttagctactcaggaggctgaggcaggagaattgcttgaattcaggaggtggaggttgcagtgagccgagatcacaccactgcactccagcctgggtgacagagtgagactccaactcaaaaataattaattaattaatcaattaattaaaataaaatggagatgaaggatggaagtgatggtgagatgtgcaagttccagcatgtgtggatctgatggcttttgaaagtatcaactgtagggattctatcatattcttacaggaacctaacagtgttgatatatatgatgaaatatagcactcaaaccttcatggaagatggtgcctctgactctggagggatacaatgaggagagagagcacacagccatagtcgaggtctccaagtctatcatgcatcagcatcaccaagagggtttcctaagatttagattgctggatgccacccccagagtttctgattccataggtttaagtgaggacctaataatttgcattttcaacaagttatcaggttattctgacactgctggtcagggaactatgctttgagaattactggtctacgtgtttcacttagaagccagaatggttcaccactgtctccttctcactgggctaaaaatccaaagtcctaaccattgccagcaaggatctatgtgatctgggccttaacaatctttctgacatcatctcctgccagtctccttgttgctagcaccactcaaggctcattgtcctccttgctgatccttacatatgccaagcttgttcccccctcacatcctttgcaattgctgcttgctccctcaacccagaatggggttcctgcagatcttcaaagggcttgctatctcacttcattcagttctttgtgcagagaagctttccataaccatcctacttaaaatcgctcttctccacagttcccctttcattactgtctgtcccttccctgaaaatttttcatatcattttcacctgaagaataatatttatttaccgattgtcagctcctctaagaacagggacttggtttgattcactgctgagttcccagtgcataagaaagtatctgacacacagtaggcattcaatacaaatttgttaaagaaaaggatgaataattgattgaataaataattttaagaaagagcaactgcaaatatattagccagcctccaaactgacaaagctaagagggtaaaggtctgagatttaaaaatcaaacttgcatctatgaaaacactctataaataagaatgtacactatatgagagaatttctgttatacataaagaagggtgaattgtatctactcacaggagccaattgtgcacatctcttcccaacccaatattcaataactttacactgatagggagaaatcagtcacagtaggaatatttacacccaggaaattggcaaacattacaattcaaggcttatttttatcagcacactactgattctatccatagataaacacattccattactcagtttgatagcctcacccatgtacctgtcacccagaccagaggtgagacaggtttgttgccaattaaaggagggaaaatgggacatctcagtataacagattgggatagactgggaagcttatctaaatcttacttcaggatgtccatttagcggggctgaacatctactttgccctgcctgagcggtcgaaacataaaacaggtggacatggggatgtgtgcttttgaagatactcacccttcgctcctgctctacatgtattatggggaaactgatcctaatcttgagtctatggatagaatatatgactcatattattcaagtctaaagttgggcccaacaatggattttcagttacacaagtccataaaatctccctctgtcttacttatgactaaatgaatcctgactatgctgtgcttttttaaaagcaggatataaaatagtacaaacccaagtttgagcacaagtaaatcaaatacatactcaagccacaagtgacagaatggaataagcaccgaaccagtaaaatttctttatttttttgttggtagttgtacaaatctattctttgtctaaacatttttgcttaaattttagtcacattgtttctgcaattaaaaaatccataatatataggttgaatttcaattttcttctctgtttataaactgttttcccacacattagaaagatgtctaagataaacccatgaattaatggagaattaaaatggcagagccaatttaaataccacatatttaaacaaacactagaaaaaaaatctcttgcaacagagattgctatagcacattaattataaggtttcagatagatttttgtaactcaaacataaattttaaagaaccttcccatttgtttctttaagttattaatgtctccaatagaaggacaagttgacctttaaatctgaaccagctcagaaaaaggcccaaatgcacacttgacctcttctacaaggagcctattttagtcacaatacaattttacccactcacaggtgctctgtagcagcctgacagtggcatttacatttttttttaaataagctaagaaataatagaacaaggaacactggtagtcacttgctttaattgtaactttgggcctctgttctgtcttatcacccattttagctgacgaatgcacttcctcattccctgttttcctcgtggtaaagtaagaaacttgaatttgaaaccagagccctgagtctcctatgccctggccatccactgcctttgcatgcagcctctgttctggccctgaatccgctctctccgcaattcccagagcattccttgggtctcaactctaaggaagcatattcctttcacgaatcattttgtaggggacacaggagggtacattcccctagcacagcctacagcatttcactaaaaagcacccagagaactttccctaaagtctcctccttagcccacagtcttctgggctttccaagctttcccactttttctcttcttgatgtccctgtctgttatattgctcctaaatttcaggacactaggagacacaaaccaatcaaaagatttcacatgctcttttaggtattataattcagtgtttacaaattatctagacattaattagatccctctcttctaccttcctggtaatcttactccattctttccaggcacctgtctttttactctggccatggtccgtcagcatttcaaattgtctacgccgcttctgctttacaaaataaccagaaaatccctctccccccaacccgaatgaagctgggaattttaacctgccatctgtcagcagctatggacctatatgatatctccttttgacagccaaacatcataaaagtgttgtctacacagatggagttcattctttacctgctacaatctggtttctgcccataccacacctctgtacctgccctcaccaagtctaacaagttcttaatcaaatgggcatgttgcaccttgtgttacttgaaccaacgtgaagtgtaaatcccacacattagaatattagagatttcataagcaccagtaaaatttatttttttattggtagttatatgaatctattctttgtctatacatttttgcttacattttagtcacattgtttggtataaagagtgtaacactagttaccattcactgggaacttcattcactgggcaccaatctttaagtatagagacttctttaaaaaaaaaaaatttttttgagacagtgtcttgctttgtcgcccaggctggatggaagtggcatgatcttggctcactgcaacctttggattcaagtgattctcgtgcctcaggttcccgagtagctgggattagaggtgtgcattaccatgcccagctaatttttttatttttagcagagataggttttcaccatgttggccaggctggtctcgaactcctgaccaccgcctcagcctcccaaagtgctaggattacctgccatgccacccagcgagaatcttctctaatcaacacaagtattgaaaataagcattgggaaaaaaatgtctagagatgtttgaaattagtggaagacttaaatctacattgaggatcaccattcagcttgcctgggctgcctctgtgtcagtcagattttgctttctagctggaaaccacccttactccatctgggaatttgaaatgtggattgttcctcgggccccaccattaatgacaacacaaacacatatttttacatgattttaatcattgtgtatgttcaatggtgtctcctggcttatttatttagcattatatcataagcatgtttaaggttgcccaatagcatctataattaccattttaattgctgcataatattccactaagtggatggtcatgatttactaagccattaccatagtgttgggaatttaggttgcttccaatttttgctaccataaattgccctgcatatagcattttcctaggtttgaattaattctttaggataatttctccagcattgattgctggtttaaagagcatgagccatttttaagacctttcatacacatttcctattccttccaaaaggactgtgctaatctgtcactagcgatgtgtgagaggccttcctaagggtaattgcatgaactgataaagtgtgcactgagaacagcctggaaccctggatgaataagcagcagtgagagctgagagtataggatatattgaagaattataggtctgcaagaattgtctttgatgggggctttatacattctctctgtctcctcgctccctcgcctgaaaatcatttacagagtcattaatgagggtctctatcataggtcaggcatcagcttttctgtaaaccaaagcctacagactttggaaaagtccctctaagtctgtgatccacacaaacactgtgagtatgctttgccatcactgggagccagattaaggctgaatgtaattctttccagtggacccagagaacttgcaaatggcttggatgagccatttatgactgatattccctggaaaagaacctaagcagttggaataagcagccacagagaccaagagtggtaaagagaggcaaggcaaaggctagagaggcatgatatgatacctccatgcccaggcaagacctggtgtcgacagagggagcaatgcttggagcctgaagtcccagtttccagtcccagctctatcttgactatgcagcctcatactgacttctaagcgtcttagagtgccctcttccaagaggacccagatacctgtctcacaggctaacatggagctgagatgggagagcatagagcttgctttgaaagatgcagggaactacaaggttattaaatccaactcagcaaccagactgtttacaccagcagtgtgcctgtccagataatattgaatatgtctgggaattcagcctggggagacaagtgagtgccaaatggtctgtttctgcaaggctgccactaagaagaggattcacacactcctggaaacccttcagagcagttcaggttattgggccaaagctagagggccttgggtgtgggctcagaattagattttctgcatattaatgatcattctttcacatcacactatatgaatgacttccaactatttccaagttattttccaactgactgagaaagctctgatccttactagttgtgggacgttgacagagttatggacctccctgagtctcagtgacttatttgttaaatggagataaaaatgcctacatttggagtaagatagggaatagtaataatcttgatggtgacaacaatgataataatgtgaataataatgtgaatctgtagagttaatacaatgtgctcactctgagctaaactaaggactgtatgtacattatcccacctaatcctcataacagcctccggaggtaggaacattaaatacctgagatcaatgaggtacccagtgagtggtaactagtattacactctttaataccaataattcccaaggaagaataacctaattagttagtgggagagcaggattgttgaaatgagtattgcctcaaggattaaccccactttgggaggttaatgtaaaaaaccaaagtgatattgattgtgttaatgaatacatttagtgctctccttggatctgtatttgacttgtaattgggtagtttcctcccactttgactctgggcttggccacatgacttgttttggccaatgggacaacagcaaactgtgggcaagtggatgcttgaaaaagtgcttgtgcatttctgcttcttctcttggatccctacttcttccacgagaagacaccccaaggccaggctagcttattgaatgtcagaccaggtggaccaaagtggagtcacccagctgaagccacctgagaccatctagttccagctgacctgctagttaatccaagatgcacattgagtattgttacgcagcattattatggcaatagctgactgatgcaaccagttccattacttcacacatactattttcttcatacatgctgataacacctggtgaataagcattttgccaaaattctacatggattgtatcatttattccttatacaaaaacccatgaggtacatgctgttattacccttactttattttatttatttattttttgagagagggtcttgttctgtcacctaggctggagtgcagtggtgcaatcacagctcactgcagcctcaacctcccaggttcaagtgattctcctgtcctcagcctcctgagtagctaggactacaggtacatgcctccacactcagctatttttttttaattgagacaaggttttgctacgttgcccatgctggtctcaagctcctgggctcaagcaatcctcccaacttggcctcctaaagcactgggatcacaggtgtgagccaccatgcccagctaccttcactttcaagatgaaaatataaggtgcaaaaatttaaataccttacccaagcttacagttagtgatgggcaagcatttcaagctgggcagctcagcttcagagcctccgccacaaccactatgcattgctttgtgcacactataagagagctcctcataccaagctgctttatacgactggttgcaaccctccccttgcctgagcataatgcctctatggacctcccttttcagccaggccaggcatcatgaatcaagagctggctgccttcctctctgagcttatggctccttctccttctttgacaaggtgctctgggaagagagaacaccatcaggaaagaaagccttctagcaaacacaagatccacagattgaaggagtgaagtgctcttcatgatgcagtgctcttaaaatccaggctgtgtgatgggcctgaagagacccgcagaaaaccaagggggccctaactgcactcttgccacttctcagtaaagtcccaagaatcccaatctgcaactgagccttcaacaggctgtgcaggtttacagccctgttctcatccaggcctcattgtctctgtcacctggacctttgtgacagcctcctcttagggcctgcagcctccagactcaccttttctaatccgccttacactccaaaccagagagacttcccaaaacacatgtcactctctgcttaaagctctgcaatgtgtccctgagatgaaatacctgaaaacatcatccaagtcccctcccaatttatcagtacagccttccaggtcttgggcactgatcttcatgtttccaaagcagagtacagggctttcctttgtctatgttcatgccccttctcttatcaatatgctcttcatcactaggttaggctcttacctgtgcatcttgtatttgggcacagatacaggggacaggggctataggatgcaatgaagaataaggtgttttgcatggagggtaatgaccctgggtcttcctcatctctggtcatgagccctcaaagtccagagactcagcaaagtggtcttcagtgtaaccccagagcctggccccaggagcactcagggactttctgggaggtaggctgtgagtaaggagctccagattcatacacattaaggtaaagacctgggataatgatcagcaattcatttacattgccttaatcacaacacttagtccttaagcaataacttatattcatatgtattgcacagattactaagtatgtgctcttccatttctcattgaaggtacagtaaaagccttgccatcactcccattatacagaggaagaaactgagacctagagaagttcagaaccttgctacatcaatcagaagtacaagccaaggctcatgaagtggtttccttattttctcaccccaagttagtaagtctgtaacttctccttcacagtgcaatttgtcacgcagtctatggcactgtagaatttggctatagatccctaagtcagaaaagtccatgtttggagaactactagtaagtcaagacagaggagtgtgacaaaggctgacaaaaccctacctgcagcctggaggtcacaggcagcctgctttttgagtctccctgaatggaggggaaggggctctccctgagggaatgtgctcaactctgggtcgtgtggaagagttaggaagttaacactccatgagcgaccctcatccaatgtcggctgggaatgggtggataaataccctaactttctaaggtatatgtgtgtccagcagggcctccagtggggatgaaccacagttggccacaatggtaacctgcccattaacacacccttcattggtctttattcccttccctgagccttcactgtgttttcagggatcacctccgaaggaaatgacttacacccaaatcaggatctgtttttgagggaacccaacataacacatggagagatgggtttcctatgaagaaggaaatatgggctgtaaaataccacggagagtcagagtaagtacaggcggctacaacaaagatagatcaggtcacggaggtctctgggaatagaggaaagccacccagaggaaaaaaggacatgactgccactagcaccatatgtatgtttcagatgggatgtgtatttatgtgtgtgtgtgtgtgtgtgtgtgtgtgtgtgtgtgtgtagggaggggtgacagagagagagaggcagaataaatatcttggtcattggttacaagccaacaaaactgaagtgatgaaactcagtgagttttatagaaatgtgctggagatgcttcaattactttctcaataggtctattttgataactgaatgaaaagaatccatgtgaagcacctaccactcttcctggcttgtagtgaacacacaaaaagaattgttgattattgtagtagacactgtagtgtacctcctagattctccttacccagccactatacccatccccattgctgtgaggtcaggtgcccaggaatcacagcatcccacccacccttcccttgctccaggcaatgccctcaactggtaggtgtcactttgcccagaaactaccattcttctccaggggacccacggccaagggcaaactggcataggctatgcaaggctggcccctggcagaatgtatgtggaaggggcaactcttcagtgtgctttatggaccatggaccaaatccagctctccatttgcttttgtaaattgttattggaacacagccaccccattcctttttgaattgtccatggctgctttcctgctacaacagaagttgagttattgcaacagaggtcgtctgggccacaagatctaaagtatttactctggcccttgatggaagaaacttgtccaccgagccctagagctgcacttccaatatggtagccattggccatatgtggatatttcaatttaaattcattaaaattaaataaaattaatatttcagttcttcaactccaaaaattacattttgagtactcagtagccatgagtcgctggtgactctcctatcagcccagatacagaacactgccatcttcacaggaagttctgttggatggtgctgcactataggcttcagcttctgggtaaaactaaggggatacttaacctgaccacattctgactcaaccccacccacatccctccctcctcaacaggttcctccctcaataaatcacatgtacctgttctcctatctcaggctctatatctagagatcccaacctaagacagcctttttttttttttttttttttttttttttttgagatggagtttgctctgtcgctcaggctgcagtgcagtggcgtgaacgtggttcactgcagccttaatctactgggctcgagcaatccttccacttcagcctcctgagtagctgggactacagggtgtgttaccatggccagctactttttaaaaattgttttgtagagatggggtctcactatgttgtcagggctggtctccaactcctgggctcaagtgacccctcccaccctggcctccaatgtgttgggattacaggtgtgaaccaccatgcccagcctccaatgactaagatagttatgatatgcttgtattgcatccccaggttcatatctttgccattcttgtgatgagagtgtgggctactaagacacaggggaggatgccaggttcacctctaaatctccagtctccactacagtgtctgtcacagagcagcattcagtaaataatacatgaataaataaagtaaataaatggtcccctcatatgctgtacccctggtgtcccgtcaacagcccagagctcctcttaatccattcccactgcacgtttcaggttcaatttctcagacattcactttacccggaagtccagctgtgacagctaatagatgaaaccatccaatttgcaagttcccctgagtctctgctgtaaaatcagcctgatcctcaggaagttccacacctaggtctccactctcagccctatgacctcacctccacagactctgcacttgagcattccaccctcagcgcttgtgaaaggagtcatgggagacacaaggctggaggatgtgtctgcatcttcagaaacccgctaacagggacagcgtctgtgataccggctgacgctcattaaaccaaggctctagtagcctgttcctctcagatttcagaactaaaagaacagtctggttatcctgacttcttcttttatcataagatgctgcaagtcgaatctacagcagtcagggttaagagaaatcattaagtaataacaaagtcaggagtttcttctctgaggtaagctttgctggaaatttctcgtccctactcaagatggcaaccaaggacactttggagatagcagcttagaaatggccctgaagtgggtctttccttagactttaggtgaaaacactttcccctgatcctctggggaaacggctcccctgaggttgtctggggtttttacagagctcttctaaagaccctgggccttggggcatgctgtttaatttactgggttattggctgtcatattgaagacaaatgcatccaaggaaaaaatggctcaagaagaacagactcctccatcacttcaatcaaggggtccttcacgaacatgcttcattaacagcaaaaagggctgttggggtgctttgtccttactctacatccccctctcagctctgcaagactactgctgtcctcccagcaaaccaagcccggcagagagagaagccatcacaggaacacagttggcctcagcagcctgatgctctcaaggaatgtgttgaatcactacacagataatcagaaggcagctgctaaggttcagaagagaaacagcaggttctatcattaagtgagaagctgcccacatgaagagttgccctaggcccccgaatgtgactaaaacacagcccaagaaggccgctacagctgcaattccatgcctgtgctgaggcccctgcgtgtctagcgccactgtactcttcgactccaaggtgtaccattcatgtggaaggctatgtaaatcatgcttcttggagggaggccaggccacagccctgcaggtgggcacatcctgtatcagtccattctcatgttactgataaagacatacctaagagtgggtaatttctaaaggaaaggggatttttttttttggtgtcgttgttttttttttttttttttgacagagtctggctctgtcgcccaggctggagtgcagtggtgtaatctcagctcactgcaagctctgcctcccgggttcatgccattctcctgcctcagcctcccgagtagctgggactacaggcacctgccaccatgcctggctaattttttctattttttagtagagatggggtttcaccgtgttagccaggatggtctcaatctcatgaccttgtgatccgcccacctcggcctcccaaagtgctaggattacaggcctgagccactgtgcccggccaaggaaagaggtttaatggactcacagttccacgtggctggggaggcctcacaattatgtcagaaggcaaggaggagcaagttacatcttacatggatggcgacaggcaaagagggagagcttgtgcaaaggaactcctttttataaaaccatcagatctcgtgaggcttattcactatcatgagaacagcaaaggaaagacctgcccccacgattcaattacctctcactggatccctcccatgacacgtgggaattgtgggagctacaattcaagatgagatttgggtggggacacagccaaaccatatcacatgccttgatggccatgcagaacactcatctctctctttgctcacctataactggggcagtctgatttcagaatcatacactccatgttctcaccacatcctataagccaagttcatggaggcacacatttatgtggtgaaagtccatctctataaacgtatccatagattcctcacagagaaaaagatatgaatgctggttaaagtaataactccctcatctctggggagtatgggaaggtcctgaaagagcccctaagttatgcttgatttactgcaaaaagtgtttgctggttgagagcagacatatccctccctcaacttctctctcatgtttggagagacaacccaggtgcagttaacaagagaacctctttgcatttgcatagcactcaagcatctgcagcacagagccaatcagagccttgccttagctcctggatgcaggcaaggcttacttgcctcaggtctatgttatccaggcaaggggaagacaaggagggcagtaagagcctgctccaactgtggtccccttataaagagctctccaaaaggccccaccctccaccactctgctttacatctcactggctaacacttggtcacatgaccacactcagctgcaagaggggcatagtcttttagcactcacatcattgccagaaaaaaataatcccatctcaggaagtaagaaggtacaaacagatattggttagcagtctcttccacttggctccttttttacaggtgatgaagcacagaatgattaagaaacttgtccaagtaaacagcagaaccaggacttgaaatccaggttttcccaaccaacctccaataccctgtccactacttccttaactgaccttctgcaccactgaggtttctgcacaaatcactgccagatgctattaacaaggcagtatcctccctccctcaagcaatctcacacacatacatatgccctcctccatctccctgggctcatcaggatcacctcattttctaaaataaatctgtcacctccatcaatcatgaaaaacaattgctcaatcagctgcagtagagggggccttttcaaatcagggattggactaaactggaattgaccagcagattcatttcaatcatcaccttgacagttacaggcagacacagtcacagaggccagggttgttgaaagactcagcatgcacaagaaaagtgcttttattctctgctgcttgcatttctgtcttggctctgcagggacaataaagcagaggtcatctcctaagctgctctgagatgcccaagaatacttatgcaaagataaagtagaagagaaaaagcaatttccttcctatatttttaagttctcaggaaaacaaccacagtggagaaaatactcatctctgccagtgtgtcaaagaatgacaacggccaggcaaatgcaattggatcttatgtgttcacagtgagaaaagaacacaattaagaaaccccagcaatacctgaattcttgaggaagtgcatagacctccatttctctggcgaagctctccagagaggcccccaaaataaactaaaggctactttattcactcacttttcaaatgggtgagtgaataaagtagcctttagtttattttacacgtgtaattaaatggctcttatatctgaatggtgtcagattataaagggttctataaacaaaaagcattttgataaaggaaagtgaatttggtatatattattgtgagagaaaaagataaatgcctttacagatggaaagtctaaaaatgatggtattgaatgtgacaacggacatatattaaactagaataaataggaattaacaaacatggccaaacccctattgcttgtcaaagtcagatataagaaaatataggcataccctattgatctcaaatgtcagaatcaatggacatttgtttaacttctacttaccaacaactgtcatggatattttctcaaatgttttccatttagtgactgtttcaaatctatgagctagtcatattttgttcccattttacagatgagaaagctgaggctcaaagagattaagcaacagtcattaagggacagaggcaggggcaggtctggaatccacttgctgtgattacaagcccagtgaggtttctgtgccttgagcagttgccttttctagaacattactaatgatattcaaggcaggttgtattgctgagcagagacactggaagcttcatctaggttcaaagtttgggtgtgccactcattagctctgtgaccatggacaagtgacttccttctccaagcttcaccctcatccttaaaaaagggataatatggccaggcacagtggctcatgcctataatcccagcactttgggaggctgaggtgggtggatcatctgaggtcaggagttcaagatcagcctggccaaaatggtaaaaccccatctttactaaaactaaaaaaaattagctgggcttggtggtgtgtgcctgcaatcccagctactcaggaggctgaggcatgagaattgcttgaacccgggaggtggaggttgcagtgagccgagatggtgccactgcactccagcctgggcaacagagcgagactccacctcaaaaaaacaaaaacaaaaacaaacaaaaaaaacaaaaaaaaaaaggaagatggatgatactatatcttcaattgctattaataagtagagaatgtaggtaaaatgcctgccacatattgtttctattctattcaaatgacaaaaaaaatggtctattaaacattcattatgaaatcaggatacttggagagattcctttaaggggaattatctgctctgaatccacattgccatttgcatgcttagaccacgtagcccttcattcatttaacagaacctccttgagtacttacttgctcaatgctggaccatgctgggcactgaggtaccagagcttagaagacactgtgatcactaccctgaggaatgtgctgagggatggtgcacgaagcagggtgttgtaactttccagcctgcatctggttatgattgctgtggctctctggattctttctgccactggttgctgatttcctgtttccctctcagagcatccccctccccttcactcatgagtcccagagctcctagaaactccaatctgtgctgtcagaaccaatcctactcatcacattcctttctttgctgctgggaggctactgaagacattgatgcctatggtgcctctgatagcaggccaaatcaagggcctgatggttgccaagggtgagtccctgcctttgtgtcacctcccccatctttgtgtcacatcacttagtgcagatttcctgaacagtgtgtccttcagttcatatgaggtgcatgtggtagaataatcagaatggatctggcaacactcagacctaaccctaaggacctcataaaaggcaaatttcccagcattctctttctccatcataactttccaggactgaccagtgctctaccagttaatagcactgacagcctacatcatgtgtgaagtcctgtgctctgtactgggaacccagcagataaataagactaacagactgatatgatttggctatgtccccaaccaaatctcatcttgaactgtagttcccatagtactcacatgtcgtgggagggacccagtgggaggttattgaaccatagaggcggttacccccatgctgctgttctcatggtagtgagttctcatgaaatctgatggttttataaggggcttttcccccacttgccctacacttctccttgctgccaccatgtgaagaaggacatgtttgcttccccttccatgcttgtaagtttcctgaggcctcctaagtcctgcaaaactgtgagtcaattcaacctcttttctttataaattacctagtcttgggtatgtctttattagcagcatgagaacagactaatacacacaccttcagtcttgtatggcttacagcctatcaaggacagcatcaagtatcacagaattgagtgataataaaaagaaaaaggtagatgatcttgcaatcatcaggtgcaaattcatggcagcaggcagctaaggagtggaaggctggaggtcaaggagaagcccacagatgtgtctgatcttcacaggccagtctagttgtggaattctccctgacagcgtattaagatacacctgcattctacctttgagagtaactggaatatttttgtcataaaattattttgaactatttaaaaaatagtttcattttcaacatcacttggtttccaagaacttaataatttatcactgtctgtggtttctctaatcactttgttcctttgggaattcttgatctgcgaggaaaactaacccacagtttatcgttaagtgtaatgaaattttttgaacagtaaatttgacaatatctataaaggcatgtagacacatatgtcatagataacgaattcttgttagcttcaattattcagtattctttttacatttttgagtcaacatattgcttttccaggccgtaaaacatttccataagtcctgaaatctcctgaccacaaagtaaaataaggaaaaagggcgcagaaagggagcaggacaggacaggggaggctggagaagctcttgcagggcttcaaatggcaggaaaggtagtgacaacactcccaggatgttagaggccatggaaactatgtaaactgagggagaaatcaggctaggtttggtgttgggatgctccccattgctgtcccatagagaatgaacagcagcaaggacatgaagttggtaattagcacccaggaggagaaggctggtagaaaggtccaagaatgatgcaagaaggctctccctagcacagtgcattcaaggatgaagaaaacaaaaaacaaaaaacaaaaaacactgtcccagacaggcaggcaggcaggcaacttagggaggacctctcaaaaagctgcagtggaacaaggaagtagcaactggccacaaatgagaacatcccacaccagacatccagggccactctacccccagaacccactcattgagggcacgaaactattcaagcggatggttactacagagaggggtagggacaagcgaaagagttatctctttgcagactgcactacgtccaacacatccagacaataccagctttgctggataactatttttcctgtgtacctatcatgttctgggcaccttgaatgactctctacatatctgttcattaaagcctcacaggagcccactgagatgggtacagttattccaaatgtatagataaggaattagcccagagaagtttagtaagttgctcaggttcacacagctggtaagtagtgagatgagagtttaaatctggaaggtcatactctccttggaatatcctgtggcttcccaaagcccactaacatcagggcaagaatatcactactacccgcattgaagagaaatttatagattatatcttattgcattaatgttatatgcatttaaattcactttcccatttagtcatcacgagaccttcttcagcaatgacaattcaatggatccaatcatatcatggtgtatttgatcctatcagcaatgagacatgtaataccccttccaccctgaaaaggtccatttcaatggaccaaaaatggaaaggtatggaagtagcaaaattaaatcacatttaaaaatacatcatcatctactggaaaagaaaaaatagtaataatctgccttagaaatttgccagatctcagctgggtgcagtggctcacgcctgtaatcccagcacattgggaggccaaggcaggtggatcacttgagttcaggagttggagaccagcctggccaaacatggtgaaaccttgtctctattaaaaatacaaaaactggccgggcatggtagtgcacccctgtaatctcagctacttgggaggctgaggcaggagaatcacttgaaactgggaggcagagattgcagtgagccgagattgcaccactgcactccagcctgggtgacagagcaagactccatctttttaagaaaaaaagaaatttaccagatctcatatttataccttggttatgggtgtaaaataaaacatgagacttcaatgaatagtggcagcaaagactcctcaggccacatctgtgaatgggagagtaaaactggagaaaaaagaaacagatctaaaggataaggagggaacatgcacagtagtatggctgattgggtgtaaaggctaaggatggtgaggggtggattccaaatgactctcaggtttctgatctgggcaaacagtatgatgtttaccaaattggagtagctatttaccaaataggagtagaccattttcagcatcaacctataatgttgaggtaggtagaaaacaggtaggaaaagtagtcaggcataaggacttgaagttcagaagtggggatatattcatgtcttgttgaagtcatggaacaggtaagacatctaggaagagtttgtgtaatgaagagagaattgggcagaggacacagccctaagaaataccatcaagtgcagaaatcagagatgagaaacagtggacatatgatccttgaagcaagttctcaatgcacatgagctggatagagcttttattttaaaaataaagctgacatgcagctcacagggaggtaaaggtggaaaatctccctattgaccctggtagatgggattgttcttaggtatggaggcatggccttttcttccttaagagggagaaaagctgaggcaagataggaaagccctaaggaaaatagagggatggatgtgggagagaaaatgtcaggtgctaaaaattcagagcctgcctaagccaagcctaaaggaaagataagagcctgcaaatatttgacatgtgttaacgccagtaagggagagaatggattccgctccaaatagggggttgagacttacaagtagtgataagaaataaaagccattgattatcagctccaaacaccaaaccacttgtttgcagagttattgtctcaggaaaacagagaagaataaaggcagaatgtcaactcataatagctatagatgggcatgtccaaataaacaaagctgctcatccactgttgaaggcagggtgaaaactgacccaatttttgaagaactgtctcaaagtcttgaaaatgctcactgacccagcaaggacggttccaggaatttattccaggaaaaaatattacatatgtgcacatatattagtatctttcaggatgctgattacagcttttaaaaattaggaaaaacttacatgtctggaaatcaaagttaggatgaaatcaattgtacatctatataacagtatattaagactgtaatcaaaacaatgcctccactctctcacccccttttcacctatcatatgacactggcttttgcctgcttatatttttaatatctgttaatgccaagtcacccatcactccaacactgacaaatccaagtgatatggtttggctgtgtccccacccaaatatcatcttgaattgtagttcccataatccccatgtgtcgagggtgggaccaggtggaggtaattgaatcatgggagtggttgcccccatcctgttcttgtgatggtgagtgatttctcatgagatctgatggttttataagggttttccccctttgctccacacttctacttcctgccaccatgtgaaaaaggatgtatttacttcctgtcccaccattattgtaggtttcctgaggcctcctaagccctgtggaacagggagtcaattaaacctctttcctttacaaattgcccactgtctggtagttctttatagtagtgtgaggacggactaatacaccaaggggaccctttggagcacctcttactcaatccttcagagttggctactttctccatcctcagttttgctgttgacctgagggcatcacaacttccttgttttcctcctgcttttagttgttcgttcatggtcttcttttcaggctctttcttcacaacccaaccttatggtggtggcattccctgggattggcctctcttgtctctccacatgctttatctaggttgatggcatttattagtatggctttgtgggggggaaaaatctgtgcttcaatgaaaaactgcattgtttatagctcatgcttccttgttatcagattctgattctatgggagctgtttcccaactctggaaattgtagataactgataataatgcagaataattcttgtccatagatatgcaaatggttccatgatcaggaagagggacaaccttgctccctcaaggaaaaaaagctagttttgcttccatttgcatattcctgaagtatacagatctcttacctttgaattttcctctgtactggctgtaacacctcaccagtttcttcattaatgaattaaatgcaatcatgttcatttttacatctctgtgaggtttacctttttttttttttttaccttttcttaagaaaagtaccttgattttaccttttcttgaaaattatcttttaacagttttaagttatatctagagccaaagaacccaaatgtatgtctctatcactgacttgtacatatatctaactgattcttcttattggaagtaatgttctctaaagttgcactgaattactgaatattgaacccatggctcctaggagaaatacaaagttcagttcctgtgagcctctgctcacaatgcttttgtcaaatgattaatatagaaccttgtttatgtacataaccttgttctgtgtgtttctgtttaaagacagcttacttaacagattttgtcaattcattaacattgaactgacagccagcagccctgtaactcaggcctgaacaaagctcatttaatatacctattttctctgcaaagcacatcacagccttcttgcgcttaggaacatcagatgacacttcagcactacacttgggggccacttaaagcagcaaaatcaccaacagcacaaaaatgtgaaaaacataacactaaataaaccatgaaaagcacactcgtttacagtaggggagctgaaacaagaaggcagagtgctacctctgaccccagctagtaatatgtgcactgggcaaccaaaagttttcactgttccgtgcaggtctgtgaatgactgggagagaaccaagagtactgatgttggtgttacaaataaattttagtgagtagataaacttgcaaatatgaaatctgcaaataatgaaaactgtatttctgtatctatattaaatgtaatgtatgtctcccccattagtattcaggatccataaaaactaagaccatatctattcaattctattatatattattcaatttaatatttgcatttattgaagtaaaaaggtacttgagtacatagaaaaatattcattatacattgttttaaagtgtgttactcaacaacatttacatattagctcagttttgtccagggagatatatctgtctgtattaagaaaagtaaaccctaatggaaagaaatgtctcaaaattttgtataatctccatgtggtggggttcatggtttctttttacatccttttttagtgtttttctgtatcttccaaaataaaataatgaaaacatatttttttcatcattgctacgaaatgccattaagacgtgaatacctgccttaacttttccactatatacagcagaagtttgaacagctccaggcaccaggaactctctaactctcaaaaaaaacatctgggtcagcacctccagcctgctcatatgacagctttaatagctcatccccatagggcctggtgctctcctaggtaatatctttcatctatctttggaatatgtggccagaattaaatgtcatggtcttgggatattttgtgtgacatattacaggcatcccactgcacactcagtctgaaccctaaactcccataatacagaataccgttaccttgatagccacacctaattaagaatgtacactcatccactcttcaaactaccagatgcgccagccagacacagaggtctgtcctcagggagttagagtctaatctattcaagacagtgggatggtctttcccagcctgtgggaggtctttagatgtctaagctgccatggctttggtcaaatgctttggggtgggtgcggggaaagtcaaatccatgtaccaactataaaaggtaattaagggttatgttattgacttcttccttctaagggatattcctctgggctcaattttattgtgtttagttcatatacagtcctatataaaatagtgtgggtcaagtttaaatggattcgctgcttaaccttcaaataaaaaaaattcaattaatcagagctcttgcctcctccatcccatcgccaccacctttcccccatgctgtctggttaatccaagattcacagcacatagaaaccttctgtagtgaacagacggcaggagtcaggtgagtctggggtcaggagatgctatttcacagctattacgagatttgagatttggggaaaattactttactcctcagagcctcagtgtccctgtgtaaaatgacagtgatcatctgaattaagtcgcagggaaactgtgaggaccaatagaaattgtgcttataaagggctctaggaagattgtactgtaaaggctatgcaagagcaggtggtgctggccacgtggaaggggctggagctttcctcccaaaataaatttccctaacagggtgtctgctccaccattatgtctacaagttcagaagatttgtaaatatggcacccactctgataggttctcttacagctgtgaagcttctttgggtcaggctctaagcttccatcccttctccctcccaagaaactcccatactctccctccccagtccatcactgtttggggtattgtaagcttattccagcaacggtgctggaataataggttaaatactgaaaaacaaagttgaaacttccctttataccaaagaccaaaacaaaccctctattagttaatgagctaaatataagacatgaaaccattaaaaaagccaacttggtaacagttgttatcactgagtgatgctttgttggattcttttcattgttgtgtgtatatttttatgattttccaacttttctccagtgcacacatttgtctccacaacattcattcatgcatgcaacacctatttattgcatccctccaggtgccatccatgattccaggcactggtgaccagaacagacaaggtaacgatccctggggagtatatagtctaatggaaagggcaagtaataaacaaatacacacacagataagtagacaactatgaattagggtaagtttggtaaacagtgttttttgtttgtttgtttgtttttattttttcttgagacagagtctcactttgtcgtccaggctggagggcagtggcatgatgtcggctcactgcaacctctgcctcctgggtttaagtgattctcctgcctcagcctcccaagtagctgggactacagacgcatgccaccacgcccgtctaatttttgcattttagtagagatcgggtttcaccatattggccagcctggtctagaactcctgaccttgtgatccacctgccccagactcccaaagtgctggtattacaggtgtgagccaccgcacccagccgtaaacagtgttttaaatggttaaaatggagagtgaggaggaggaagctagaccaacaaggtcctttgcgaagtgacttttaaagggacatgtaaagggcaatgatgagttaactagttcacacaaaacttttctgtaaaatatttattttatgctgtagagtgaccaatgagactaaagggcatatggagcatgattacatgagaatgaggtcagtgactaaaagggaatagacacaagcaaaaaatatatatttaattggaatatgaaatacatttcctattttcaaaaggttactttcaaatttcaaaaatgtgctacctctttttttcaagtataaagatgaagaagataaagaagtaaaatggcagccaccaccagagtagttatagtggctgcatccattttccgccctaagcccaggtgggaaaagggttggctggaaaagttacaagcttctaatgattaagaagccccatcaaggaaaatctacatggccgtggtggatggacaaccactctctggtggattcccattgaccttcgagaccccctaactcccactctcacctcctgctacacctcatctcaagaatctcaggatgacttgtggctcaagccaatagtgggtgggatttagaaacaactgacactctggttttcctcttttctgtcaggcagagtctttttctctgcaccaagccaggtttgggctcactgctcaggataactctcccattcttctcactgcagggagacctctgcgttccagaatggccagcaatggacagggtgcccttggcttcctctggctcaggcatcattttggctgaggctgcataccaagctcttgatagagtgagctttgtgaacacagcaaagggctagcccctcagactcatggcaatgaggatttttggggtttaatggtgaggaaggcctagggcctaggtaatgagagagaaactgaaaaaagatagcatactgtcctcttaatatgttgtaccagttaactcacctgcagaaatgcctgttaagagcctacttcgttccttgccaaaactggttactaccagtttgaaacatataagtaggtaatatattgataatgagagagaaagtgagcccctaggtgttaaagtaccaaaggctccaatttactaagcacctactaagttctaagcattgtacttagagttctatggtcagctgggtccagagcaggactctaatcggactcagtaggccccaacctcagctacttcctaaactgtgtgacttggagcaaaacactaaatctctctggccttggtagtaatggtcatgataaaacctacctcatggggttataggtttgcaggcaaagtcagtggggtaagccttgcagagcattattagccatcattaatattaatgacctgtatttctatccagtgaggtaagcagcattatactaattaacagagggggaaactgattcacagaggtcaagcaattgcccaaggctgtccagcatcctaaggagtgaatctagcattaaaactctgatgggactgaaagcaaaccccctatttaactgtcccttactctatttgaacactgagcttgaagcttggtttgcatctcagggcttagcaaatttgggactgtttctgtactgtccaaaaatgtcaatgattcactaactaataaaaataccctcatatagagtgttttacaatttataacaatcattcacattcacatttgactccaatgggtacaacaatttctaaattatataaatttttgtgacccacagtctcaatacctgaatatatgtgtgtgtgtgtgtgtgtgtatgtgtgtgtgtatttatatatatacatgaatatatatacataatatacagacatatatatggcatgtctgtctctgtacctatacccaagggcagataggttaaaatacatattttaagaagggttgtttccattcaaagaaacactttgatctcagaatgagccgccctcccccaaccccacttaatgttcagttcagtgcaaaagatgtacaaagaggggcctggaaatagagtctagagaaagttgaactgctctaggaacttgaatgagaagactttgctgcacctgtgggcaatttgggagggaggaaacagaaagaggtgaaaatttcttgcctgttgaaaggacttttaaagtctgagaaaggatgagttctatgctgggcaggacggcaatgcgaccccttgcctgagtcccaccaaacaccaagagaagtttgctgctgcaggaaacagcctttgttatgtggcttcggcagggtggtgtggaagggcccaggtccacatttggttcagttaggggagccagaagaatttgactgatgttctagaatccagggcaggcagtgaacaggggctcatgtgctctttttgaaatctccatgtgcagaatttgaaatggggagttctggtcaatacttcatagatttcactggtaaactggccccagctgatatgcggtctgtgtatttatatttcacaaaactgacacagtaattacttacactcgtggttttgtaggctcttttttttaaaacttcctacagcatgaacattaacccatgccattagatacatataccacaaaaacagtttgtaacaatactagcatagaattccactgtgtgtgtgcaccaaaatttacttaactactctccaatcgttggtgcatttaagtgatttccaagtctttgtccttataaataatgcagtgatgatctctgtctgaaactctcttttgagcagctctgattattttgctagaaaaaaaattagcaaattgtcctcttaacatgctgtaccagttaacttacctgcagaaatgcctgtaagaacctgctttgttattccttaccaatactgcttattaacaatttaaaaaatatataggtaggtaatatgatagataaaatgcatttatttgatcatctgtaacactggacatttttaatacgctttttgctattcatattttgtttagcaattacctctttatgcctttagcctttttttctatcaatgtgattacattttaaagttagagctttttatgtgtaaagatattttatctcccttttctcagttttgtcacatgttttcccacaccagtttactaacctgctttttgattttagttaacatggcatagaagatttttctttttcttgtctttctatgtagtaaaatgtgtaaaccatgacctcaatggtgtatttgcttgcttttaatgaactgagagtctctcccaataaaagaatgatattttctttatttttttctagttttgccttttaagtttttaaactacccataatttaattagcacatggtaatatatgcaataaattctattttttacaaagtatcttaccatgtacaatttattaatcatgtactatttgataagcaattttcaattcatataaattttttatttttgtaaagctggggtcctgctatgttgcccaggctggtcttgaactcctgggctcaagtgatccttctgccctggcctcccaaagtgtcatataaattttaaaagtcaccagtggaacagaacagagccctcagaaataatgccacatatctacaactatctgatctttgacaaacctgacaaaaacaagaaatggggaaatgactccctatttaataaatggttttgggaaaaccgggtagccatatgtagaaagctgaaactggatcccctccttacacgccttacacaaaaattaattcaagatggattaaagacttaaatgttagatctaaaaccacaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaaaagtgggcaaaggatatgaacagacacttctcaaaagaagacatttatgcagccaaaagatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactggaaataccatttgacccagccatccaattactgggtatatacccaaaggattataaaacatgctgctataaagacacatgcacatgtatgtttattgcggcactaatcacaatagcacagacttggaaccaacccaaatgtccaacagtgatagactggattaagaaaatgtggcacatatacaccatggaatactatgcagccataaaaaatgatgagttcctgtcctttgtagggacatggatgaagctgaaaatcatcattctcagcaaactctcgcaaggacaaaaaaccaaacaccacatgttctcactcataggtgggaattgaacaatgagaacacatggacacaggagggggaacatcacacaccagggcctgttgtggggtggggggagggggagggatagcattaggagatatacctaatgttaaatgacgagttaatgggtgcagcacaccaacatggcacatgtatacatatgtaacaaacctgcacgttgtgcacatgtaccgtaaaacttaaagtataataaaaaaataaaaataaaaaataaaggctgaaagaaagaagaaaataaaataaaattagttatgtaacatctcatcataagttgtttataagaccaatcacacaggacctgttatgaaaattccatacttgtaaagtgctacccagagcctgacacgtggttggcactctatatgtatgagtttcttttaaatttatttgggatatttgaatgcctatttatttttgtgaaagggtttatgtttcaaaaattaaaaaaatatactttcattcatgcatcaaaaaaaaattttaaagtcagttttgctatgtactgtattcatttctgggctttaattattatagtttttacaaatgttgacatttcacagagaaaccctccaatcactttttctaagtgctcttgacttctttctcctgtattttctttcagatcaacttttaaatcactttaagtttcaaaatgaatcccattaagattttgattagaactgtattaaacccatcaattaatttgggaaggattgctatcctcacaatattaaatttgctaatccaacaacatgacatatggccatttgttcaggtcttgttttctcatcctcaataaaactttgtaggtgtttgtattttcatatacatgctgcacaattcttagcttacacttaagtgtttatactgtaattacatttaagaataggatacattttattatagttttataatggttattactggcatatggctatttatttttgtttatttgctttgtgtctgaccatagcattgaaatcttttagtagttccaatagcttgttttttcagttaagtttattctcttaggcattgaggctataagaacgttttcttctggaaataagaaggtgcctttccatttctagcttactaagaattctgatcagtaatgaaggctgaatcttttcaaattactttttagcctctcttgagaggctcagatgatttttattttttggcctactaatatgaggcattacatccatagtttttctaatattcaacatttttcatcagtgtattcctggaaaacacccaactgggccatggtgcattatgcattgataatgattctggatttcaggagctagagctttgcagctgtgcagttaagggttccattttcatccgggccatttgagcaagtgtgtggccttgggcaagtcacctacctcctagacagtgagtggaggaattatacctccctcacaagcttgctgcaagaattacaagtaaaatattcaaaacaagctcaacactataagccttgcatacagtagatacccctcaaattggcagccactgttttcatcactataatcatacactttctttacattgtcatctcaagtgtgacagagctgtaagagtgattgaactctaattttaatatatttgggatgctattttttaaaaatccagagagcttgataaacactgttagcttttactatctttaatgcttctctgtgactcactttttcttcaaatttcaaccctgaaatttagaagaagttgagggattacttgttgacttactattgtaactgaataaagatttagttgcttgctgcttgcggagttcaattaacaagagcaagatctggtagaaagaaaagtgactttattccagagctagctgaagggcagtagtgcagtctccttcctcagggtgccactttgcttccaggcagaaagcagaggcttttaaaggaaggcttggagtgaagggcacgcaggggagagggcgaggaagtgcagggtctatgtgacttttcagatttcttatctatccggaggtctcactagtgccatcatgggcagagtgaggttgtaaatggtggcaatctcctattgggatagaattctggatgtgcctggtttgcttcaagtttcagtctctggaacttctaagtaacacatagttagacagacttgctgtgttggaagtgtctggtggagagaaggtaaagattatactttcattcctaaacagctaagtaggtggtggggggaaagaaaaaaagttaaacaattgattttttcccttttaaaaacgaggtgctaagttacactattgcacttcatcttctaggaggccctggctccctaaggagcatggagtggcagaaaaatctaaaagtgcaactggatgtctaatagggcttttcctgttgctttggaattttatctaagactacaaaaccaataagcatacaaaataaacactgccaccttctacagagaagacctgagggacttccagctatttcttccagagaacactaagaggttcccaagcggactctcactcttccctcccagcactacagtcagctcatacaataatgagacttcatgggttaggggaagtgagtctctgggattatgaattataggtttaaagagagagagctttatgttttgcctctttcttaagccaagggagagggactccaatggtgccaacagtagacatcgtgcgacagtgggaggggagagagggtctgcaagaagaggagatgaacatcttatgccctcacaggtgcttgtccgtctgcggataattctttttttttttttaaggcggagtctcgctctgtcgtccaggctggagtacagtggcacaatctcggctcactgcaagctccgcctcctgggttcacgccattctcctgcctcagcctcccgagtagctgggactacaggcgcccgccaccacgcccagctaatttttttttttttttttttttttttgtatttttagtagagatggggtttcactgtgttggccaggatggtctcgatctcctgacctcatgatccgcccgcctcggcctcccaaagtgctgggattacaggcgtgagtcaccacgccgtgcccagataattcttatggcgtctcaatcagaggctccataaccgagtatgatcagagcaggttttctcccttctttagctttcatctctcttccgtggtcctacaacccagaggaagcagagagtgcagcagcagcaaaacaagttcggtaggtgatgcaagaactgccagaaccctttctccacatctttttgaggaagtgctggtcataatccatcttctgtgactgccttcaatctaggttcacctgcactgcacaagcaactatgtcccttcgagcatggtgtggcatgcatgaaagtcccctccttccctagatcctcatggtcttgaaaatttctccattggtctttagaatccattaactctatggctttgattctgggtgggatagtgagtccattttcatttctactggctactgtttccatgttccccgaagatttatggatcatctcaccagaattacagtacagcagagatggaggttagatgtctgtgttcatactaccctcctgcccagaaggatgtcccattttacttctaattcagaaccctaagagttaggccaagttatgttcctcccattttatagatggtgccgccaaggcatagagaaatgaagaagaaaaactcacgagactagttaagtgatgctgttctattttctagaccttcaattacctctttttataattctctgcctctactctgtcctagaactgcatgttgccctgaaagacccttgcctgtgggacccacaggcttttcagagaacacagagaccacctgaggctgcttattgcagagagtctggattcacttccaatccctttttgctctgggcttgaaaggcctcattcttacaagccttggcctcctcaaagagagaagcatctgcgtaacatggttctccctcttacctgagactagagacaattataaaaaggacaattcccatcccccttaccccgtgccctatatcatgaaataccctcacagctacacgtcgaggactccacaacatgcacacagccacatgtcttaccttctcagcagtgatcagagcttgttgctaaaccaccactgtctaagaaagtacacagagtagcagctagagaaatccttcttaaaacagggtccatcatgctacagtgaaggaaatcaggttctgacatcctttccccaggcctaagatttatttctaaataatgtttattaaagggcccctaagttcccggttctctgcaaggcatataacttatctcactgaagctttccaacaaaatggtgcattataatatcccttagatggaagaaaataaattgagtcacagagagatggtgtaacacatcccggtcacccagccagcaagtgcccagcttgaaataaaaaccagattatttttggctctaaagcctctatccttttcattcaattctaatgactactctcacttcattgagcccagcaatttgaatttatcttttttatccccctggagaaaagagagaggtagacacatatcactgcaagtagaaatccataaatatgtaaataaaatagaacatgcaatcaaccctcaggtggagggaataggaagagagccctccaaatcaacagcgtatgtggtgtctctggctgtacaaagccacttttcacttggagagctgggactccgcaagactacaatgaagtgggttcccaggcaaggggcctttgattgacacgcaagggggacgggctaagattacgtgacttgctggattgttgatttgtgattctgtaactataatcggagtggcctggggtctgcgtcaagcgaagtttggggggataaaagaaagcaatgtctggggattaagtgagacaactgagtggctgaagacctgtttttgagatgaggaggaaaacctgggagcaaaacttacaagtgggtgtttcaaggaggcctatttgagggtaacaatgaggaagagcttcttctatctaatgctagatgatagtcttaagacaccaacaagctggtacccaagccattgaaagtggtacctgcaggagaggtacagggccaagttggacccatgtggtgtccctatctcttgtcacctcacctgctttctccagttactgacctcggcatccactgcccttggttctcactgtggactcccaatagttaatgctagcagcctgcctactgcccccactcttttaaacctaatggacactctgtgtataatccatccagagctgtacgataaccaagctaacactggatagaggataatagtcaccacccgagatctccagcagtgaaatggtctgccatggaagagtgtaaacttcccatcagaggcagcattcaaggtgaggctgggtgggcaacacacagcaattctaagacccaactcctatcacagaaagtctgctgttggggatgtgctggaggaaaccacacaatgctctagacaagagagtctctgagatcccagaccacagcatgaactctgaaatgggattttccaggagatgatgaacaacaaaagaatatgggtccaccttcaagatgccaattagttctgagaagtggacaaggaagacttcctgttttgatataattattcataatcatagcatccataacaatagcagcaaccaataacactttggttcactataggcagctaaagaacattttgagtttgatatacatgatcgcatttgctctcatacctatatctcatgaaagatggtgaatgattaaactaaggaaaagaaacaaaatgataaataaaaatataagaaatggattatctcaacagaacagcatgaagacacagacttaaattgctttcatcagtactaagaagtccctttgatcctaaagtccaagtgaaatcaggtagtccgcatggaagaggcagttatctgctgatctctcctgagctccagatttatatattcccatcacctgctatacatcttcacctccaacacaacatattcagacctgagctcatttccttttgtgtttttcggctcagaaaattgtttcaccactgtgatggttaataatgagtgtcaacttgattggattgaaggatgcaaagcattgttcctgggtatgtctgtgagggtgttgccaaagaagattaacatttgagtcagtggactgggaaaggcagacccaccctcaatctgggtgaacacaatctaatcagctgccagcatggccagaataaaagcaggcagaacatgtaaagactagactggcttagtctactggcctacatctttctcccatattggatgcttcctgtccttgtacatcagactccaagttcttcagctttgggactcggactggcttcctttctccacagtttgtagacagcctagacctcaccttgtgatcgtgtgagtcaatactccttaataaactttcctttatagatacatctgtcctattagttctgtccctataaagaaccctgactaatacaaccactcatctctcagccatctaaactgaagcatgggagtatcacctttgactccctactcccaaccccacatccctcgattcctatctgatcatctgtacagtttctggtttaactggctgggagtcttgctctgaactccagcctactgggctgggatgctgcgctacaggcaaacacttgacaatctcccccttaagggttaaggaggaggtatcctttgggttaagggaaggatagccttcccttagtaccccagaattttcttaatcagtgacctctcaaaactggcagagccagaatgcatccccacctgccttagctgaattgcctctctagcatcttcttgtgctacgcccaagcttgtagcctactgctgccaagtctctgcctgctactagcatgtccttactaagccaacctctgccaccagtgcctagcacagaatttggcacaaagaaaagactaagtaaatgtttgatagaaaggagtgaaacttttgtgtagtagttattcattctcagctgatctccatagtcaccaacctccttactacccaatgccactctcaagaggacacttgtgggcagaggaggtccccagggctgaagactccatcaagtcctgtggtgaagagtttctctggccaagagacctagcatttaaccgattggtgaccttcatccaactattctgagtctcagttttcctcccatctacatctcagagctgctgcaaagaccaagctatggaatgaacatccttccaaagagccatgttggcttgtcactatacataagttagtgtaaaacttgggtatgaaatgacatcactcagtggaatccttacagcaaatttctaggctcaaccccagaatttctgatttattacgtcgggggacaggtctgagaatgtgcatttctaacaagttcccaggggaatatttgtcttaatccatctaggttgcagtaacagaataccatagactgggtaacttataaacaacagaaatttactttttatagttctgagggctggaaagtccaatatcaaggtgccagcagattaagtgtctagtgagggcccatttcctgggtcctcacatggcagaagacatgaaggagcattttggggcctcttttgtaagggcattgatctcattcatcagtattctgccctgatgacataattagtacccaaatgccccacctcctaatatcatcatttcgagggttagaatttcaacatatgaattttaaaggaacacaagtattcagtctatagcaatactgatgctgctggtcgagggaccacactttgagaaccaccgcccaagatgattctaagaccatttctctttccatgctgacgctgtttttcctccatgaagcatgctatttcaatgcttgcctttatgttttacctttttttgctgttttgttggaatcctaacccagcctgtaaattcctctgggcagaaattataccttccactctacatactctctcactttctgttttgtaaaataatgagtacatttccagcgtgattaataatagaataggaaaaggaggaaaatctcagactaccaacaccaataaacaccacctacaaatagataccagccctggaattctcttaaaaattaattacgaggcaaaaaacattccaccatcagtggcgatgcaggaaggaagattatcttcttgatgacacattttgtaaaatgtgaattattcaagattttagctgtaacttaaacaccaacgttttttaaaaataaaataccacaattgcattccaactcataatttttatattgatagccagattattgtgttttcaacatgtaaaatccattacacagtcatggcaacagtttgcaatagactgtaaatctttattgagatgatcatcttgcgattgaatttcaaaatgtattatatgatcatcagcaaataagtccacgggggctgctaaagtactttgaatatcatttataaagatcaaaaaccctggaaactcttacatttaccctgtggaaagagagaagtctcatcagcaggatcaaatcaattatttttatggatgaatattgcattgcaaagctgagataaggtattacccagtttagtaacatatcattatgtccttttaaagtagtaagtttcataatcaggtttcaatgaggaattttaccaaaggcctgttttgaaaataatcaagaaaatggcatctctgttcagcatagtggttcaataaccttacaaggaatatttccaagcaacaaaaatacctgggttacatactaccacgatacaccactgagatacttaagaatggttacagctaattccactacaactcttgctttgaaaacgcaaatttgttccaacccaattaatatatgaaagggcaatttgagcacaacacgaattctgcatttgcttatgtgtgattttgtatgtgagaaacattagtgaaggagaaacctgcacccagcagaactgagccacctacgaatacatgcaacacacacagttccaacccctacctggcccgtcagctcactgcctgtgttctgagccacacctttttccccaatttcagacagctttccttccaccacttcacagtcactcacaggctgcaagtcactcacaggctgcaacttccctgatgcccacttccacagcaaacttcaggtctttttcaaggtaacataccatctgtgttgagcatcccttatccaaaatgcttgggaccagaagcgtttcagatttcagattttcttgaatttcagaatatttgcctatacctaatacgatatcttggggatgggacccaagtccaaacacaaaattcatttatgttttatatatatcgtaggcaatcttacataatattttaaataatgttgtgcatgaaccaagtttttgtatgtcgaaccatcagaaagcagaggtgtaattatcttagccacttacgtggacaactctgtgcttgtctgtcatcaccataattcctgactccaaatgtatatgctatcgataagcaatcatcttcttaagcttattcacacataagtgcttaacagtaaaaaagaataaatgatatgtcattaatactgtgaaatattaatgtgttcaggttaactgagcagcacagtagactcagcagatacctggatcagctggtgaatgtcagcaacaaacatcctggctttcagtcctctccctgtgatgttgtgctttgatgaagggttcctatacaccacattttattttcttaggtgagaacaaacatcagaagcagttgaggaaccaggaagtggatcctctagggataaagaggcattctgctggatggcttttaaaaatgtttcctccagagtcatctgcctcattaacaatgatttttgtcttagacgtctctgattttataaattgacctggtttcctgttctgctatgaatgcatactgctccagtccttccataagctcatcaccaatgcttgccatgtcatctacaggcactttttctgcagtgttaacaatgtcatcttcattggtggtatcgtgttggcactcagtaagtttcagattctggagcattttggatttccgaggttcaggttaggaatattccacctggatggatgcatttcttagccatttcacgtgcataaaattgtgccaccagttttactagattcccctcttttttgatgtgtcactaaggaagtatgaatatggcccctagccccattttttccataatccctgtggttttcatttcgtaacttgacatagtgtggtgatttttaggcacctatatgtcaagtcatggcagagctgtatgcactttcccttgctgtttgttccatggttcctgtactgatgggtccttcccctccacccagatgccctcagtgactcctctttgttttctgaaacccatgctgcctgctcccctgagccacacccgcctccactagaacatccccagctgtatatacaatgctctctctctctctctctctctctcttttattcatcatgatgtggccaaaagtcaaaagctgagagtcagaaaatctaagtgtaattcctgaccgtaccactggccattctatgactttggacaaaaagtttaaaagtattgagtctctattcctttgtgcatatataaaatgtaagtacttacagcaaaagtttacttggtgtgaaaaaaagatataacataaataaggtaatttgcaacaaataaagagcaagttagtttaatttcttgagttgcatccagagccagatcatctcagaggtacagtgagacacatgttgttagccaatagcccctgattagaaatgcagtagaagccaggaggcctgggacacagttggatccagagaatctctcccctcttagacacaatctcagccagcaaactcttacatggcatccaggaatatcagagagacaggtgtagtcagtaacccatagagatagagtggaatccagaggaccttcagaggaatagtcccaacccagactcttaggtagggataggagcctccaggggatacagaggcaggaagctcttagggactaaggtagttccagaaacaattcagagatactgtcagagccaggaggcatttaagacatggttggcaacagaagcccctcggagacaattctagaaccaggagccatcaagaaaattttcaaaaccaagggtcacaggcccagctcagggagcctcaggaacaatgttagaattagaaactcattaaagatacaaccaaaaccagaagcccccaaggacatagtctaaatgaagcgttcacggggcacagtgagagccaggagccctcagagacacaaccagagccaggagccctcagagaaacagagccaggaaccctcagagaaacacggccagggcccccagagacaaaaccaagagccctcggagaaattattagcattagaaagcctcagacatacaaatggcaccaggagttctggaagacacagagccagtgtgtctcatcagaaacactattagatccaggaacctcccgtgacccagctaaagtcaggaagttcttagaatcacagtcagagctagaaagcccctagaaatgcaaccacagcaagaaggtcctctaaaaaacaaacaaacaaaaaaaaccccaaggccttgatcctgtttatccacaataggaagcacattcacattcaaagaaaattcggaattatctgtcacaggaaggcaagaggaaagccagtcttggcaatagcacagcctctcataatggagcctgggaaaaaaaaaaatcttacctgcacacttggtcctggtggtgaggggaggccctggcggtcccgtacccccctcacctggtcgtgtgaggagcactcggatctcatactcaacatcggggtccagatgccacagcttatagttgggagagtcgactatgtgggtctctgcccacgtgcctgtggtggtgcgatattccacttccttcaggatgatggggccatccccgatgatggagttggcatttggcttgatccacaggtatgtggcccccacagccagcagctctgggggagcaatgggcgtgggaggctctgtaagacaagcaatcaaaaaggactgtcagattcaaatgatttacagagcagactacaagcacatgacgacaagggacagaattcttgatgtagccacaaaaaaaatagtcagaaacccctttttgttttattttattatttttattttatatttttgagatggagtcttgctctgtcattcaggctggagtgcagtggggccatttcggctcactgcaacctctgcctccctggttcaagcaattctcatgcctcagcctcccaagtagctgggattacaggcacctgccaccacggctggttaatttttgtatttgtagtgcagatggggtttcaccatgttggccaggctggtcttgaactccagaccacctgaggtgatccgctggcctcagcctcccaaagtgctgggattacaggcatgagccaacacgcctggcctgaaaacccttttaaatcccattcatgccctactttaagggtttgcatgtaagtacctgaatcagtatttcttcaatagctatattcaatgcctaccttatctccttcatttaaagaaatgaaagaaagaaggccatgtgaggaaatggttttcccagaacacagcaaagctgctgggtgaatactctgttttctagcctcaaaggaaaacctgcttttgctgaagtaaagtttggcacaaaaccaggggagcctgaggtctataaacatttcttacatagaacacacagattgttagtgaagttctttccaaaaagtgatatgagcctaagtagaaaaagaatgatggcacagcaagaattcagcttctgcctcaaccccagcaggtttcttccagcagagaaagtcatgggtcacagcagacccagcaggaatgaggggttaaaggaaaagttgtgctgagttatcgtgcatctactctgtgctgccacctctcttccactgagttccacgcagtcagctaagtagaccagaggttcagcaggcttggattgtagcctcttccttgcaattattagcccatggcaaagctacaaaaattaacacttaccttgtacttcttatgtactttaaaatctcacacgtatcattcatgtaattcttgggacagcattatcaccttaactttaatggggaaaaaaaaaaaaactgacaacctaagaaatcaggtcacctaaccaaggtcatggagaaggtagtgtaggataaaacttatatccgcatgccttcctggaccaacttgcaccaaggaaagctgtctgcctcttaatactcatctttaaaaaaatcaaactgaatatatttgttatttttatttgcagtaaaaatggcagaacaataaagaaaatggaagaaagagaaaatatgagaagaaatggaagaaaatggagaaaaatggaagaaagagaaaatatctctaacatccaacatagccatttttattcttccatgtccattccaatatttatgtactgacacattttttgtgttgttataataacacatagacccaatgtagattcatttttcttccttcacttatattgtaaggattttttttttcatatactgcttgagctttatcatcattgtctttaatatttgcataacaatccatcaggttatcacactaactattctctgattgctggacccatgagttgttcatgttttgctatggtaaataatgctgcaatgaacatctttgtgcaaagacttcagtctgtcttatctcatgttttcttagaaccaactgcgaggaatgggattatatgtcaaagggtatgaacaagaggaaatgaagagtagaacaaggaagaggagaaagggcaggcacagaggaggcatatgagggtagaatacaatgtgcatttgtttgagaatatttcacttatagagggcctctgggttattcacatggatagaaggcaggtatacattttagcttggaactcaggtaagggctttgagatagagacgcactaagcatttcccttccaattaattacctagaagcaaagattctctagaaacagaataattgctatgaaacaggggtggacaatattttctcagtgtgactcgaagcaaatcttaagggacaactccagattgcctctattatagcctgccatttggtcagagaaggaaattaagcagattagtcaagctagatgcttttctttacaaagccatggaggttattactcaagaccttgttatctcaaaggtgtttgcaaattgatttttggataatttgttccaggtagagaagctaggttggcaggcagataatttctaagctcatcctttgtgcatgttaaatatatggaacctttgattgccattatcaactctccagagctcccatcagtctccaatgaggccccaggggtgatattttgcagctctgtgatgactctgcccaattccttaatataattattcacagactagacctctacagaattaagagttgcagacttcaatagtttggaggctgagtgagtggccccatttagttcttttccattgacttttcaccatggttttctgctctcctatttcagacagcagtattcaattgctgaccaccagaaagaaaataaagtattaaatctttccaaatggttagcttcttttcatgtatttctaatggcatgtgcaagtatagtaacaaacatccccttgagtatataaatgtccctatctcaaatgacttgcgacttcacacatttgtgtgcagattagcctcacggttatctctctctccatcccctcaagagtagaccatgtaagtttatcacggtgtttcctctatctggcaccaaggaagccatcagattattgtgtgctttattctttcttttttcagtgatccattgattcataattggcattgtttagaaggcacaggtactggtggttcaaagagagagaagcaaaaatatagcacagaatgtttttggtaagcagcacattattttaaaaatacatagacaaaccctatctatttatagcagttctctatctctaagatgaactcttcaagaagacagtataggaaatgtacagggccatccagtccaatggctagagtcagcagggaggaaaaggaaacccctgtgtatctcatttgccagacagagcactgagcgcatgaaatttaatgcagccaagtaaatcagtgataacaaagtgtagtaaagtcatgatgcgggtggcagaggcagttttgaagcctgtgaaaggacccaatctggtctagaggttagggaagctcttgcagagagcacttaggggagtgttctgctgggaccactcatgttgagtctatgaacaaagaaaaattcctgggggtcccctagttctcagttgcttgggctacactggtcaacaattcaaacgatgtgccctggacactcattcattcactcgttctatgaatgttgagtccctgctgctggtcacacactgtcctaggcacagacacaatcttggctgcatggagctccccttccagccttcactcgaggattgacaaagagaagtcaggagagaaggaagctgactcagaagctgttgagaaggagggcattcgagaatagagaggccctgggagccagacctaggtaagagcttatggatccataaagggatacacatatacacaatggaacgctgctcagcaagaaatgaacaagctgcagacacagacacacacaacaacatgagtaaatctcaaaaaaattcatgcaaaagaaaaataaaagaatgcatgatgaccccacttatgtgaaaagttcaagaacaagaaaaactgctctatggtgataaaagccagaagcatagtgacctgaggggcaggtactgaccgggacagagcctgagggaagtttctgggatgttagaatgttctctatatattgatttgggtaattaaataacagaaatcaaaatagtgttactataagggagatgactgcctgaaagaaggcataagaaaaatttgggaggttataaccatttctgtatcttaactggggttatgtaaaactcattaaactgtgaactttaaacagaagtatttttatgcatataagtgataccttaaaagttaaaaaaaacaaaaatatggatatgtgactcactggatgaagagaatgccactaattacctgaaagggaacctcagaaaattgggagaaaatgagcctttactcctataccattccctcttatcagcaccatcagatgcttgaattcctaacagtttttcaaacaagaggttgttcaggcacacaccagtttcttatccatgaggcttttcacttctaacacaaccaatgccctcttaacagactccacaccatcatctgtgcaaagccaggagtaagtgtttaacatctgacagcaccctctgctcacaaagtttgcaactaaattaaggaggaggaagtcttgccttcatggagctgagggctgagctgggagatgacatcagtgccttccagccaggcatcaaagcgctgcgaggacaaggatgccaggagccatccatgagacctgggcagcagcggccctgagcttccaaggctctccttcaacatgtagatggtgaagtgaccccttcctgtaattctgccacatcctcaggcatcaatctccagaacaattctgtctttcttttccctgctgtgagcacttgtaacagtttgactccctagaaattcctacagagagtaaaagtgtttcaaatagctggagatggagctgtgcgcatgtactgtctgctctagatagaaatcaaacgttttgagaaaaaccaaacgttactaagacgtgaagtgagccttgatatgattaaggtgagtgtaacctagcctccaacactttacaccacacgtctcaccccacctgatcacccttttaactgcattttctattcactgaccctccaggtctgtgggaatgcctccacccacccaaccctagccaccaacacaaacacattcatacacagacagaaacacggttgtgccattctcatttccagacttttgtctgtgccatttttcccaactagaatggctttccttttacttgttttttttgttttgttttgttttgttttgagacagagtctcaccctgtcacccaggctggagtgcagtggtgcaatctcggctcactgaaacctccaactcttgggttcaagcgattttcctgcctcagtctcccaagtagctgggattacaggcacctgtcaccacgtccagctaatttttgtacttttagtagagacgtggtttctccatgtttgccaggcaggtctcaaactccttatctcaggtgatccaccctcctcagcctcccaaagggctgggattacaggcttgagccaccatgcccagccttcaattacttttaactaaaccatgcctatttttcttttcaaaactgcttcatgacgacttactttcgtgtagcacagggctaggcacagagtagatgttcaatgctgattaaactttctacgatttatgcgcaacactgttttcatacaataatggactgaggatcaaaaaggactaccttggggccagggttcaagctttccttgaccttggcttaccactagccagatgtgtgactctactcaatcttcatggtcctcaaatttattttaccttgacaatgaaagattcaagtcataaaagtccctaaattttctctaccaagggccacagggattctatgtgtactgaatgactaccctaacagtgagcaatcggcagtagcccagccttctcattcttccctggcttgggctcacagtccttggacacaacctaagtagatatagcatcaaatcctccagtaggtgccaatcagaattagtctttgttggctgggaacggtgactcattcctgtaatcccagcacattgggaggccaaggcaggaggatcacttgaggtcaggagtttgagaccagcctgaccaacatggtgaaaccctgtctctactaaaaattagctgggcacggtggtaagcacttgtaattccagctactcgggaggctgaggcaggagaatcgcttggacctgggaggcagaggttgcagtgagccaggatcatgccactgcactccaacctgggcaacacagcgagactctgtctcaaaaaaaaaaaaattagtctttgtgccctaaccaaacatacagccagtggtcaataaatatctgatgtcttacttaaatgggtagaaaaaatatttgataagttttcccaaagtgaaaggttgagggtggcaacaaagagatgaaaaagaacaagaagtacgatgttgtagagaatactgaatgcacctctaagcaaaggattggaagtatttagagagaagacatcaaacaactgacagaaagcaacaatcaaagacatatgtaaagaaaacttctctgaaatacccaaaggcctgagtttgcagactctgaagagcacagtgggttccaggcaaaatcaatgatgagacttcagcttaagtacatactggcaatatttttgaaatataaaactaaagaaaaattcccataagccttcagaaaaaataacagatatctatcaaaacaaaataaaaagactaaaaactctggttccagactttatcattacagtttcaaacactgggatgtgatgaggaagaggatgatgagaataatcacaaataacaccatggggcagctcccatgtactgcacactttcagacacctctgactgcccttagtgttctacagtattgattcatttagtcttcacagcaactttatgggtgggtagatacccatccaaagtcaaacagttagtcattcaaaatccaggactgaggccaaggcaacatgcccggggtctgcactcctaaccattatgataaagacaatggtacattatgataaagacaatggtatacacaaaaggtcttaagggggatgtttccagtcccaagagttttataggaggttagttgtggtgcattttcaaagccagcagaaaaaatgctctcagtttctgaagaacgcagagaagaaaatgctatgtgcatgccttcccttagagaaaaactgcttgaagatttaccctagtccgccttgtgatgaatcaaaatcatgacctctagcataggggaattgtgatataagaatgatcagtcctatgagatggttagctaccacaagaccctcctttctcagatgtgagtctagaagaggagcatgatcttgtgccagactgaagtgaacacatagcccaatctgtaagaaggggcagaatggcatgcctttcatccacacagcatttagggaatgcttaaaaacaagcaatttcattatgaacggttaactttagcttcggccatcatcctgaaaagggacatcataaattcctatgaaaaagtctctccttcactttgctgaactaaattcaacaaacaaatctcatctacctaagcttaaaacatctagatttaaatacatgaaaacgctgacgtttttcttagggttatgagaatataggtactattttttctttattctgtttcttatttgatttttttacaaatgcctagtaaacctgcatcagttgcttattataaatataagcatttgaaataggtaaggtttttatatatttcaagcttttacatctggatgtgacctctcttgcagttctctgctctcaatcactaggagtgtttagcagtcaatctcccctcctatctgcccaggtagcaggagtcaagaaccacgattacatccattttcccagcaagttcctcaccaatagttcactaacaaggagacatcctggctacctctgggaccccctcaaagacctccactgtgagttttgacacttgactttcagataatcctctaatcattgcaaccacacagtagtttacctgtttcctcatttttctctccatagtgacaacacaaagcagacagtactacacccttattacagatgaggacaccaaggttacctagaaagcagctgtgtcaataccgcctgctctgtggctacaggcattgcacttcccacctacccgcaagcccaggtgttaccactcccaggagcagcccttacccagtgagggatggaagttggtggataaacatccaggtttccttgacccctagtgggacaatggggtggctttattcagtcttttagatggtcctgggtgggactgagcaccagatatcctctagcacttccagctcatagtgcactcttttttttttttttttttttttttttttttttttttttttttttgagacagagtctcactctgtcacccaggctggagtgcagtggcgcgatctcagctcaccgcagcctccgcctcccgggttcaagtgattctcctgcctcagcctcctgagtagctagaactacaggtgctacaggcatgcgccaccatgcccggctaattttttatatttttggtagagacggggtttcaccatgttggccaggatggtctggatctcctgaccttgtgatccatccgcctcagtgtcccaaagtgctgggattacaggcgtgagccaccctgctcagcccatagtgcactctttaaggggctttctttcttctcagtctcacttcgtctcctgtttaccagtgttccctacaacttagataaactattcgcaaatccatgctaaaggatctgttttttggggaaatccagtctaacatattatgaaaacgagggaaagttacttaacctctttgtgtctaaactgcctcacctgtaaactggggatatagtaacatcttcctcatggtaattgccataaagattatataaattattatagttgatactttagaacagttcctacacgtaacaagtaaactgtctttgctactaatatcatcatcctcccaaccagccaccgatgagccattcagctgtcagtgacagccttaactgatattcttattttgtgcccccccaacagagagacagaaagatcccatcaaacgcattccccttcctgtgtcaggatcaagacagtctacagtcatgtcagtgtgtactcctgccaaaactcctaccagcaaataaatttaagagctcagcctcagtctacttaacaacatcatgttgcaaccagtgaagtcattcagaaatgcataattcaataacaacttagcaccagatgaagttttatgatctgcaacactctgtctgccccggctcccccttatcccccaaaacctcaacattttcaagattactctttgctgggccacttcccaaaattaagagcagagtaaacattctagaagagccttcctttccttgcctgctaatcaggagtcctcagaaagcatgaatcaagagtctgtcacctccaaaggaggggctaggagaagctggattctaaagctttggaatcaaaggccatgcttcaggagcaccttgttccagggcagcatgggttcacaaatgggcacccttcactcccctcccccacctcagccaagcagccctgctatgaagaatggggtgaaagaaactcttgccttatccagtttggatcttaagagttccagagacaaccacgtctgtacacccacaggatggtgagagctgttattattactgtcacgcagcaaggacaaataacattctcataatgttcactgcgtgcctggctctatttcgggatttacatacaaattcatttattcctcatatcacaccggaaagtaagtactattctagtatgcatttatagatgaggagactaaaggagtgtgctagtattcagctctggtctttttgcctcaagcccaccctgttacatcagttatgtaattctggagctgggaccccactaacaacatctctaaactaccttgccagctggctttggtccagtcctagtgatgggagacttcagatggagactgggatgctggaagaaggaagaagatgctctctttctgcttcaaggtccttgtagcatcattccagcaacaggggctgctacgctccaggccttcatcttttctggtctttgtagcacccatggcacagtatctttctgaaggaactaatataacctaggccatgccccttacagctgcagtacaatctgtggggtctccctcctcagaggtctcagaatcagccctgctgtgctcctcctacagacttctaggtaccataacccctcctattccattttgttaccccagccccaggtgtggtcaccacttcctgccatttttggctaccttagcgtcccacttttgcactgacagcctttcatcactgtgtaatggattcccttcaataaaaaccctctgtttgaaatacctggtgtgatttagggtttccctcctggactgtgatttatatcaataggtattataattatctttatttttcacatgaggagaccaaggtacaaattgcccaaggtcatgtggctaattagtgagtgtgctgggatactcaggctgtcttgctctagaggccatgattttaactcacacagtgagctgatgccccactgttctcagcaccctggtcagcgacacagtgaggcaggtacatgaaggctgggagatatcatattctgcctaactaacaagtaatgagggctgactctgctatgtttggggatgtggagtcaaagcaaataactgtctctaccctggaggagactaagagactagggaaggatgcagaaaccaatgagctatagaagaaagtgatacaggctgggaagtggcaggcccagagtcctgtggactcacacagttgtgtggtattgatacagacagaagacagggaagcactgggtagaagagggtggttccccagtaagggccccaccctcaagcctgaagacccacagagctaagtcagcacagacatttctgttttcgcacccaaaaagttgccttttggcccaccatacctccaatcctgtccccatataaacccaagaccttagtgggcacacatacaagtggctgaacgttggaaccagcagaccagtgacaatggaacaatgtggcagagaaagacagaagagaaaggatgtctggacgctgaggggggttcagctggaggcagtcagataagaatctgccactgggcggcccaactccaggggaagaccaccttcccactccatcctccccttctggctccccatccatctcactgagagccacctccacggataaaacctcgcactcatcctttgagcccacatgtgatccaattcttctggtacagtgggcaactgaaggagtgagccacacccgtttcacatcctgcaagggagataagggaaatctctcatttcagtatcatacacagaatagtggtcccaaaagatgctcaattcctaatccccaaaacttacatagactccaaaacttgtatagactctgaagctgtgattaagttaaggatcttgagtagggagcatatcctggatatgtagtatcctggataagtgaagaagggaggcaggagagtcggagagagcgattggaagatgctatgttctggctgtgagggtggagaaagggaccactaggcagggaaagctggtgacgtctagaatctacaaaaggcaagggaatggactcttccctagagtcaaaggaacacagccccactgacccattttagacttctgacctccaatgctataagatcataaatttgtgttgtcttagaccactaactttgtgattggttacagcagcaatcaaaaactaatacaaggagagatatccaaattagatggaggatgttagggaaggcttcctagagcaatcaaatcatgatcttggtcttaaaggaaaaggagagtctaacaggcacaagggtggggttattcacaaagacaagactgggtcatgcacggatggtatatcctgctgaaacacaggtgatggggagcaggggtggggggccagcaaaaaggcaatcagagaggtcaaaagtgacctgatcaggaatggtcttcatcctgaggctgtgtaagcagtggtgtcacgtaggcacaagagttttagggacaactcctctgagtgcacggtgaataatgggtctaagggagagaaacagacagggggaccaataaggaagttgtgtcaattacattgaggaaagaaatgatggaggcataactcaagtaatggccacggggctggagaggcagaggcagaggaactaggccgagggttgggttgggagactgaaaggacaggacttggtcatggattgaatgtaaggagcaaggcatatggaccagtacaaagctagtgttcaacatgctgggtgagtctccccttgacctccacaatgcctgcgcagcccacataagtggaagtctacctcaatttccctgtgcagtaccccagtactctatgctagcttctccaaactatgcccaatacacttcatccctttgcattttcatattcactttcacttacaaagggaagtgaggtgtactggaaagtaaaagatcactgggtcagacagaggttgccttgcaatctctattatttaatggtgtgacattaagcaagtgatataactcccttgtggctgagtttcttcccatgtaaaatcagggtcatggtcatacctcactgggtccttgtgaagatcaagtgtaagtgcctgaaaaatgacaggccctacataaacgtgagttattcctttcttcccatggctattagctttggacccctgcactggtctttctccccattccacagccttctcctgtaatgggccattcagcccagcgcctctagcctcctgagatgccccctctgagcatctgagctctcagggcatcttgggctcatgcatcacatgtatcacgttcgataaaatcaatgtcagctttatgcatgtggtagccactaatctcccaccaggacaggcaactcactttcagaaagcactggaggaaaaacacagtagctgccatagcagaacaaatatgacaagatgacaaagtagagagaaagggggtggtagggagtgagggaagaaacatgcaattcagggcaacctgagtccaggaagcttcgtcagttgctacgctaccagccacagaaagaaaggcttacgcagaaggtgtctgtggctttagagatattgttattttgcaaattcttctccttggcctatccctatgtgcaaggggggagatgcataattagtctgtaagctgctgaaatggctagaaatgactagaagtatcgactgctctgaagtgtcaggaaggggtgtccagatggattaagaggcttatccatagagcctactcagtttgtgggaagagtttaagagatgacaccctcccttatgcaaaggaactgaaaaacgagcttcttccaaatcctccctcattcccctagggctgcctctgcccctgccgtatcttgcctgaagagagacttagcacagcctaactcactgctctttgggaaaggacttcgaaacaacacaattctgcaaggtcccatagacctctgtccctgtctccaaaagccatgattctgactaagccagatggacgctgggctccaagaatagaattagtggcttcatgctgttgtctaccacaggtcactgcctctaggtgcttctgtagaggaagagaacatgaggaaacaggaaggaaaaggtaaatatattgtttatgacattgcaggcactgttctaggtatttctaacatcttattcatgtatttctcaagcataggcccagggaactcaatgacatatacagtgatttccaagggcccatagaaagcaagtctttagctagaacatcttggaacaaaatcctgcttgaaggtgttgggtaggtttgaattttaacacacacaaaaggtttcaatgaaatatcacctttacacaaattatttcagagactccaaagagaagaattacttccaaacttactttacaagcccaggatagctttcattccaagacttcacaaagatatcacatgaaacttttaggccaatctccctcgtaaacacgtaaactaaaatcctacatattgtattaccaagccaatcctgtgatatataaaatgaataacaggttataaccacattaagtttatgctgggactacaagattgatttaatattagaaaatcaatcagtataactcatcatattaacaaactgaaagataaaaatcacatagttgtctcaagagatgctgaggaagcacttgatggaaatcaacagccattcatgataaaacttttagaaaactagaaatagaaggaaagtcctataatctgacaaagggtatctaacacattactctaacatcataatcaatggtaaaatactacacacttttccctgatttccccaattctactggtagttttagccaatgcaatgaggcaagaaaaagaaataaaagaaataaatgttggaaatgaagtaataaagctttcattattcatagactacataattgtgtgtgtagaaaattctttaaaaatctcaaattatgataaaaattaacaagttaatttagaaaagttccatagattaaatataaacaattataaaatgaaatttaaaaagtgccatttacccaatcaatggtaatagacatcataataatggtgacctctaggggaaggagtagtcgactgggaagaaacatgatgaaactaggtaccacaataatttacaccttgatttggaagatggtaatatgggtgtacatgtatatgaaagacattgagctatccacataaggttaacgcactttatgtcctttactgcattctgttctacttcaataacaaacaaattgaataattacttacaaaagcaccagcaaagtattaaaatatctggggatgtatatatacctatatgtgcatttgtgtatatacatgtattcttcttcactgaaaactgccagacattactgggatacatttttaaagatccaaataaatggagagatattccatgctcatgaattagaagaatcaatattgtaaagttgtatattctccttatgttgaagtataagctatcctaataaaatatctgtcaggctttctagacaatttgacaaacttattctgaagtttatataaaaatgcaaaaggccaggaatattcaaagcaatatttaaaaaggaaaagaaagttagagagcttaccttttaggaaattaagatttattattaagctacaataattaagaaaatgaggtattaagctacagtaattaagaaattgaaaaacagttcaagaaacaatggaggcaagaaacaaatccacatattgataatcacttgatctgtgatacagctgacacttcactgtggtaggagaagtgtattctcaacaaaacaattaggattatttaggcatccatatgaaaaaataaccttcaacattgtgccctactttatactataaacaaagtcaattccagggtactatagacctatatgtaaaaggtaaacaataagatttatataaaatagaatgtttctgaccctggggtaggcaaactataatccataaggaaattaaagtggaccacaagggtttctcacgctactcctttagaaccacaaccacctccctccccacttccccacctcatcattcatccctgggaaccaccaatctgttttctacttctaaaattttgttatttccaaaaagacaatatataatctcttgggactgtttttgtcacctgccatcataccctggaaattactccaggttttttttcttttattttattttcttttttttttttttttgagccagagtctcgctctgtcgcccaggctggagtgcagcggcgcgatctcagctcactgcaacctccacctcccaggttcacgccattctcctgcctcagcctctcaagtagctgggactacaggcacccgccaccatgcccggctaattttttgtatttttagtagagacggggtttcactgtgttagccaggatggtctcgatctcctgacctcgtgatccacctgccttggcctcctaaagtgctgggattacaggcatgagccactatgcccggcctagtccaagtttttgtgtgcacggatagttcatttatttttgttgctgtgtagtttacatgtgatatacatatgggtctattgttgtgttgaatgttgtttaaccattctcccgttaagggtcatctaggctattttcaggtttttgctattaaaataaaactgccatgaacagttatgtataggtttttgtgtgaacataagttttcatttttctggggtaaattccttggagttcaatctctgggtcatatggaattcagaactatcaaactgctttccacagcggctacatcattttacattactactatcaatgcatgagtggtccagttcctcacctgtactactattgtcactatttctttttagccattctgataagtatgtagtgatgtttcactgtggttttaatttatactaccttaatggctaatagcatggaacatcttttcaagtgtttatctcatctgtacagcctagtgcagcttgatagctggttctggctggggtcactcagaaggctgcaaacaggatgtctactgtggctacagtcctctcagggcctgactaggataggatctgcttccaagctcacagagctcctggctgtcttcagaagacccactgcaaagatcatgcatggccaggcgggggtggctcatgcctgtaatcccagccctttgggaggccgaggcgggagggtgaaatatctcatcatatcttttgcaaattttctaattgttttgtcattgagttttaagaattcttgatatattctagacattagtcctttgtcatatatatggttggcaaatattttctttcactctgtagcttatcttttcatcctccttgcctgagctttcacagagcaaaaattttaactttaataaggttcaatttatcaatttttcagttagaaatcatgcttttgatgtcaggtctgtattaactttttacttttaattatactcaaatgtatcagagctcacaaatccattcagattcctgatgaaatggtgttcagtcaaatatttggttcacaaacacacaactacgcttgattctatttcctaccatagagtttctgaataacagatatgctgaaaaatatgtctggattgttttgaaagttttagtggtatttattttttagaagtttgatattttaaaaattatgttttcggtcaggatgatgaatagttaatttaaaataagaaaattaaagaatatactcaaaactgtggaaaagatggaagaccatacaatttggaacaacctacaaactgggaagcatgtatccaacacagcactgtccttcagagtctcttcattgaacttaacaaggaagaagatgggatcactaccccaagttcaattaatgattcattagtaagcagctgtcaatctggaaaatgtaagatagacttagatacttaatatgtgacttttactactgtaaatcttcaaagggctaaaacttgatatctctcatgcaagaaaatctggcaacatctgcataagaccatcactgctgtggtgatatttaaagaccaattattggcagcctgcagcctccagcctctacaatgaccctcagtgactccctcctcctgtcattcatggccttcagtaaccctatcacttagagagtgggctggacctagtgactcgcttctagcagagtacagcaaaagcgatgtgataatatttctgagattctgttacactaagtctaccattttacttgcctctctccttctctcttccccttccctttccccttttcctctgctcttccctcccttttcttccctctcccctaaaccctctctttttctatctcccaatcatctctctctttctccttcttctcactttcccctgatctcttttttcctctatttctctcctcctgtcccccttcctcctccctcttctctccctttttatctttctgtttcgcttcctccctccctccctccttccctcctcctctctcccgttctcctttctctgtttcctctctctgccatgtcatgagtggtttcataaagaaacacatatttaagccaacaactaacaaggttctaaagccttccaatagccacatgaattatttttttttttttttgagacagagcctcgctctgtcgcccaggctggagtgcagtggcatgatctcggctcactgcaagctcttccccccgggttcacaccattctcctgcctcagcctcccaagtagctgggactacaggcacctgctaccacacccggctaattttttgtattttttgtagagactgggtttcaccatgttagccaggatggtctgcatctcctgacctcatgatccacctgctttggccttccgaagtgctgggattacaggtgtgagccaccccgcccggccatgaatgatctttgaagtgagtcttctgaagacagccaggagctctgcgagcttgggagcagatcctatcctagtcaggccctgagacaactgtagccccagtagacaccctgcttgcagccttctgagtgactccagccagaaccagctatcaagctgcactaaagctcctaaggcattcttgtgagataataaatgtttcttaaggcactttattttgtaacataggtcatagacaactaagacatcaaacatactccatagatagctaataatgtagcttaatattaccagactttttttgtgtcttaaaaaagtcttagcttgaagttaatataataaaaaggtacaagcggatgcaccagagaaaaaaacaaaacaaataaacaaaaaaagaaacagaaaaacttgacacttcctttaacatcagtttcagaatcaccattgaaggtgaagcttagaaagtaggcaaaagcctggagaagatgtggctgaatctgtttcagataaacataaaaggatacgggttactgttattgaaggacactgtcaaaggaggcattttaatgcacttcaagtgtgtccaaacatttggttaacccagtgttttattttacagtggtaaataaacatgcgcaacttctggccattttatacatttcctctgtatattctatgatcctgatatcaaggaagacattaacttgcaaattactcgaaaggaagataaccggtaaggaaatggtcagtaagatatggatggatgtttgcacacatggaactcaatacaaaacagacacggccatggggcagacactgggtcttcacacacacagcaaggattgttaattcaaatgttccagcacgtgaagcatcacttaataataaagctcgtcctaaaatctacttctttatttcatcaatggggtggtaaaaaagtaggaaaaatggaaaaaactcgcctttgtgggcatgtacacaataaaatgagaagtgaatttgaaagcatgctctgcttcaaagatataccttggcctattcaatggggcacattgatggtctcagtgaaattgccatcattcttcattgaggaagaacacatataagcaataacaaagttctcttaaaattcttgcctaaagcctcatctagatcttaatcagtaaagcaatctgcttaaagccacatataacaaagaacacacaggtttaatgtagcaattttcccgaagtattaactttttttaaaaaaagaattgatctctaatcgtatcattcctatagagctcttcacagcttgcaggcatttatggactcttcaaattgccccatgaacttcctctcctacctttgattcccctaaaggaaaggaaatgtaactttgattgtatgttcctagttggaaacccaacaaggtttcccaacagctagtgtgtactcaagattgaccctgaactatcgatgttctgcccagaaggctgatgtgagcacatttaggggttttaaggtcaattcaaaagctaaagtaaccagttcctttacagacaagaagcataaactgggcctctctaagaaatgaggtgtgtcattatgaaaactgcagggcttaatgcttacaggacccctctgaaaggactaaattgtacccacacctaaatggcaaacgcctgggtccctccaagtccatttccaactaaggtccaagtactgcttttactaaaagtcctttgtattaagctatcccactctaaaaaaaatatcttcatgggttgcaccagtggcctcaaacttggctgcacattagaatcatgcagagaagttttggagttcctaatgcttaggtctcaacccttaccaatgaaatcagaatctatgcgggaagttaaaattgtcaaaaattccctagttgtctccaatatgcagccaagttggagaaacattgggaggcatcatttattcattcatccaaagatttcctgaacactcattatatgcttggcctctaggtgattccccaaccgcccgggtctttgggtggtcatgtcttatgcatctctgtgtgtctaactctagcatcagaggcaacaatgaatgcatacatgaatgaatgaatgaatgaatgaatgaacgaacaaataaatggcccttcttatctgcctctccctgacttgggatacaggaaggatttctaatgcttacagatagctctgcatagattaacccaacaaacaactaacaacgatgtagtaataatgcctgaaaaacttggcaatgaagaggagagacgatggagaagaaatctagtctcatgatgttttctttgcaaacaacctaaaaaggagtaaaaagcacagtctcaagggaccagtgcattacctcttactctatactcccacggaatccttaggcattgagacacctcacatatttacactgatcacatctgaacaatgccacctcacatatttacactgatcacatctgaaatatacatggtcacatacaccaaatcacatctcaagtatatgtgatcattttgcacctgctgaaatagtttcttccttcaaggccctgttaatattgcatctgcttgagaaagccttctaggagaccagcagcctccctgacatgttccaaagtgcagtacatgagattaaataaggtgcacactcatggatatttacttataaattattttaatagtcaaaaatgtacattaacttgtaaaagaagacagacttccttctatcatagtaatatgcactctcatttgaaaaatcaaggaaagcatgtgtcatttttaaaaagcaataatatgaaacacataagagaacagatgggaaaaactcatgaaggggacacaggaaagactttagtgtgggaaactcagctagaagcctttgtagtctacatagtcctgttaccctctgcattgtgtcagtatcatgtctgtgtctttttcccctacaagagagtcatcacagggcagggattatggccaatcatgcttgcactcctcactacgccaagtacagtgccttacaaaggaattctgaatcgacaaaatttttctgtgattgtgttaccagtcccatttaggttaaaagcaattgacaaaaaaagtaagcccacaaactaatttgggtcattgctaaaaatataaaattgatattattctcagaagcagccctaaatagatgacgtgtcatgtgccgctttcctacctacccatctttccaggtcttgatccttctccctgacaacagcagtgagaccctgacccctgatttcttctctaccagcttggccactgggcagtgaatccaggaaagcacttaagtcacaagagatttgaaagatttcttgacatagcactcgaccatctctaacctagcgtttggggatttttcagaaaattatctctgacaaaacgaaacacaaacctcatttcgatgtgaccaccagcttgagaagcccacggaagtcaccttgcccttctcgcctgagctctgtgtgatgcagctcctggggtctctccacagcaggcagtcctctcctgtccctcccactgagcctcagcccccatcaagaagcctggaggctggcaggcccccctcacacaagctgtgtggtataaaaggatctgacatggcttaggaaacagacgcagagcgcctcgactacaccgcggatattttctcagtttaaaaaaatgtgttctcacttaagaatgctaatggcccatgcacagaaataaaatccctgacctactttgaagctgaacttattaaacaagccgaccttattactcagaagagactgtaaaacagtagaataaagcccaaatagaattcctcgcatccctcgttaacaggagcagccaagaaaagcacaaaaggatgtcagagccctgggctgggagtcagaaaccagggcctggtccagctttttgatgactttctgtgtggcctgggataagtcaccatccctctctggctctcagaaccctcatctaggggctggacaaggaggtctctgaggccatttccacctactataactggagatcttattttttaggagcgtaatgttaaagtaaaataaaaatcaattatcaagggcatattatcagacacactaagacaggtgagggagtaagatggacattctgcctcctaggagcctatagccaggcagagccagtgggggcggtccacactgattaatggatttatttcccaacagcaatttgaaagccgccacaaggctacatacagcagacataacacaacttgtgtctgcaacaagaattccctctggctctccacctgacaactcagtttagtcgaatgaatctttcggtgtattttaaaccaccgcagagtcatgagtggccatccgtaagttataatcaaatttatcacactgggaaggaagagagtggggatacatttccacgggattttagggcagtaatgtgagtcattcctgctcattctggagaaaatcctggaactgcaaggtaagttatccaaaccagaatcagagaaaggcagggaaggtcactgatgtaacagtaggcattagtaacccacacaacagtagattagtcagtaatgataggtgctaccgtgggatgcttaaatgatgttactgagaaaatgtcatggtgcaatgtaattagagggcccccttttcaaatttcaggctcagagactcttctcttcattgactctttagcatatgctcaacctcacagagctcagaaaagaaagccagcggagagaagaaattccccaaaaagggacaagtggacctggggtttacattgagaattgcaaatcccatagtctctcccaggcatggccagggtgaactcaggacttgaaatggtgtgcacaaattccaaggcagagcaagatgtgggcaatcctatagagactggatgtccgcaattggagaatgtggtgtcccagggaaagatttagaagggtcccaccaagaagacacttggatcacgagctctgctgtcatcgttttcatagtcctcacactaagtagcctgctacagtgctccataccttggaggtatttgagtccccaaaggtactgtggaacagctagatctagagttcttgtttctgcccattttacagatacgagcactgagattcagagagatatacgcaaggccatagaggtatcaagtggcaaaacaggtaagagtgtgtgcagccccgcgtcaccgaggttaacccttaccctaacccgactctaatcccagcccctccctctctgtttacccacttcccacttgtcacacttgcttaacctcaaatttcccacagctgctaatcacagtctgcacccaccaatcacatcctgttccaccctcatgagtatcctcccacctcctgtgggagtgttgctgaactttgaacagagtgttctttgtcctccactattggtgcttgtatcatgatgggcctattctgacagctattctttgagctgtttggggtgtctccatgttgttgggcccagaaggtattctcttcatcttctcaatgtgcaatgctcattaacatctccagggatcaacacggataataaagaggaagcagagagcccaaggttgcaaggaaggcaaaccacaaccttgctgcagaggctttaaaaggctggggtgaaaagtcatttgaatgtttccagtcctgaatgcattctctgtactgcatctgacaaagctcccttgacacactgaacccccatggatccttttccccctagcaaagggagcaaaactcttaacaatctacttcagtgcatctccataaacagtggccgtccagcacccctgggagggctgccctgtgtcctgtaatgaatgcaggcccatggaaagtattgtaaagatccacagccctacagaactttgagaacactgttctatcaccattaacctacagtgggaaacagaggccaagaggtagcaaggtggtgtttatcaagttcccttagaaagtcagtggcagagctagaaccagatcttcttgattcaaaggctctacctaacacagtttatacttccctgagcatccctgaggagaacatctcttagttttgtttttgcctctcaaattcaattcacaattcttctggttaagcaccttcgcaaatttctcttaaagacccctatcccatagccagcccatatggtttgggatttatcctgccagcagcagggtatgatcagagtaggttcagattagcttaagtcaatcagcatatctactttcccactcccatagtttagggatggacacacgacccaattctgcccaactgcaatcataaatagtttattcatccataagggagaatgctgggattagtactgctgcagacttcatctgaccatgtggggccagagaataagaatgtggagaaagggaaagagagacacagagagagagagagagacagagacagacacaccagaattctatggaagtgctgtttgaacctttaattagctcacactggaagccagtaaaacctattcattgactatttccataaaaaaaattcctctgttgagtaacaaaaacaaagatagtagaaaagaaaggaggaaagaaaagaaaaaagagacagaaaaggaaataagagaaaagtaaagaaagagcattgttaccaggagtggggtgaatggaagttgaaccccaacctaaaagtggtcttggctatggtaggcagagctatgtgcagtgggcccagcaacatagagttctcatgatccaactgatgctcctctttctgctccttttactgcaacccaggttttatttattaaacctcagctcttggaagacgaagcttagagaccatctagcctcactccttccatttactacacagaaaagcttatctcaaagagggaaggaacttatccaaggccatacaagaatccaaggaacagtcacttatagaaacatcacgtgtgccttagagagctttgtaaaaccagatgccacctctacttgcccctgcacacgagctctctgcggcttcctactgtgctctaagaaatagaaaagcagctcctgtcatccggggtttggtcctatcagctaaaacttgatgttgttggaagctggcccaactttctcacccaggccattttgttcccctattggacctaaacaatcttacacaacaccaagatcaggtcaggtcattctgtagccacagtgaagtgataaggaacaagatgacttcatatttttttttctaagcaagacaaaaccaaggtcactgtgcaaatcgcaaaataccatgtatctttcttgtccagctcaaatgagtggctgccgcaactctaccaattatagctttaatcttgctctactattatccccttctagattaggtttcctcagatattcaatcatagaattgtccccacttcctaacagctcaatctagaaaaaactccacccccttgatgtctcccaaaatcatccatccaaagcccaaatcccttaacactgtcttgccgagacaccccatggttctctgtggtgtacattctccctcactacaataagtcataaacccaacttgttcaactatgggtgtgttcctaatggtctttagctggaaggcgttgatatccaaaaaaaaaaaaaaagttccacttcctttcctgatacagaattctttccataatcaagctttcctattgagtccacctccatgtcatgcatgccatcttgtgccatggcaaactaaataccattctgggcctttctaccttccacattcagatcctgttaactggaaaacccctcttctctgatcctctgacagaactaatttgggaagccttctctgaccccaggtagacaaaacaaaccctcatgcctctctgctacttccctatgctgcacacacactgttatgcacccatcacaccgaactgtaattatgcataaccccagactgcaaagctctctgaaggaaagggtcatgtaggggctgatacagaatagaggctccaggtattggctgtttactttcttcctacactgaaatgaatacctttcctattcgattgttgtcatacttcaaatcatattccaaataagcatcaaaaataataacatgcggccgggcgtggtggctcatacctgtaatcccagcactttgggagattgaggcaggcagatcacctgaggtcggaagttcgagaccagcctgaccaacatggagaaaccccatctctactaaaaatacaaaatcagctgggcatggtggtgcatgcctgtaatcccagctactcaggaggctgaggcaggagaatcactttaacccgggaggcagaggttgccctgagccaagattgcactactgcaccccagcatgggcaaaaagagtgaaattgtatctcgaaataataataataataattgttacacacgtccatataaaaggctacttgagcaggcttagagtgagcaacaaggctgtttattcacttgggtgcaagtgggctgagtccgagaaaggagtcagcgaagggtggtgggattatcgttggttcttataggtttgggataggtggtggagttaggagcaatttttgcaggcagcattcacaagggcggggtggggggaggtgcgggggtgtattgtcactagggtggggaggaatgttacaaagtacattcacaaggaaagggaatatcacaaagtacattatcacaaggacagggaatgtcacgatggcttgaccatggtgtggctagctcagaggaccttacaataataataatgataatgtgcaaatcaagactcctgtgaaagtgcagctttggtctgttgtaatcatgtcacttgtcacctgcacaatgctctcagacttgcaaagcacttcctcattaccttgtctcatttaatgcagtcctcatggcaaccttggcttctattgtggcttctcatttctgttatgtctactcttccaagatgcttagacacatgggggactcaaggctgggatgaaatcagggaataactgtagttgtctgtcacataataataagcatttagtacatgttagctattgatatgattatgttatgaacattactcttactattatggactaggatggtcctaggcctgttcaccattagatagattccttgcccttgatctgttctgctctgtataatggggagaggttggagtggagattagggggtggggaacaggtttcccaagctcctcagctggcttctgatttgatcagctagatgcactcttaggagattaggaggagggagactccaggtcatgtatgtctgtctgtctgtgtctgtctgtctctctttgtctctctttatctctctctctctctctgtttgtgtgtgtgtgtgtgtgtgtgtgtgtgtgtgtgtgtgtatgtgtgtgtgtgtctatctgtctctctccccactaaccctctcttctttaggcagatgttcttgtagcatctcaggccaatgctggacttcccaccatagcttctgtttgttgttaatctctgaattggctcatctttgcaaccaattccctacattaaattccttctgtttgaaacatctggagtttgtatttttttttgctgggccttgattagtggatgtactaggtacgtacatttgagcaagttacttgctgcattaaagtatttttatcctgtgaaaagttgctaatatctcaacattttgtattgagcatagaaagtaaaacatatgggcacataggcatctcagcacctggcacatagcagtcattttaaaaatttagtttcttctttcttcattagaaagaattgttatgtgcaaagatctcattctagggactccctagataaagaaataactgaaactattacagaatcaacaatgattattacaaaattatgtgccatacagaatcttgaaatacctaaaaatacaattacagcatattgtcatataattgtgtccacccaaaagaatatgttgaagtcctaaccctcagtacctcagaatgttaccttatttggaaatagggttgttgcagatgtaatctgttcaagatgaaacactatactggaatagggttggccttaatccaatttggctggtgtctttataggagaagatgcacagacagggaaacagggagaatgcagtgtgaagacagaggactggagtaatgaatctacaagacgaggatgccaaagattgccaggcaacctccaaaagccaggaagaggcaaggaagaattacccttcagattccaaaaggagtctggccctgctaacaccttgctgtcagactcttagcctccagaactgtgagtgaataaatttctgtgtgttgtttttttgtttgttgttttttttgccacacacagtttgtggtgctttgttgtagcagccctaggaaattaatagaatggtaagaaaagataatgagttggtagaattctgttggctcttaacattttcatcctgttatacgggccctgtataatccttgggagcatgcatatgccgagatagcattcccatgagtaggttatgttacatggcacccttgactctaagaaagggagattattctgagtagatctgacatagtaaggtgaactcttaaaaaagatggaaattccttctggcgaaagagatgtgtggtgtcagaacatttttatttgagagacaggctccatttttggctttgaagatgaaggaagcacatgacaaagaatgtgtgtggcctctaggagctgagagtggccaccggctaatagccagcaaagaaatggggccttcagtcccaccatcacaaggatcagaattcaaccagcaacaaggatgagcctagagctaggcatggtgatgtatgcctttagtctcagctactgggggaggctgaggcaagaggatcagctgagctcaggagtttcagaccagcctgagcaacacagcaataccccatctcgaaaatcaaaacacaatgagcttgaagcagatttttatccagtgtctccagatgaaaattcagctcagctaacaccttgactccagctttgtgttatattgaagagattccaaccatgctatgcccaggtttctaacctacagaactctgagatcataaattattttaagctgccaagtttgtggtaatttcttatgcaaaaatagaaaaccaatacaggtaggtacattcactccttaaaattgtatgcaattattaaattataaaaatgctaaaggtcataaagaaatatgcaaaatatgtgtaatatagcattaactttaaaataactgaaataaaatggtactctcttctgatggtatctatgccaaatacatatttatgtggataaaacaaaaaatcaaagagactttggatgtactagggtgacaggattattagttcaaagttgtcattagtcttcttttatcattttaagaatataaaatattataaaattcaagatttttcttgcccccagcccacattgaacagacaggatagactctaataggaagcatggtgtcctatgagccaagctacttgaaaaagagaaccacatgagaactgacatcctataaaattccactggagagagagatttctcagttagattaatatatcaccacatcacaatgactcatttctctagaaattccacacaggccctccttgtggccattctcctccctgcccaagagaaagaaacatagacaccgtatacttggggctaaaattgcagcttgtgttaagggcccaagatagcaggcatgctctacacgttccactttgcatttcccgtaggtctctgtcttggtctttctctttccatagctacctcctaagtggcttgaacaagttgcttaacattctgtggcctcagtgccctatcataataaagacattatgaatgtattacttaataaattgtacttccctctttttccatatatttgctgtgtgatcttagggaatacagtctctagcagtttcagttttacaacacctgaaatgggtgatgactacccatgcctacctccataggaatgttgctagcattggcattaacgagcagaattacactgttaaaggtcaagccagagagaggacaccaaatcccatccatagcagagagaatgggcagcaagtgctgcaaatggaggctgccaggtggaggtgtacagagaggtttctgcctcagagaactgaaaatccaaatactacatggtgtaatgtaaactcagaggcatgccaagcttgtagcttgctttggttattaaaatgtgagtacaaaggacctaaggtccttcgggacagaaagggccagtgctcagttccccacatcctcttttcctctttgtcatagtcaccagcaaagttacagatggcggctgctctatcatcttgcagtgtgttacggatgtttgtcccctccacagaatctcatgttgaaatgtaatctccagtgttggaggtgggacctggtggaaggtgtttcggtcataggggtggatccatcacgaatggcttgatggcctccttgcagtaataagttcacatagatctggttatttaaaagagcctaggacttttcttctctctcccttgctccctttcttgccatgtgacaagcaggctcccttttgccttccaccattattggaagcttcctggggcccttgctagaaatagatgctaccagtatgctttgtgtacagcctgtagaaccattagccaaatagaccttttttctttataaattacccaacctcagatattcctttatagcaatgtaaaatggactaacacagaaaattggtaccaggaatggagtgttgctataaaagtacctgaagatgttgaactggtttttgaactggtaatgggcagaggctggaagagtttggagatttcagaaaaagagagggagatgagggaaagtttggaacgtcttagagacttgttaagtggttgtgaccaaaatgctgatagaaatacggacagtgaaggccaggctgatgaggtcttagatggaaatgaaggatttattagggactagaataaaggtcactcatgttacaccctagcaaaaaacttggctgcattatgctcatgccctaagaatctgtggaaggttgaacttaagagtgatgacttagggtaactggcagaataaatttctaagcagcaaagtgttcaagatatggcctggctgcttctaatagcctatgatcagatgtgggaacaaaggagtgaccaagttcagaacttataattaaaagaaaagcagaaagtataacattggaaaatctgcagcctggccatatgggagagaaagaaagaactttttcagaagaggaattcaagtgggctatagagaaaccatttgctagagagattagcatgactaaaagggagacaagggctaatagccaagacaatgggggaaaggccttaaatccatttcagagatcctcagtacagcccctcccatcacaggcccagaggcataggaggaaagaatggttttaggggccaggcatgggacccttctgccctgcccagcctcaggacactgctccctatatcctggctgctccagctcccactgtggctcaaagggccccagatacagctcaggttgccagcccagagggcacaatccataagccttggaagcttccacatggtgttatgtttgcaagtgcacagaatgcaggctttctgatacatcctctgaaatctaggtggaagctggtaagcatccttcactcttgcactctggcctgccacaagggcagagccctgcaaagagactctactagagcagtgccatggagaaatgtggggctggagcccccacaaagattccccaccagggtactgcacagtggaattgtgggaatgagggccactgccctccagatcccagaatggtagagccaccagcagcttgtactctgagcctgaaaaaacagaaggtactcaactccaacccatgagagcagccacatgggctgtgtccaagaaagccacagggacaggaatgcccaaggccttgggagcccaccccttgcaccaatgtgccttagatatgggacatagagtcaaaggaggttgttttagagctttaagatttaatgcctgccctgctgggttccagacttgcatggggcctgttgcccttttcttcgggccaatttctcccttctggaatggcagtgtttacctaatcctgtactactattgcatctttgaaataaataacttgtttttggtattgtaggctcatggatggaaggaacttgttttgagtctcagataagactatgaacttttgacttctgagtggatgctctaataagttaagactttggggaactactgggaagaaatgaatgtgttttgcatgtgagaaggacatgatatttggggtccaggggtggaatgatatagtttgaatgtttgccccctctacaaatctcttgttgaaaagtaatccccagtgtgggaggtgggacctggtgggaggtgtttgggtcatggggggcagatccctcatgaatgtcttaaggctctccctgtggtaatccattcacatgagatctggttgtttaaaagagcccagcacctccacctctctcttgctccatctcttgccatgtgacataatggtttccctttgccttccaccatgattggaagcctcctgaggccctcaccagaagcaaatgctggcactatgcttcatatacagcttacacaaccatgcagagccaaataaacctcttttctttataaatttttcattctcaggtatttctttatagtgattcaaaatgaactagcacatcttggatcccatgtatagagtagagccctatccaaatgccaaggaatatgaacaaattgaacttttttttttctagcctcggacttatggggctgtttgttactgcagcattacctcctgcatcctatctagtatagctttaagctactctccccctctaacaagtggagaaaatgaggctgacagatgaaatcattggctcaaaagcacatggctaccactgatagaaccaagactcaagttcaggtggcctgactccacagcccatgactctcattcactgtggaaacttccctctgccccttgatgcctggataacccaacattgtgttcaagtggaagcagggatgtcacaagaatcccactttaaaatgagcagtatactgtgccattcattacctggactaatgagacaaaggtgatgcaggagatgccaagcatgagggcattctgacagcaagaggtatctcattaggaaaataatcctgaatgacattgttcttctctcaacaggctcccgaagaggtccaggtgccaagatagtccctttccccaagtcccacaggatctaattgtgggttctgccctgcctggatgtcagcttagattttctcaggccacaactggcttggcagtgggtatgttagccctgattttaagagaagcaaacattatgtagcagcccaaaaaagaagcccctactgagaactttgggtactaagagacaggttctatgtactcctcccagttgatgatactcagtgagatgacatgtttgccagggacagtacacatctgtgcaccctgaggttatgcaagatcactcaggctaaacagttaggatacccagattcacgaccacctcaaaaacagactatcagcgtgaccttggttctatctctgagccctggactccctattcatagcacaagagaaatggaaaagtgatatgtaaggtgatttccagcttaaaatataataataaaaactgatgtcaactctcacacatagctgataggcctataaattggtacatcccctatggagaataatttggccatatctatcaaagttaaaaatgtttagcaatctcagacctaggaattatgctaaagatatgcttgcacagtgaaataatgtttgctcaaagtaattcattgcaatattgtttgtaacaggaaaaaactgaaagcaatccaaatgcccacctatagaacccaagtaaataaatgatggtgcgtgcatacaatggaatatcccagagctatgagaaaggaggaagctctttatgtctgaatgcagaaatacatccaagatacattaagtggaaaaaaataaagccaaaagagtttttgaaatacgctacaatttatgtaagaaaaagaagataatatgatggggatttaattttgattaatctacacatgaaatacctttggaaagatatacatacacatacacacgtacacgcacacatacacacacacacacacacacacacacagagtaacattggtaatctccagggaagagaaatgtgtggctaggataaggaataaaaagagtaattttcagtgtacctttttctttcttttgattttttgaaccacataaatatattaccacaaaaaaatgagtaacattgcaatatttttaactgctgccagccaggggttgaataagaatcaagaaaattcccaaaagcacattctgaagatgctgacgaatctcaagtatcttcctcctggagcccactacccaaaggtttctcatgggcaaaatttttctcttctctattcccagtatacattgtattatctgccttcctatcatccattgctcttcagaaatttcaccatataccttaaatgaaactgtaagacttttaacattttcttttcaattttgaaaaaaatgaacttagggataagtgaaggaagacatgtgatacagtttggatgtgtgtccctgccagactgcactaaaatgtaaccccgattgttggaggtgggatgtagtgggaggtgactggatcatgggagcggatttctcacaaatagtttagcaccatccctcttggtactgtccttactatagtgagtgagttctcttaaaagctggtcatttaaaagtgcatagcacctccccctctctcttcctccagttcgggccatgtgacatgcctgcttcccctttgccttctgccatgactataagtttcctgagacctccccagaagcctagcaggtgatagcattacgtttcctgtataacctgcagaaccatgagccaattaaatctctttctttataaattatccagtctcaggtatttctttatagcaacgcaagaatggactaagacaacacggaaagaagtaagcagaaccaagctctaggtagggctctcatttcccatgcagctgttgggtgagcaccttgccctctcagagcctcagtttccccactggttcaaaaagagctatgggatagctgaggtctcaggtctacttccttccagctttatgtttctggggttctaagaatcatgtggaatagagaaaaggcaagaccacattttggaggaaactttggaccagctgcctgatgagcattttctcactttactgtcatctggcaacatcctaaatgaaccaatgagtgtccagatgggggccaaactatgagtcaaatcaacacacactcacttattatttatgtacaaattctgtgacaggtgcagtattagaagccagaaatacaactataaacaggatacaattctgcctggacagagatcatagtataaagtacactatgtagcagacaaaaaggtgatttcagtctccagcatctcatgacaaacacgtccacatctggccacaactgactaactggcacttaacttggtatcctgccaaaacaatcaaaacactacaaaaatatatgagtgattttttccagcacagtattttgatcattgatagcgaagaaatacagaagtgagactcatgtttgtcttggctttctgcctggtggttattttctagacccgacacagagaggtggaggccaaacagcatcgcagtcttgttgaactgaggaacccgaattagagttctgggctgctgactcatctggaatttgtgaggaagggtaccagagagttcatatggggagtacctgttagaatttggatattggctggcctgcatatttgcaaggtaaaactctgtaaggtctagaaaagagtggttgatgcagggctgagagctgaacagaaatgtgagaggttgaccagtgctgggaacctctggaatcctggcccacctgcagtggagttgcagttgaggcttcagaaagagcaggttatagtagtgaatattacatcaaaatcaaagtaaggcacacacatgaagataactgataagccaaaatagatccctcctaacaaagtataagacaataatgacagtttcagaaggacacgccggtaatttaactgcttaccaggataaaattcaataccatttaagtccaatcaatataatccagaccacctacagcaaactatctaccattcttaggtaacaaacaggacataaataagtaattagataggcaaacaaataaggagtaaaatgaacagatcccaagataattcagatgttagaatttgcagatgagaactttaaaatagatactataaatatttttgaaagatttaaagaaaattggatataatgggaggatagctaggaaatcacagcagagacatcagaagtaagaaaataaaaataaaaatctgatgactaaaaactaccatatctaaaataaaaagcttactctggggttagtagcagtgcaggcactgcagaagaaagagtccttgaatataaaagcagatcaacagaactaatccagtctgaacaatggatacatatacacaaatattaaaaaataaagagactttgcaacccgtgacagtgcagaaaaatatctttaacacatttctgagaattttaaaaaaacataaggaaccaagagagataccatattcatggattggaaggttccaattaagtggtagattctcccaaaattgctctacagacttagcgtaaattttgatcaaaatcccaaaagtattttttctttttaaataaatcaacatattggtgctaaagcttgtatggaagtataaagaaccaaaaatagttaaaacaatcttgattaaaagagtccatgtgcaaatccagagatatatgggaactttatactttttactcacatttgctgtgaacctaacactgctctaaaaaataaaatacattgtttaaaaagtacttgtgcagtgggacttgctctattgcacttctgttgtaagaatcttccactcttggtggctgctcccacggttctgggtctcagaatgaaaaaagagcatagatctgagctggccagacccacagcttgaatagagatgctctgctaaatagctcggatcagctgactcctaactaaaccacagacatgtgagcaaaaaaataattgctatttaaaaaaaaattgcagagggtatatacccagtaatgggatggctgggtcaaatggtatttctagttctagatctctgaggaattgccatactgtcttccacatggttgaactagtttacagtcccaccaacagtataaaagtgttcctatttctccacatcctctccagcacctgttgtttcctgactttttaatgatcgccattccaactggtgtgagatggtatctcattgtggctttgattttcatttctctgatgaccagtgatgatgagcattttttcatgtgtcttttggttgcataaatgtcttcttttgagaagtgcctgttcatatccttcacccactttttgatggggttgtttgtttttttcttgtaaatttgtttgagttcgttgtagattctggatattagccctttgtcagatgagtacattgcaaaaattttctcccattcccaaaggattataaatcatgctgctataaagacacacgcacatgtatgtttattgtggcactactcacaatagcaaagacttggaaccaacccaaatgtccaacaatgatggactggattaagaaaatgtagcacatatacaccatggaatactatgcagccataaaaaatgatgagttcatgtcctttgtagggacatggatgaagcaggaaaccatcattctcagcaaactatcataaggacaaaaaaccaaacaccgcatgttctcactcataggtgggaattgaacaataagaacacatggacacaggaaggggaacatcacacaccagggcctgttgtggggtggggggaggcgggagggatagcattaggagatatacctaatgttaaatgatgagttaatgggtacagcacaccaacatggcacatgtatacatatgtaactaacctgcacgttgtgcacatgtaccctaaaacttaaagtataataataataataataataataataataataaaagcagaggtgtaggtcttacatggatttcaagacttgtcataaagctataacaattaagacaacaagacatcaaaataatgataaaaaatagatctacagaaaaaaaagaacaacagcagaagatccaaaataaacccttacatatgcagacacctgatatattataaaggttcaactgaaatcagctggggaaagatgatatttttaacaagagtcctgggtcaactgatatccatacagacagaatcaaagtgacagtttttatagtatctatataacactttatgtgaaaatcaattttagatggattacatagacctatatttgaaatgtagagtaatagaaattctaaagataatgtgagacaggattttttttttattgtggggaacacaagtatttcttaaatatggcaaaaataaataaaagactgataatgggacatctttaaaatcaaaactgttattcatcaacagatgccattaattaagtgaaaaggcaagctacagaaagaaaaaggatatttatgatatgtatacaaggactcagatctagtaaatataaagaactacaaatcaataagacacaactcaatataaaaaaacaaaagacctgaatatccaattcaaacacatgacatcaagatcacctgtgtgtgtgtgtgtgtgtgcatgcgcgtgcacacgcgcatatgtaaaggttgctcaatttcactagtcatcagaaaaataccacaatgagctatcaccacatacctaccagaatggctaatattaaaacacagacaacaccaatatgcaatctgtcatattagaaagctatttggcagtatctgcttaagccaaagaacaactctactcctagttacatatccaagagaaatggagtccaatactaccaaaaacacgtacagaatatttacagtcacgtggttcattatgtctaaataatagaaacaactcagatgtctgtaagcagtagaatggatacattttggtatattcattccatgacatactatttaagagtaacaacgtgggccaggcacggtggctcacgcctgtaatcccagcactttgggaggccgaggcgggtggatcacgaggtcaggggatcaagaccatactggctaacacggtgaaaccccatctccactaaaaatacaaaaaatcagccgggcttggtggcgggcgccagtagttccagctactcgggaggctgaggcaggggaatggcgtgaacccagggggcggagcttgcagtgggccgagattgcgccactgcactccagcctgggagacagagcaagactctgccttaaaaaaaataaattaaaaataaattaaaaagtgaatacaacatggatgagactcaaatataatttcaagtggaagaaactagccaaaaaatatataatttatgctcttatttatataaaattcaaaaacagggaaaataattctagtagtcacaatacctttgcaaaggagaatcaatgacttggagtgagaccgaggagggcttctgaggtgctggttatattctgtatctcgatcaggatgttgtttacattattatattcagttataatgtgtcttttcctgcatttttattattcttcaaaataaaggtttatccacacacacaccaaaaaataaggaactgcaagagtccagttgagagctgacgagagccaatgcagtgatactagtgatggtaggaaagatacatagtcaagaaatattcaggagctaagttggtgggtctgttttaattgaacatatgcagggatggagtagggcgaggactgaggaaaaggcaggaatctgaaatgaatcttaggtttctttttagcttcgctgaagaaatgaatggttgagccaatgatggagatgaaaacttcgagaagaacatgttgagttgaagtgcctgtggcaatccacaggaataactccaacagctagttaatcgtaagttcagcagaactgtccgcgcaagagatatgggtgtgggagtcatcagcctccctggtcataattaaaataatgagattggatagactcactcacaaagagaaatatgaaggggtatggtagccagcactctggggaacattatatttaagggaaaggcccagaaacagaaagctgtgaccaagacagaaaaggttcagctgtagaaattgttaagaaaccaagagatatagttatggaagcccagtcctgagggaaagtcctgaaaaactgtggccaataaagtgacttctctccaacagcttggcaggaaggcaagaagttagctctatagccgtggtccttgggcaagttatttctcccctctgagcctcatttttttcagctccaatgtgggaatgttacagctaaagagtattgttaaaggctattgtgagaagtaaataagacaatgcatatgaagtgtttagcaaatagtgaaaggtctatggtcatggtgacctatagaaactatgagcaaatcaagcagggtgttctttctcaggatgagagagatagggatatgtttagagaccaaacagaagagccagtgtataaacgtcactggatacccagagaagaagcagaaagggcagccccacgtccccaggtagatggaaacacctgccactctgacacagggtaagaacggatgtggagaaagacacatctgacaaagaagtggtagatgaagcaacgaaaggggtcattcctaccaaaggcctccgccatgaactcacatgcatttgggcaagacccctaggtgtgggacaatcggtgcagatactagagatattgtaagaaataacaagtttcatttaactcacttactcatcatttagccactcacctttgacacatactaaatgcctactgggtgatttacagggaaaaaagaaatccttcatacccttgaggagataacagttccactgggatgctgaacaaggaagaaaagtgcagtgaatatatattgaacattgcctttgtaccgaaccgtgggcttacatgcatgataaatgatatcatgtgtatcccttagcagaatgggaggtaaaaatcactattcccattttacatatgtgaatactgaggcatgaaaatttaactgattagcccaaggtcacatggttgtgtctgactggtagtgcaataagagaatgcatataagcaagtgattgcaaggaagtaaggtgagatgtgtgttgcagaggtgggaattatggaggggtcaatgaagaaactgacgtataagttagattccgaaataagagttaaagaaaaagggtcaaaggcaagaaaaaactgacgaatgttccattgtcaccagaatatatgtgtccacagctcactccttgtatagagagaagttgtctataagtcgtgcttgcctccccattatcaaaatgtggctccttcttgaataagtacaattcattatcatgactgaagttatactggattttctccaagctttcctgagtatgcagaattgtccttctgcactgtcaaatccccagatcacatacttagcagctgttttcaagatattttgtcagaattgcttgtcatagaggcatagaataatgtgtcgcaggcatttttgaatataactgtctctcactagagagttggggtccagtaaccttgatgagcttaggaagctcgagagacctcctggcatgcagccctgtgcttaccctgtctgcctgcacactgtcccagatgctctgagctcacagcctgtcaatgtgaaaagacaaacacacaactgacaaagtgtaacaagtgtcaaacaagaggaatgtgggacagaacgaagtgttagctctacacagacagcactcctccaaggaggtcagaccacggttcaagcagcatgaacaaaaagcagggagtttgcatgttcaagggtaacttcatgaacaaaagttacttgggcctgaaagaaggcaaacccagggacaggatgcctggaaatgaggagatgaagggtacttgaagtcagactcaaaagttaaaatgtatcttaaaggcagcagggagcccctgaaagacaaggaacaaggggatgtcaagggaagtgcatgatggtgaactggagatgagatggatccacaggaggcagggttgtggaggcctcatgtgatgggaggatgtgggtgtcactcaggtcttggcggtgtgggtggatggaagcgtggtgggtgggcagcgaatatgtgtaatgctgttgtaatcaggcgaccaatcagacaagggctggggagggagcagtcgggctggccctcaggcttctggttggacaagtggatacacagccatgctgagaaacggacacaaacaaagaagcaggttaggggaagagggtcagtcagtgcagtttggggtgtgaatggactgtgggacctgcaggctctgcagcatcctggggctgacatcagagcagcaagtttcccttgtcattcctatcatgagccagtttcatagtcaggtttctggccttttccaaggaaatccctgctgccatgtgcatccatgcacgcacacacaggtgcatccctcacctccatctcctaattgcacagacacctccctccacttatcaacaggccaacccatttcagaccatcagtaaaatgccatttagtgataacctcccagtgatgtctgatcctttggtggctgctgccacatcccccagggactcatgaaattgtgtctgtcttgatactctgctggggccactttgtggaaggatgccaatgcccccatgttgccagaggtatctgcacctgttccctttcccttccttgcagcatctagcactgtgctcagctgcattgggaaatcctgcttgctggcctctttgcttcctcccaagtgtcctcccttcctctctgcacattcttctcaccatatcgggtctatgagtcacctgatgaacttgttaaaacacagattctgattcagtcggtggggtggggggtgtccagaattctgcatttcaaactccaaggtgatgccaatcctgctggtctccagcaagatttacccatgcccactgtctccactgcctcacacccacctccaatgcccacctccttaccagaacatctctggcttaattcactaatggcctctatgtgactaaatcccctggacattagcaactgaccctcctgctcctggaaatagtctcttctctgatctgacattggatggaagctccatgagacatctgcttctactgtaaatgggctggctagaaacttcccaaaagaaatgcctgtcgattccactttctgcaccctcgctgggagctgactccccgtctctgtcctttctgagagtctcagagtgctctgggtcactctgtctgctctctgtccaaaagtaggagaatgtcttcatctacagcagcagcatccagcagaaccctccacaatgccagagatattctatatccacactatcccacatggttgccactaggcacatgcagctcacgtggccaagaaactgaaatttttatttttacttaagcttaattaacttaaaaggccacgcatggccaacagctgacatacaggacagcacagatctatgtgcacaacaccccagaaatgagctcatcgcataccacatgttcctcaggactatggcaaactttaacaagtctgcagttatcctggaaggtggtaaacattagtggatggaaagcatgcctgccagactcagatgacttgagtacaaatcctgcttctgatactgaatgagtgactttaacaagtcacaacttcagttgtcttcattggtaataatatgaatataacctcagaatgtcttcctaggggtaagagtagtacttatctcattgactttctgggagtgttaaataagtaaatgtatatagagtgcttaggtcaatgcctaacatataaatgctcaatcagtgctgtcttgtcacgattttgattaagtctccaacctggttttgcaaagaagggattattgtcttaccatcttcattttgccaatattaaagaaaaaggggccacaccaagaacacacagaaaacgagggcttgaatatggtcctgcccagctcggaagcagctggcaggtcaaccaggggccggatgtcccattcgaagctgcagtgactgcctcccagggcggccttcccggtgagctgggctgtggggcagctcccacagagctcactatctccatatccccagaagtggctggtgggccagatgtagcaatgcgggcacctgccatgttcagtgcagttgtggcctgtggtctatcctcaggggcctgaaaaggacttgtagctccccttcccagatcctcagggcctgcataatacccctcttccactctaccctacagggacaggacacacctccctttctacccaatgtagccaactgtgtgtttctaaattcagaggagatcccagcaagatgccacgtgcttttgagatatcctcattgtcattccttgcagaaggtaccctaccccaggaagcagtcatggggagctagccacccaaggagcccacatgggatgggcagatcagaaggctgtgatttgaaagccaaaggcagaatccttgctctcctatctggacagggtaggcaactggactggagtgggattatcactgggcttggatccagaagactgggactcaaatccttgctttgatacttcctgtttgatcttagtgagttcatattacctctccgaggctgtctcaatgagtgaaaataagcttgtatgtagcaatgcatgacttttaaagtattttcacaagtgtgaattgaatcatttgttcattcagcaaatattcattgaacacccactgtgtgttctgtccctggagagacaatggtaggcaaagcaataaaatccttgccttcagaaagctcactttttaatctaatcagctaagtgtaatattaaccactgagatcaatcttatgaagaaatattacataacaatgaaaatgcatcaacaccagctgtgtggttgtttcaattattctgtttgctcccctaattcagtctctgtcctccctcatgcacctggaggcccaaatctattcactgcatctctcagccctcttaccctctggtggtcagtggggctcagccagtgagaggctacagcaggaggtagaaggtaaatttaaaacaaaaacaaagctcagggcatttctttcttgtttccctccaccatcccctaccccaaagttcttagttttcatacttagtttctaccactccctcccctgccccttgagacctgggaagtaacagctccctgctattgtttgtccctggctgcctcctcattcctcatttgtttcctcaattctgctcatatccctgtaaataatctcttcatgcctagacatggtaactcatgcttgtaatcccaacactttgggaggccaagacaggaggatcacttgaggccaggagctcaaggctgcagtgagctatcatcctgccattacgctccagcctagcatagcatcttccaatctcttcttctttctctctctctccattgccacctctcctcctttgactctgaccatccctgcctccctcttttataccccttgtgattacagtgggcccagataaatcagtataatttgcccacctcaaaatccttaactccatcataccagcaaaatcccttctgctatgtgagagaatacattcatagattcttgacagcaggatgtggacatcttttgtgtgtgtgtgtgtgtgtgtgtgtgtgtgtgtttgagactgagttttgctcttttcgcccaggctggagttcaatggaatgatctcggctcactgtagcctccacctccctggttcaagcaattctcctgcctcagcctcctgagtagcagggatcacaggcacacaccaccacgcccggctaattttgtatttttagtagagacggggtttcaccatgttggccaggctggtcttgaactcctaggtgacagagtgagactgtctcaaaaaaagaaagaaaaaaaaaccttcctcaataaactctaactagaaacaaacatgctgtaaaggaaagagcaggtgccttgagaatgtttaatgacaggctcatttcatctaggcagggagatttatcatctcaggtgggattggaagaatgtatatgaggtagacaaacacttgtacaatagtattaaaatcctccactttacaaatgagaaaagtgaggttcagagaagggaagggtggccaaggttatgcaaatccagtcttgtttgtgcatgcaaagcagctcactgtgacatttgccttccaagtcctagggacttttattactttcctattgctgcagtagcaaagttccacaaacttggtgatttaaaaagtcaagaaacaacagatgctggcgaggttgcgcagaaatagaaacacttttacactgttggtgggaatgtaaattagttcaaccattgtgggagacagtgttgcaattcctcaaagatttagaaccagaaataccatttgacccagcaatcccattactgggtatatacccaaattaatatacatcattctattacaaagatacatgcacgtgtgtgttcacaaactctgactctgaccatccctccctccctcttttatgccccttttgattacggtgggcccagataaattggtataatttgcccacctcaaaatccttaactccatcataccagcaaaatcccttctgctatgtgagagaatacattcatagattctggacagtagaatgtgggcatctttattattattattattattattattattattattattatagactgagttttgctgtttttgcccaggctggagtgtaatggcatgatcttggctcactgcaacctctgcgtcccaggttcaagcaatcctcgtgcctcagcctcctgagtagctgggatctcaggcacacatcagcacacttggctaattttgtatttttagtagagatggggtttcaccatgttggccagactggtcttaaactcctgacctcaggtgatctgcctgccttggcctcccaaagtgctgggattacaggtgtgagctaccacacccagcctggatgtgggcatctttaaggggtccattattctgctactacaggggcctacggccatggagtggatggtaacttgcccatcataaagactaggtcctattgctgaggtgttacctgcagcaatgttgcctacgggcagccacaaacaaaaccaggattctgaggccagatggcctttggcaaaaggggctggtccagcctactgtcagctttgtgaccctgagtgagacacataacctttgtaagcttcactttaccatttgcaaaatgggaacactatctggtccccatgctgagaagacacgagctggtgtgtcaagaactcaccacacagtagggcctcgggctcttccatctctcttgtcctcctcctgccttccattctctagatgcacacacacgtgcagctcacgttcagtccctcagcagatgctatcactatactttggagactgatgagctgttactaatgggatttttgtgtgtgagcagggagaggcagtgggagaatagaagagcttcagtacctcattcatcctgctgagattttgacacagacacagatcttaagagaattaggcaaagaagcagacatgctatgaataaatgtcagtgcccctcacaaaaggttacctcccaaggcctcactttttgcctgccaatactctgaggtaccagagtatctctgatcacgacgcccatctttttaacatcttttgaagactgccctgctgctgacaggacagagagaggcctccattgtggggaacctcagatggccttgtgcctgtctcctgactgctcttctcatttgggcctccatcccccccgttccaatgcaagcaaaaaaagagggtatgtcccaaatttgatatcctcttagatatctaatcctatgtaagacctgttacttgacatctttcggtgaagcttcttcagttgtaaaatgggtcactgtgaggccaaataagatcacagttggaacacaccaagaacactgccaagatacaatagctagcagagatttcattaacataacacttacagtgtgccaggtgttcgataaggtttggatgccctcctttatcacactgtctaataactgacatctttctcaggagactgtggaccatgggagggtacagaggtgtcacttatgtgtatgtgtgtgtgtccgtgagtgcctagagcattgcaggtatccagtgaatgcttgcaggaaagcaaatggaagaacaagtaagaaaaggacaactggtatgcccaccaatgttcaattcagtagaaagttttcttctggagactccagggactgttattttccctggtctactaggtgttcctgctaccatactgcagcctcaatgactgatcttactaatgacacatttgaccttgttacttttgtgtttaaaaccttttaatggtctccaggtacaagtccaacgttcttagcttggtcaaatcagaccctcctgatctggctctactggattgtatctctcttgctgcatctccaaccacccttcttcttgaattttgtgcatgagcagcaccaaacttggcaccatcctccaaataccactgtatctttcctcacattgtgcctccatccagaggctctcttccttctcaaaacccacaattatctctctagagctggctccagacgaccttccagggcaacttgcagcacccttgaaaagaattattgcccattatgtttgctctcacttcactaacagctgtaaatacctttaccatgcatcagtatttgggcagattctgtgccacacaactgtcataccttatctctaagccagtgcctctcaaatttttcccaggcattctaatgccccgaaggactttaaagacagattcctaaaccccaccctcagattctgcttcaataggtctggggtggggccggagaatttacatttctgataagtttctatcactgctgctgctgctccatgatcacactttgagtagcagtgcctcacttgtgagcaaaattacattatcatcttgcaaggggggagaggtaaggacttgccataggctaaatgatccagtggtgaggctagattttgaaacccagtctctgaagccacagcctggctcctttactcagcaacagcactaagagcatccaacattgactagcagttacctctagttcattccaccaagcacacatatacagtatctcatttaatcctcagaatcttctaaggtaaagccattgttcctacacgacagctgatgaggaaacaggggcagaaaaggtatcgcagccaaagtcacacggaactgagcgaagggacaatgaccacgggcccatgcgctaacaatgaccattttctaaatgtgacgttgctcacccttcattgcaattcttggtttacacaccaagtctttctggccaggccacgagcacctttgaagttaggggaaatcatctcatttaacttcacatcctagccactggcaaaatgcaagcaattagcaggtacctacatatgtttaatgaatgaatatgtaagactgaaagagtgaacaaagaacaggaaaataaccacattcttagccacttgacaagtagattgaccttctctctataaatgatgtgactcaactcacagaacaatccatagaggggcttcgaggaggtgagtttgtcttcaaattaaaaaaaaaggagcaaaacaacaataacaacaacaaaaaacacttcatctccagaagctgtaggttgacactgaaagaaggctctggaaccaggcaaaagacctcaggtttggcaaaatgaggctcccaccctgaactaaaaatgcttctcttgtttcccttttagctaatttctctcctttctgagtctacccaggggggtcggtctagcggatgctattaaaacccacagctgcaaaaggggagaaaaaaacagaggaaattttctgttgcttgtaatcaagggtaaaaataaaagaagcacaatgaaaattaaggaaaataaacagtgatcaaggcttttcttttccacttgcccgtggagtcctgctgtgtgtccaacaataggggaagaacaggactgagatgtgggattccgtcagctctcgctgcatgcaaggacagaaagatgcctacaacaagccagagttacgggactggggtgacatgactctcacaatctccttctcccacgtgaaaggtgaggccatggctatataacgagaaagctgggaagacagtacaggcagaggaaaggagtgatccaggaatgaatgcagcttggtccctggctgtgagacacaggattgcactcagatgtacccttcaaggtatccatccattcagatctcttggggagtgggcttggacttgactggaggctctcccatgaaatcatagataacctgatttccccatggctacctcttctcttctcaagattttgtgctacactcaggattccagcatctgggttctaagctgagatttggcctggacttcccttggccaggctgaattgaccacagcttccaatgaagccaacaaggatgataacctctgccatatgccacgcactgtgctatgagcccagcatacaattcctagtcctcccaaaagctctctgatgcaggtagatttgccctaattttacaaatgagaaaggctcaaaatgaaagtatgacaccaaacacatgaatccatgtctgtgtccttaatgttgacaaagagaaaacctgacttactacccaacgtcattcttctagaaagtggcagaacatagaaccttattctggtctgactgacctggagcccacacattccatatttctccaggagggtgctctgatagatggtagaagttgggcttccagactcactgctagaaataagaccaccaaaagggaagaatcatggcatgagtaggaagtgaattgaatagctgacttcagacatagctgatcagccatgggacacaaaagcagaaagcaataagagagaggcactggaggcctgggaaagtgttagaagcaagaaggataaagaatagagggaaaattggactcgaggtagccaagagactttctcattttcacccataacagatagaggatagagcaaagggaattggaagagaggaacagagcagttcagggtgtgtggttaccttgcagtcaatgtctgaggaagatcagaaattctcagggaaccaaatgctgtcagttctggttcactttgtggtaaacactgtgtagttctgctgctggaagcacccctaccctatcaatgctgaatgctcacagcttcatccttccctgggaactctctcagccaagatcatgtttgctttcttggaggtgagaggacatggctgatgactgattggtttgagaataaaaaagtctggtcctctaacctcagtttgggggcaattctaaaggagcatcccagctcctgggttctcccacagggttgactgatccctcggttgtaactacatcatgagtcagcttctccctctgcccagcccagcctcccccacttctttacaggtgggtgtccatacagctttcccaaataaatcttctgcacccaatctctgtctcagattttgtttctagggaacccaacctaagatactccctgtacctctgtgccccccaccacccttcaagtaatcttgagagaagacctacagaatggaagggaggggtgcaggtaaaaggtgaagcaagaacatcttcacctagcctgcaaacacagcctccccttgtgcaaccagattcctctatggttccacgagccagctgcaagatttccaccctggttctggcaccagacgttcagcgcagtctaattgcaccaaattttatttgagtcttcgctggggctgtcacttcatccaattaagtggaggttacagaaggatccacttgtcattacagcaattcctccttgtgctaaatgcttccagaatcttaattaccgagcaggcaagatcagaaaagatggctccagtggagatggtagtatttctctttcacaaacacaggcaggcccccgagcctgacatgcactacccatgtacagccgctacataaattagacaggcctaaataagtcaggctagagacaggaatggaaacagaatgcagatgaggctcaccaccaggcccagcactgtgtgaaggttgtgcgtccacattgcttgggcagcatggtacagcagaaaaactatggagctaacagctaggagacatgcaccctgtgctctgctctttgactggtgctgggatgtccagcaagcccctttccctcccctgtggcctctaaggtcttaagtgatttgattcctgattatccagcctccactcccactactcacccatctatcccagccacatcaaccaccctcagtcctttcaacatgccacactcattcctacctctagagtttcccactcactgatccctttccccataaaggtcatcttcctactctttaaatggctgacatcttctcattctccaggttttaaaccaaatgtctcttcctccaagaagcttctcttgtccacttaccgaagggagccccctacttactttctgtcgtgatgctctatttgatcccaacaaagtctcaatcacaatttgtaattctatattgttccattaactctttcaaagtccatctctccctgtagaatagtgatgcccaatatggtagccaccagctatgtccatgtgcggctatttaaacttttctaaaaaaaataaataaaatttaaaattccattcctcagccatgataaccacatttcaagtgtttgatagccataagtggctactgagccagagatgccagacagcacagatacagaacattccaatcacagcagaaagctctattaggcagctctggtctatagtatatgcttgatcagtttcattgacccttgaatcgaatctctggatacctatccatagtgcctgggtatatactactcacgcaataaatatgtgagtaaatgaattaacaagtgaacaatgcatattttaaatagagatatgtttggcagagccaagaaggaatgttcatttctgcttggggaagctgtagaagtcttcacagagaggatgacatctaacatgagctttgaaggatgactgcgagaagaaggtgaaggggcaggcatagaacaaagaaaaccacagaggtaaaagcatcaaatgatgaaagatcgtgctgtttcatgcttagaggtttggcaagtttcttgttgcaagtttcttgctgcaaagttgattagaactcaggtttcctttcattgaaagtccgatgcttgggggctcaacagctgaaatatttgcctcagggcccagaacttaaacgtggtggtaaagtattatctctgaaaagaaggaaaaatgtactgatttttaaaattcaaggtgaaaagggaatgcagatgttcatattttaatacactacaaaagatccctggatacttatctcctggcctacatcttccttgtttttgtattgcagacatactttagcatacacaggttgtatagaagacaaagtaccagttttaggatgaataaatgggaacactgatatctcgagaggccttctcagcatggaaacacaatgatgcaacctcatgtggaaataaaggtgctttacttccaccctcacttacttcaatacgctggcacatgcttgctttcaagcaactccctctctagacatggggtttaaccacctgccctgcagatgacgtgtacattctgacatctgcatggaaacaaggtaactcagtcttagaaagccaggagggtggccaagatcacagcgggaggatggagcaaatccttgggtttatgtccctttagacgaggggggttcactctcttctgaaacacgggctcatttatacaagcaaacagatcagaacacattacaggaaggaattcccacggcatgcgctgctctttgctttgccttgtgaagataaaaggaggaagaaacaaaagacttagagagcagagctggtatgaaccatgaagctgctctacattaatcatctccatcgcccccacttcctgctgcccttctcgacataggccctgggtcttttgctgggaaaaggcaggtcgaactggagctggctggggagctcattagcacctcgccagagccgagggctgcctgccttccaggaggcattttgaactctcccttcagttacttccttgcaatcaatatgctgcttttgcagttgctccatccactgcccttgcagccatcggaggctacaggcttctaagaagaactgttggggtttatcaacatacacatcttcacttcacaggaagcagcattccatggtttgcacattggtcctctgggctcataacacagcagggtccagatctggggagaagcaggcacgagggatgtactgggagtagggaggaaggccttggccaggtgctctggcaatgtgggcaggaaaaggccttggtggcaatgggtgttgcatgaggaggtcctatggtcagctcaggcaaaggcccaggagtctcaactgggaagcagaccctgaagccatgtctcccaattcagacctaggggccctgaaacgctgtgtctgagatgcttttcccttactgattcctgtaatgcctgagccagcttgtagctgtcatgcatatggccactagggaccaggagaatttgagttctacatgtggcctggttggccccatccctctgggaggtcatcactacagctgagccacaagatcctgggactgggatcctcatagacctctgggacagtaggttctggggagtgacattgactccaaccctgcaggtgtagccttccagaagccagttcctctctgtaaaataaaggcatataaaggaccactcttagcccttccaatcaccagcaggaacccaagagagagtccctctagccctgagagtctccaatagcatcatccttcttatccaaatccaataaagcaatgctgttcttcaaggcccactgaccacaacctaatggagagctgaggctgccagataccaagacttagcattatagaagggcagagcatggcaggatcccaggggaaaagaattagcacaacctcatacaaaatggagtaataatacacctacctcagaaaatctgctatgagaattacctagatcatctctttaaagcactgtattacttagctttttcttagtgacaaacaaccccgaatcttgatgtacgcagatacttgtttcttgttctcagttagctccaggctgtgtttgaatctattccctatgcctctcattccaggaactagtctgaaggagctgttgctgccaggggcaggttcttccagtgacggatggcagcaggcaacagagcaagcagggacacatgatacctcctgaaatctctcctgggaactggcacaccatcccttctgcccacattctacggttcaaaccaagccacatggccaagctcaaggtcaatggggctttgtcaaagccaatcaggaagtgtactctgcccatggggagggatcatgaagagtgaatctttgcagaaaaaccacacagtgttccagaagtgctcaataaggaattgggatatagtcatctctcagaaaatgttagttattatcaacatgtgtattactatcactattagtaacaggctttgctgatgattcattgaagctcagataaggttgggttggatgagacacagtttggagggctgctacttgggaatggccctgggaaagcttaacctctattgcttggtcaaggtcaagactgactgtaagaactgtgatggagccaaatgtgactagaggagagggaaacggcttcagccaggtcaggcttgacccctgagctgtccttaggaccaggaggaattggaggaaaaggcatcccacggaaaactgagttcatggcagaaccatgacttaaacccagattgccttactctaattctagattaaatccctactccaccctcactaggagaaagaacattttgagatggaattgattcctttctacatatttttctttaaaaaaaaaaactcagtgtttatttttatttcttttaggctgaagcttaactccaaaaatagtctttttcagtagccctgtcattagcagttgctacaaacactatgtcccccacacattgaactgcacgcacgacacttgaaaagagcaattagaacagaagtctcccaagaatcgcaaggaaggcagtggctgcagctcctgatgcctacagtctcccaaggacatggctgggagccagccctgctctggggcttctcgtgcctctctgtgggtcgcccataccctagcatttgctccgttgtgtgcctgactctgtgctaaccccaggagaacttgcagccactcggccctcaacttcactctagttgtctgtccttaaccttaggtcttaatgtagagaggtcactaagcctctctaagtctctgattcctcacctagaaaataagaatcataataattttgggatatttgaggcatcctcatcattttgtacacatcaaagaactatttgatttcatgggagtgccaccaactgagctcctcctatacacagggatactgagaataaacagatagttggacacagcccttaccttcgaacaattatagtctagcagaggttcctgctgttgatttgggggcatgtaatatagtttacaatggtggggaaagtttcaggtaagacttccctgcagggaaaatacatgggctgaattataaaatggttgatgaagtagggaaaggtattccaaaggaaaggagcagcatgtgcaaaggctctgaggctaactagaactatctgggctggtctccagcctcgtgtgcagtgaaaaggtctgaaggaaaagatatcgtgaagggctttgtccacctttgcaaagaagcagcaagtaatagagaagtatccaagccctgcagttgcttcatttatgcaacaaatgtccactgagggcccacaatgtgccaagcaccagggacacaggccgagcaagcacagacccagtgcctgtcctcgtggaacccataacctaatgaacttggcatgtttgctatacatgtgtagtttcaagaagtcaccttggataacaagggtggtggcattggggaattagaatttgtgtggtcaagaaagggggttcatggaaggggttcctgagaactatggctggagagagactatggctggagagagacacggggtacaatttatgcccttctgtgggcaatagggccttggcaggggaagggggcaggctctggcctgacagtaagacaaaggaagaaactaaaagatgaggagagatggaaggagggaaggaaaggaccagcccccagcctctcagccagacctcatcacactcttgtctgctgtgaatctgtggtcacttctcacacctgggaaggtgcagacctctgtatgggcataaaaggaggcgtctgaattcttcagaagcaaaaacatacaagaataacccaaaaggagttgggagggggatttcaaattcatgaaagccaatacacatgggtgctgcggattcaattgtgtcaaccagaaagatatgttcaacacctagcccctggtacctgagaatgtggccttatttggaaatagggtctttgtagatgtaatcaagccaagatgaagtcctactggaagaaggtgggccccaaatcaatgactggcatccttctaaaatgaggaacatttggatgcagaaacacacagagagaagaaggccatgtgacgacagaggcagagacaggaatgatgcatttataagccaaggaacacccaaagatcactggcaaccagcagaagttagaagaggcatgggctgggcatggtggctcacgcctgtaatcccagcattttgggaggccaaggtgggcggatcacctgacgtcaggagtccaagaccagcctggtcaacatggctaaaccccgtctctactaaaaatgcaaaaattagccgggcatggtggtgggagtctgtaatcccagctactcgggaggctgaggcagggagaatggcttgaacccgggagacggaggttgcagtgagccaagatcacaccattgcactccagcctgtgtgatagagcaagattctgcctccaaaaaaaaaaaggcatgaaacagattctccctcagagctatcagaaggaaccaaccctactgacacttggaccttggacttcaggactccagaactgtaagagaatatactgttgtctaaagccacccagtgtatagtagttcattatggcagccctggcaaactaatacaatagtaaattatacctcacaattgtacagattaaatttggatgggtcaacagccttaggggtggcaagttgaagtaacccaataattgcattcagatatacttagccccaccttgcaggacagggccaggaagtagctggtgttagcccgaggggtagggagctgctgactcctgttctggccacatcatctcactcatacctcacaacaaacctgaagggtccacctcactgtgctcactttgtagagggtatgacaggcttacagaagtgtaggtgcatgccccgggtccatgtggcaagtgccagagctgggatctgaatacaagtcatcctgtgacttgcttttgagccgtaaaattataaacaagcagttagttcccgtccacaaagcattcactattcacagaattaagaatgacattcttggctgggcatggtagctcatgcctgtaatcctagcacttgggaggccgaggtgagtggatcacttaagggcaggagtttgagactagcctggccaacatggagaaactgagtctctactaaaaatacaaaaattagccaggcatggtggcaggtgcctgtaatcccagctactcgggaggctgaggtagaattgcttgaacctgggaggtggaggttgcagtgagccaagattgtaccactgcacttcagcctgggcaacagagtgagactctgtcttagaaaaaaaaaaagaatgacattcttaccactctctaaatggtctcacttatgagctcatttttcttctcccctccattagaatatctgcttcaaaatagtcgaagccctgatccatatggctgtttgctgtatccctgtgtctagaagattactggggcataacaggtatttaataaatatttgtcacattaatcagtcaactaatagggggcatttggagactaagatggcactgtccaggtgtatatttctatactaatttaacaaagtggcaaatggggctgggcacagtggctcacgcctgtaatcccagcattttgggaagatgaggtgggcacattgcttgagctcaggagtttgagactagcctgggcaacatgatgaaaccttgtctctccaaagaatataaaaattagctggctgtggtggcacctgtagtcccagctactcaaagaggctgaggtgggaggatcgctgagcctgggaggttgaagctgcagtgagccatgattgtgccacagcctaggcgacagagtgagaccctgtctcaaaacaacaacaacaacaaaaacaaaatggcaaatggtactaattgcttgctgtcctcaatcaaagaatactcaaaggaaaatgttaatgccacacatttgtgcaggctcgacccctgcacctgagagtctgcagaagccatggccaacagctccatggcagtggacaagacaggtgtcacccaaaacattggtgtgtaacaaggcattaataagaaatgaaagggagagataaaaaaaaagcaggatttacagggaatgagaaggaagggagaacaggggaagagaggaggatgtggtagggggaagagaggaggaagaggtaggaggaagaggaactgtttttcaggagggactatcagtagcagcagacactgacaagcatggcagtggtgagccaagttacctgtttgtgaccttttgaatgcataggaatggttgcaagagagagggaaggggcagaggctggcggacactgaggagaggagaaagaaagatggggaagtgttagacaggaagtcagggaagcacagggacaggcagaaagagaagctgagagggactgagactctgaaatagacatagataacacaacttagttctgaacatatttagttctaaaatgggtttccatcagtgtgaaattcattacaacaaaaatttaaggtattaatagatcattctcattgttatttaagcctgaaagcaggagacacaaactacacaccacaacctaccaatcagccctaacacttcatgcggccaactcccttcctgctctattacagaaagtggggaggtgcatgccagtgggagccccacctatgcatgtcctattttggtatgcccagcattcctattgaggggaagggctcttgtctcactttgcatcctcctggagggcctgggttcacacactctggctaaagaattgggcacatgacttagactgggtccttccatctgccactgggcagatggtgggtctagaatcggacgctcaaccctgtcagggataggcagaatccttccctgggactggccttcagacatggggagacataatccttttgcccttgaggttgttaaactacaaggtgtggatctggagatgccagcccccaaatggcccccaacttatcccatcagcatgtaggataatagtgccaatgaggaacaaacaaaacagaaaatgacaaaggagacaaagccctgggtcctcatttgagccctaggatgtgatctgcacagagacagctccatgccagagcattccagggacgtgggccaacaaccttcctctggggttttatccagttagagttgggtggctgccacttaccactgccagggtccaggctgagaatggctcctcatctccatcctcctgctctgtgcagcccctgccgagtcctcctgcccttaactatgtcaatgaccgcacagttttggcaggacaagagcaggactatacgcagtgatgtcccagcccaggtaggtgtcaaggactgaggcaatggcaaaatccatcctggcagtgaaatggagccctgcttccgagatgcaaaagaaaggcagggaaaagtcatgcatctgccagagggaattaatccagagccagtgggggaagaactggcaagtggggctggcagaaatgagctgtgcaaacaggtcctgaggcaactgtctgctgtcagactgctctaagagcctccgaggaaggagagagaggggaggagccagggcaacatggtaggagaccagagctgccaccaagaacttcttcctgggatggcaagggcacttgtaagggcagaaattcatcagatcccattgaggacatttgtatttctatgctataaaccccttccagtaccctaaatcctcagaggtctattataccccaaagaacttgagagagagagtgtgcatgtgcatgtgcatgctggagaaaggataaagaatattaaggggagctgagttccaaatttggaaggtttagagaggacagaaggtgtaaggagtgagagggaattgaggatgaaagtcagaaggaatggtaaacagatatgtcagaagtgaccatagaagaaacccctaggaataggcacaaaggtaagagagagctaatgatactgcaatctcaaaggtcatggtaacttctgttggcatcatggttgataaatttgggactgggtgaactcttctcagatgtagccccaggaatgcctggcatgagcccttttgtgcaaaagcaatcactacgggtatatccatgagctgtcttttctgttcttttttttgagatggagtcttgctcttgtcgcccagactggagtgcagtggcgcgatcttggctcactgcaacctctggctcttaggttcaagcgattctcctgcctcagtatcccgagtagttgggattacaggcaaccaccaccacacccggctaatttcttgtatttttagtagagatagggtttcaccatgttggccaggctggtctcgaactcctcacctcaggtgatccacctgactcggcttcccaaagtgctgggattacaggcatgagccaccacacccggccttttctgtgatttctgaagacagtagggcaattccttgatgacatcatggactagtagtcaaccaagagtcttatggtcatggttggataagagagggtgagaaaggtggtagcttggagttggggtggtaaaggtaagggccataggcacaggcaatacctagacgtactagatacgggtcaataactgctagatatgggttaagacctgggaggagggtaccctgtagtttccttcatctctgcttatctcagaagtcaagaaataaaggcaacagagcctggaattcagcagatgcatgcaaatatatctgaaaaagttggttggtcacttaattaactatattaccctaacttgggacaaacattgaagaataaaaggtggcggtcagctcacagaggtgagtcatagaagaaaagccacagagatgagtgcagatgtgctcagggagaaggagcgcctttcagacaattgaatcccaatagcactgtgggtagatacaatcagctaactccgcctactatgagaccagacgcagcaaacctgcttctgatcactgttcagctcccacaaaatgctgactggaaactatggcattgtctgcatgctgtgggtatctgtccactgcatagatggccagaatgaggtttctaagccatcaaggcgagaagggccacggtaacagacagagcctccctgcagtagcaccacctgccccgccctcacgggttggacaagtcacagttggttcagctttttctcattcccatcacagcccagtgaagttactggatgaggagaggtggtgctgtactccacatagtcattcagggacccaggctccgatctggagctgctgcctgacttaatatgtggtctcaaatgtcacagcaggaggggaaaaagagagggggcttgcataggggagttttttaataggtctggcccaaaaggagtgtatatcacttctgcacacactcctctggccccatctgaatggaggaagcttgtgtgcccagaaggaaaaataaatggtacagagaacgtaacattgtcacacgagtctttgaactttcttgctggtatgaagcaggtcccacactctgcgatttccacactttatttcactgatcctcagaaaacatgaggcaagaaacatccttctgtccctttctacagatggagaaactgaggctcagtcacgtgcagagttgcattcagcaacataaaatgaacagagccaagaatgaaccccaggtttgcctgcttctaaagtgcagcctcctcacctccccttacgaagggcctttccaattgcttgctcaggcacagcaaattgcagccctgtcttgctggggtcccagcagttcctcactcacgtgcagaagagattaaaagaacaaaccacagagcacattttgccgctgattaactcaaagaggaggctttccctcactgagaacagatgatcagctgctctgccaataactgcctgctccgtaccaccaggccgcattccatcaaaaaggcacagtttccatttactgggttgaaagtgagtcacatctgcccctggatagacatataaagcaacaggcatgctactctgattaataatgaaaagctggtgcaagcacatttcattttaaaagagaagaggccaaatcctagcctccttttctaccaggtttaggaaagcatgaaaaaggagaaggatcatatgggttaggggggaaaaaagaaactttaaagaagcaaagaaatctacctgcccaagaggtgggaaagcagagattttattctattctaggaaccttgtgattctgcagagctgcatcgtttgttttttatactattttagaaaggaattccattgttttaaggcgggaataagcgtgaagcctggccttagaatacaacccattattttgacaaatagtcaagtcaaggccctgagcaatggtcacttaagtctaattagcaggagaatgaaggccacatctcttcttaggtaaatgtccgctaagcacggcttctgagctccctggatcaaaatgagcacatgttgtgcaaggggcatgggtgaagtttaaaaacaatacaacgtgagcatactgaacctcatcgattacattgggaacccacagccaccccaactgttgagatacggctgttttcggcatctgcttcctgagaattgctactgttttgttttttcaatgtttgaatgtgttgcgacgatttcttcatgagaatcctttctaaatgattggcggtgcttgtttttgaactgcaaaatcttttactctacctccttttctccacccacccacctgcggttggagtcactgggttgccggtaggtggaccaactggcttgggctggaagctgggtgaggccaggtacaaggacagttcccatgaccagctgggctggctgggactgttcacctggacaccctacctcatgtaccaggccctgcctgacaggaggatcaccagtcctccgactcctagtgcaagacctacccttcaggatcagacttccaagctgccacatctggccagactctacctgagttcatgtagttcttgggcttcgtggccatagccaagtctgtctctaaccccttcccataacacagaacacacaatttttgccctcatgtattctggaatttgtaaagtctacatcaagaaagaacatttgggaggagactttaaaaaaaaatcttcaaaaacaatcaatacgtgacaagaaaaagataattgctcagctttcagatcgtacagaatttggacgtttaagcccaatatcagtgggaaaggaagaaacatcttcccatctgttttcaggtaggctagaaagttttcattcaagacattaagcctgtgggggtttctaatggctttttttgatccaaattgtattaattaggaaaatactaattgctgtaacaaataaaccccaaggcttagtagcttaacacaataatagtttattatcacttcaatattaataacaggcctgcttagcagacaattttcctccacaaggtgattcagggacccaggcgtgttcaatcttttgactctcccctcaccttgaaattgtctgcatccagctaaccaaagaggggggtgagcagatgaggaatgactacatgctttttaactctttgactctgaaaggacatgcagcagttctgctcacattccttaaactggaactattatcacagggccctagtgattgcagagcaggctgggaatgaggtccgtggttaggcagctgcttcaccactttatcctatggaagggaggcacatgtgcttggtgggcacttggccagctttattggcctgaaaggtagcagaaaatttctctcagatctcggaaatggggagtcagtctgcatttaccttttgctgtatttccctggatagttagtggggaaatggcagagggaaggccaagcatcactagtcagagtaaaccagaagacatatgtcaattttccagaaagggattctggggctcaaataagtggaaccacttcttcacagccacgtcaccagctctgccttcccatccatacagctccattggccagaggcccacagaggaagtatcttcccatccagtttctgcacctggcgtcctagatgaatagtagggcactaagtacaaaagccttcccatggggcaggatctgggccagtacgactggcctttggagctgggtcattctttgttgtcagggggccatgctgtgtatcgtagggtgtttaacagcatctctgggctccacccactagatgtcagtaccccccctctcccatcgtgacaatccaaaatgtctccagacattgccaaatgtcccctggaaggaaaatcaccctcaattaagaatcactggtccaggcagaggctgcagtgtttcagagataaattaggctccagtgactggacaaaggcaatgatctagagcattcttactaaactggagcccatgggtttaactgagtttagcctagcctggaacttgggttctcagaaaaaatattccatatatatctgtcacggaataatacattatggaaaattagcataaggagggtcagaaaatagtctcatttatgggctcattataggaagagggcaggccttggactgtgtgactctgatgagactgggtaatcagacttcagcatcctcagtggtaacaggggaccatggtgaagattaaatacaacctcatgagaagacagtcagtgaagtgtctggcatgcaataaatggtccacaaatggtagctaactacagactttgcagcttgttccatacctcagatcattcttccatttgaacacaggagggtaatgttccaagtgaatgagaatttaatgcagttgccatttgatttaatttccaaatgcgttaaaagtgttaatgcaacacatcagcatgcagctgataaagtagtcaaaataattcaaggaaaccaatacttatcaggttttatttatccacatttacacttttttaaaaataagctggtctttgtgcccatatagattacaatatacataatatctcccggttagcctcccctccacacatatgttcaagtgaagtttcccacttttctcccatctgtcatttttctctttccataaaaagctaatggtgacgttatcaaagagtgaaggagtcagaggctaagggtggggaaccgggcacccatgaggaggatggggaatgatgaggagaagcacaaacataggcacgcactttgtttaggaacaattttcatagccatggcctctgacccaaatctaggggagccggcattattattccaattaggcagtcatgaaatgatggtcctaatccacttagctaacacaaggcagaatcaggatttgaacccgagacctctgatttgctatctatgtgttcttgacaatagcagtcatgggaaaaaaaatgatgcaagtattattaataaaagttaagaccaaagaaagattaaaaaataagaaccaaagcaccagcatattttcctacaaagaatgaaactcacgcagaagatgagcatgttgaggtttctctgctttgaaatagggttccaggaaagtcaagatcaggcatgagatgagaggaggaggtaagctaagtctaccacaaaaaaacttccagacctaagttggagcatatatgatccatatgcagggctcttgggggaatgggtagaactcacactgaggcaagccttccttgaaaaggcattgaagaaggcccaggagtttttaaaatgaccactctaaggggcacatggtggggtgggtaagtagcatggctctggcagggcaactgagccccctaaatttgtagccaaatcagagcaaagaaagaccataagaggagcacagggaattacaaagctcacagctcccataagaaggaagaaaagaattaaggaaacgtaatacttaaaggaaaaggtaaagaaacagatacctataaaggagacagaactttctcagaggtagaaggaaaaccaggagctcaatcaataacgagaaccttaaaaaagaagggatggtgaggggtctcgtcacatgcttgtaaagtaaggacctgagcactcttccctggatacagcaaatgtttaagccccttctatatgccaggtactgactcaggtactgctggtctagcaggaaataaggcttacaaagcttcttcctccaggagctcatgttctagtaggaaagatgggtaatccacaaatagatgtaaattacaatgtcagatagtgacaagatctaggaggaaaaccaaagcaccctgcaaaggaacagagttacaaagggaaggggtgggaggtgggggagagtgttatttcagataaggtaatcagagggggcctctctgagaagctgaagtctgagcagagaccagatcgataaaacaagtgagctacataattatctggaagaaatgcatgtcaggcaaagcaaggacagcaagtgcaaaggtcagaactagtttggtgtggttcaaggaagaggaaatggatcagcatggctagaaaagagaataagagggcaaatatgggggtggggcattacaaatcaaggactagatatggagaccatgttaagaagtttggattttattctgagtgtgacaggaaattctggaggcttttcaacaggaaaaaagccattatctaactttttcaaatgatcactcaggctgctgcattgagaatagacatcaatggggcaagagtggagcagggaggaagctggaatagtcatgcagttgagaacagaatagagttttgactcatgcactgatcagcaaactgtggccaaatccagccctctgcctgtttctgtaaataaagttttattggcacataacccatgctcattcatttgcatattttttatggctgtttttgctacaacagcagagttgagtctttgctacacagatcatatgacctggaaagctgaaactattgactctaatgccctggagagaaagtctgccaaccttgtcgaggatgttgacaatagaggtggtggaaggtggcaggctctagataaacttaggaggtagagcagaggccagatgttagcccaggctctctgataccatgcctgctctctgatcactgggtgatatagccctccagctcctctttacttctgaggacttgtggagaacgtgaatggaaactctggagtccagtctgaggccagcctttgctttgttccactccctatacaagcacagagctcaaggtggctttgcctctcctcctagcatgagcttgtcctccatggctgctgccaccaaggaggcaggagccagcagccttggtcaccttagaaggccacagaggctgtaggatccctgtagcagaagctgttgcgtcccaccgccacctcaggacttattattgcaccgagtgcagtccaacctccaactgcctctgccaactgtcaaatagctaatagacatgggcttctgccaaagccctggggagcggggggttacatcctgtatgacaagacagtaaagccagaaaattaagacccccaagagcagctctcaaccaatgactggagggggttaaggtacaaataaccccctcctccacaccccaggggttctacactgaatcccagaattacctagtaggatagagctccagacggtcacagcagttactcacttgagaatgtaccctttattcgctgcccttgattctctgtctcatgtccctaaaaccaaataagcaccttgcactcggaactcctgccctgagtctgcttctaggggtctcaacgccatgtgccttttatcttcactcttcttttccaacgcagtctgtgccagtgaccatagccagctgtctgacaatggtttttccctgcaggaccagagaaaggaagaacagctggatgcagagatcccaccttatgagtgtgcacactactatccatggccatggatagggtccgtcacagcccctagactactacaggatgaagcccaggctcctattctggtacaaagactctgcaaatgtccccttgcctacttatccagccccaaacatgtcacccactcagtgtctcaaaactaacccaggctgtcctgcttatgagcttgccaagccacaggacccatctcagatggggccagtcggagaggctatcccagactcttccagactgcgctcattgttccaacctctgtacacctttagctcacacctgaatgcagggtctaccatactggattttgcaagaaatgtggtataaaagagacagcatggccaaggcaaggcaagcctagctctgccacttatgagcagtatgatcttagaaaggtccagaacctctctgggtttccatgctctcactggtaaaaggtggttgctaacagcacctacgtcatagggccattgttaggattagggaggtagtgtggcaggtggctaacattaactgaccatgcagcacagatttgcatgattcttcctgctagaccatgagcttattacagaacctgacacagttgggctccataaacctttattaagcaaatgaatacaggaatgagtcagctactccaggcattccatctttaaactagaggctataaatgcaaatcactgctggcaccagactagtgagagagcaaaacgggaccagccaggacagcagtcaacggtggaacgtgtgcttccaaaacagggacgctgaggagcccactgttgccatcctaaaatgtaggctccaggtagctatgcctgatacagtctcaagaaacttgtaaatgctgaaaaaaaacttaaaaaggaaagagaagacagtacaatgtaagtaaagcactttcgcaactgacttcaaacaatggattggattggatgacctcaatcccatttcagaagagggagaccttaagatgatctaaatttaaattttcatagtatgtacagaatatcattcctttaatccaggaaaacaaacaatggacaatgtctttgggaaacattccttaatagtaatgtaaaaaatatgattactactaaagacataattttatactttctagtactaggatgtatctgtttatatatgttacatatatattatgctatatatatgtgttttatatattatatgtatgttatattttctccctctcataggacctatttatatatattcacctccattattcagataaggaaaatgacgcccagagtaaatacatgatttgctgaatcacacaggtaccagggagcaggactaagatggaaactcaagtgtatttagaacaataatccctactcttgatcctaacaacctcccttggtaggaagtcacatcagtgtttaaatcggaacctctaacagcactagtatcacatttcttctgagcactaattctcatactgatgagtgttctgagtgcataataggttgttaaatggagttgaaagattggtttaaaaatcaccaccgacaagaaactttttatgaattagaaaattttcatcaagatacatctgcataactttggttgcagacactcaagtccttgaggccagctaagacaccttgaaattgaagacactcagaaaaccagaagcaaagcaaatgaataagcatttgctgagcactggtctggaccaggtaggttgaggggccgaattgtcaattgagcgaaacctcaattacagagtaatctaatgtatacccaggtacattatcacaactcaataaacagctccccagaattaagtaattccaatttgctttcatttcggtctgtgtgtcgccctgagaatttgatattacctaccctcacattaggcagcatcttctgaagtgctaatctttaccatctcaggatcacacgtgagctgtgagccagtcagccatgaatacgcctgtttggggagaaagagagaccagcctgggcctctgctgttcctctcagcctgagtacctgctgtggaagccagcacaggggtttacagctcccagaaccctcgggtgctgaagggcccagtgacctcccaactgtggagtggttagggttttgaatgaacaataccaggagaggggtggtccatgtaactagatggctgagcacaaacaaaactagctacttttcctttgtccccagacccgggaatcagctttcccgatccagtaggggtgaacacaggaaaggaccagagaattctgacctacagggacttgtgatggttaatattaagtgttaacttggttgaaatgaaggatgcaaagtattgtttctgggtgtatctgggtgtttctaggtgttgccagaagagattcatatttgagtcagcggactgggagaggcagacccaaccacaatgtgggtggacaccatcccatcagctgccagcgtaactagaaaaagccggcagaagaaggtgaaagaagcggacttgctgagttttcctgccttcgtcttcctcctatgctgccctcgaacatcaggcctcaacttctttggcttttggagtcttggacttacaccagtggtttcccaggggctctcgggcctttggccacagactaaaggctacactgccgagctttcctacttttcaggttttggaactctaactgagccactactgtcttccttgctcctcaacttacagacggcccatctgggtcttcaccctgtgatcatgtgagtcagttctccttaataaactccccttcatatatacatatatcctattacttctgtccctctagagaaccctaataaaagaccccatgacccaaatgtcccccagtccacactttcatatttcctccctccctcttcttatactcggcacatcaccgtgtaccaacagagaactgggccacactttacagaacaggcctgacatgatttccccaaagccacagagacagtcatcaaatcggcacctgggtccaatgtcctgtccccacccatggagtccttcatctctcttacttctttgtctgataaatcccacccctatgggcaatttatttattttatttaacaaataccttagagtgcctatgcagggcactgttctaagaactcctacatccattatcacatgtcatcctcatgacgccttctgagggaggtaatcctacattcctgttcccagatgagccagctgaggccccaagaggttagatcatgttcaaggtcacagagttgggacaaggtggggccagaattcagacccaagcatcttggctgcagagttatctcctgccctgaactggaaccaaagggtgggaacctgtgaggaggaagaccttgaagacatggttttctttctgtgatatcccagggttgtgggtgacgtcagtccaagaaggaatccagatcccatcccataacacagcacttggcccttgagaatcctttttcttttttggtctgtttttcagattttctcccttctctgaaagaaggaggattaatgcttttcccttgtatttttttaaacaagtacaaatacttcagtattaaagtacttaagcatcctggctccgcaaaggcaaagggctcttgagaggtaagtgagtcattcttcatcacacagtttcttccaaacgcttgggtttgctgccttcaaatgggtccctgggcacccactccagggtgacaggtttcctctggttgcttctgctcctgagggggtccctgccttttattttcttgttttgcttggatgccactaactctttagcagtgtgtttggggtcggggcagggggtgagggtaggttaaatgtatttctccagcaatctggaagttagctgacagtcaggaagggaatatcacgtgtcaaaatggcaagttagctagacggacccagggaatcctgcttgcctggtacctgggccccttcagcactgctcatgacattgtggcaccaggtaacagcaagaccacaacccaccagccctccaggtgtgaccaaacagcatgagccagatgcaggtcggactccagttgtaccccttgggatggtcctgtttctcaacctggctgtgctaattctcccactcatgaaatgagttaaaataaaaccaatgtacagagctgcaattaggaaaaaatcaggtaacatatgttgaagggacttctttacatgcaagggaccaggctcctagcttaccaccatcataatatttaaatggaggaaaaatgggcactaaaaaactgataacctatgccaaaaatatggatgaatttcatcgatgtgtaataaaattacaccttgattgaccagattacaggaagtgccaaccccccactgttcaatgtgaaggagactgggtgccacccaccaccccaccctccctaagctggagtggcaggggctgcaggtgagtggcttcagagcagtggtagctgcggagtcatattgccaggcctggctactgcacccaggctagcaccagcccctcctcttgacttgggcccaggatgcacaaccagcagaggacaaatcagtgtccccgtaaaccctggccacctctccgaataaagcaaggatgctccaccacatcctctgtcccagtagcctcttggtttctcttcccatagctcccatcctgcccctgaatgggggcatataagcaaataataaaccaagcgttttctggttccatttgtctgctcatgggaatttcagagtgctaaactaactcccatagccactggtcacattcttttgccaccaactttgccccatgtacatgcaaggtgctagcaagaccatgaggagcgggaatgaacacagcacaccctctcctgggactctcaatctggtgtgggagaccagccacggaaggtataagacacattccagcaggacatctgaaaatacacattcactgagaacctgaatggcctgcaataacccctgtgtcacataatacaaatataataataataaatcttcaaaaaaaattttttttttgagatggagtctcgctcagccgcccaggctggattgcagtggcatgatctcagctcaccacaacctccgtctcctgggtttaagcgattctcctgcctcaacctcccgagcagctgggactagaggcacgagccaccacacccagctattttttgtatttttagtagagacggggtttcaccatgttggccaggctggtctcaaactcctggcctcaggcgcatgccaccacacccagctattttttgtatttttagtagagacggggtttcaccatgttggccaggctggtctcgaactcctggcctcaggtgatcgatctgtctgctttggcctcccaaactgttgggatgacaggcgtgagccaccataccgggccacacaaattaatcttatggcatcaacaaagcaaagataggagcttaatgccatcaaagtggtggcttcttttctatgttaataacatttaatgtaaacaaatttaaagatttttaaagttttttttcataagtgcctaacttgttgatctttggcttaagtgttcatggcattgtggtgaggaaataataaactcctgctgaggccaataattcattcactcttctatcagtccacacattttttcaagttgagccttgtgaaatgactgattgtgcaagtcaaaacaggcgaacactaacacttcatatggtttagcaaactgagaaccagtgccaggcactgcgctgagtgcagggacttccaacccagcagacagccctcctctcacagagcttagatcctaaaaggggagacaaaaagtcaccaagtaaacaaataaaggcaaaccagcattttaaagtgtgataaaaactatgtggaagaggagaccaggtaatgagaaggaactgtgaccaccaggaagggaggtgtgggcggggggtcagggaagttctctgggagaagacgacatactgccatttcagctgagacctgaatgatggcacatgatcagccatgtgaatgtctgtatgaagtcaagacagccagcatagagaatcccagcctgcaacccccagtccagttggcccaaggatcccagtcacactgggtcagcaaaatgaggtcaaagtttccacacccacccatactttgacaaaggaaactaacttaggaggcctcaaaggctcgatcagtggggttttttttgtttgctttttgttttttcccttcaaacacaccaggtctcattctacagctagcataataagaaaagcttcattatttcattcactaaattatgctatattaaaattttaatcggcaaacataacattggtaaaatgagtacatccatacactgcagttaccagtgtaaactgtcaaaccatttttttttttttgcaaaagcaatattgcaacacaaagaaaaatccataaagatgctcatattcttggcctcccaactctacccccagggaatttatcctaaggaaataatctggttcaatagaataaaatgttctctccagaagaactccatggaggtgctaattgttacatacacaaaggaaagaaaaaaacaagacacgtggaattatcgaaatgactgcaaatgggggggtttaacaaaataggataactcattggatgagatagcatacgatcactaagcatcataacaaagatgacaaagttgcagaaagaaatgggatatctggctttttgagagaagcagaaaacaatctgcatattttaatggaaagcatgtaaacagtatctcaaggtgaacaagaacaagaaaattgaaaagaattgaatcaaggccagtggggtgaggaattattcatttcaaaagtccttccaaaatattgtcattgtattgagttttcaatttttaaaaaaaaatccctcagaaacaatagtacgagaacactgccacagcatgccacccaaatacaaggacatttgttcattctaactttaaatacaaaataaagccaaatttgaagatgtcttctgtgttatatattccacagtctttcacgtatggctcttgtatgtgagactcaagttggaatagcaatgcaatgttgcatgattttaccatagtttctcccgtttggggagtttgtgttggggagggaggccagagtgactagaaattaatctcctcttttactgaatgtgggggaggatcagcagatgagaaaaggggctttaaggcccattaatgccaaccttccatggcagtagaggcgcaggctggaggcactcacctttcacgatcagctccgcgtagttggacacaccagacccaccatcagagcggatcacacagcggtacttgctgacgctccgctgggcagtgtctgccacactgactgtggctgagaagcgcctgtggttgaccacacgggtgaccatcagggccgtgtccctgccattccattgctgcagaacagaggaagagagggagaggaggaatcatagcatcataggcttctaggtgactcccaacacggatatccacccatcctcacacccctggggctcaagactttccactataataagggatttccagccaggcacagtggctcatgcctgtaatcccagtgctttgcaagggctgaggcaggaggatcatttgaggccaggagtttgagaccagcctaggtagcaagcaagaccttgcctctacaagaaattttaaaaaatagccaggcatggtggcactcatcttcagtcccagatactctggagggtgaggaaggaggatcgcctgagcccaaaaaccaaggttgcagtgagccatgatcaagccactgcactctaccctgggtgacagaggaaggccctgcctctttaaaaaaaaaaaaaaaaaaaaaaaagggcaggagttttcatggctggtttgtgctaatgagctgattcaagaataaactttgctagtgagctgatttgaggacacaggcctggtggtaagaagagaggaaaaaggctccttctaaacactttggctcagcctgcatttggggctggcatgtagccccttaactttcctccctattttcctttttcccttaagcagaactcatagcattctttcagacaaacttcagcagacttagtgaaaacccagcccatggagaataaacaccgcctggctcacaggccctgtggctggtgccctgctaccccaccccacaggctctgagccccacctgccctaagctatcaccacaggtagggaggggatgggagccttccaacacctctcttccttggcacatgctcttttctctgcctggagggtctggtctccctggggacactccgtcttccgtaaaaagccacgttcagctcacagccatctctagtcagttctcacaactgtcacaccatctctggaatcttatctatgtatgatacaaactttccacacacatttgcccacaagtgttgcccattttacactgaaggactttcctctgttcatctttagaagcttgtctgaaagcttcccaagttggtagacatctctagaatcaaggtgaatacacgtgggcttttgtcttcagcatcctgaatctcaggagggatatcctgagtttgaacaaacctctttcacagttgcaggttatgagaactggtaaggcacatgcatgttggtgcagtttgagtggatgtttattaatgttattaactggatatttatctactatgtgccagcccctgagctgggtatttttgtataaatcttcattgtgtcttcacagccttgtttggggagtgtacaactgctgctcttctcagaagaaaaatccaaatgtctaacagtttaactaaatgtgtagagtacacaagccccttatccaggttttccaacttcaagtcaagcactgtttttactaagaccatattctcagtgcctgctttaatttgaaaacgtttttccccaaaaagtgaaattgactcctttaattatctggacttagggaaaccttatgacttatgattctcatgccctgagtctcccagtctcgcaacgcgatcttcattgtttcctgcaccaagtaaacagtttccccatgtgcataacctactttcatctatgtcatctttcctcaccctctacagtgacctgtcaggagaggggcacaggtacaggtagagccacactgctcagctctatggcagcaaatgaggggagaccaataccaggggaaggcagtgatcatgaaggccagaaacccagggtatcccaggcccccatcaaagggcagctaagagagacttgctccaggctacaggctacaggctccaggctacagggagattgtaggtaatattttgctgctgctttttactttttcacattcttcaaactttctgtctcaaacacgtatttgctttatacttgaacataaaaaaaaatggtattgttcaaaagccatggcagaatgagaggcagccataactccctctcatgccagaaactaaccaacatgtggaatagttagtacacatcagagcaacatgcatggggctgtaagaggagaatctgaagccaaatgccagctctgcagcttccaagctatgcagacttgagcaggcaatttcactgttctgagctggaaagtttccattcgcttgcccgaataaaaaccagtacaaggtaatggaaggggagaaaggtcacttgggcggaaactgccatccagcttcctcatgccttgaggcatctttgcaggagatggcacaacttggaccccactatgagaacctaggagacaccacatgcaatgccccggaaattcccaaagtagtgcagggagaaaggcgggaaaattccggcaaacaccaggaatgtatcctgatttggagaagagatcacttaatgaataggagggccttggaagcagggggtcatcaaaaggagcccatcttccccactgctgagcaaggcatttcagggccaccatgggggataagaatgagttagtggtgaggctttggctcaatattttctaatatgagttatttataacatcataaacacttttattttttctttattaagctaataacagctaaacactactatgtgctaaatgttttatatgctttctcatttattccccatgaaaaataaggtaggcacacttcttatcgctgtcatatataagaggaaactgggctgggcgtggtggctcacgcctgtaatcccagcactttgggaggctgaggcgggcagatcacgaggtcaggagattgagatcatcctggctaatacggtgaaacccagaaatcaggtagcataaaaatgcacagagatacaaatgttaggatgtcaggaagatggagcaagacattgaaggaaagcccaaagtcctgggaaatgccacaaagaagcatagcaaggatgtgtgcacacagaagtccaggaaaaattccgtcagataaggcccttatctaccacttggcttctcggaaattttcttctggttcctgcagtagtttttcagatttaagtatatccttcctctgaacttttagggcatgcttcttttccttctgtggcaagattttcaagtcaatatgtgtgttgttctaaagtgaaatcatcgtctggccctctgattccacgagtcaactcaacaaatgtcccagtgggccccaacaggtggtgtctctggttgggctcactggaagcagactttgacacatggagatttatcaagtgctttcaggagaaaggatataaaggacagagtgagaaaaggggctaagaaaggatgagatcacaactggagtcaagctccagcctggtcccacaaggagtcatggagcatgaagtgtaccccagagtggatggtaccttgtggttgaactactgtgtccatcagtcattggtcagggctcacgaggcagagagaggaggaaacttcttacttgacggagggcagctctctgggaaaaggaagctgtgaggctttagcagccgacatgcccagtgctctagggttgagggcacttgcctgcaaaggggatctgtccaggacactaaaagcatgcattccacttggcactttcctgtctctgccttctcctacagtaaattatacgttgggtttcctgaaatccaatgagctactgccttgagattttctggcagtctgtttctaaatctgctttttttttttttttttttttttttttacacatggggctgggaactgacctcagtagcacactggcaataccaggtgtgagcatagctgtaattaagcactgcttcctatgaaatgtcactccatctcacataaataaatcactccgtagctgagcttgataaacattttgttcaacttaacaagatttatctgagcgtttatcaagtaaaagtcacatcaactaacagttttgaaggctgactttgtgccagccactgtgttaatggcttacataatagactgttcacttgatcctcttaaagtccctgtcaaagttcttctcaaagagtggtccctgaatctacagcatcggcctcatctgggaacttgttagaaatgtaaatttgtaagataattctagggctgatatccacttggagatgttgtttactggggttgatagtctgaggtttttcccctttctccattctattattaatcatgctgaagatgtactcattattttacaaaacagaaaatgaaagagtgtggaaggtataatttctgcccagaggaatttataggctggattaagattgtaaaaacagtagaaagagtaaaacataaacactaagtcgagcattgaaatagtatacttcatggaggaaaacaggtctggcatggagacagaaatgctcttagaaaaatctagagctatggttctcgaaccatggtccccagacaggctgcactaacatcccctgggaaattgttaaaaatgtgaattctcaggccaggcacggtggctgacgcctgtaatcccagcactttgggaggcccaggcaggtggaccacctgaggtagggagttcaagaccagcctgaccaacatggagaaaccccatctctactaaaaatacaaaattagccgggcatggtggcgcatgcctgtaatcccagctgctcgggaggccgaggaaggagaatcgcttcaacccgggaggcggaggttgaggtgagccaagatcgtgccactgcactccagcctgggcaataagagagaaattccatctcaaaaaaaaaaaaataaaacaaataaaaaagtgaaatatctagcgccatctaataaattcccagacctaatgaatcaggaactttgggaatggggccaggccatttttgttttaacaaaccttcctggggattccaatgtctgataaagtgtgagataagtcctactagtaattcctatttaatgaataaggaaactgaggcagagagcggtcaagcaatatggcttttagtagtacttctcagactacagcatacaaaccacctggggatcttgttaaaaatgcacatcttgattcagaaggcctgtgatggggattggaattcttcaggtcttgctgatgctgctggtccatgaaccttactaggaggaacaaaacctgatatcactttgctgaggggctgagttaggattggacccaggtgatctgataccagacactgagacattaatcacatcacccatctgccacctagtactaaacagtacacagctacacttagcaactctgtgaaaggagggtagagagtgcagtgttccagaaacttactttgtttgttcaaagaatatctaatgataacttgcagaaaatgactgcttcacagaaaacagttttggaaatgctgtgatagaagcccagatgcctagcattctggaaatcttggaagaccttaggtcagaaatatatatgtaagaaggaacagagtatcttcctatattcttggccatcagattcttttaatatattattaagttatggcatacctggtatactattaggttggggtgaggtttccttatccccactctttcagactagaacagtagttcctaaattttaatgtgcatcagaatcacctagagggtaatttaggaggtctggggtgaggctggataattagcatttctaattggttccctggtgatgctaaattctgctgactttaccctgggtctcaaggacttaaaagctgatgtcctcttaagtcccttaatggaaagcaaggggccaaataataccacagaacacatgaatggaaaaattccttaaatctaagaccatgtcctgaggatgagcaactggtcactgcaccaacagtgcccagctaagaggcgggagttgtggcccccaaacccaacccatactctattggcagagccaggagttctgactacagccatgagtccttactgagcccccttggagggaggtcacttttgtgctttgcccaagggctctatctgcatatcaagctacatatctatggagctgcatctgcccagaaggtgaaccccttttcttccaattcatccgtacaggagggatacatgttctaaattgaagaaaggcattttacagcctaatcggtggttctgcttaatcccattttatgtttatgtttctctgattatgttgcctttgaaatctctctttttctttcccctttttcaactgcttgccttgctctttaaaaacaactcaaattccaacttcccttggcttactttgttttatgtggataagtcggcttggtttgagagcacacactcattggaagaacaggagctgtaatagctacactttaatgttctgtccccagcacaagtgcatccttccacccccaggcaagacccctctattttcaggaaccacctaaagaggaaggcaagagttgcacctgatgccacagagagtgctgttttcctaccgtctgattatctatcaaggtttctgtaatggccttgccattttgcaattccccatccactctcctttagtgtcatgacattatttccttcacaaagaggtaagacaagactacaaaaatggctgtcattatttcagaaagagcaggaagccttgaaattgacttgtaattggcagaagtggaaacagtactgtctttaataaaaggaaaccatttctggttttgcacaacagatactatgcctggtttacagaagatattctaatgcaggatcctggaagccttcagtgtgttggtttgaacttcttggcatcaaaataataaaaaaaaatgataaagataaaaatataaaaataaaacaaaataaaattaggcccagcatttccagctgtcatttgttccaactgctccaggaatttcctggccagaaaatatttaggtgaaattcccacaattcacttgtaatgcgtattcttttcacttctagtcaccctgctgccacggcatgacatttagaaacttgctaaaatctagcccattgattctcttaagatcacatttgtacctttttggcagtctctaaagaatagcttttgattattctttattaaaagtcagaagaaatagaagtagacataaatcatttttgattagctgtgctgaaacccttccaagagccctctatgtacgtggctgactgctcattttgggttgatttctgggtttagaactcctgcaaagagtcaggagggacctggcataagtcccacagggcttggtgggggacaaaggaaactaatgagaacatgaaacttaatgctgcttgctgtgtggtgaataacaaagttctttgtctctgacccagaagtttcatgtcttctgccagcatctatgaaactgtggcagtctaccttgtgagcctccaaataaggtaaaatcttaggcctttcatagttattgatagacagtttcaagtgggcagtaagatttttgtggagggagcagtcagtatcatcaaatctgaaaagagaagtataaggcctgcgatgcaccctttggctatagcaatgaggaaagcactggggacatttacaagggccactccttggaagaggtggcactgaagaaagcctcattccaagtgtagacgtcccatttaaagaatgtggctaggaaggggataagagaattaagaaggcaactagggggtggggaggcaattcaaaaataattccaagggcattttatttcattgatctcatgtagatttgagaaattaaaatatacttaagtatctggttcagcggccaataaatttagaagtgtataaatatatgctaaataaagaaatctgtttttaaatagaaagcctcctgtatagaaggaaaggctggagtgtaacccaaggtgacagggccatgaggtaggcatggaagaatgagcccaggactgagagacaggacctatgtttcttcacaccatgcttctgctgctcactgcctgtgtaattccgaggatgtcatctacccatctaaggctcagtctcctcacctataaacagggctacaatcacatctaactgaaagactggttatgagaattaaatacatcctatgtgtaagcacttagtaaacatcagctgttaaacatagtatcattacattatcatcattgcttagttgcagcgtgaccactagattgtcaacagaaatgccacacagaagggatgcctggttcagatgcaggcaggtaggtaggaggaggagctggtccccagaacactcacagcctcagaggccagcagcagccctgcaggagcaaggaaacaggtttactgggcgaaccggctgcagtaaagactgatatgcctcctcagctcatcaaccctgttgcagctgctggagtgcaggcaggaaccttttcctatgagattcagatctgctcccagtccagtgaatgcaatttgtctgaaaacatacactgtccctacagagatctgcacagggcgtttggacacatggcttcatttctgagactcttcaaatgttatttgtcataaaaacccctcgtggattgaatcctttgtagggaggcctgagagtcagctccatggtggggctgacagactctgctctggagtccctgagtaattcaaggaaagagccccatccaccatgctccttgataaagacaggaggacacacataaaatatttctaaacatgcttctggatgagtagtgtctgatggtgatgatgggggtgtgggaaaaacctgtgtcctcactgttggaattagctatgccaaacccagcaaaggcttcttcgtatactaggagtattctgtaactgggaaaaagtgaccatttttctttttttaatagcattttgtttatgttagtttcctgtattcatcttagaatatttggataaaacagaaaagaatagcgatgaaaataaaaagcttcataatctattattacaatcaagtgtcttaatatgtatttcatggagttataggagtgtctatgtatatacatatgtatatacagattatatatatttatatattatgtacatgagcatgtatatgtgtatatattttttcataaagcttaatattatatgactctataactcatccttttcacttacatgttatgaaaatgttaaatatacttctaaaatctgatatttaatgataccattccctcatttacttaatcagtctcttttgctgaaaatttaggttctttccagccttttgtcctactgaacacaattgcagatacatttttgtccccatctctagatatttccttaggtaaatttccataagtaaatttactcattggaaaaatatgcatatttaaggctttggatatcaactgcctaattatcttgcagaaaagatgtacacatttatatttgctctgtgctacacttataattatgttggtatagccccacctagttgtatcctgaatgtcattttttaaatggactccacaaaactgtagaccactttgtttagtggctattccccttggaatgcacaccatctccttgcttgaaaaattgcttgcaaagttacatgtctggattcctcaggccaaagtatcacataaggaataagcaagttatgactgagccccttccaccacagaccacggcatcatacacttcacctcaaggagaaatgatcccaggacaagaagaacctgcttataattttttactagccttctatcatccttttccctgattcactacaattgttctaggctcatgtgtttgcatttctgcatcggtcctgtccattgactctcatgtagaacttgtactgtaattccacaaaagccagcaccggcagatgggatcttctaaagacatataaagtttccagaggggtgcaaaacaggggcattggctggtcctccttttaacttattaatttatgatccaaaaccacttaaggaaaagcaagctataaagtcccactctacagaaaagagggccagcatttcaccacacaggcaacagggatttatctcaaactatgaatccactggctcctttctaaccactgccagaaagaagggccaccgacatacctgctatgctggaaacaacatctttatttccctgaattacaactggccgagttgagaagttaccactttcagtgacttagtgaaattcctcagcatatctcagaagctacagcaggaagtagcactgctacacagtagacctgctgtagctgtcttatagagactcttttggccatgatgggcctgtttcatttgctttggaaattctcaggctaagtcaccccaaccttattatatgaggcagaacaacagcgagagtgccagccactcctctactgcttggacacatctgaagaaacatctcaggagaaactggccactgccttggcctgtcttggatggtggctgcgatcctctctggggtggcaggtgtgttgataggtgccttctttttgtagaaagatgttaacctatgtgatggttaattttatgagtcaacttgactgtaacagagtacccaaattaaacagtatgtctgggtgtgtctgtgagggtgtctggatgagatgagcatttgaatcagtggactcagtaaagtgcatggccctccccagcgtgaatgggcaccatccaatctttggaagaatagaacagaaaagcaggggaagaagagtttgcccctttgcctcctccctgactgcttgagttggaacagtggtcttctcctgaacttggactagaattacaccactgccattcctggatctccagctcgcagatggcagatcatgagacttctcagtttccacagtcacatgagccaattcctgtactaagtcctttccttccatataggaaggacatattatatatggaaggaaaagacttactatggatggaagtgtttacatctataaggaaacacttattaaaaaaactatatatacacaaatatatattaatatatacttacatataaatattttccttaatatatttaataaatttttataatatatattttataaaatatatattttctttaatgagtgctatataaagattatatatttatatatacatatattttaaacataaatatattacatataattatatatttttatatattatatatgttatataacatataataacataatttgttatatgtataacatataattatacataacttaggataacatataattacatataattatgttacatgatatatattataacatactatatattatatatgaaaatatataaaattatacacacacacacacacacacacacacacacacacacacacacacacactgcttctctggagaaccctgactaatacagcctacttccaattacctgattgcacataagcctggatttaactagccacacaggcatttgtcagatggcacgatataaactgtgtacctcccaatattttctgaaatgcagatgagacagacaatatttagggaagtttccttgaaaaaatagttactgaatctattcacttaccagatacgtttcaagtgccccaggatggagacagattggcagagagcaggggactctgccatagcctcttgcccacttcacccctctctcccccttctcctccccagactgctttctcacagccatcatgatgtgaaacaggcctgtgaaactcacttgtgtgccctcagtaagactgtggtggggaacattgttcattgcatcatacagtgttttcttcacagggactcctgggaacaattcctgtctggcttctgtgtgaacaacaggtagaattttcctgagcaattggtttttgtttatctcacagacattgtgaactgtgtatctgacaagtttcctttattccactagtggctacaaagctgcgggctctgtgtgtgacccaccagttagtaacgtgtgcagaaatgcggttttcgcattattaccagctctgtgtattttctccttctatctggtgttgtcccacttttaatttatgatatcttgtcatgttttatgtcccattgaaagccacctggaagacgttttgtgaaataagatttggtttacattgaaaaggagataagatgtggaagagctccatgtcatgtgtttccatctgttttcttcaaatattcagttatgatctctttaacatcctcccactgacaaacccaaggttcagggcatgcaactaagaactgccacaataacgatcataaaataattggaaaacccaaacaaagttgctgaaaatattgtgatggtcctgcctcattctcatgacccagctgaggcaatgccattgaaatcacacagcttcttggcagcctaatacacttgaacactaatcgtaatgaaaagagtaaataactctaccgaatactgaggtgacgtggaggtttcttatgctctcctgtggtctgtaagcaaccctgggaagcagaaagaacaggtatttcacgctgctgtgctgctatttgcactctgcttgctgctaagtggcaaggaagaactgttggtccctagatgggctctttatgcccaaggatttttctaaccacaggaaatggcttaaattcaagaaaagaagtgacaacatgaacttccaagaaagtgtgtggagagacagctaggcaaaggaacacatgaaaatatgttcagtatcatcagtcctctaagaaatgtaaattaaaactataacgtgctcccattacacacctattgaaatgctaaaattaaaaagactgaccatactgagtgctggtgaggatatggagcaactagaactttcatagactgctggtaggaatgtaaaatggtacaaccattttttcaaacagctcgttgttctttaaagttaaacatatatctaccagatgaccctgccattccacttctaattcactttcatacccaagagaaatgaaagaatacgtctctacgaagactcacacatgcaggctcccagcaacttctttgtaatagccagaaactgccaacaacccaacaggtatccatcaacaggtagatggataaacaaatagtagtatatccattctatgaaatatttcttagcaaaagtaagaaatactgttacacacaacaacataagtaatccttagaataattctgtaggaaagaagggtacataccgcatgcttccatttatataaaattctagaacatataagctaatacatactgtcagaaagcagattggcggttgcttgtgacaaacgggagtggggaagtcagaaggaagtgattacacatggggacggaactttggacgccatgcaaatattcaatatcttgattgtggtaatagtttcacatgtaaacatacaaaacttatcaaattatatactttaaacatcacatctcaattatacctcaataaagctagttagaaataattttttgagaaggagtttcaatctggttgcccaggctggagggcagtggtgcgatctcagttcactgcaacctccgcctcctgggttcaagtgattctcctgcctcagcctcccaagtagctgggattacaggcactcgccaccacgcccagctaatttttctatagaaataattattttcatgtcaaatcaccacagccacatgtagttagtggttcctgcactgaacagcatggctccaacttctgtgctgccccaaaaacttgctatttgtgctagtattaatggaagtatgctaatgttataacaagttacgttttagttctatgtgtcgccctctgtcctaacccccactcaaagagatcctttctcatctttcttggaaagtgggatgaacaagcagaaataacaggaaggcaaattcaagcttcaaacacttccctgatggactttactaacggacttatttaaccaaagaatagacagattgctcattttagtgaaaaattcccataaaaagcgactctctaattttacccagaagtaccagtgaatcactggatatccaagaaccttccagttaagattacatgacaaccacgtaccaagaacctaagctattccatttgcctcagccctagtaatctgcaattaaaagacaaagtttgttagagggtagttggaaaaggtcatagttacaaattctagttctggaacttttaggttttggtctgggtttctgcatgtataaaatggttataccaatgcctgactagcagaatcgtagttaagatttaacaagatcatagatgcagggcaccatcagaggaacagaagtactttaaaaatctcccttccctgtacacaccaaaccattcatcatagcacacactttcttcccttatcaagggataagacagcatcgttagcccaagctgccccatttcgtaaactcacaccattttgcaaatgctggttagagcagaaaattccgcaggggtttgggccatgagacacatcccgccagacaagtcccaggcctaaccatctgaccccaggaaactcctcacttaccagcgactgaccacaccacccaccccatctcacaagcccagacctctcccgcctggacctataattaccccagtttgtaagcaagggtgggctccggtgctagctgttgtccccctctgcatgtctttgttcaatacacttgtgttgccatagagctgcttccttccagtccttcttttccctttctcatcctaacgagtctgagcagaggcttctctcatgcttacctggagccaaagcttgtcatgctgagaccacttcccaccagcaatgcactgaaatgtggcattctgccccacattcacctccacgttttggagtcgcagaaaatgaggtgcttttcctaagagagaaaccaaagaacacaagagaatgagattcgacagcctgcaccacttccctattggtggatggcagctcaggatgggcactgggcagggtggaactggcacttaagaagtagcccggctcagtcaagatttcattgatcacttattataagtctggcactgttcgaactttacacgcagaatctcactgaaacctcacagaaatccatgaagtgggcagtatccccatttcacagatcagaaaattaaggctctgagggtttacgtcatcatttggcacagacacatatccagagggggagggaaccaggacgtgaatttagatctgtgctctgtgaaattggcacaaacatgcctagaatacacccaaactgatcattgcttctggggttggcattgcacaaaaggtgaaactacgacactgaaagttaaaagaaaaattggggggcaggaggggtgtattcaccataggtgatgcttccctgtagcctgaagaagcaaaataagaaagctgaagtgaagcacctttgggcctgatacctgcacacttggcctgggtgacgatgttgatgaggaagatgatgaggaagacaaagagcggaagagggaggaaaagggaaggaaagcactagtagctgtcattcttagcgcttgccatttgataagtaccacatgcagtgtctctctgcagtaactcacttaacccaatgcagtcagtagtgttattttctctattacacagtgaatgaactgaggcacagagaactctagaaacgtgcccaatatcacaagaccccagagtcttactctgtgatggtgctttctgagcatgagggggagcgttgattctagggactggacataacagggaaagggtctttcaaatgaaaatcagggtgtgtatgagcagacaatcttcggattaagtctatgttttatattgggtaacctggtttcatctctttccttttttgtggagaagggtcctcacctacctgcactctacaaataataacaacagtaacagctctccattggctgataaattgtatctagaagaattggtttcttcattgaggcacaatgaaggatctctatgccatcaatcaaatcagtgatgaactgggatcacccccagaatggaaacaaatggagggttaggagaggatcaaggaggtttaacaggaggctttggccatctttctacaaggagtcaaatacacagagagacaaatagtaacaataatgtcatttactgagagctcctacaatgccaggtactatgataaatgctttgcatgctctatctaatttaacttcatgacattcctataaagcagacactattatgatttccctgttaggcagaaatcaaggctcagcaagtttaatgtgctgaaagctacacagcgctagtgaaagacagaaacaaaattcaatccaggtccactttagccccaaactcagcatgtaacaagcagctatgctcccttgcctcctgggcactgggaatgaggatggtgtctccagatagactccagggtctgcagaaggggctcccagtcagggctgtgctgatggttcaggtttctgtccatgctcccaaatattttattaaaagtgacccctttccatgctatttttccttgatttgaactattttgtctaccaatctgtgtcagcacctataaagctcagcaaaagccaagaatcttggaacaattaggcagacttgttgggagagcactgggcagcgtggaattggtgcttgagaagtggcctggcacagtgaagagttcattgatcgcttatgatgagtctgacactgtttgtaggactttacacgtcatatctcactgaaacccccaaaaaatccaggaagtgggcagtatccccatttccccaatgtacttttactcaggtttttaaactaatgacagcagctcagagacccctcaggctacctttgagccaccatggctggtgtggtgtcaaggacccaaggcccggggaaaaccacctctatgggcttttcagagttgaaaattcctgcatctagtcaacttgacaaatgccatgctgctctgattgtctgaaattgtttccttttggctctcctgtataattttatgaagttatttttggaactatcagttcaaatcaattcttaaaatgggaatagagtgaaccttggaagcctgttcatgccacaggcttaaagggggagtgaacacatccaccccaggtggggagggagtgcagagtcttagctccaatgctgggaaactctgtgtttagttttacaaagaaatgctcttcccttacccttcgagaaaatggtttaacctctgggatatgcacaattagcaatgaatcttttctggatcaatgtccccagcatgcctctgactcctctccacttcttccttctcagcaacagaccttttgccttgattctttcatcttcaattcctcttcttcccttccttctaggttcagtggtagagagtttagatgtttaatggctcctagtgtgaatattctggggaaatactggcaatttacagcagagataatgaacgcatgcacctacaagagccagttatgtaaattaataaagtcgttcagctgtaaaacaaaacaaaaataccacctccttgccccatcttttactttcccacttttgatagagacttgagaaaaataaagatttctttatataagaaaagcaatgttgtaagcacaataactggtatccaccagtagcctcagcactgaggagacaataaggagtggtgaggactggagggaactggagagagactctgaaaggggacactgaaagggggcagctcctacttaaattcagcagaggaaggccaggcatgcatgctttgtataggggtgtcaaacgtctgatttctccaggccagtaagaaatccagactttatatgaaatctctcactctaaactcaacatgttattaaaacacagtacaggcttaacaaaacatgtgtacatgcaggctctatcaatctgcggtccctgatatgtagctcttatgaaagtcctctgcaacaatttccactagccagtctcacccgatccagccccatacattcagggatgcccccaccactccatgcggtacgcggtgggcatcacatgaaggccaaccccgagtacagttcccagcacaggagctgatctaggctaccctcttcttgctcaagacccttgtctctgctccttggggctctgggtcatccttggctcatgacaggcagtgctctctggtgattgtgcttatgtggggggcctgtatggtcctcttccctgcgttcctggcctctctgaccctcctttttccatgcccccaaacggcctgctcatcagccgcaagctctctcaactgtcaccttcccccagcatctgctgctctgggagagaacttatattccacgagcttcaaatcactcatcttcagccaaacatggttgaccttggtacccaggtcagccatcggctcgtggttctaagcatttcctactcactccacactgagacccaattccccccagatgggatgccactgaatgggcttaacagaagactggctgtgcatttggggcaaaaatgccttgacgttagtgacatttagacgcctacagatgtcagtgcagcatctgaagacatattattgtgccctttatcttgctctttaaacctgacagtgctcagtaggaagccacacaattgtggagaaagcccagtacgcacattagaaacatgttgcagatgctctgtgggctcggggacacggccccacaagattgtgagggagaaagaaaagtcaacttagaagctagaaactttgaaacggagtggaaaaatcatactgacatttatcttacacagttataactgccttggccctgctaatggctaacactgagaaacagcaacagagggtaactaaggatagaatacttttagaataacacaaaaatgttaaatgggctataaaatatagatgagaggcttccgtttgtaagagaaaataatttctttgagtattatgcctgtcttttggttactgttttgggagcttggaggcaattatctacagttctaatttcagtgccaatcaattgaagatacaattgcaaatcagtcactcgctccctggaacttttggaatacttagtggaatcacttattgataaactctgaccatatgttaatagaaaatatgttttagaggacagaaagggataattaaaaagactttatgtccacaggcttttttgaattgaacgcatatatttcaatatagttcaatttttaaccatctatgagtgaagtcataaattctaagactggaggctggggaaaagcacctttagtctaaaggagagttcagaagctactatccacttgcatgacaggtaatccctgtaagcagtccctggggcccacagggcccctcaccaggcagcctgctcagttcttcccaggctctcaccaccttgcttaagctacaaatctgtgagtgcactatctccgatgcctgactcttaatccaatttatcaaatgagaccagttggctctgcctcctaaatggatcgctaatctctgcacctctatccacctctatgctctaagtttcttcattgtcctgctcataatttgtcatggtctgaactgtgtctcccccagatttatcttttgatatatgaccccaacccccagtatctcaaatgttcctatttttagcagcagggcctttaaagacatgattaaattaaaatgaggcctttagggaaagccctaatccaatccaatctgaccagtattctcaacagaggaggacatttgaatgcaccgggagacaccaaaggattgtaagtacagaggaatgaccatgtgaagcctcagcaagaaggcagccacctgcaagcaaagaaagagcctcaggagaaactacggtggccaacaccttgaccttgaactgccagcctccagaactgtgagaaaataaaatacatttaagttgcttaagccatccagtctgaggggttttgttatagcagctttagcaaactaacgcactgtctgtgcatataattatataatcatatcatataattatataagcatatcatataattatatatgatatgcttatataattataaatgtatatatgatatataaatgtaaattatatgattatataattatttatatactataactcacatttatataatatatacttctatataatgcttgtacaattatataatatatagattataataatataatcatataattactttatttgttttgcttcagcctccttcacttcaatagaagtccatgaagacagacagtcaatctgtctttctcactcccacaaacccagaatggtgcctgacatggagctcacgctcagtaaatacttgttggatgatgaatggatgtctctcagtcaccctggtgcgggccaccaccacctcttgcatggctccagaactttcttcctcctaggtctcccgacatcttctctatggtcctccaacacagagcagcccaagtgacccttctccagcagcactccctgcagcagagcctccctgcccttagacaaacatttaaactactcacgatgctgcccaaagtccaggctttcctgcccaacatttgccctgaccaccttctcctgtgccctgtatgctcaggacatgctggcagcatcaagccaactccgtgtgcagggcctctgcaaccactatctcctctgtctgaagcacccctccaccaaatcactagactgtgaactccctcctgtgatttgagtcccagcccaggtcacattttcaaagatatctcctctgaccactatatccaagcagccctcccgtatcccagacaccgacacttactatatccactattattttcactatctgaaatttctggttacttaatattagttactgatttagtgcctttctttccactggctcttctgctaatcaaacaccatgagtacaaggaccgaacctttcttagtcacttaagtatcactgtgcctaggaaagttcttaacacatagctgatgtacaataatttacttgctgaaagaaagaataaaaacctgggctaggtatggactgagcactggtccttaggaaagggactttgctaggccctactcaactccacatgattcgtgagctgtggatatacctcaggcattatatacattgccagtatttgtccatatagttaagtgaaattttttccaattccagccactcctatggggtcttcacatcatgctttctgggaagtttatgcttaagctgcctcaacactgaggttgaacccaacaggagcacattatgcagacataaagccaggatcacgccttcctgagttatatcccatggtccatttgctgggtaactggctttcagcaatttcatgaccatgccacccacacccctctgcaggaggaggatgaggttgtcaggagaatcctgacttcaggagcaaccccagtgaaacgagaatttcaaaaggattcatgagactttggggggtggaaagtcattccagtgccctccaaagagccctctcccatggagatttatcaaagaaaaaggatgcatttgcttgtgacagcaaaccatggtcagtgcttggaggtaaggcagagcttttaccactctggccttgaaggtagttacggctagggtaagagacaggtgtcaaggttgggcatcaggacggagatgaaaattcccattagagcacaaagttctgggatccaggtagagagactcatgctattttcccttgggaaaagccagctgtcacctactagaaagctaaagtccaagcatccagcacaaagtaagaagcaggaacacaggtagatgtggcagaggcaagcacgctctgagtggatgggatgtaggcagggaatgaggaagacagaaggcatgtttcagagagactacctcgaaactggaggtagtgcaagattgagcgcatgcaattaaatggaccacaggtagcacagacatctcccaacacagttgcccagtcttaggctcattctcaaatgagcagctgatggtgactcccacgagtccagggtggggaatatttcaccctagtgaaggagattcatatgcatatctactacataaaccctgcatagctggggggatttctgggatcctcttcacatgaagtctgggtcaatagaaacatttccccaggcatgactgaatgacagacccatctgagaaattctaaaagcctcaggaagtaacccagagggtagggactttcagccagtgcaaagaagagcccagtagcatctcagcattcccaagataccagttgcttcttgggaaagagggtctctcctgcacaggatccaaacacaatttctcaaaataatgttcggaacttgtaatgtgttccaaattcctccagagaaggggctctaagacaatgagtcagacaacggcattctagtgccaggcagagggagggaagttacatttgagggtctgacaaattcattgcagcagaagtggaaagagttatttcaattaaagcaacatggatgaggctgaaatgagaatagtccctaaatgcgaggattgagaagcacataaggagaggaggacccatgatgtctcttgaggcagcagcaaactgcaccatagcccaaagcatgactcatgcccatatgggaggagtggagagagcccacagggggttacctagaactggatggctgccaagaaactactgggaatctccaatctgcagaacactaacaaactcatggggctggcattccaggtatccctcccagggtctgccataatctccatgcaaatcagtttgatttcagtccccccaaccaaatgtcactgggtatgatgtcatctcaactacctgtacccaggacttatggcctctgagatttagtaaatccagaaaccacatctccctgctgaaacacattccaatatctgagactaaatatggcaaagaagtagatgggtatggaggagtgccacgcctttgaggactcttgacgctgtaccataagtactaaccactatgagaaatctctatgcctacatggagctgatgagtatatttaaaattattttaaaagaattaataacttcagggtacttttccctgtgagggaacagtgtgctaatttgctcagtgttttggtggtggtgtgtttttttttttttaagacaattgcacaagattctatccaaagccctctaattctaccacttcagtggtctgaatcccactaataaacaatcaggactttagactcccttaataatggagagagattcaaacaaagatgttttgccactctctgcaaattcctggaggtgctgcctgttgaacaggccggcaaaattatggatttattcaggactgattgcattgagtatgtaagcatttctgaaggattcaaagagaaagagagagtgagagatgtttgtaagctgaatgaatggaagggattgcaggctctatgctacccagtctggcatggatcaaggctgtgttgggaggaagggaaagacttactgcatggatgagcaaggacccggacctcgtccacggcgatgtagccaggatgacccttcaatgagacggattcaaatatcacctgcaacacacagggcgggagtcaatttcacagaaacagttgcaggcattcatcacaagaagctgcccggcccccagccctttatgtttcaacttcccatcagaagcaacccaagaaaccttctgttaagacagcacgctaccctggcaattgactgggattttcaacacaaggtaaaaaggccacactttggtggctagcaaaagaagaatatttttaacaaatttcagaaataacacttagatgcaggaaaaacaacccaaacaccgaggtctcggaaaccccagtctgcatctttctcattgcagcttcaagggtcaagccacaacttgaccattcttctacagagaactactttctaatattccaactttcttatgaaggataagatagatgcctaccttggaagctaccataagccaaggagggtttaccatgagttgattctacattgccaaggaacatattacatttgaatctataataacactcttaaaaataagtggcaatctacctgttggtatccaggagtagaaggcaactgacttccacctaaactgctatttccataaaaattttgtaatgcatttagcttccctcatcactcaacctctatcttcaccaaggagatatgaatgtctgtgtggatagcatggccaacatccttgaactctctggttccaatggccttcttcaatccactttagccccactttcacctcatttttcaccttctggaaattggaaattccattttcccatactccggcacagtctctaccgacagtctcatcccagttgactcctcttgacctgctcctcaggctcacgtggtagcctggacctctgcttttcttatctaatccttggattattaatgcagaaggtccaggctaccatgtgagctcctcagactccatacgagtctctcctaaagcccccattcctttgcacctttatttcaactttgcccagcctataacacatttgccttctccaatcctgtaccttacacaactgccgccctttcaacatgcacccatgtaatcccagcagacacccacatcttcaagaggcaagagggaaagaggggctgacttctaactttttacccactgacttgatatccatccacaccatcccctgcctcttctttgcaaggaacatcagcgctcttgacccggactcttgctatattttccatcttttggattctttttggttttctctgtctaccctatatctccaaaccctcccttttatccctaattttgacatgtcaacagcttctcctattctttaaaaactacccttcagcagcaggttttctctaataccatccagttgtgtttcagtaacacttaaaattctcagcagttttatcttcattgactcccaacacttcctgactttccactgcaaaactttaacctaatatgatctggaacttcccctaaaactgcttacacggaagatactaataatcttctaattgcttaatcaagtagatattttcaatctttatcttactttaagaaggaagatagtacagtgcttaaactcttgttccaagtgcctaggttcaagtcctggctgtgccacttgctagttagtagtcctggaaaagttatgttactgctctgtgcctcattttctgcatctttaattatagtgtctacctcattgagtgattttttagattaagggagttaagaccccacttagaacaatgtatggcacatggtacattctcaagaaatatttactagaattattatcacaacttgaccattcttctacaactgtcagtgttcatagactctccatttctgggtcttttttctatttaggctcagataacactttattcttgttatttttctcataaatctggcactgttcaatgcctgggaggtctgtaggcattcctccttctccatcttcccttctaacgtgggcccctgttagtcatcttttcactgcatacactctcccttcaacagctgccaatgcactgataactccaaagcccagctctgcaccctagacctttcacccacacatccgtcttaggtgtccaggtcacagatctgtatttctacctaggtaccacatcaatgacgtgaatccaacagatctgcacagattcctcctcaaaccttttccctcattgaccaatagtctattctttctgaaatacggaatatggttaagtggcactatgacccattcagtcacccaagctggagaccagggtgtctattgggcctcaacttctgcctcagccctcatcttcattttcctttttattctaccttattagcatttctcaaatcttcccatgtcatacatctctgaattgtatgctataagataaacacctaaaacagaatgactgcacaacattaaaaagaacaagttgaagaaagacataataaagaaatgcaaataaacagaaagcagttgttgcaaaaatagtgtgaaaaccttgaagtagaattttaactgaaaagaacaatgaaaaaattaggtggactaaaatggtcatttagaaaaaacacatgagtcaagggacttaagtgaagaaaatgatgaaaaagacatgggttgaagactttaatctatgtcttagactttgactactaatcgtataggaaaaagcaagtatatataatgtaaataataatgtatttcctagatacatgttaataaatgtaaagacagaatgaaacttccattcaaaggcttatggctcagttgcaaaaaaatcatatactaggctacaatataacttcaataaatccctcgaagaagaaattgtttagctttgggcctatacattttctaaccaaattcactacaactagaaattagtgacaatgtcttaaaaaccaatttatttaaagttacacaatgctttcttaataactatggtgtcaagtgtgctttgtatgttagcaaaaatctaaaacaaaattaaaagtcaaatgacaggttgagaataatatttgtaatacctatgtcagctaatatgaaaatatccttttttatgtgtaaaggactcttgagaatcaacaaaaaaaaaaacccaaatcattcaaattaaaaagtggcaaatgacttcaacaggtaattcacaaaaagaggaagtaaaaatggtaataatctatgaatgtaattgtgtaaaatgacactgagtatgatcaaaaggtgccccagaagacacctacaaccttggagggagatgatcactccatcaatatgcttctgacgtgagactcctagccataggaagccccacccaatagatagccagctccagtttttagggacagacaccacaaggggacaaggtgatgcctggaccctcagagatggaaagacctgccaaggtgttctgaggagagggagaatggttatctctgacccaagcacactctcaagaaaattcaaccacggcccttgaggaatcaaagtcaggaaatgggagagccaggggagtgagtagagaagtctagaggtgactctggtgcagtgttttcctcctgtcttcaggaggcaggggagtagggatgggatgtcttcaggaggcaggccatgcatacccagtggcactccaagtcagtaaatggaggccgagaccctgagtacagggagtggagcagagggcccaggctgagaattccaacgtctctgtagatgctcttcagctccaaggctgccatgtggacctaccatctattgcacatgctccagcccataggcttcattagagacctcctggtgcgggtgttgaagagatgaggcttgcatggaaaggtgaaaacctctccctgtgcatgactacttgtgcaaagccaggaagcaattccccacaagaggctctgagatgagtcttgctcatccttccaaaaaatggtttttgttcatacttggaggagggtgtggatatgtcaggccatggtttaacagacctggtgttttaacctaatcttttatagttcttgagcagaaaatctgcatggcaaaaatttcaaggggctgcaaacattttcaggagaagagaaaaatgttggcacatcagaactcctcttagaacataaatatacatgttttcatggggagagattgtttagggtaaaattaagagagactttttttaccctatcagcccaaggagacctgtataagacaaggaggaggatttgatgcttagtggagagaagtgggatgggtaaggaagcagatggaatagaattccaagagtggtagagtgggcccctcattgtgataaactccacttcattgtgagtgaatttactaaatctacagagtgccacatagcaccgttttccagggaaagggactgagtttaaagtccagttgaaccaaagctgggtgagtccttaatttcaggggcctatatagcgataataactaccaaataaaagataatttttcctaggcaggtgatggagactagggcaagcagatggctgcaaaattaacagaagttcttttatttttttaaatcttgaaacagaaaattcagaatcattagaaaatatgaaatcaaattaacatcacctagaaaggagctgtgatctgaagtacacgtgacttaacagtcattcagcactgagtggtgaccacatttaataataatatattgtgcatttcaaaattgctgaaagaatagatttttttaatgttctcactatacaaaaaaagttaagttggtgaggtgatggatatgttcattagtttgactaagtctttctataacacatgcatagatcaaaatatcacactacaccctctaaatacacacaattaatatttgtcaattaaaagtaaataaacaaacaagcccctgctttcccaagaaaaggcacatgtcgggagatggctggcagaggcaggttctcacccccggccttgccaaaagtctggtgccagaaagctcactaatgagaaagaggaaatttcagtgtttattacagagctaaaagtcaattttagaactataaaatacgactttaataaattaatacataaaccatcagctccgaagcccagtaatttgtatttagcccatagaatcatatgtacaggaccagagctccaggtctggtgaattttaaaacccattttgctagtgtcattggattttctgataggcctccttttcttgccactgtacttatgtgtatatgtgcaagtatgttttgaatctgagagtcttgtgggtgcttgtccctatgtgggcactctgcagtgtttgtggccaagtgagtaaccattagtgacggtgtgtgtataacatctctctccaaactgctgctctcagccaaggaaatgcaatgaggctgtagtagccaataaggtgcaaatcagaaaattctcccagatgaggctacttatccaagggagggcatggaggttactgagtacaggcttaacaacactggctatttcttttaaaaaggcttccttcctccttcccctttgtctctttttccctcttttcctttttccctccctcccttcctcccttccttccactgaggcccactacaagcctgatggcatggtttggctctgtgtccccacccaaatcacatcttgaattgtaatccccataatccctacatgttgagagacgaacgtggtgggaggtgattggatcatgggggtggttttccccatactgttcttgtgatactgaatgagttatcacaagatctgatggttttataagtgtttgacagttcctccttcacaggctctctcttgccttccaccatgtaagatgtgcctgcttccctttctgccatgattgtaagtttcctgaggcctccccagccatgtggaagtgtgagtcaattaaacctcttttctttataaattacccagtcttgggaagttctttatagcagtatgagaacagactaatatacctgacatgatgatacatatatgttctctaatttcatctgcagaaggtcctatcatacctaatatcctctccattctacagatgagggaactgtgattctgaatgatgacaggatacagctaacattacacaactaggaagaagattctcagaaagtgcaagctattttccctaaaggcaaagcagagcttagagccagaggacctgggatggatcatggggacttgaatttaccagtagtgcttcctacgctggaagataggacatgttgccacctaatagagggagctactgcacagatctcatgcctctcatagggtgtgaacatagggggtactccagaaatgtcctttccccccatgcctcatccaaaagcatggcaaatggtatgactgtccctgtactcagtcaattttcttgttcattgtacttcaacctgtggccccatcctgtacccatttgtgtctggtcctatatatggggtttctaattgaaaccttaaaggctcactgaccgtgcccatgagcttttagagatactttatgtctacagtcaatgatacagtggtgacagtctagggagtagggtatctgggatctgctctcagctttgccaataatttgttacgtgttcttggacttcactatgcaactctggacatcatcagctttatcatgtacatcagggttcagctatggcctggaagccaaatccagcccaccacctgtttttgcacataaagttttgttggaacacagctgggtccattcatttacatattatctatgactgctttcatggtacaatggcagaattgagtaattgcaatagaaattgtatggcttgtaaagacaaaaatgttttctttctgcccttaacagaaaatgtttgccttatctacaaaatgaggataaacctaagccacatgtgccagtatgcattctgtaaatgtctatggataggaagactatataatttatcactgaaactggggcacactatgaaatggatgctcttaatttcaccaggataatgggagtaaaccagggttgtcccagcaaactgagatgtagggccacctgtctgcagaatactatctctatagtcaggtggtcatccaacaaaaagagggccaagatcaaacttagaggcaagacaggaggttaaacaccaataaatggatttctttctgactcctcagaactcccacgtgggtaactgtgagtctcctagaaccgaatacatcacacagctttttcaaaatgctgtgacctccaccacatcagccttcactacagagaatctcggggaacacatgttccacagagcacactctacaaatcatacactgggtattcttcccagaatgtacaagcaagatctgatccccttgttcacgcaactgtgcaggtagagaatataaggctatatgcttaatgcaattctgaaaccccaaaagctctgaaaacaacgttcttcaccttagtattataaaaagtaatttggtggtaaaacctgaacacagccgaatggcctgatactacttacagtctttatttatcccatttcttgtgagtgtgtgtaagttttgctgtagaaatattacatttgattacagggtactgcctcagagcctaccagggttgttataaaatacagaagatatgccaatatattactaatatattactaaattccaaacattgtgaattctgacacatatctgacaccatcagtttcagataaaggtttgtactaaaacatattacacaaaaggaaaagacaccgaagtaaagaggccaaagatatataatttgtctcaaaacatctaggatacaacacgtcacgttgttagtgacacgtgttaaaaacaaaggactctgcttttagccactttcattcataggttcctgctgttgtaaagaagggaacaggggcttaacctcacaccaaatgacaacagtccaccctgaccaccccaaggccagctctgtcccactcacctctgcgttaccaatgcctgaactggcctggctcacgcaggatgcaaaatgactgacaagcagatgagaatagggagcgagtggctgaatgatggtgtgatgagttcttccaagaatttactctctctttttctcttttcttctctttctcacttcctcttttatttctgctctcttcctaactttccttacttcctgcctctggctcttggtcacccatgggcaggccaaggagatgaggctgggggaaaagcaaaggaaacgtggtcccaaacaaggctacttaggtccatctcccaggctgcttgcagatctccaggattgcgggagtcacctgtgctgttcgacagtcattgccattatatctcattatttactcctttaagtctcctgacaaagaaccccaaaataaaaaccttaagaaaaccctcaacacagaccaaggcattacaagagatagctgcgggattctccagcaatggaggatgagaatgagcagaaccagcacctcataaaggccaggtcccttctgagagcccagccttggagttaccccgcttcatctccccatccacaagttccaggcgtggctaagcctttcaagaactctactaggggaaattgtggagccaagtggttaagaattatgatctgtactaatttgacaaccacgagctactgaagcgtggctaatgagactaggaaactgaacttctcattttacttaacttcagttaccttacattttaatttaaaaactgatacccaattcacttaagaatgtttggaacaacttgtgtatatgtatccacttcttcagctatacattttatgagtccaaatacagatcattattactaatgaaaataaaacatttaaattgagacttactgtaagtgtaaaatatagactgaattataaagattgacagggagagaacagaaaacatctcactaataattgtttagattgattacatgtccaagtgatagtattttggatacgttggtttaagtaaaatgtattactaaaattaatttcactgatttccttttactttttaatgtggctactaaacgtttataaatgacatgtgtggttcccattatatttatactggattatactagcttagacagtgaaatcaaacaaaacgggtaaaaaacaaggcactacctccgttcaagcttgggttatcacttaccatttctgagccttcgtttcatcacctataaaatgggtacgtagtacctgcctcaaaggattgttgtgaagattaaacaaggtaatgtatgtgaaacattttgtactgtgcctggaacatgataaacacccaatgaacggtaggtatcaccatcaccaccattaccatcatcatcactacctctcccctatttctgaaaggagtttcaggaaatgcatcatgaagaaaaataacattattctaaaaggaaatcacaagccattgaggataaaattgaaatatgtatggcaaaaatccagtctaaatattgagggtaattgagtattaaattctgatttctcgttaccaaggcaaaagggaaataaagcttgaattgcctcattaaggtaaacccaacaagcaatctcaatagatacatgtattcctaacactaaaatctggaagaactgtaccatggatattaacttggagaatgtctaagaagcccccagccaccggttcatcttctgcttcagatgctagagaaatttctccaaaatgcagatctgactgcctcaccctctaacctaaaacctttcaacagtgcaagtggagattaactgcaaatgagcacagtgtatcttactaggatgatgaacatgttctggactgctttataatgatggttgcacaattcaataggttttcttaagtcatgggattgcacacttaaaataggtggattctgtgatatgtacattttaccttaataacattgttaaaaaaaaaaaaaacaaaactttcaatggccccaggccaagacaatgtggagaaatgttcctctaagcatgctttatggattggtgccaatctgtgcgctgtgtgcatcagttcgcaaggagataaggaaggaaagagagagaggtttaggaactgttgcaacaatctgtcattgccatgattttttttttttaccatggtttataagagtattgctccacaatgagttgagaggaagtgtcccttcaccatggacagtatgagcagcactgctttaaactaagttccatccattagcctgacattcaaagccccccatgatctgcttgtccctgcaggctgatctccctgtctgtcctctttgcaatgtaccttaaacaacttagactttccaaactctgccatagtctatcatccacccctgcagctcactgtacacactgtctgtgacaactcaaatgcctttccctccctcccttttaaaataaatttgtattcattcttcaagattcatcttagatgtcatctcctcttacaaaccatcctaattgccttccccagcaaacaccccattccccagagggtgatcttttacgagttatttcatctctccgaacctcaatcttttcatccataaaataggctagtactagtacctccctcatcatgtcataagcactgactttataaaaaggaatcaatgcctatgttcctctagcatcttcaggagccacatgcatcctggtacattgttattttatctacatatcagtcttttcctacaaatgatgaattcaagtgggacagcggctgtgttaggtcacctctgcagagcttggctaggaggagaagcacagtaaacacgagtgaataaatgaagtcctttctagacctagcacctgtagggagagcaaaggtgtatagatttattacaaattttcaaaaataaaaccatggtaaaatgccatacctgatagaaatgtggccagaaagtgctgatggcgagctctgccttcacccagccctcagtgacgaccccggacacattccacacagggttcccttgggggccaccattcaccttcacgtagacgttcaaggcccctgggctggacctgtcacggctggagaagtagtaatggaagtcgatgcagtgggtgtcattctccttcagggttggcaggagaaggtgggccttctggccagaggctctcccagagctgttcaccatcatgaaagatcctggagacccacaaagcaggtgggaagtagagacaaagagaaagtaagaaaatccttctgaaaatcagtcacacccataaacatggtggccagaggagtggccagagatcaagtcactctagaagggtctgggtgaccctgcaaaagccacatctctctgagcctgagtatcctcttctgtaattgggtataaaaaatctattcaataaggtggttttaagaattaagagatggtaacatgtatgaagtatttctacaacgtgctactattgctatttgcagaaaacatagctactattactgtttgcagaaaacatctccaagcattcaaaaagtttccttgtaggacgaagtgagcctcttttgagttgctttgacaaattaaatggttgtttccaattctttatccctccctggatccatgtcccttgccactggctttgcagttccttccagcagaaacagagggtatgtccccatcccttgactttgggctccaccatatgacttgttttggtcaataggatgctaacagaatgattcaagcaaaggttaaaatgtgcttgccttgctgggcttgccgtcttgcactactgctacctttcatgaaaaggatgtgcccccagtagctgctgcccctttcagcttgggatcaagaatacacacatggaggacacctgacttgaactgatcttaaagaaccaagccatgccacccctgcagctggaatcacagccacatggcccaaaagcccaacctagatcagccaatctacaatcaatgcacagttccatgagagctagaataaacgcttattgttgtttgccagtgagtttcttttcagtgtgtcatgcagctttattgtgacaatagcttattgataaagctgcctgggagggcagactcatgaaagaaaccatgagggggtaaatttcagttcagtgtacaaataactttctaacaagtaaagttggtgcaaaatagaatggactggccagagacaaagtgagtccccaccaaagcaggtggcaaaacagagcctagacaaattaaagagatgattaaggaaatttcacaagcaactgggagggctgaacttagagtcttatgattctatgaaataaactgcatcatggaacactgcagataaactcagttgattctagaaggacagtttccacctagaaaaccactaaaatcttcaattcaaaaataaaccttaagaccacttatcctcagccaagttgagctacttcaatagctaaaagtcacctcattctttcaccctaataccaaaaagactaacagctcccagttaataagtgctgggaaacccataacttcttgggattctagaaggtaccaatcaaaccctgtctccttcaggttctgagtgaatttaaaaacagacatgagagagatagaaagggagagacagagagagaggagttcaaaacctccacgttattattcacaaagtaacttggacttacggccaaattagactttctgcatgtttcccctgaaccaccatgcagagcaggcggatggccatggacccaccctccaactgtgcccagatccctagggccacagttgtcttactgggatgaccacttaggatagttgggtgggtttgtaccaaaaggtagccaggtgaaaagcacagagaaacctgaaccagtggctatcaggttttcgccatcctaccaatgagaaaaacttgtgtgtaaatataagggatacaagtgcagctgtgtttcatggatatgttgcatagtggcagagtccgggcttttagtttgactagcaaccaaatgatgtatattgtatccattaagtaatttctcatctctcacccccatcccaccctccaactcttccaagcctccagtgaatatcatttcacactctgcgtccatgtgtacgcattatttagctaccacttataagtgagaacatgccgtattgattttctgttttggagttacttcacttaagattattgtctctagttccatccatattgccgcaaaagtcatgatttcggaaaatgtagcacctcctggggaaggagccactggaagtggaacaaaggtgcgggtgtctttgcctggtgtttctgagtaaggcgtcccagttttatggccgtgcagtaacacaaggtaagtggagcaatgtctctatgtcagagaagttattgaattatcataaactcgcaagggggcagctaaaaaggagcaattataggggcagaaattgaggcttagagatgagaccgagcctgcatccatgcccatatctgtccactggcctacatgccacagggttccaaaaggtttccttggacaggtaagtagcaactcacaagccccacaaagggtttgtgactgcctctgccactgaggagtagcacatctcccagcagaggcagcagcctgagaagcaaagtgtctctctcctctctgaatcccatgatacccgcatgcacatttcagctcctgtcctcctgccaattcacgccacgggctcatgtacccttggctccttacaatccactgtagagagagttgggaaggttttccttccaccagttcatgatcccacttctttccatcctagcttcggtagcagggcaggctcgctgaggaggtagagattgccctgttccatgtagcttcatgcacaaccctgtaacattgttctgggcacacagctagactatgtcttccagcctccctttagcatttggtagggacatgcaactgagttctagataatggggcatgagtatgatgtgtgccactttccaggcctggttggtaaaagctgcctccctctcacccccacacctccatactaaatgatcttgcctctcaaagactggtccttggaccagccaccccagcatcacctgggagcttgtgagaaacaagaatctcacatccacccccaggcctattgagtttggatctgcagtttatcaggatccccaggtgatcggcatgtacataaagcagtgagaatcattggcccattctattttcccatctaccagctgaatgtcccagagctcaagagcctaggagagggcagtgcaccataaaagaagccaggttccctgaatgagcacaaccacacagaaggctactcacctattaggagcactcatcttggattttaagtaaaaagggaataaactattattcagctacaagtccctttatttaaggcaataagatgtgaaacagtagctactaagcaaagttgcaagacaggctacctaaggatatcattaagagcagcaagccttggtggtaacttgggaggcatttgaaatagaatagcctaggcaaaggcacagaagcatccagcaatgctagtgtaaggtcttgggggtggggggtgggatccagcggccatctctagccccttccacatgtagcccaccttatataggtctgaccacaccctccagaaaggaagggagcctatctgcgagttgagctcaagcgcgccactagagattgctcaggagtgaaaacccttgtatatcatcagctctgtggggcccgctttgatcaacaggttggcataattaatatcatcccagggctgtcagtttcctggagatcaaaaatgagccggtcattacgccaagatcagtcagaaacaagaaagagaaagactgtaaatacattcttttcccttctcccttaaaaaaaaaaaatctactaacgtgataaggaacataaaacagcattagtttcctcatagttattatacatagcactgaaaattgtggaattaaaccaggaagtactctctggctggccataaattttgcatttttccccttcgtgcataataatgccttgataagcgcctcgttattgatgtgtctgcaacacagatctcctttttggaggcaaaatgcttctccatagcagatggtggctattgtgtttacacatgagcacctcaggattgcatttcctcacgtcggcagtaaaaagaaagtcctaattgagtttttaatggctttgcacattgttcattaagattacatgagtgtgctcgggcgactggcagctgagggccttgggcaccaagagctcagcatggtccctgcagacaggtggccccgccagctcccagtgccagcacctacttgaagggaatggatgctggtggggcctcaaatgctgccaaaagccaagcagctgtggtgacatgaaacaagttctggatcttcagttaagtaagctgggtttcactccagcttctggcatttcttagttgtgtgactttgagcaagtcagtaaaattccctgggcctcaatgccctcatctataaaatgggataatgaaacctacagatcaaagttgtttgttttcagtgaatattaagtaaaaacggtacttaataaatgctaattttataacagatagccaacagcaggtaacagtgagcccaatgccgtttataaaaccttatgtttattgagaacttattatgtgccaggcattgatctaagcattgtttagcaccctaatgaggtggtgccatgcaatctctgttttaaagcaaggaatacgaaggaacagagaggtaaagtcattttcttaaagccacatagccagaaagtgataaatactcaaaccaattattccttcttagaaagcagagactacagggtctaggaatgcactttcctaaccagtagctaataacgccatatgcctatttaaaataattaaaattaagtagaaaaaaatcatttacttagagatactagccacatttcaagtgcccagtagacatacatgactggtggataccatattgaacagtgctggtgtagaatacatccattgtcacagaaatttctgttggatagcactggtcttgaagttgtggattacttaccaaagcataacaaattacatccaagtgagtcacaggaacttaactaacccaacctactcattttataaactccagtagggaacaagtaacttggccaaggtcaaccaacacaatgaagatttagactcagattttccgactccgatttcagtttctaccgcagacaactctgccgttccttgcccgagctgtacagccacagaagtggtttcccagatagctatttaagagggaaaagagcatatgttgccttcaggaagcagaagcatagaagtcctaggcattctacatgtcacatgacttaggagaagtatgtgcacacacgttgggcattcccagcctcagctttgacaggcagttcaacaactgtttgttgaggcccaagccctggtgagcaaggacaatgtaggatgcttctaacaaggggtccctgggataaactggaacccaagatacatctcttctctctgatgatcttaaacaagtcacttaactctttgactctcaagtaccatcttctataaaatggttataaaacacatctcatattgtggcctcatgtaatccatgaggattaatacaactactatttataaagtgcgtagataagtatcgctgcatgtaggtcctcaaaaacagcttcttttctatctttcccatacccctaaagttttgtttcagtgtagcagggagaccttaatagactgaagaagaaaatagtaagaaatccactgagaggcagagtaaaatctgctgccccgtctccacctcccacaattgataaggcatcaaggtccagggatgcctcctccttttgtttctctgaccatcttcttcctttccactcccttggcactggcctaattcaggtccatggcatttgtgtcagaaactgtttattttgcaacgacttcctaagcagtctagtccttgattctctcaccatccaataaaacagtactcagcaccatctttctgagatacaaagccaaccgtgacatgttctcgacttccattgaggtcttcctttataggaaattccccacttcctataaagcccaaggtctttcatgagaatatgtggagccttacacatcctgacccccacccctcctgcctcttatatgaagactatctctcccaccctcccccgcaaacacagtcctcggccactttgtggtagacagaataagggcctcccaaagatgtccatatcctaatatttgaaacctgtaatatgttacctttcatggcaagagaattaaggttcagatggaattaaggttattaaccagataagcttgagatggggagattattctggattttccagctgagcacaatgtaatcacaagggtcctttaggtagacaagggggccaggagagtcagaatcacagttgaggagctatctgaggaggctatgctgcttactttgagatgaaagaaggagccatgaaccaaaaactgcaggtggccagaaaaaaactagaaaaggtgagaaaacaaactctaccctagagcctccagaaaagaatgcagccctgataccttgaatgtaccccagtgtgacccacttaggacttctgatgtccagattagaatgtgtggggtttcggccactaaatttgtggtaatttgttacagcagcaataggaaactaatacacacttcaaacatcctacgcatgtccctgctgctaggcttttgcccaggtgatacccttcctgaaatccacgccacccagctcagccatggtccttcattaaactacttaaatatcactttccctacatggctttcactaatgtccaggaaacaggcacttctgaattgttgttcctatacttcagagtgcatacttccattataggtattttaaacaggatctaatttaaaagtccataatgatgaaatttagctatctagtcataataaaagtgaaagtggcacaaagacatcaaaaggcacaatgcactttcaagtaagataatgtaggtgcaagagaagcagatagtgctaccagtattaccatgaaaactagtaatcatcaagccaattgcaaacataacaatagaccaatagccataccaataaacatatcattcaacattattcttattatctatgaaagcaatctaattatcaagtgtcaaaaaaaagaaatctgctgcttttctaatataccagaaaatggggaggtggtgttaattggaacttaatggatatataatacctatttaaaacaaaaaaaagatacatcctgaaacttcaaaggaattgaatattgtgaacattttgtcactttgcgtgaacaagtaataagcatttctgtaaccattcattcagaccggtaagttggggtttcagcatttcatatgcaaatttgttaaggcaatttttgaagaaacaactatctaataatccatgtagctgtggataatgtcgtttaaatatggtattaacccccagtgattggatttgaaggcgcactggtggagaggctctgctaaccggtgctggataccctaatgcaagcagagtcaggcagggagtttgtgtgcacgtgggtcttttcctcaaagaccaaatccctagccgcctgcattcttttacactttctgagaaaaaaaggaaggcagagaggaagagggagagacacaagacaaagaaggaatggagaaggggaagaagaaagaaaagaaggagaaaacaaaagagtaatgaaaactaagatgaagaaaggagggaaaaggggaagaggatggatggaagggaagaagggaggaaggggaacaagggaaagaggcagaaggagaagcaggagacatgaactgcaggcgagggaaggggtactgagcagggggagagaagaggcaaaagattatggagacaaagcagaataacatgtaaactacacgcaacccctacataagcttgcatccctcctgacctcccaaacaaaagcaaaagtgaaaataaagactttttacccagcatacttcttctggtccttccaatgatgatgtgatgaaaacagaccccgggacaatgttgcagggcatactgggacctgcgtctccctttattacttcataacttgccttccccaacaattcaattcaatctcccaggagcaaaactaaatgttattgtaggaaaaacaatggaacccaaaacacaacagaatgacaactcagcaacataaactgtaaaacataaggtcttgaccgatttgctctttgatgttggaaatagacaattcatttggcaaagtccagatgaaactgaaggtcagataatgctactctcccttcagactcttcacctcttcctatgcacccattttaaccacacactgccccgtaagcaagaattctgtctgtttcttcacgtgcaaaacaggtatatatacaggtagaggttttaaagttccttccagctacagaagtctgtttccaagactttacagcgactttacctgactagttagtggtaagtcaggagcccaggctggcttggattttctacctagactctctctgaagaaggggtgggaaggaaagatctttctccttgggtcttgttcccaaagaaatgcagtactttttgtgttctcatgagaatttatttatcttctcagtcactcctcttcttaacaataacaacagccaacacataccatcatgttttacttaagattcatttgtttaattcttatatcaaccctatgaggtagtgactactatcattcttcttttacagttgggaaaactgagaaacagagagcttaagtgactttttcaaggccacacagctggtagcagagccaggattcaaacctaggaagttataattctcatttagctgctaggctgcacaccacatgtgggcacgttgtgtttgatggcaaggagtgatcatcaactccctggagttagctggccttgcgctggggagctggttcatgcaggaagaggggtaaagaatggaaagaacgaacaaaaattaagtcagttgtcaagctgctgccatattaagagtaaagagaacaacagggctgctgggaacattgtcagaccccaaattgttcttgacattcattgggctgagtcccttgcttctgcagctctaaatggaaatgacatggaactaaaatatatatatttttaaatctccaaactcttcacacatccgttggcatgataatattttgattagttacatttatgctccaattacactcacagaatgttcaactgtgtcttatatatagcatgtttgccatgctccatagaaaatactggattattacctcgtatatttgcaatgggaaaagacacaaatggaaagggggagaaaagacagcaaaaagaagagatgactaatcctgttaaaatggtgccgtcttgccttcacattactaaattgggtcatcgctattattgccaagctttaaaatgccagggctgggagagacatcaagtatttaagtctacccttcccctcacctgaggcttttatctcccttaccacgactgggtctgaaagcaacctcctcacatacccagtgagtggcaaggtcgacagtggggaatgtttgtgtctttgtgctctttttttcttcctggggagagcatccatctatttctcaaagagctccataaccctgtccaagataaatatataaataaataataaacagaagctaagagttactctgagctttgcaaaatgcctgccctggggatactaggagtgacttattaccgtgtgtgctgcccagatgccatcacattattttgctcttcactagtagcccatgctgcaagcactgaaggtgcgtgtatcacaccatctaacgcggataccaggtggaaggggtcccatggaggtctgctaaagatcgcccccagttccacagcacccgcccctcaaatcctcaactactggagctggctttctcccctggcttctctctgccactgcatccctaactccactggtacctctatgcctcagtttccccaaggtggttccattcatgaaggctaacccctccaccagtctccttatgaaatccaccaaagccaagcatttcatcaagttaataaaatttgttctaaccacaagtattatttgtgcacctactatgtgtctgacactaggggaacagcagtcagcatggaagagtttttatcctcttagagattacagacttctaaagagccattacaggaatgtggaaagttctatgacaaggcaagaacccagacttgatttgggggaagaagtataaaaagaaaacacctacaactttctggagcaaataaactgtaggctgaggtctaagttatgtaggtgtcagacaggggaaaagggaacagaaagaatgttccatgcagatgaaatagcctgtttcaaagccaaggaacaagacagtttctgccttgtgggggggctaaaagaaattgcagacagaatgcaagtgccttagagaccacctctctaacctctcacccttcagtttatatataaggaacttgatattcagagaggtgccctgatttgcccagagtctcacagccaaagggtgatagagccagcattcaaattgaggtgtatctgactccaagatcagtatcatttccctctgaaacagcggttcccaaatcgcagtgtgcatcagaattacttggaaagcttgttaaactgtgccgggtcccatacccagtagatttggggtggagtccaagaatctgcacttctaacaagtttctaagtgatgctgatgggactgatctgtggaccacactttgataaccactggactagctggtctctaattccccagccctgatagggcaggggcccaaaaatttgggcgaatcaacaaatggtgctaccacaggggtgctaacttgttaaactacctcctaccctgggccacgccctgcctacctctctcaggggcaggaggtcttggccactggccattaaacatgaagactctccctctgcccaactccaacagcctgagccattttctttccatcactgctaattaccaagaatataattagacacttattgactcccccaaatgtactaaggtctgcaaagaaaatagcacaataattattcctcctattttaccatcctctaaggagctacaagactttgacagctgttatccaattaatcctgacagcttatttttttaacgtaaaggtatttttttcttctaagattggaaaagctatttccttttttgaagtaagaatgagggcaaagagaggccagataacttgtccaacattacaagggtcatttcttgcctcccttctcctgcatgatcagtggaacaatgaaagataagggcatggactgttgactcaaactgccagatcaaatcccagctctgtcagctctcagctgtgtggccttgggcaacatacttaacatctataagcctcagtttctccatctgaaaaatggaggtgatgatggcaaaagttgtacatgcttcctaggcttgttacgtgaattaaatgtgtctgtatgttacacgcttagaatagtacctgacatgttgagaattagctaccatgatcatcagtggcagaagcggcatttctgagccctcatgcagatcttcgactacaacagtgagataactgaccctggaattcagcagggtaaggcaggtcccagtctcactgtccacagaggcagcgggcctagaaggcaccaggaagccatggaacatctccatgctgttgacaacaaggaacatctctctttgccagtggttctccaagtgtggccctgagccagatacatcaacgtcatggggaacccctcaaaaagtaaatccttgggccccaagctagactgactagaccagaaactctgagtggggtcagtcatctgggtcccccaggggatgctgacacccactcaagtttgagaaccactttttttccccagacaggttgcctgagcctcagcctatcagggtagaccacaataacctggcgatcatgccagttcctgtccactggatgttccctgcttttcccaagaagggacaggacaggttaccagattccacagcactgtagcatgggtccagagcctgtgcttttttaattatttattatttatttattttttgagaaggagtctcgctctgttgcccaggatggagtacagtggcatgatctcggctcactgcaaccttcgcctccagggttcaaacaattctcctgcctaagcctcccaagtaactggaattacaggcatgtgccatcatacccagctaatttttgtatttttagtagagacagcatttcaccatgttggccaggttggtctagaactcctgacctcaggcaatctgcccgcctcagcctcccaaagtgctgggattacaggcgtgaaccaccgcgcctggcctagcctgtgttcttgaccactgccctacattgtctctcttgaaactgccttcccacatgcacttctggaaaggactccaatccctaccccagtgagggccagctgggagtgcggtccttattgctgaggcaccatagttgccctggtgtgccaggaggtaggaaatggacaccaggagataatgacgactcacagaaatgacacagaaggcatctcccagaccctctgagtccttgaagccactaggatatgtccatcaactgaggcctcttgaaatcaagcacctgaacccctagattttctacggttttcatcctgaacccactcttcccctttcatccctcactcctccacctgcccccatcctctcagctgcaaagctagtttcctatttcagtcttacctttctcccattccccatccctagccctcctcccctgtcccactttttgtaccaaaatgcactttggactatcccccttgaccacaatgcagaccccaaccatctcttgggttccccttcctcttgctgctgtccacctcatccagtcaagtggtctctgcactctagaccaccaaagatactgtctctgtcagttccaccaagccctgcagtagaacctagacccagatggaaagagaacaagacaaaatcaggaagtagaggcagctctagtgctgacaactgccagggaagcaatgagctgaatgggttccctgaagccgccataacaaagaccacaaagtgagtggctgaaacaacagaagttgatcgtctcacagtcctggaggctgaaagcctgagatcaaggtgtcagcagggttggttctttctgaggccagtgagggagaatctgttccatgccctcccctagcttctggtggtttgctggcgatctttggcattccttgggttgtagatgtacccctcctccttatctctgccttcagattcacatggtttatccctgtgtgcatctgtctccatttgttaaggaaaaaacaccagtcacatcgaattcagagcacaccctactccaatatggctttatcttagctaattacatctagaatgactacttccaaataaggtcacattttgagatactgggagtgaagacatcaacatatgaatttggtgggaacagaatttaactcctaataagctttctagagccctactgtgttcatcacccaaagagttatctaaggcagtcctaggagggtttctgtagagatgacggaatatcatatttagagggagcatgggaaaatattctttttaactataaaacaatacatggggaaacaaacagaaaagtagaaaggaggagtgacaagtcctcacggaaagacagccacacatgtcttgaggtatttccttacagtctcatttgctggcataggttagtgctttccaaggagttatggcatttacttgggtttgtgactgtggttagtaaatttttcctgaagaagaggcttaatgggggataacagtttatagtggccttgtctgcattgaagctatatccaaattccaatgggaaaggagcaagcaccccttcaacagggctgcctgttcactgatgttgcaggttagtttcacaacaaatgtatattgagtgcctgctccacaccaggcactgttgtaggccccgggagtacagctgtgaacaaaacagtgaagatacttcatcagagacagtttgcggagatgaaaatgctcctcaagagctttgaaacaagttgaatagggctcctgtagacgccccccagggaatgcatgccagtttttcatgccatgattaccccttttaaaattcttgatttttagctcatctttcgaggctctgaagtacctttgcaacgattatttccccaggaaggatctatgaatggtgtattttctgagcctgtgcatttctgatgctgcatcacttttatagtatagatcacgtgcccatatgcaatttattgagtctcgacctattcccttctaaatactgtggaccggtgcttctcatcttttgccaaaagaacaaggatagcatgtttgtccctcatctgtcaaatcctctttttgaatatacacttggaaggcaggtagataggtatatctcacaccctaattcctaatatagggaagatttttttttttttttttaatcttacagccttgttcttaggagcacagcacagcaatgaagatgcaggctctggagccacacccctgcagtcaaaacccagccctctcatttcctaaagtgcatccctgggcaaattacatagatttttctctgtctttgtttcccaatctgtaaaatggagataataaaaagacaaacctggccaggtgcggtagctcacccctgtaatcccagcactttgggagtccaaggcaggtggatcatgaggtcaggagatcaagactatcctggccaacgtggtgaaaccccatctctactaaaaatataaaaattagctgtgcatggtggcgcacgattgtaatctcagctgcctgggaggctgaggcaggagaatcacttgaacccaggaggcggaggttgcagtgagccaagattgagccactgtactccagcctggcgacagagcaagactctgtctcaaaaaaaaaaaaaaaaaaaacccaaaccttacaggatcctcagttaagcttgaggattaactgaattaatacaggtaatagtagaaaggctgacaaactttttccataaagggccagagagtcaatattttaggcttagcaggccgaaaagtttttgttaacaactactcaattctactgttggggtgtgacaactgcagagacaatggataaatggatggatggatgaggctgtgttccaacaaagctttacaaaaacaggcagctgaggggtccatgcataggctgtagtttgctgacctctgacttagtaccaggcaaatactaaattctcaatcaatgttagccattattattaactatgatgagattcagaaggacaggggttggatcctctctgtcactcactgcctggttctctgacactatgaacagatggtgtacatgaaaaaccaccatccacagaagtattccttccagcccacctatagcactgcacttgtgaaaacgacaccttccaagatgcaatgcgctgccacaatgtctctgataatttttgccctgttgtatttgtgagtttcagccttgagcaggatgtgaaaagaaaggtgggaggaaaacaatagaacattaagtgcttcagaaagtcctcttcatgctgtaaagggatgtctgtcccatttagattggtacagacctttatcttctactagagggacagagaaggatggatgcacatcttccttttgttagtggcacggcataggtggctgagctctgtttttccgaccattcctattagccttggagttgagggaaaactctcccagattctgtcaaaagttcacctgtctcactttccagtgttgctatgatctgatgcttttgtgctgttctcatgggaatttttaagggaaactgcaagaggttgggattcccaaagtctcttaaggttatttccaccatggactctgtgtatggtggaaagagttcccgagccctgtgctctctgtggcactgtctcatttcaaacacataaatccaatgctttatctacttcttgggattttctggttattttttttaccacctacaccaagggttaagccatgccccacttttcccttgtcctgaccaaaattgatatactacgacccagggccaaaagcatagacaacaggtgtgggcgaaaattctctacttgtatagaaattatttgaagaaattcctgcttaatcgggcttcaatctcttccactcccttatatccattcatttgttcactcattcattcattcttttactaattatgtgcccgctaaacattcactgagcaagctttatgtacttggtaccaagcatgcagagacacagaataaatattttattcttgaagacatcttgctctaaatgggtatggtgcatctggtgatgccctgcccaggtctctctttaaagaaacttgtctccccagctgccagggcacttaggcacacagtctttagcagtagcccctccagggactgtgtcagctgcagagtgtactcccaaggtctgcctttctgagagctgcacatccagcaactgatggaggctagggttgaaagcctcagccagtcctgcccgttgcagactcggacgggccattttagctccccgtggagttggctaatgatgtcctgaggtctgcgtcaactcacttcctcccgcagcctgctgctcatcccttccttcccttccatagctgctagtccagggggcaatttccaataaacatcctaataaacactcatctccatctctgattctgaatcccagagaatccaacagtgacaatgggtctggggaagcaagttgctctgtctgggcatttttgaggggacatttgcgttggttctttaaaaacacacaggaatattccaggtagagaaggaacgatcatttcaggcagagggaacaggacgagaaagtccaggactatgacagcacagaggcatttggtgtcctggcctgactggtgagaggggatgtggaggcccaggaagaggaccaaagcaagtccttgatagtcaagctaaggagctgaccatgcaccaggagcccatgggtgtttatcagaagaaatgggacgtaataaaatattcatttcaccgagatgagttgtctttgtcaaggttccctctaaaaaacaggagctaatctggatgcgtcaagtagatagttttcatacaaagactcagacctttatccactactgggaggctggggaatgtcagtggggaaggtagtcctcaggaaatccctaagtataaggaccacaggaaaagtcgagtctgtagttttggctacttgggtgactgttgggtagatgctcaacaaacatgggcacacctcaaagtctgctgactgcccgcacccctgcaggggctctcagctgccggagggaggctcactgttctctggttctttgacctttcagatctctcatcagtgggatctcactgggaccctgcaggtgaaggaatctgggaaacgtggcttctgggcttcatgaccctttggtataggagagcacttagggagctgtgcatcaacaagcaatatgtgacttgggtcacagaggatgtggctgcagcaaggagattagttagggggttgaatcaaaagcccaagcacgagatgttggtgccatcatcacgtcactgcccaattctccttcctctccaaggcctccaaacctgctctgaggcttggcagggaaagtgagccagactgaggacaggagaaagggctgccggaaacaaacgcaagggacacacagccctgtcccgccaggtgtgactccaggtgccaggtgtgactcctgccaggtgtggctcccggatcaggatggctgctcttcactcactggcatttgggtgagaagggcactgagatggagcagggataaccaatccagaagacagaaaccctggcttggagccctttccagccatttcctaattggatgtatgacttttctagggctgccggaacaaattaccacaaacttggcggtttaggataacagagattcattctctcacagttctggaggccagaagtctgaaatcaaggtgggtcggcagggccgtgggggaagtctctaggggataattcctctttgcctcttgcagcccgtggtggtgtctggtgctccctgaggtcgtctctgcctctgttttcacatggtcttctcctcatgcctcgcatttcaaatctccctctgctttgctctcacttttgcagctatcattggatttaggatccaccctaaatccaggataacctcctcttgagatccttaactcaactgcatctgcaaagatcttttttctacataaggtcacagtcacaagttccaggaattacaccttgcacaatgctggggggccgtgattcaaccccactacaactacactgggtgactctgtaaatgtcacttaccctcatgcttagacttaaatttgtactaataaaatagagtaggggccgggcgcggtggctcaggcctgtaatcctagcactttgggaggccgaagtgggtggattgcctgagctctggagttcaaaaccagcctgggcaacacagtgaaaccccatcgctactaaaatacaaaaaaattaactgggcgtggcagcgtgcacctgtagtcccagctactctggaggctgaggcagaagaatcgcttgaacccaggaggcagaggttgcagtgagcagagatcatgccactgcactccacactccagtctggctgacagagtgaggctccatcaaccaaaaaataaaataaaataaaataagagagtgcgaggagaagatgacctacctggatgttggggtgattacataagacagaacaagtcaaagccccggcccacttatacacacaagggaagcctgaattaaatatctattgaatctgaatcagctctcaccccacggctatgggactggtctggtcaggacctggagactcctagttcatgcagcgtaacacaaagctcagtttgcatttaggattgcactagattgccttaaaagcagtacgcagttctgaagcttaccattgtataaaataatacctggtgtctatagtccttcatctgttcaagtacaggttggatggaaggatttccagattcctgtggatttaggattcctacaatactgtgggcatcagattcactgcaagtaactttcccagcaactgaaacactgttcccacccaaaaggggaaaatcagatcacttccacatggtggaaaaactagattacttccaccatagaagtctttcgacgctgcctctcccctttgcccgtccaacccgccccaggtcttaattcctgtccttctatttaggtttaaatcattgcacaatcactttctgactatataacttagaacaagcccctttgtacttcatttgttttccttttatgctctttaaattttaataaattaaaagtggcagaaaattgagaaagctacaaagaataaaattataaatacccataactctgccatctagcttcaaccactgtgaacatcttaacatatttgctttccctttttatttttaaagaagaaagattactttattgttattgggaaatgatacatattcattttgaggaattcaagaaatgcaaaatacaaagattgaagtttaaaaaaaatcttaagtttcactacccagaaataactgtcattaacatatggcaaacatcattttaaatatcttatgatatacacagagacaaaaggacagacggatggatggatgaggatgggcggatggacggaagaataggtggaaataaatactatgaaatgtgggataaaatatatgtcactttaagtttttttttaacactgtatttgtctttacttgtatgtagcagaagaaaaagaaattaaaacaaaattgaaagaaaactagcctttcaaatacttctttaccaagagatacttacccaaagatctctttaagaacacagattgtgaagaaagcattaagagcttgaagtaattatactatattttaactatttattttgatgttaagcttatctaatgactccatgctgtcaaatatggtattagaactatcacacttcccctcaacttctcctccctctctcaatttctcagttttaattgttggtggccgctgttgttacactgcccaggttttaaccttcataccctgatctataactgtaattgtctaagttgcttactgtgagtcctatatttatatggtttcattacttatcatcaatccttatgttatgaggtctgcattcatgaatcttttatttttgtttgcttttaattagttgtattttgtaattaagtatttttgtcaagatcttatggatattacactgcctgagtacatttactcttgacaaccatgacttgtgagctttatattctattatattcttgaactatgctttctttccctcaaatcttttagataaccattctttcatctttgacattgaatcctgctgtagagaagtctgaggacaacttgactttttttttctccttgtggaggatattcttgtgtctagaatactgggtaattctgtatttatcctaagttttaatagtttaactagggtatgtcttggtatctagcattctgtaccaaattttcctggaatacattgtctctttattattattttactacaatatgtaacataaaatttagcattttaattattttaagtgtacaattcggcagcattaattactctcacaatattttggaaccatcaccattatttatttctaaaactttttcatcaccccaaagagaaattttgtaaccattaagtaataactcttcattctctcctgccccagtctggtaacctctaatctactttctatctctatgaatttgcgtactctagatattacttataaatggaatcctgtagtccaaaaatgaacagtaacaatttttgggaggatatggagcaactggaatccttatacactgctggtgagtaggtaaaatggttcagctgcttgtaacacattctcttttgatttgcacattcagttatttattcgcttcaggattttttttttatccagaggcaaaatagcatcattctactcttttgaatcccaattctgttatatatactagacatgttgccttgggcaagttacgtaactatatcttaatttcctcatctataaattgggaatactaattgtattaacctcaaattgttgtgaaaaattaattcatgtaaacctctaaataaatgtttcatgcataatcaacgccaaaataatttgttattgttgttatactaagctatattttgttatatttgaataaataaaaggttatatgtttatacctttagagtatatatctttatgtctgtatctattgtagaataaattgctttctcctttagctttctttatgttcatattcagttgactactttcaccactctatttcatctgtattcatgtgcttgttaagacttccctctacactgttttttccagcaatgtatattctattttgtttttgtattgtttcactttttgctgtcattatttatgggctctttaatcctattaatgctattttgggcctcaatttgtttccttttgtccctattaatctcatgctgtccatttattccattatcctgaaccctcgctttattgacctggtgttcatatcaaattgttctatagaatgaagcaattgtgaataatttacctctgtttctgaaatgttatttttttaggttagaatccttgcccttgtatattacagccccctgcttgcttgcatcccttccttcctttttcttccttccttccttgccccctcccttcctctcttcctccctccctcttttccttctttccttccttgtttcttttctcttcctccctttatttttttcaaaattagtatttgtggtatgctttaatgttgccatgacatttcttaccttcttgttctgcctaggtgactccactcgggtggctccatcctgacatgccatttgctatgatatatagcatatgtgacacctgactttcttcctaccatatcagggaagtttgttttccccttgaagtttgaagattgagtattctttattctgtctgatttctgagcctaatgaaacagtgagaaggaaggagagagctcatctaaggtgatatttggtcattcttagattactgggcatctgtttcttctttttagattttgtgaatatcccatactcagattcactacatctacttgcaggtatttacttttctgatgagaaggtagtccctattttcatttatcttactcaatttagaagacagtcctgaagattttgctaccattagagaaagttaacctcctccataacccccttcctttgctttgtttatacccccatcccggccccaagccattttttcttattacttaatcatatgagagaaaggataatgatacccagtaaacttgattttctctagatgtttggtattgaggaatccccaaactatgttactaatatgctttttggtgggtggggaaaaagatttagaagcctagctatacctctccacatcactctgtgtctcctgtttctttccatacttaccagtgtttaaaacttgcatttgatagttttctttcccttgttttggtgttgtggtgaattttatttatttttcttttcttgtattcttgtttgctcaatctattacgtatttgtcaagaggaattctgtaattcagtttctgtcagtgatcttaacgcaaatatctgagtcacactttccataagtaagttgggataataattataatactgaactcatgaatttttttagaagtactaagttagataatatatgtaaattgctttgcaagctctcaaattttatatgaagaatatgttttcaataaatgtagttatgaatgaatgagctgttattactctgcagtaatgaacttagttatctaatttataggattataaaatgttagcacttaaatcagtcctaggaatcacgtagcacattccatttattttataaaggaagcaaatgtcatgactgccatctttagtgccatgtttcatcaggaggtgggtgacacaagaattctgtggttataattgatggcaagcatgtcattcataagaattctccttgcaaataaacttcatgtgttagaagaaatatttttattcacttctcagaaggaaggttttttcaatcagaaggcccctattttgctgaacaccaacattagtttaaacacgcaagcttgtgggaagaacccagaagcaaaacctaattgccttccataacagaggggaaaaaagtacaacagaagagagaaaagagatagaacaagctagaccaaatgctgagtaagaaaaatgaagagttaagtaaaagcaatgggggtacaggtgagaatgaacattgaaaaaaagatggtctgatattaattttcagttgtttcctctgaaaggtatactttctccatctcacacaaggaatatttattaaagtttatactattcactgatgtttttgtagtaggtttttgaaaggcttagtcctgaattcatttagatcttagtaaagaccaagcagacatagcacgttcatttgcagaagctaaagagtatgggatctactgaattatttatgttggtcaattgtgtcctcttatgttcaaacacagcactggggtaggggggatagagtgtggtagagggctgagctgaaggagcttagcgtttgtcagatgactgactgaagagatgagtttaaagctaaagggattgccaacaccaaggatggaggcaaagctcaaaccatggtgaaaatcagaggttctgatacatggcaaaggaaaccagtagcaaagtaagtttacaacatttgcttcagcacaacaaggaaacattttttctgccaggtcaaacttagaagttgtcatctgcttcctaacgcaccttaggaggttcatccaagcctgatattaagataaaattaaaaaggtacaaaaataaatattttcagtcaaaaaaagcaaaatgatcactgatatttgtcttctagggcctctctgaaatgatcataagtggatttttaaaagtgtttaggctcacaaaaacaatcagggcaagagagaggctgagttgacagggcttctcatcaaccactttggatcctggggagaaatgtcaccataacttcaaatttttaagagtgatctttagtcaaaaattgtatacccagcaaaactatcaaataaattagacccagacattttgagccacacaagactacttactctttcttgggaaattatatgagaatgtagtcctgtttgaacagaaaactttttttttctctttttttcatttcattttaatatcagggttatgaacatctacaaaaatgagtctggaggaaactttcaggctgggagctggcacacacacaaaagtcttctttcttgggctgaagccagtaatactaactgtgaaaagccacctcatctcagacgacagccatgattaatattcagtgaagattggaacagtaggacaggtggctctggaagtgagtaagatctctcatgaaataagagaagttgatagctcagatgctatgataaaagtaagtagtggggtgtaagtaaaagagagaatcccttcaaccttaaaggtaggagcattctcctttgagaggtagagaagatatgctcgagtccagcagaaaaggaaatataatcctagcacacggtttggttttgcaatgaaacaatttacacagtaagaataatggaagagctatgtatccactttcaacttttagaatcattaaactgactgatatggtttggctctgtatccccacccaaatctcatcttgaattgcaatccctacatgtagaaggagggacctgtaatccccacatgtcgaggaagggaggtgactggatcagagggaggtttcccccatgctgttctcatgatagtgagtgaattctcatgagatgtgatggttttaaaagtggcagttttttcttgcacagtcacactccctcatgctgccctggtaagaaggtgcctgcttccccctcgccttctgccatgattgtaagtttcctgaggcctccaagccatgcttcctgttaagcctgtggaacttgagtcaattaaacctctttcctttgtaactacctagcctcagggaagttctttacagcagtgtgaaaatgagctaatacactaaccaatcatgaaaggcaagaatcgttatggagaaaagcctaaaaattaccaaccttggccatgaaagcgtaaaaacaaggatgacaatgtcaaagacagaggtgattgggagaaggggagatcaacaatgtcttcctcaccttacccagaagaccctgatggttcctagaacaagaagcagaggctgaagtaaactatagcatctgaatttgcaaagattaccagtggtagacataaaaagtaaacatttactataacagaagctagaaagtgatttaaaagggcaattcctcatttttcttagcagaaagccagtagacaacatattaagttaataagtcaagaaaagcactttaagtaaactacttacacatgtagaaataaccaccaaagaagcaaaaatagaaatggatgacctgtgagggcgggatctgaaaggcagagaagccaaacagcatatggtggtttttaaacatgaacccttctgagttatttgacatcttaatcatgtttggttttttttttttttttggtttaacagatctttgaaaatgaaattaaacataaaactatagaacaatctcacctatcaatgtgtacacaataatactccctgaattaaattaaattgtgatatgaaaaagaaatatatgtatattcagggacagtatgcttattctaggaaaggaaagactgtttgaaaatataaaatgccttttgttatgatttcagcaggatgaggtgagaaaaacaatctctaatccattgttgcggaagaggcttttggtaaaatcttttcaatatttttggctttaagaaagtcagtattttatgctggagccagggaggctggagggcttgatcccaagatttgtccccacagcccaacacactggctgtggcagtctgaggccagcgtgcctcttcaggcctaaccctgacctatccttcctcattgggcagggcttccctgcagaaactccaataactccagctagaggctcaaggacagaattcggatccccctggacctgagccccggcgggaggggcagccacagtttctagggaccagcagacttagtctctcttcctggtagctctgaggaatccaggcagcccagacaagtaggtttccccccagcaaagcacaccctctccaccaagtgacaaagtgtttcattaaatgggtcctgatccccgtgccacccaactgggtgagcccctccaacaggggttgtcagataccctatacaggagcaaccctactggcatcagtctggtgcccctcgaggtcagaggccccagaagaacgagcaggcacccatctttgctgctccccagcctccttgagtgacatctccaggcacaggagcaaatcagatgactaggtcctaaagtgaacccccagcaaactgcagaagccctaatgaagagggacctgactattgaaataaaaataaagaagcagaaagtgacaacaacagcatcaacaacaacaacaacaaaaagacccaaaaaaaaaacccattcaagggtcagcagcctcaaaaacgaaaactaaacaaactcacgaatatgagaaagaatcaacaaaaaaatgctgaaaacacaaaaggccagagtgcctttcctcctccaaacgactgcaacgtcgttccatcacaagcataaaactggatggaggatcagacagatgaattgacagaagtaggcctcagaagatgggtaatgaaaaactaagttctaacccaatgcaaataagctaagaaccttgataaaaggttacaggaattgctaactagaataaccagtttagagaggaacataaattacctgatggagctgaggaacataaattacctgatggagctgaaaaacacagcacgagaactttgtgaagcatacacaagcatcaacagccaaactgaccacgcggaagaaaggatatcagagtttgaagatcaccttactaaaataagatatgcagacaagaatagaggagaaaagaaggaaaaggaatgaacaaagcctccaagaaatacagggcttcataaaaagactgaacctacaattgactgaagtagcagaaagagatggggagagtggaaacaagctggaaaacacacttcaggatattatccaggagaactgccccaacctagcaaggcaggccaacatacaaattcaggaaatgcaaagaaaccattaagatactctccaacaagatcaactccaagacacacagtcatcagattctccaaggtcaaaatgaaggaaaaactattaagggcagacagagagaaaggccaggtcacctacaaagggaagcccatcagactaacagtggacctctgggcagaaactccagaggccagaagagattgggggccaatattcaatattcttaaagaaaagaattttcaactcagaatttcatatgcagccaaactaatcgtgataagtaaaggagatataaaatccttcccagacaagcaaatgctgagggattttgttaccaccaggcctgccatccaagagatcctgaaagaagcactgaatgtggaatggaaaaacaggtactagccactgcaaaaacatactaaaatataaagaccaatgaaactatggaggaactgcatcaactagtgtgcaaaataaccaaatagcatcatgatgacaggatcaaattcacatataacaatactaaccttaaatgtaaatgagctgaatgccccaattaaaagacacagactggcaaaatggataaggagtcaagaggcattggtgtgctgtattcaggagacccaacttacatgcaaagacatacatgggctcaaaataatgagacggaggaaaatctaggcaaatggaaagcaaaataaaaataaaaataaaaaaaaataaaaaagcaggggttgcaatcctaatctctgataaaaaagactttaaacaaagatcaaaaaagacaaagaaaggcattacataatggtaaagggaacaattcaacaagaagagctaactattctaaatatatatgcacccaatacaggagcacccagattcataagacaatcttagagacctacaaagagactcagattcccacacaataatattgggagactttaatacctcactctcaatattagacagatcaatgagacagaaaattaacaaggatattcaggagttgaactcagctctggatcaagtggacctagtagacgtctatagaattctctacaccaaaatcaacagaatatgcattcttctcagtgccacatggcacttatgctaaatcaaccaaataattggaagtaaaacactccctaggaaatgcaaaagaactaaaatgataacaaacagtctctcagaccacagggcaatcaaattagaactcaggattaagaaactcactgaaaaccacacaattacatggaaattgaacaacctgctcctgaatgactcctgggtaaataatgaaattaaggcagaaatcaagaagttctttgaaaccaatgagaacaaggagacagcatgccagaatctctgggacacagctaaagcagtgttaagagggaaatttatagcactaaatgcccacatcagaatgctaggaagatatcaaattgatatcctaacatcacaattaaaatacctagagaggcaagagcaaactaatccaaaagctagcagaagacaacaaataactaagatcagagaagaattgaaggagatagagacataaaaaaatctccaaataatcaacaatgcagaagatggtttttcgaaaaaattaacaaaatatatcactagttagactaataaagaagaggagaaagaagaatcaaataaacacaataaaaaatgataaaggggatattaccactgatcccacagaaatacaaactgccatcagagaatactataaaaacctcacgtaaataaactagaaaatctagaagaaattgataaattcctggacgcatacactcaaccaagactaaaccaggaaaaagtcaaaaccctgaatggaccaataacaagttctgaaattgaggcagtaattaatgggctaccaaccaaaaaaggctcaggagtagacagattcacagctgaactctacctgaaatgcaaacaggagctggtaccattccttctgaaactattccaaacaattgaaaaggagggactcctccctaactcattttatgaagccaacatcatcctgataccaaaaccaggaagacacaacaaaaaaggaaaacttcaggccaatatccctgataaacatcaatgtgaaaatcctcagtaaaatactgacaaaccaaatccagcagcacatcaaaaaacatatccaccatgatcaagttggcttcatccctgagatgcaaggctggttcaacatacacaaatcaataaatgtaatccatcacataaacagaaccaaagacaaaaaccacatgattatctcaataggtacagaaaaggcctttgataaaattcaacatcccttcttgttaaaaactctcaataaccttggtagtgatggaacatatctcaaaatgataagagctatttatgacaaacccacagccaatatcttattgaacgggcaaaagctggaagcattccctttgaaaactggtacagacaaggatgcctcctctcaccactcctattcaacacagtattggaagttctggccagggttaccaggcaagaggaagaaataaagggtattaaaataggaagacaggaagtcaagttgtctctgtttgcagacaacatgattttatgtatagaaaaccccaccatctcagccacaaaactccttgaactgataagcaacttcagcaaagtctcgggatacaaaagcaatgtgcaaatatcacaagcattcctttacactgacaataggcaagcagagagccaaatcatgaatgaactcccattcacaattgctacaaagataataaaacacctaggaatacagctaacaagggatgtgaaagatctcttcaaggagaactacaaaccacttctcaatgaaataagaggacacaaacaaatggaaaaacattccatcctcatggataggaagaatcaatactgtgaaaatggccataatgcccaaagtaatttacagattcaacactgctcccatcaaactaccattgacattactcacagaattagaaaaaatagttttaaatttcatatggaatcaaagaagaccccaagacaatcctaagcaaacaaaacaaagctggaggcatcaaactacttgactttaaactatactacaaggatacagcaaccaaaacagcatggtacctgtaccaaaacagatatacagaccaatggaacagaatagagacctcagaaataacaccacacatctacaaccatctgatcttcaacaaacctgacaaaaacaagcaatggggaaaggacatcctattaagtaaatggtgctgggataactgcctagccaaatgcaaaaacagaaagtggaccacttccttataccttatagaaaaattatctcaagatagattaaagacttaaatgtaaaacccaaaaccataaaaatctcagaagaaaacctaggcaataccattcaggacataggcatgggcaaagacttcatgacaaaaatgccaaaagcaattgcaacaaaggccaaaattgaccaatgagatctaactaaactaaagagctcctgcacagcaaaagaaactagcatcagagtgaacaggcaacctacagaatgggagaaaatttttgcaatctacccatctgacaaaaatctaatatccacaagttacaaggaacttaaacatatttacaagaaaaaaacaacccatcaaaaagtggcaaaggatatgaacagacacttctcaaacgaagacatttacgcagccaacaaacatgaaaaaaagctcaacatcactgatcatcaaagaaatgcaaatcaaaaccataatgagataccatctcatgccagtcagaatggtgattattaaaaagtcagaaaacaatagatgctagtgagactgtggagaaatgtaaatgattttacactgttggtaggaatgtaacaaccattgttgaaaacagtatggcaattcctcaaggatctagagccagaaataccatttgacccagcaatcccattactgggtatatacccagaggaacgcaaatcattctactataaagacacatgcacatgtatgtttagtgcagcactatttacaatagcaaagacatggagccaacccaaatccccatcaatgatagaccggataaagaaaatgtggtaaatatataccatggaatactatgcagccataaaaaggaatgagatcatgtgctttgcagggacatggatgaagctggaagccagcatcctcagcaaactaacagaggaacagaaaaccaaacaccgcatgttctcacttataagtgggagttgaacactgagaatacatggacacacagaggggaataacacacaccagggcctgttgaggggtggcagggtgaggggagggaacttagaggatgggtcaataggcacagcaaaccaccatggcacacatatactcatgtaacaaacctgcatattgtgcacatgtatcccatttcttcctttttttagaataaacaaaatgtaaaaatgaaattaaaaaaaaagtttattactcacatcctcctcaaaaaaagtcagtattttagatgtagaagaatactctattagaataacagcgcccatctgaagccaaagacaacatcatatataagagtcaaacactgaagccacttctattaaattcaggaatgaaacaaggttatacttacattattcaatattgatttgcaaactctaagcaataaaattaaaagggaagaaagagaaggaagaagttagaaagaaagaaattttttataataatagaaaagcaagagataaaattaccattattttcctgatgatatgattgaatacctaaaaaaaacacaagcatcaactcaaaaacttgcagtactgattaaaaaaaaaagttcagtaagatgagtggttaaaaaacaaatagataaaacacaacagctttcttatatagcatcaataaccacttggaagctctgacaagaaataaattaaatcccatggtagcaaataactaggaatcaacttaaacagagatatgagaggtccagatgaagaaacccacaaaactttactgagggaaataaaagaatccttgaaaatgtgaagatacaggtaacgattctgagtctgaagactcaataaagtcaagatggaaattatcacaaaaataatttgagcaatattttcaattcgaataaaacccaagaggagttttctggaacttggcaaaataattctaaagatcatttgaaaggagacacaaagagtctctctctcttttgttttgttttgttttttttcataaagtgtaactagaagagaatgtcctattaagaattaaatacctagtaaagccacaataattaaaagagtgttgtactgacataaaaacagacaggctaatgacaagaagaagaaagaacatcaatagaccatatatgagaatgcatttgatgagaacagccccacttttaatgaggggagaaaggctaaactattaattcatggttctggaatactgattaactatagtatttgaaaaaacaatggacttagattctattcacatggtgaatgaaaaattaattaactagctaattaattaattcataactataaagagttgaacatgaagaagaataaaaaatcaaatcattaaaatctagaaaaatacaagagaatatttatctcatttgggaatagggaaataacttttgaagttcaaaagcaaaagaagatataaagttttctataatggacaacataaaaattaaaactattcatcagagacatcaaaaattctgaaagcaaataaaaactgaaaaaatgtaagtaccaggtaaagaataatatcctttctccataaaaaagcttataatatacatatatggaaaatataaaaatgtttatgaacagataattcacagaggacaaaacataaaatatatttggctatataataaggaaaaaccaggtcaataggatgcagtgtcatttcttatcaaataagctaagattttgaaacagtgataattcctaatattagcaaatagtaaatgagtaattacctgatgcttggactaccagttgtctcaatgattttctgaggagcaatttgataatacgtatcacattatcaagttgtgaatcatataacacaatatgaatcacatatcacattaaaatgcccacaccaccaattgaataatcccaatctagaagacataatgagaaatcataacaaatatttaggtgaaaaatctcacgacagtattactgtactgaaagactgaaagcaatttcaacacccaagtgtaaggacgtaattaaataagtaataatacggcaatatgatataatttaattgatgtaaaagtccaagcattcaagaatatttaatgacataaaaatgttaatgatagaattctaaatgagaaaaaaaagccatgtaacaggacttatagcttgcacctaattttgtaaaatatatatatacatttagcaaacgtatgagcatatgcatacacatgtgtgtatataaatagtaatctacatatagaaaaacgacttgagaagagttcaactttcaattaaacatcacaaagtaaacacatgcattaacctccattttcttccaaatgcaccaaaatgacagtgtaggaattaaaaagacataaacaaacccatatataccaagagaatggggaaaaaagtgacagcaattgagagatgcaaacattttggaggaagaaaaatggttggacaaatggtaactgattaagcagagcagtgaaaactgaagcccgtatgtccatcaggtaagaaagcagaatacaaccaatttaacccatggagtaccaaaaggacccagaaatggggcaaccagattattctaacggcaggaacacctagggctgaaaacaaaattacctgaaaatctgtataagaaatgttaagacaaccacccacaaaaccccctttgacatctgccatgcgaccagatgccagtcccttctcaatacctacataagactgaaaatgtagttactacaacatatcaagcagagaggatatagcttcaaggattctgtggccagctgagagggggtaagtcaccaggcaaaaccacgggtgatccactgaaaccaacatactgagtgaagacagcatcccccaattagctctgagtacccacagccaggttacacatacttcccatgccttcatgagtgcagaaggcttatctttggaaaaatttaccagatggagaggaaaaggccttagccgtgaacattccaatgttcatccataaaaatccagtttactgtcttatttccatatagtcaaacctgtcagtgaacaaagcccctcccatgcaatacatagactcaaaattttagtgccaatctcttaaatatgaatggatagccaatgatgatgactatttgagttaaatctctaacatgaacagaagagaccaaaacaaacagggaggggaaaagtgcaggtagaaaacaaaagataagtgcttctcagccttttggctaagatcaaatgtagtatctcttcttatcagtttcatatgcagagcagtgacacgataaagcaaccacacaaacaagctggcatgataaccaactaacaacaaaatggcaagatcaaattcacacatatcagtattaactttgaatgtaaatgggctaaatgttccacttaaaaggcacagggtagcaagctggataaaaaagcaagaccaaatggtatgcaatcttcaagagacccatctcacatgcaatgaatggcacacaaaagctcaaaataaagggatgaggaaaatctaccaagcaaatagaaattagaaaaagcaggggttgcaaccctcatttcagacaacacagactttatccagccaaagatcaaaaaagacaaggaaggccattacataattgtaaaggattcaattcaaaaagaagacctaacctaaccctaaatatatacacacccaacacaggagcacctagattcatgaactaagttcttagagacctacaaggagatttcaagttccacacaataatagtgggagactccccactgagagtatcagacagatcattgaggtagaaaattaacaaaattatctaggactttaactcaacattggaccagatggatctgatagacctctacagaactctctaccccaaaacaacagaatatacattcttctcatcaccacatggcacatactttaaaagtgaacacaatatgacataaaacaatcctcagaaaatgcaaaagaaccacaatcattccaaacacactcttagatcacagtgcaataaaaatagaagtcaacactaaaaacattgctcaaaaccatgcaattttatgaaaattaaacaatatgcccctgaataagttttggataaaaaaaagaaattaaggcagacatcaagaagttgtttgaaactaatgagaacaaagatacaacataccagaatctctgggatacagctaaggcagtgttaagagggaaatctatagcactataaatgcccttatgtggtttggctgtgtccccacccaaatctcattgtgaattgtagttctcataatccccacatgtcatgggagggacctggtgggaggtaattaaatcatggtggtggttacctatatgctgccattctcataatagtgtgtgagttctcaagagatctgatggttttaaaggagatggccccctttttcttggcacttctccttaatgtcaccatttgaaaaaggacatgtttgcttccccttccgccattattataagtttcctgaggcatccccagccatgctgaacggtgagtcaactaaacatctttgctttataaattacccagtctcttgtatgtccttatcagcagtgtgagaatggactaatacagtaatttgataccagtagagtagggtgctgctataaggatgtccaaaaatgtggaagctactttggaactgggtaacaggcagagattggaacagtttggaggatttagaagatgacaggaaaatctgggaaagtgcagaatatcctagagacttgttgaattactttgaccagaatgctgatagtcatgtgaacaatgaagtccaggttgagatggtctcagatggagatgaggaacttgttgggaagtggagcaaacgtgacttttgttatgctttagcaaagagactggtggcattttgcccctgccctagagatgtatggaactttgaaactgagagagataatttagggtatccggtagaaaaaatttctaagtggcaaagcattcaagaggaagcagaaaataaaaatttctaaaatttgcagctgacaatgcaatagaaaagaaaaacccattttctggggagaaatccaagcctgctgcagaaatttgcattagtaatgaggagccgaatgttaatcaccaagacaagggggaaaatgtctccagggcacgtgaaagaccttcacagtagcccctcccccagaggactaggaaaaaaaatggctttgtgggccaggcccagggacccctgctgtgggcagcctaggaacttcgtgtcctgaatcccagccactccagtcatggctaaaatgggccaaggtacagctcaggctatggcttaagagggtgcaagtcctgtgccctagcagcttccatgtggtgttgagcctgagggtgcacataagttaagaattgaggcttggaaacctccacctagatttcaaaggatatatggaaacacctggatgtccaggtagaagtttgctgcagtagtggagccctcatagagaacctctgctaggacagtgcagaagggaaatgtggggttagagtctccatacagaatctccactggggcactacctagtggagctgtgagaagagggccacagtcctccagaccccagaatgttagatccactgacagcttgcaccatgtgcctggaaaaatcacaggcactccacacaagcccatgaaagcatccagaaggggggctataccatgcaaagccatagggaccaagctgcccaaggccatgggcacccatctcttccatcagcatgacctgtatgtgagacacggagtcaaagtagattattttggagctttaagatttaattactgcctgattctagatttgcatggggcctgtagcccctttgttttggccaacatctcccatttggaatgggtgtatttacccaatgcccgtacctccactgtatctgggaagtaactaatttacttttgattttacaggctcataggtggaagggactcacctcatctcagacaaaactctggacttggactattgagttaatgctggaatgagataagactttgggggactgttagaaggccatgattggccaggcgcagtggctcacaccagcaatcccagcactttgagaggccaaggtgggtggatcacctgaggtcaggagttcaaaaccagcctgaccaacatggtgaaaccccatctctactaaaaatacaaaattagctggttgtgggtggcacatgcctgtaatcagagctgaactgaaggaaatggaggcatgaaaaacattcaaaagatcaatgaatccaggagttggttttttgaaaaagttaataaaatagactaataaataaacaagaagagagagtagatccaaataaatccaattagaaatgacagaggggatattaccattgactccacagaaataaaaattatccttagaaactaccatgaacacctctatgcccacaaactagaaaacctagaagagctgaacacatttgtggacatatacaccttccaaagactgaaccaggaagaagtttattcccgaacagaccaataatgagctctgaaattgaattggtaataaatagtctaccaatcaaaacaagcccaggaccagaaggattcacagctgaatactaccagatgtacaatgaagatctggtacccttcctaccgaaactattccaaaaaattgaggaggatagactcctccccaactcattccatgaggccaacatcatcctgatacaaaaacctggcagagacacaacaaaaaaagaaacttcaggccaatatccttgaagaacattaatgcaaaaattctcagcaaaatacttgcaaaccaaatccagcaaaacatcacaaactaatctaccatgatcaagttggcttcattgcaaggatgcaagtggttggttcaacatgtgcaaatcaataaacgtgattcatcacacaaacagaactaaagacaaaagccacatgattatctctatagatgcagacgaggctttcaataaaattcaatatcgcttcatgttaaaaactttcaatacactacgtattcaaagaacatatctcaaaatagtaagagccatctatgacaaacacacagccaacatcatatggaatggggaaaagctggaagcattcccattaaaaccagtacacaacagggatgctctctctcaccactcctattcaacatagcattggaagccctggccaaagcaataagccaagaggaagaaataaagggcatccaaatagtaagataggaagtcaaactccccctgtttgcatacaacatgattttatatctatataaatcaggatacaaaatcagtgtatgaaaatcactagcatttctatacaccaacaacagccaagctgagtgccaaatcagaagcacaataccattcacaattgccacaaaaagaataaaatacctaggaatacagctaaccagggaggtgaaagatctctacaatgagaattatgaaacactgctcgaataaatcagagatgaaacaaacaaatggaaaaacactccatgctcatgataggaagaattaaatcattaaaatggccacactgcccaaagcaacctacagaatctaccaaactaccagtgatgttcttcacagaactagaaaaatctattttaatattcatatggaaccaaaagggcctgaatagcgaaggcaattctaagcaaaaacaacaaagctggaggtatcatattagctgccttcaaaccatactacagggctacagtaaataaaacagcacggtataggtaccaaaacagatctatagaccaatgaaacgtaatagaaagcccagaagtaaggccccacacctacaaccatctgattttgacaaggctgataaaaacaagcaatggggaaaggactccctgttcaataaatggtactgggataactggctagccatatatagaagattgaaactggaccatttccttataccctatacaaaaatcaactcaagatgaattaaagacttaaatgtaaagccccaaactataaaaaccctagaagacaacctaggcatagggacattctgtacataggaacagcaaagatttcatgacaaagataccaaaagtgattgcaataaaagcaaaaatggagaaatgggatctaattaaacttaacagcttctgcacagcaaaataaactatcaacagagtaaacagacaacctacataatgcgagaaaatgttggcaaactatgcatctgacaacagtataatatccagcatctataaggaacttaaacacatttatgagagaaaaacaatcccattagaaagtgggcaaaggacatgaacagacacttcaaaagaagacatacatgcatccaacaagcacatgaagaaaaactcattatcactgatcattagagaaatgatgcaaataaaaaccacaatgagataccatctcacaccagtaagaatggctattattaaaagtcaaaaaaataacagatgctggcaaggttgcagagaaaagggaatgcttgcacaccgtcggtgagagtgtaaattagttcagccattttggaaaacaatgtggtgattcctcaaagagctaaaaagagaactatcattcgacccagcagtcccattactgggtatacacccaaaggaatataaatcattctaccataaagacacatgcacatgaatgttcatggcagcactattcacaatagcaaagacatgaaatcaacctaagtgccctagattggatgaagaaaatgtggtacatatacaccatggaatacaatgtagccataaaaatgaatgagatcatgtcttgcaggaatatggatggagctgtattctaagcaaactaatgcagaaacagaaaaccaaacaccacatgttctcacttataagtgggagctaaatgatgagaacacatggacacaaagaggggaacaacaggccctgtggcttacttgagggtggagagggagaggagggaggggatcagaaaaaattaactattgggtactgagcttaggacctgggtaacaaaataatcaaaccccacaacacgaatcttcctatataacaaacctgcacacatactcctgaaactaaaagctaaaaaaaaagacattttgaagagcattttttaatgtagagagaagagattttatccaagaaaaagatgctgtaaaaaaggatcattccaagaaccaagataactatcagatgttaaaactatacaagtataaataaaaattgcaatagatggcttagaagatgaagttgaggatattgtccagaatacagaaagaaaaaaaaaaaaagaagaagaagaaggaaaagcaaagaaaaaaaaacaagaaaattgagttttggcttatgtaatccaaaagccaactaataggatttgttaaaaaaaaaaaaaaaaaaaaggccaggcttggtgcctcacacatgtaatctcagtacttcgggagacagaggtgggaggattgtttgagccgaggagtttgagatcagcctgggcaataaaaaactgtgtctctacaaaaatattaaaaatgtagccatgtgtatgtagtcccagctactcaggaggctgaggtgggaggattgcttgaacacaggaggcagaggttgcagtcagccttggctgcaccactacactccaacctggacaacacagtgagaccccgtgccaaagaaagaaaaaaatatacgagagaaaactgagaatatgttatcaaagaaatgatttaagaataatttctagaactgatgataacaaagttgtaaattgaaatagtaaccaaatagtcatgcagtataacttaaaaaaaaacctaaagtcattatgaaacctcaaaacactgaaattaaaagaaaaaaaaaaaaacttggccaagcatgaaggttcatgcttgtaaatgccaacactatgagaggctgagacaagaggatcgcctgagcccaagaatttgagagcagcctggataacatagcgagaccccccatctctgaaaaaataaataaataaataaaataaataaagtggggcatgtgcctatagtctcagctactcagaaggctgaggcaggaggatggattgattgagcccaggagctcaaggatgcagtgagctatgatcacatctctgcactccacactagatgacaaagcgaggccccatctcatttaaggaaaaaaagactaaacatttacaagataaaagcagacatatgtctcatataaaagataaggaatcagaatggcactggacttctcaatattgtgaagggaaatcagaagacaacacagccaacatctgtgaaattctgagggattgacaaagttagaaagataattcagtggagaaaggacaggcttttcaacaaatagtaccagaacaattagacattcacacggagcggggggaagaaaggaggacccttgacctatacctctcactatatgtaaaagtttactcaaaatggaacataaacctaaatgtaaaatataaaatcaaaaacaggaaaaaatctttgtggccttggactaggctaaaaattgttaaataagacacgtcttagtgtcatcatccataaaagtaaaaaactgatgttagacttcatcgaaattaaaatattttgctctgtaaaagatactggtaagagaataaaaagacaagccataggctgggaaaaaaaaattaaaaatcccagatctgacaaaatgcttatatttggatatataaagaactctcaaagcttaataacagctcaattttttaaacgggcaaaaaatttgagcaaacacattactaaagaagatgtacagaaagcaaataagaatatgaaaagatgttcaacatcattactcattaggggaatccaaattaaaatcacaataagacacaactgcacattttgttaggggagctaaaatttaaaacaaaggggaaaaaggaaaaaaaatgctaactgcaggtgaggacgtggaacaaattgaatcctcacctattgctcatgagtatgcaaaatggtacaaccattttgaaaaacagattgacagttccttatgaagtcaaatatacatttatcgtacagctcagaaatcttagtatttactgaaaagaaataaaaacttgcattgagacaaaaaccggtatgctgacatttacagtggatttattcataatcaccaaaaatccgaaacaatgcaaatgttattcaggttgtgggatatgatggggtttctcttccaataatctgatcaatcttttattctttaattcaccgtaccccaccaccctttttccttttcccagatgttaatttctttggagggctgaatctcttctgtatgtactagagtaatggatatatgattctacacatttgtctaaacccataaaactatatatgtgtaccaaaaggagggaaagttactccatgtcaattaaaaaaataattctgagaaaaaattatagcctaccagaactttatatccagccaaactgtcaatcaaatgtaaggataacataaaatgattatctgctaggcaagatatttaaattattttttaccttcaaatataacttttctcaggaagctcctatataccatgctctaatagaatgagaaagtaaaccccacacaaaaaaagaactcatgggacctagaaaaaggagagaggtagcaggaaattccaaaacaagtgatgtgtctgggatctaaagagaacacaggcgatattaaactaggaagctggaggcttctaggcatgtaaattcaaggagagaaaacaatgaaaccaatagatattctgaagaattcagacacaaggagatgagattaacacttttgagggggagttggaaacactttaaggaaaacaaaataataaagcaaggcaggtattatctctatgactggggaaatgaggaaagagatgtaatcacaatatgaggggacttcaaaaggaaacttgggaaggtttgtaagtgaggacgtacaaggaagcttccagagaactcagtagatagatgatatccaaatgaaatagaaaaggactagcagaatgcctattttatttggaaatgtagtattaaacgcagggggaaacagcagcaaaaggagctgagtctggttgcctcaggggggcagagaatgagaggggaagggctactgctgttcactcaaggctttgtagcatacattacttttaaaactgttctagacaagaactttttttcatcaaaaaataagaaaaaagagaatgaatgataccaaattattaacaacgattatttttggttattactgggtttatagataattttcattttattctttacaatttcctatatttcctcaattttctatcttaataatcaacagggagcagaatgagagagatacagacacagagagttattaagagcagaaaatacttctcccttctctttaatcaggcaaagcataatagatatccatgtcttattatgaagacagtctgcatttagaaagtggggatttcagggcacagagtaaaggtttctacgagatagcacgttgggaaggagactagctcagtgcctggcatgaaggaggagtttggatgatgcaaacccctctgtttgcccctggtctaatttttccattggtaagatgagggcttggggtcagccacctctccctagctctagaatttgactccaagaatctgtatccacctcagatgcctgtaatcaaggaacctgccaggaacaggttaccctagcctcctgctgcccaggcctaggtgccaggagcccctcctctccccgcctcccacatagggccaggcatgttcccaccccagaccctccatccactgcaatacattcctgggagtttctttgttctctcaactgcccacctcccaagagacaagtccctgaaaccaggtataaatggctgctgagacttcagtgccaccacctggtctgtgtacttccagctgttgaataaatggcaacccttggacatttctatttcctgcaaagccctcccagattagaagctgatcctcatgactccttacaagcttggcaatgcggaaccaagcagagtatttgaatatgaaaagaaaggccaggtctgtcttgaaattcaagtctctgaactctaagacctggacgcaggccaacacctggtttctagagctgcaagtcagaaatggcaacaaaacacaaggggatgagccgagctttggaaccaaacagccctgggtttgaatccttaatcggccactgaattcctggcactggctgagacacgttttggcagatttctcatccataaaactggaacaacaaggcctactttctatctaaaataattagcaaataattagatgacaataagtcgtgtttactgggcacttgctatgtaacggcactgtgctaagtattttatgttcactgttcatttaatcctcagaaattaactattacgtgctaccatccccatatcaaaaataaggaaattgaggtacagaaagattaatgtgtccagtgtggctcagcaaggaagcaccagagttgggatttgaaccccagcagtctgaggccagacttaactgccgcaccgcatggtttccctaatgacaggcacttcttgagggtggacagtaaccagccctgtctccttcttcctgcccatattatagatgggagaacaaggcccaaagcagggacgtgggcgtcccacagtcatacaggagctgggggtgggccctggattcagctccagttctttcctcatgccagcagccactggagcccacagaggcccatccggaggacccttggatccccactgtgagtgggcccagcaccttgctgcctcagacaacccacaacccctgacactcacaggtcccctcaccttgttctgatgtgggcatggtcttctgctgggaaagcaggtatctggcctccgccacccctcagcacacttaccaggctatcatcctattgtgacacctgccctagtccacacctcttgagagctcatcttttcctccaccatggtgaccaagagcaccacccatgccctgccatcaaagtggagggaaggaccaatctcgggcccctggatccagccaggtctgctgcagtccagtctgctcaaacagctcatgcctaccaaggcaagtgatttgtttccttggtagcatttaacactcactacattaacagtatgtatttattcagggaccatatctgagttatccattgctgggtcctcagagcctattccagtgcttagcaacgaagagtccagttgctacacgcagaacagagtacagaggccaaagggaaacaaaagtccagtgaagagtgactgccaggaaagagatgatggtatcctggtggcaaaggagaaaatagaataatttcagcagacatttaggaggaaaacgggataggattggggactgagggaaagaggggtcaaaggtggctcttggtgttcacatttgcaccctagacagatatccatctgtcctttcggagaagtaagagggaaaaaggaacactttttccaaactgggtggcagctttggagtaccaggccctcacgtaaactgttttgtttgtttgtttgttgagacggagtttcgctcttgttgaacaggttggagtgcagtagcatgatcttggctcactgcaacttctgcctcctgggttcaagcgattctcctgcctcagcctcccgagtagctgggattacaagtgcccaccaccacgccctgctgtttttgtatttttagtagagacagggtttcgccatgttggccaggcttgtcttgaactcatgtgatccatccgcctcagcctcccaaagtgttgggattacagatgtgagtcactgcgctcagcccaaaaactgttgataaaatgaaaccacagataaaaagccagtctgttgcctaaggacaaaccatattatgagcccttgcccctctgggtacccttttaatcagaggctccagactgagctagccaggctggaacggggatctgggaagctggagatttctttcctgagatcaatgaaacactggacattggaggaccagttggggatccctgtattgtatgggcttctgaccaaagggtctacaccatgaccttgctctgtgatcccaccattatcttgggatatctgggctgtaaccaatgggccgctggacagaggagaggatcagaagggttgggatataaaaacaaatcacatcccttccctgattttaaacctgatatgggtgcccacttctctgtggagggtatctccctcatggcagggaatccaaattccaatacaaattggtgacaatctccctttcccattttttcaccaatgtctagtgtagtggccatcattggctgcccgcccagccgtgtcccccgctcatccttcctaggggaacctctggggagtccttgccccctttatataggaacctgtgcttgggcttgggatgatgagacttgaggctcctacacctttggtccccagggttggtccaggaaacaggactcatgtatctcctatcactgcttgccattggctactttaagtatctatctcccctgctggactatgacctcctagaggccagggctcaatatgatccctttctgggctctgcaggagggatctgttgggcagaagaagggcacaggtgctggaggtaggctcttcttgcatacctcgtagggacttccatctcacacggcctccctggttgcccatcagcctttcccaccttgggcaggattctgatccatggctttctttagtctcagagcaaaaagctctctcaatgtcactctgaagctcgggcacacttactctgtgttcactctgttttttttttttttttaaagcgcccttcacatgatctagctctcaggcaaattggaaaaaaagaaaagaaaaagccttaattaaaggaaagtaaggcacagttttcatgcataataagaaatggctttttgagccagcatgataaaatcctaccactctggggttgccctccagaaagtgaggattaagaaagccagggttttatttaagggcagttggagaaataatggcagcaaactcttagaaagcactcactgtgtgccagatattcctacatgctttacaaataagggaaagcagcgattcccttgaatcctgctggccaaaagctgagaagagtgaagagaaaaacatgggtggagaaaaatgaccaaggacatcccaaggtatggcatagtctggagggtcgtgaaagccaactggtgctgttactactgggaactggatcccttgtttaagatctttaataagtggtactctaggttgtggtttgcaaatttgtttttaaatcacctgaagagctttaaaaattctaatagctggggtttacccgctgagatcctaatgaagttagactggggtgtagccaggacaatgagactttttagacaaaccccaggagatcccaacgccagtggaggttgtataccctggcctaatgttgtttactagtatattggtttcctcagctgccgtaacacagtaccacaaactgggtgacttaatgcagaaatttattgtttcatactattgggggccagaaacctgaaagcatggtgttggcaggaccatgttccctctgaaacctatagggaagaatctttccttgcctcctcctaacttctcgtggtttgctggtaatccctggcattacttggtttacagctgcgtgacccccatctctgcctgcgttgtcacgtttttctccatgtgtgtctgtgtcatctcagggtcaccttcttgcaaagatactgattggggccaacctactccagtatgacttaactaattacatctgcaatgacggtatttccaaataaggtcacaatctgaggtattggtatttaaggcttcaacacatcttttttgtttttttatttttattttcatttttttggtgtgtgacactgagtctcactctgttgtccaggctggagtgcaatggtgcgatcttggctcactgcaacctccgcctcctgggttcaagcaattctcctgcgtcagcctccctagtagctgggattacaggcatgcaccaccaagctcagctaatttttgtaattttagtagagacggggtttcaccatgttggccaggctggtctcaaactcttgacctcaagtgatctgcccatcttggcctcccaaagtgctgggattacaggcacgagccaccatgtccagccatcacatcttttttagagagacacaattcaactcacaacaatgggtataaatgcctgttcctgcaacccctcagctttgacctgtggactctgcctgcccattgcctgaatgccatactcacagcatgagttgctacttggagcccagcatccccacatatttgggagatccctagtggccttcctgctcaagaagcctctacctttctccttattgttcatggagtccttcgtgctacttgactcaaagccttttgccttggctcacttggcctttggcttctgagtcttcaacaccaggctccttggcaaggctactgacagcctgctaaatttcccaagcacccttgccatgagaggtatgctacaccctgtcccctcaaaaccccactgctagctggggctcagccacaaagcagatatcccaccccatccagctgcaggtttggtacttgcctcctcttaggtagcatcagagctccgacattccactcaccaggaacaaggcccactaatgagtcaaagctcctttaaaatctgcatttgtctggaccttgctgtgctattacacagctgaacatccttgggcaaatcacttaacctctctgaagctctgtttccccacctttaaaacacagatgataatccatgccctcatttctgatcacaacactcaggacaaacacagctcagaattcagaacagtttgggtttttagacaagtaatatgggcccataaaacagtcctagtgagatctggggcaacattctgggctcagacacacaaatatttccacagtgaggcatatcaaaattcataccatgggagacaaaggctacagatagcttcataacagtttgcgtcaggtttgacagccaaatgaatttagtgttaaatacacacacacacacacacacacacacacacacacacacacacacacacataatctctctctccattttcataacttcttgaatttctggactatatgtacgagaatgtcaacctaagtctagttcacaagtttgtggtaactattacaagagatatatcacacatgtgggtatcttgcagaatagctagtttgaagtaattaagtatttgtgaatctggaaaaggaaaaaagcttcaatctagctgaagccaaagtttgccactctccttaaaacactgcaatttggccagaaggcctgtgacttgtgcattataagtggtaaaatgtccccagctttgccctgctccccacttcatcatcagtcccaaactgaggtctcagcatgtgacaggaaccacgttcattctaatcatcacagtaatttttaaaaaaaattccagctccattccacatctcttaagttttggcataaatcattgttacaagaagaccttctcttagaaagatctttagaatcagaaaactcctgtattctccaacagcagcctggtttcatggaatgcagccagactcaggttcacaggtcttcctcctcaggttggaagtggtttttatggtggctgcactgcgaacatccccaaagctccaggagacatgcaaaacgaagaagagtgcagtgtctacaaatcagcagccagtgctacaagggagctgagtagctacactctgtcaggccagggttggaaaatccattgtcttcttcacttcagactgctataacaaaatgccttagactgtttatttatttttatttttattatgttttttgagacagtcttgctctgtcactcaggctatagagcattggcacaatctcagctcactgcaacctctgccccccagattcaagcaattctcctgcctccgccccccgagtagctgggattacagaagtgcaccaccatgcccaacaaatttttgtatttttagtagagatggggtttcaccatgttggctagtatggtcttgaactcctgacctcaagtaatctgcccactttcgcctctaaaagtgctggtattacaggcatgagccactgagcctggcctaaatttattgatcatagttcttgaggctgaaaagtcaaagatcaaggtggtggcaggttccatgtctgatgaaggcctcttcttcatgcatggcagcttctatgtgccctcacgtagcagcaggaacagagggggtccctcaagcctcttttataaggacacaaatcccattcacaagggctccaccctcatgacttaatcacctcctaaaagccccgcttcttaaaattatcacattggggattcggtggcaacatacgaatttggaagagggagatacgaacacctagaccacagaacccatctagtcaggcctagtatgaccttggataagctaattcacttccgggatccctaaatcttcacctgctaaataagcatgtggattatattcccttccaaggaacttctggcttaaaaactccacaattaagatttctgcctgtctgagataaatgttggttccctaaagagatttggaaaataaactatagctattaatagcttccgatagacaatttcaggcaggaggtaaagaagcaattacacagtgcacatctcatgccacacccggccttcgtatgctgatggattcaggtacagtgtggttctgcagttcccttggggaattttgtttctcaaagccagggactgactgctcccaccacggcctctgctgggcagctgctactaggcaggaacctgtcagaaatcaacccaagcaatgacttcttttgggaaacagagtctccagaatttgaggtaattcaggtaaatgtggcagatggtagcatctcaaattgtcatttctccaaagaaacctggcaagggtgataacctctggtggcctgaatttagagttgagcaatagtaagaatatggcaggtgtaataggttgctattgaggggagcagaaagatttggggcagagcactccctcaggtatacaaagaacaggggccatgcccatggttgtagctttggctccaaggaggaaagtaagcatggagggcttccaaattggactaaagccatctctggctgaattctgggtgccacattctaatgagagggaattaaggggtaagacttgacctcatgtcatctctttacagtgaccttaaaaagcacatcaccttccttaggagtaaaattctattagtagaaccagccaggaaaaaataatgcatgcgagtgtgttgcatggaaaatctcagaaacttggccaagaaaactgaaagatcaagaacctgagtaaaattcatcgtaacaatagaagataatgagaaaaaacacaaaacttcaaaataaagtagttaagtgtatgtattgaggacatgggaacaacatttacgcaggtgagcatcagagaaggaaaggcctgttttttgaatgccaactatgtgccaggcactgtgctaggcactttccattcattatttcacttcactcccataaaatacatatgaagtagcattggcggtcattgcagtcacagtaataataggaaagcaccagtaattagaaatcatagtgtttttcaaatctttttgtgatgaaaacataccccgggttcagggaggcaagcctaccaaattcaaaaggcatgaagagaaaaatgagaactcctataaactcatctttagatatgagcctgatgccaaagctcccaccgccatagcatccacattaccatcagaattaaggggtcctttctatgagagtcatagtccttgctcaggtgatttcattggtttccaggaccaggatttcagaaatgacaatggatttttttttcttcatggtccagaaagtcttggtcaaaaaaacaatttggttactcacagtgacagaaggcccctggctggggctctcagagggaatccatgctgaccactccccatgacttcccccacatgacaatgggctaagtggggctctcatgcttcccttctgacccctctcccctctcctgactcaccaaaaatacaaagtccttgggtaccttcaacatatctagaatcagcttcacactgctctggcgtttgttcattcatcagttcgagcccctgttttgggtcagaccccatgctaggagatgggcgtacggggatttggcaagctgcctagtctggaggaaacccatggtccctgcctgccattccatgactctctatcccacccacctgttcaggttcattctcccagcaccttctgccaatgtgacaatagagtttgcggtctccaagaaccagccctctgggagtggctagtgctttgcttgacggggaccatcagattcagctctcatcccttgttactatgaaggtaaggatgaagatgcccctgtgggagaagggggctgcctaagaccaaagtgtctagacattggtaagcaagcagcccacccctcccttgcctgagtgtgtgaatgtactcaggatcctcggagcagtcagaccagtgccttgctcgatgtccactgttgtttctgtttcgggtgttcttgcccctcagaggtccagactggggaaagctaaagggctgtcttgtgtggtaatggccaagtcacttctcctggatctcaactgccttctctgtaaaatgggagtgttatattggttggtgatccaaggtcatcttttccatatatgcaggtttatgattttatataaacctgtttctcatcctaaatcataattataatcataaattgaagggcgtgcatgtgtttctgtgtgtgcacatgtgtgtgacagagtgtgtggtctgagaaaaatctgactctgagttttctacgaatgctccagagagtacttaaaaaagtctggaatcctggactctccttgttgagagggcacacacctgctatacccacgtgggtcacacagcccacctgctgcacaagcaatggaggaagggcatggcagagaactccctgggtatgagctggatgcaggagtccaagacaggcatgaacagagctctgtgatctggtctggagaaatgggacatgtatggagcacttggttaagggcaagcgagattatcccagaacacctcaggaaatcagagatagcacaagcttctgagaaatgatggcagagaagaactgggcaggtaaagaatcagacctccagctggtccagggctcagggttaaacccaggggtgccctcaaagaacagacaaaatccttgttctcagtcatgagacagccacacctacttggcccagcataggtctattaaagacagaacttgcaggggtctgcaagggaagctgagcatcctgcagcccccagggacgctacaaggcagctgagggcctcaaaaccttaccaccatcacgcccaccacccaccagcctccgtgtgtcacccagaaccatggatgccctcacttgctgcctgctcacttctcctactttgataaggtcactcgccatgctttataacgcaaaaataatattcctgctgccattgcaaattatgtctgaactatccacccttcccatcctcatgcagaaagcagctctgcaggggagaggcatgccgggctgcagttacaaggcttattaagacacctaatggaacaccttgtggtgaccgccccctctgaggagagctcagcaaaatgcatcacagaagcagatgtcaggcttaaggcaaaagcttccaaagcactaaagccatacatggaaggactgagactggccccatctgtaccagatgttcgccatggctgtggtgctggggctcctcacccttcataagcaaactaccacagtaatgatctcacattcttggcttctaggggctgcaagaagaggcactcttgcttaatacaaagcttgggacaatggctacaggcatttggtgagcctcaaacaccataggggataaagttttaatttaagtgaatgagttgcaagcccagctgtctggggaatgacctctttagggttctcttcgctgcccctcaggagctctggtttcccatgtggctagttggctcctaccttctgaagtggggagctctggaaagttgagataaggactgggcctggggacagaggttccaagaaggctacagagcctgattttttcctttgttttcctgtgtcttaggtctccctcgaaaagaatcaatggaagtaggtaccctagtgctgtggtagaaaatgtgcaggaacaagccagatgcaaactctgtctctactccttacaaacaatgagactctggagaaaacaatggggccattctatgcctgtgttttctcattttaaaaatgagggtggtgataataacagtctccttgtcctccagtttttatgaagatcaaattagttaatgcctagagaatcaatcagggtcaccctgggcatgttcgaatgaggagaatccaaggcaagttaacaaagggaatatttacaaaggtacaaagcgggcaaggacaagggtaagtgtagcagagcacccacggggatggaagggattaggggaggaagtcgttaacagaagccagcaggagagaacaggggcgagaagatccccttgagaggaacagcaaccttcagtcaagacacacggctggcccatagcaaccacacagggaaggcccagggaataagtacacagaacactcttactccccgcccccctctgatttctggccatacagaagaccaagggcattggcagagcctatacaggccagcctttcagggcagtgagcagggtggaggtgggtaaagatggattgaaagggtcgcgtgaacaccactagcacagctctcaatctgcccaggaagtaagcactcaaggcacgagatgttgctccatccatgggcatcaacttggatatacatgttcagccctcatcactgggacactaaatggggctttagagtcacatgccacagccatcaatgtctctcacagacctgtagctgccacagttgagtgatctgctggctgaagggaaggccacccacaggtgacactcccaggacttccctgggcctaccatgttcaccttgagactgtttagactttgcatcaatgacagggcaagaggcagtgatgtttccatcctgttagaaaacagaggtctttaaaaaattttttccataggtttttggaaaacaggtggtatttgggtacatgactaagttatatagtggtgatttctgagagtttggtgtacccatcaccctagcagtatacaccgtacccaatttgtagtattttatccctcacccccctcccaccctttccccgagtccccaaagtcattgtgtcattcttatgcctttgcatcctcagagcttagctcccacttatgagggagaatatatgatgtttggttttccactcctgagttccttcacttaggataatggtctccaattccatctaggtcactgcaaatgccattattttgttcctttttatggctgggtaatattccatggcatatacatgccataatttcttcatccacttgttgattgatggagtttagggctggtttcctatttttggaattacaaattgtgctgcatgtgtgtgcaagtatcttttttgtataatcacttcttttcctttgggtagatacccagtagtgggattgctggatcaaatggttgttcttttagctctttaaggaacctccacactgttttgtatagtggttgtactagtttacattcccaccagcagtgtaaagtgttcccttttcaccacatccccaccaacatctattattttttgattttctgattatggccattcttgcaggaggagtaaagtggtaacacactgtggttttgatttgcatttcccttatcattagtgatgttgagcattttttcatatgtttgttggccatttgtatatcttcttttgagaattgtctattcatgttcttagcccactttttgttgggatttttttttctaatttgagttcctcgtagattctggatattggtcctttgttggatgtatagatggcaaaatttctctcccattttgtggactgtctgtttattctgctgattgtttctttggctgttcggaagcttttcagtttaattaagtcccatctatttatctttgtttttgtcgaatttgcttttgggttcttggtcatgaagtctttgcttaagccaatgtctagaagggttttttccgatgttatcttctagaatttttatggtttctgatgttagatttaagtccttgttccattgtgagttgatttttgtataaggtgagagatgaggatccagtttcattctcctacatgtggcttgccagttatcccagcaccatttgttgaatagggtgtcctttccccactttatgtttttgtttgctttgttgaagatcaggctgtaagtatttgggcttatttctgagttctctattctgttccactggtctatgtgcctgtttttataccagtacccatgctgaggaaacaggggtctttctgacagccaaggggtaagtggaatttgctaagtgaaagaggtccattttaggaagtcccactttctcttaaatgacaaccagcctcctcctaagtctttcccacttgctctaggcctgaattcagagttccattgttctttcacagaactccttggagtgacaatcaactaaattaaatcaattaatccaacatttacagaaagtcaggcatgtactgcttctggggaaagtggaaacagatcagatgcaggcactgtccagtggtttctttttcccaagaggacaattttgaaactccctcctcacatgcccctagggtagccaaaacccatagaggttcattctccaagatagggtggtacagtgggcagagcatcagccctgggggccacaacacactctgttagaacccagctccattattattacatcatcttggggaaaagtcacttagactccatgaaccttgttttcctcctctgaatctttcagagaataatctctaactcacacgatcactctagggattacatgagacgatgtgtgtgaattttctagaacagcacccaacacacagtaagtcctcaataaatgttagctcttcacccctacaagaactccaggtctccagatgcctatgtctacccctttaaatctcagacttagaggaagttaatcctgctgtttctgtttcctacaacttgggctgtgctaccttgtcccatttccttctgggtccaggtttcatcacctattaaatggaaggacacagattacacaatggataagccaaggggttctcaactttccctatgactacatttctccctgggctgcatgttatgaaaggcttgtccactgcataaactgaatttgtgaaggactacctcttcctccattttctcctaatcaaagcaagttccccccttcaggtttctgagcagcatgagatcacagctttgttcaccgggttgaatttgaaacctaacccaaagaacttgagatttctttgaacctgtatagtgtaggcacaggcatcttgaaatactaaaagcgcttcaagcactaccacttctccttcccagattcccaggtcctcaagttgaaaagcactggactaattgattcttctgaagccctccaattactaactctgtcattttaacgtccgaaccggaataactaaggaaaatcaggcccaacctgaaaaggcatttgttaacatgagatggactgtggctcattatggcaagggctggatatgtaaggatggaggcattttatttatgttaggagactgggccattaaccagtgttgtgaatgtgccttctacaggcgagtcttttggcatcccccagtggtaggcagtcagtcctttttgttcagttgctatacacccactgcactgcagtgtcaaccccaaaggcagtggcacttacacattcctttgtgaggccagctgctggtttaacccatggccaggcctggtcctttttctccaagcaacagggaaggtgcttagaggcccatgggcttatctgcaaagctattttcctggagctcactttggagcatcccctcctgaccatggtagtgatttgagatcaggtgtcttcaaagagcagcccttggaccagtctacctcctgacgccctttcttctcatcagatggaaaactcacagatgggaaaaaacaagctgattacccgggtctcactccccacagacatcttccatctttggtcctcattagggctcttggtagctggctcgttgctaagtcaaacttgcaaggcacagtttttctgccacttctttagatctgcacttaattacagctgttccttcctgttggccattctccactgtttcaaacatccaagatactagtcttctaatgttcttatcctctcattagagttgaacattttgttcttgtcttacatctattctgttccctgcacagctcaagaagtacttgagtttttgcctctgcttttatgttgcataataaatagcattctgcctggtgtgacactgagaataactgagttactactttctatcaaaagtatctaaagatccatgaagactcacaaggctcctttctgctgttaaaagactgtgcttttaacaacgctgatttctattattcttaactttattaactctaatcttactcaactctaatcatcactgtcttgcatttctccctttccaatccaattcttgatccattataggcatctataattataatacctccctgcctacctggggtattccttttactctcaaaaatgtccctattgaaacaaaaataaatatgtcaccccaaccatagagaataagatgtttcctgtttatttgctattgcttcagctcaagttcctgctctccatgtgtcaaagcaggggtcagcaaatatttttcgtaaagagctagatagtaaatacttttggctttgcaaccatatcgtctcttttgcaactactcagttctgccatggtggtgcaacagcagccgcaagcaatacgtaaatgaatgggtgtggctatgtttcaatacatttaatttacaaaacaagcagcaaaccagatttggcctgtacaccatagtttgcaatctatgcttatgtacggactgagataatgatctgcctttccctctaaaaagctgattttcctaacagcattaattatataatctattatttcccaaaacgatttaagtctaccattatcacatagtaagtatttacatagacacaaatcattttcattatcttattttgtattctgtttcaattacattttatttcactagccactaaattgcttatagtattaagttattttataactctctgtaactttttgctgtgcaaatctcccttctattaagggacaaaatgtcccttttgccattcttatgcatttcatcttctatccaaactttacaatcatttttgtcaagttttaaaaacataaatatgtaatcactttgggggagaattgacatatttatatgaatacacgtttccattcagaaacatgatatttttccaagtattcaagtcttcttttatgtgcctctgtgttaaagttttcatgttgttcctgcattttttttatcttcatcccaagctttaaaagatattctgtcctgttatgattgggtttttctttgctctatatattacaatttaaaaactgcacatagaaaaaacctgctaatttttttttagaaatttatttcgtatctggtccctaaaacctcttgctaatgccaatgggttcttctttgatgcctccttcatatatttttttagaatactaatcacacttgttcagagggctatgtcctttgattttcagagccagagtattttttcttttccatcagtttgaggatttttctccactggctcatcctagagatacagccttcattcatggattctgttccccaccaagcccagcctagatacctcctctatttcacaaaccctctcatctgacctatcaacatgccttctagttagtgaggcttgtactaattttacagtgcttgggtgcagaagagaacagactgagaggtaggtggggctgcagaaacccactgggaaacctagacctccctagagagtgaacacaagttcactcagagtggccaagagaatatgacaaatgcaggttccacccaggttgctagcatacttgaggagtcaaagatggtggtggagctgcccagcaaagatgttcaagtgaaggcatcaggagatggggatgctgagagtcagaagctagatgatgaagcaacagctttgctgcatttcaggataagagcaaagaagctaaatctcaggcaccctttggtctgatatatctacattaactcagcattgtcagtgccttttagctcatgtggcttggccctgagtattttggtctcattcaggaatcaccatcttaatcaagaaaactaagcagaagcctcatatgaagaactttgtattagttaaggttctccagagaaatagaaccgacagaatatataaagatatataagaggagacttatggaaattggctcatgcaattatggaggccaggaagtcccccagtatgctgtctgcaagctggagaatcaggaaagccagtggtataatttagttcaagtcctaaagcctgagaactagaagaggtgatggctgatggtataactctcagtctgaggccaaagtcctgagaacccaggatgagaaggtgtaagtctggaagtctgatagcccaacaaccagaagctccaatgcccatgcataggagaagagtcctagctcaagaaaagagagaaaaaatgaactcctctgcccttttgttctattctggtgctcgaacgattggattaagcttgcccacattggtagacttctttactaagtcttctgattcaaatgctaatctcatctagaaacaccctcacaggcacacccaaaattaatgttttaccagatatctgagcatcccttagaccaatcaatttaacactcagaattaaccatcacaaccttgtatacgttttcctcagaatgactgcatgccaggattgcgccagcaggctgactttaatcactactatcttgagagatgggctcctaaaatacagcaaagttgagctggatctgaatagactaaccccgtggctgagcaaatctgggcaggaccagatggaaaatgggctaattctgtaccacccattatcaaatcacatatatgtctagatctgtgtcaacaaatcctttccaacccaccaaatcaaatcattggagtagaactggggagacctgcagtaccattacggctcacaatacctcgtcacaacatgactctggatctccttatacccagagtgtttctgtctggagagtaggatgtaatggtgacattccatcttcctttccatacgtacccatttgtttccttttatttgttcattcattcgttcatttggcaaatacttaccaagcctactgtctggcaggcaccttactaggtactgaaaatagagacaggaataaggaactctatccttgaagcacacatcctattcacgcatggtttaaggaggccaagacatagcaagtttgaacaccttgacaaaggaaagaaactagggaggtacaaccagagtttaatcaaggactgtttaacttaccacacctgctatcactcagaattctcacaggaagcttccctaggcacactgtgacagaatgggtgggggaaactcttcctaacaccacctgacatgtgccttgcacccaccacaggcatggtaccttgaagcagagtaacagaccagtcagatgatcacatctccctcacctatagagactcatgatgatgtcttactgcctaggaaacagtacagtagctaaagcaatcactgggggaaaaaattctgaaatctctaagcattgctcattagcataaagcttggagaggtctgataaagttcatggcttatctccaagcctgcttgcttcctctctgcccagagcagcagctgggcaagggattgccttctttgcaaagaagcaaattaaattaaattagatcagttataccagcaccaccaacagcagaagcatcttcaataaaattaagatctcgaaatgaaaacaaggaaatcatcttctaaaaacctaatcccattgcccagtttgaaggcgctcactactgagacctcctgtggcaactttacatgaacatttgggagcagggaactaggggagacctggcagcatcgttgggtaacccaggatctgggccttttgtttgttgttgttttagtcttagggaagcacatatccaatcacacacttgatatataaataggccatttcagtgaatacagtcattggaaaccttttccaataagagcatgtcatactggctatgaaagagtgtatttataatcacacagcatggtatagtggaaagaatgccaggtattccagaaaatatggtggtttgcacaccatttcacagaacctccatcttcaaagttgactgaaatgaacaaaatgaattaaaatgaacaacaaaaatattattaattctgaaactcagaaactgccccaacctcatgctataggttttaagtgccacctgggccaaaatgaaagaagagtaatctatgttcatgcttttttttttttttttttttttggagacagagtctcactccacccaggctggagtgctgtggtacaatctcggctcactgcaacctccacctcctgggttcaagggattctcatgcctcagcctcccaagtagctgggatcacaggagtgcgccaccacacccagctgatttttgtatttttagtagagacatggtttcgccatgttggccaggcttgtctagaactcttgacctcaagcaatctgaccacctcagcctcccaaagtgctggtattacaggcatgagccatcgaacccagcccatcctccctttcaagatggaaaagtactgttggcaaggaaaaaaaaaatgtgtaatggacagaaaagctgaatgatatagctcctaatttgaagagaacaaattggaaaggtgtgaatattccacttggagctcgtttttcccattttggattgactccttccctaaatcccttcccagagccattctgggaattatcaggcagaaaccagttatctcatatgaggactcaaatgggcaaagacaagaaaatgaatgggtttagaaaaacaaacgacaaaagtccatgaaacagaaggacctctcattaaagcagctgactcattttgaaacaggtgagcaaactgaagctttaggggaccacccaccccaggaagaggatcaactgacaattcaatagacctaaatctagtgtcagaatttcaataaatttagagacagattagagacaaagcccccagaggctttttgcaagtcctcagcaatttcctctcccataagagagcagtcaaactgtaaccaagtaaattgggaaaatagcaaaggcaaattcagcattaccaatttggatcaaataacaccatcaggtaactgcccccactgatatagtggtcaagtagagggggaaaagtacaagacttaaaggaagattgtgtgtcccccacagtaggtttcacacgcaaagatttttttttaaaactcaccctggaagaagagatgctccaggaaacataaatagatcactgctttgtaatcccaggaaaattaaagagaatttaagctctacgaaacaagcaattaaagggtgagaaaacatgacagttgttcaagaccgggagtgtatcagcttctcgacaacacccccaggttcccccagggttgtcttctgggcaacctcccaggtactgtcctctcatcaatactagatccgctgcagttcctgaacatgtgacggcacagtatgtaaaaatgcatatactattagggctggaggaccctcatctagtcatcgtcaatgacaggacaataaaaaccaagttcacgtatttattaagtggcaaagctatagcttagaccccaacctgaccctacatgtataaagaggaaagaagagggatgaagataggatgttgggagggaaaaaggaggagaaaaaagggagagaaaatggaagatggaagcaacagctggggtgcagtaaaaaggggcactggactagccagaaaacctaccatgaatcaaatctgagtacatgccttcaatttctggggctacatgcccaacaaacagaattgttgggtcacatagtcacttgatgtttaaattttgagaaattgccaactgttttccacattagctgcaccatttggcattcccatcggcaatgtacaaggttctaatctcttagctctagcactcactatgttgcatgactctgaaaaagtcattttatttatctgaacctcactttctttttctctaaagagtaggggttagaactagctatcctgtttctgcctattcacacattctttctttccatccaaatcctgaccttccactgcccacatctgtttccaagagtttcctgacagtgtgaagtactgtaatgagtaagtcctagctctgctccttagagctagaattatcttaatccatatccccaagttatattaatgcacttccatttccatccatatctctcagcgtacattttttctctcttgtctattcttttaacctttttgcaagcatcatcttgttctgtctgtcggctgtcagcttttctctccgagcttctgcggagttgccagattcttgactatttccccaccctcagctcataactgtttttccctggagctcagcgactgctaagtggtctttgtgaaatcctattaggataatctccctgtctgtgtctcctctcagctgggctgcctctagaaacctcagctgtcttcctactcacaatcggcaaatcataggctggctcctgagtcatccaacatcgtacttattcacaaacatgcttagatgagctctgaacctgtcgaatcttgtagcccacaagcaagagttaaattcactggagattcaactcatatgtcttctcctgcagaaggtgtctcctgtttatgcgggacccctattccctctacaatcccaggaatgacacctgccccctttttactttttctgtttctgtttatgtttatcatctatctctctcatcagactgtgagattcatgagagcaaggagctggagtatcttgtccaaagctgtatcctcagtgcctggcatattacaggccctcagtacatgtttgttgaattcatgaatacgtgttcctcttccatagagtcaatcatggatctgcctacctgtctacctattagacccaaagctactttggggcagactgagatttacctgccatggtaacacttgttaaaaataaaattactctgacacttgttaaaatggtaaggaagacattattcaagattattgcaatggaggagagaaattaggcaaatataacaaagacagctggggatttagagccaaggaacagagtgagtggatgaaaaattaccaagaggagacaagggtagggagattcttgctaaaacaacttaccagggttcttaccgaaggcaggccaggatgatcagatagtgctatcatccgaatgtttgtggaggccaaaactcgtatgttgaaacgctaaccgccaaggtgatggtattaagcgatgaggactttggggagatgaattaggtcatgaaggaatgggattagtgtccttataaaagggaccccagagagctgccttgcctcttccatcacatgaggacacaactagaaggtgtcattttttaatgaagagagatctcacgagatatggaatcttctagcaccttgatcttcaacttcccagcctctacaactgtgagcaataaatttctgttgctaagaattagtttatggtacttttttatagaagcccaactggactgacagatgtcaaggggttgggggatcctcagtaggctaacctagcagagttcttgctaaaactgggctagacaggccacagacaagatagccaaaatcaaagcctagttgagaagggaattcagaggagcatgactaaaatttggtcaaggggagagtctttgtcaccccagcacctagcacaagtggttggtactaaatacttactgagcccagctgagcacccaccctcagtgcagccctgcttaccctgacaaaggtttagggctcttactctctcctttgtgcctcaatgagctgcagcgtcaggagaagggactccagtagatagcgttcaagtggctgggggtggggaagagaagcaaaatgtgacaaccccacattaatcaagaaggtacaccattttctcagggtttcataactccaatgatttcctgggccaatcatcccaaatgaccctcacagccactttgtgaagcaagttgatttatcttctcatgttatgaacggaataactgacactctgggaggtcaagcaccatgtcataggtcacacacccagaatttcatgaagtcatgaagacataaagtgtacatttatctgctcagaaactttttaagttgttgtccctaaatattgtaccaacttgtacttataccaacagtgtatggccacctggttgccagaggtctcaccaacactgatgtgtgtctgccggattatttttccttttactgatttttaaaacctctttacatgttaattatatcaatcattttttgcacatataatgcacatatctgagctcagtttgtttatttttttttttaatttttttttttttttgagatggagtctcgctctgtcacccaggctggagtgcagtggcacgatcttggctcactgcaagctccgcctcccaggttcacaccattctcctgcctcagcctcccgagcagctgggactacaggcacctggcaccatggccggctaatttttttttttttgtatttttttagtagagacggggtttcactgtgttagccagaatcgtctctatctcctgacctcgtgatccacccgcctgggcctcctaaagtgctgggattacaggcatgagccaccgtgcccagccagtttgatatggatattttcatgatgtttaggttcttagggacaaagatataatatttttctttatggctgtaccttcaatggtatcatcagaaaactgtcctgctccccaaaattaaatatttatttattctttaaatgtcatctatgttttccaaattttacatttaactgaaatgcactgcatttatccagaatatattttggtacatagtatgaagaacccacatcctcccctggtggattatcatttcatcttgacctgtctcattaattagaaatgtgaagtttgtctataacatgtacacatgcatgcattcacacacacacaaacacacacacacccctctgttttaaggacatactttattctgttaatctatctgtctcttctaagattggtataagctatttgaactattttagtttcaggatatatttctaaaacttggaagtagaagtctttctccatcattctcttttcaacatttgcttgatgatctgtgcccatttatttttccagataaaccttaaaatcattttataacattgcttatacatttctattgcaatatgcattcaatattttaaattgacagctttaaaataccaagccttcccatccagaaatgaaatacctccgtttacttatttgttttcccagttttgctttatagattccttctacagttcctgcaaattgtctcttaagccaattcctcaggcttttatatttgttgcttttacagaatgaatccttttatattatgtttcctaactggtgattggtatttagaaaatttttcatttttgtatatttattccctaactagtcaccttattagactcttttattgggctctaatagtttttcattatttctcttggggttttggtagataataaaatcctctgcaaataataactttatgccataattatatttcccattctgttactagaaatccctgaataaatgttaaataattttagtggtcctgagcatccttatatttttaggatatcagttgttagtttggaatagacaggctccgtcacattaaggaaatagctttctaggtcttttaaggatgacgattattctctgttcctccatcaccactttcacccaccaacctagacatagtggtctgtagtctgtatctcccaggcttccttactctctgcttctagctgagtttaaccaatggcagagtttggccatggacagaagaccagggggtggctgtgttcctctatagcctgtcaagcaatcccttaacactttagcaccatttctatttcctaccattgcccttcagacccagggtggtaatggcttcccaaagttgccagtccctgggtgcttcactatcccttgttaattcccttgattctgatccaatctctatttcattaaaccccatttaaatcattcatctctcacatgcttcttgcctagacattccctaactgattgataaattaagacccagtgggaagtattttcaaatgtatttttcaacatctcaaaataatcaaaatatttttttcttttgtgaaattaacgtgacacttattcattcattcatttaagaaaaaaaattctgagtacctactatgtgttgcttgttgtgctagacactgagatcagaacacattaaaaaaaactaaataaaacaaaacagataagccttctgcccttatgttctcttagggaaaacagttacacaaacatgtagatgaataaaatgccaaatattatgataaggactagaaagagtgtctggataaaacaaaacaaaacaaaacaaaacaaaaaacagggagtacatattcaaaaaggctagtcagagaatactgctcacagaaggtgacatttgagttgagttgacatgcaagctcttgctgagaagagccttcggcaagtgaaaagccttgagacaggagagagcctggtgtggttaaaaaaaaacaaaaaaccaaaaaaaaacagaccagggtatcaccagcaagggggaatgtggcagaggatgtgaataaagagataggcagctgctagatcagcactgtccaacagaaatacaatgcaggccacatttatacttttaaattttctacctgccatattgcaaaaggttatacacacgcacacacacacacacaagacactatcttttcaacatataaacaatataaaaattaacacaacattttacccttttttttggtacaaagacttgaagatctggtgtattttgcatttagagtacatctcagtttgaactggccacatttcaagtgctggaggccactgtattgaaccactcaaggctacatggtgcacatcaggcctggctcacaaggcctcccttggttgagaggggcaagatatctgagactcatctctatagctcccagcatcatgcctggcacatggtaggtgttcagcaaatgtttgccacacaggatggcagaagaactgcaaaatagatggcaagttcctgaagcagagaggctgcaccaggatcactctggtgcctgctccaggaaattgggtctattgtgtgtcctcaagcaagagaggaagttggggtccacctgctgagtctcccactgtgggggctgttcatgaccacctctcccatagccagggtgcttggcaaagctgctttcttaattcagaaagatcacatcacaccatatgccagagagtgggagggagggagcccattagcattcattgtacacagcttttcgtttggaaaagcacctcgaatgtgccgatctgcattgctttgcttcatttttcaacattcatgagtgtaattgcatttatttttctcgtcaagactgcaaaacaagtgataatttactacattacagcccatatcggctgggtttacagccacaacagttataatccaccctcttagggactgggtgggtaagcagggggtggtctttttagctgagagcactgtatttctttataacaggaagcttgggcccagctgttcttcaaggttacaataatagtggcaaaaactaacccatacagagacactgagctgtcaaagcatatgcacttctactatcttgatggcttcttacactaatggggtaaggcagacttgtactcccattcacacttgccagagaaagagactgagattcagagaagtcctctgtagtagatggtaacaggttggtgaacagcagagccagggttcaaacctagattcatgtgataggaaatcccgtgctctcctcatgatgacacctggcagtgcctgagctctagcaaagcgtgaggtcttgtagttatattggtagaaaagaagaggacatgatcttaaaattttgtaaatgtgaatgaagtgcctacagcagctgtgaccacgaaggacacctattttcttgcatctacaccacagaatgctaacttccagcagagaatcaggacaggagactacatccctgcctgaggtccatccaggtgctactctgtttgtgactatctagaaatgagagcagggaaggatggtctagccttgtatttggagatcattcaatgcagatgttttcttcctctttagaacaagagtcaagccatagtgatgttcagactttagatcacaaatgctcacgaattcatgagtagtaactgatgaacaagatccaaccctaaaaacttatggattcattaaaatcatttcctaagtaagattaaagtagtggacatgtcagtggtcgtgagctcctcatttcttcttcctgggttttagagggatgtaaactccatcccctaacctgactccctgccccctaattacaacacacggatcttgaaaagggtggacttgaaagctggtcttgctgtaaaggatctgaggaaagtgggcagaccatgaaaagccccagatctcagtcagaggatattgctaccatatgatgtgacatctctttcaagaggagatgaccctggggtccagccccacctctgcagctttctccaaggcaggaaagagataccaggggtccctgtaaagtctgaagagtcaggagctgacaggtgttcaggaagtcgctccagctacctggccaggatgctgtagtctgcaaaggacccttcagccctgttcctgtcccttttctgcaaactgaggtcccctctctcaatcaagtgatggctctcctctatccactcctgacattggcaagtgagaccctgtgtgggcgtttctgccccaggccaggactaaaatgacaaggtctggccactccagggccttctgctgagtctcagtaagcacacactggacaaagaacctccagcagccactcaatataaggggcctcaggtcttcaaagaaggccagtaggcgatgatgaacattacagcccacctagtgttaaacacatgtaatcacacacacagagagaggaggggagaggggagagaggagagggatggcaggcctaacaagtcctcagggttttccatcagtacacaggttaccaaggcacctccatgctgagtcccagctctgagacaggacaagaagaagctgcttgatggtgatggaggagacccaacatgggtccacgcaccaaacattttgttctgtgtgttctcaaatgtttgtcattcaatccctatgtgtcccaattgcatgaccttcattttataagtaagagaaaaccttgagccatagagaaactttgctcaatagctttgctcaaggtcccccacactagtccctctggctatagtgtccctgaaccttgaacgtgtatatgcctctggaatctcttttctgaaattcaactgtacagagaatcaaagaccaaggttatcaaagttttatttcaaacacaggaaagtagtctttcaattcaggcaataacctttctgttattattttccatattgcaaagtctaaaaacttagcacaaatctaaaaatcaggcttgtaaaggtgacattttgtttgaaatggtcaaaatcagataattttttcaatcagcatggagtgttaaattcaggctttcttctacttgttgccatcacccagaaaagaaaaataagatttattttccagaggttggaactatactccaggtggctctctggcctgccaggccccatctgctccatgctgctaccacctccacgtgcagtcaagactctcttcattcctgtattgtgaagtcttttcatgtggtccctggttgcagtaatgaacaaagtatgccacagcagaactgctttatagaacctgtgtggtattagagttagaaaactgggagtattacctaatcagggctcttccttgtataggttaaggccactggagcccagagagactaagcaacttgcttcaggccacacagcaggtcagcagcacagcagacccggatctcctgagacccactgagcaccatgctctgaaccacaagtgtatgtttcagccacctcagattttctgtttcctttaaatctgtttccaaatagctgaacacttcactcatcccctaactcacttattcaatattcattgagggcattctggtgccagttttaggagctgaggacacatagctgtgaatggaaaagttgcttcctgctctgatggagcttatagttcattgaggaagatgggtgttaaatgcaaaattacacagagctcctctgtattgagctcccgcactgcctgacctgggacaggggctggaagaacaatgggattctgagacccagtggtctccaaggcaaaggaaagaacatggcagtgatgacaaggggatggcaaagtacagcaggtagaggaagaaactacagggatgcaagcaacagctccaacaaagaggtgtcccagggtgccaattctccgcaggggaaagaagaagggaaggagctgggtgctcctggtggaatgccggcttattcctgtcttcctctaggaatgcactccctccgtctccttctcaggctcccattcctctacccacaccctagattgtggcaatgtgcagagttctgctctctcccctctgctcttccctttctcctgtgaaatcttgaccctggccttgacccctttcctagcttcccaaacacccagtggttctcaagatcaatgtactaaaattgcctgctgtttcctgggccccatcccagtgccacatgttgggataggacccaggaatctgctttttaaaaataccctcggtgattctgatgcagatgttcagtctacctgctcactgagacccaaggtctggtaagcatcaaacactgggccaacactttcacttgctaagaacccagtattgtgggcacagaggtagggtctctgcatgagcatcctggccatttttagcacacctctataggtatgtgtgtaatatacagatgaggaaatggaacccacgtggcttggctagagtcacagaacttcaaagaataggcacctgactccacacccaaatccagtatctttgttcatctctttcaccaagttttcttgagctcaccgatacctccaacccccttttcctcctccccatttttacagctaacatccccattcatgcctgatcagttccctcctggtccactgccttccttcccaccacaggctccctgctgctccaagttgcctttcacactggccaacaagtggttatcctaaaagataaatctgatcaaacattccctgacttaatctctgatgaatcctcactcttatcatgcaacatccttcaagttgtggccccaacctcccttctcatcacatctcatcctatgccacatgaccatggtatcccttcctagaatactacattattcaagagtattggtttgagtatttgcctctgccacttacgtgtgattttagataaaatcacactgccacttctgtgtgattttaaataaattacttaatctttgtgtgcctcatttttctgaactgtaaaatgggctgttaccactagctccttcaaaaggctgttgtaaagacttaataaaagaaagatgacaagtataaagtgctcagcacagtgccatgaaaacagatgctccaaaatgctacctgatactaatgtcatcactgtcatcctaccatgtaaggactacttgttattctctgaacataccacatactttgaggtatctcactggaagtagacacctcttggtgctggaaactcctcatcaaaattctaaagtgactgcaaggtagggtggccataaaatatccattgttgtacaaggtgctttgtatgtgaaattttagttaattccccacataagtcttatgaggctcttgtcccttatcctcattttagagacgagcatgaggctcagacaggttaccaaaccagctccatatcagaatgctagtcactagtagaattggcattccaactaatatcagcctgatttcaatgttcacacttctgttcatttcttctatgtgaaaagaacacagatttttttttttttttttttttttttttactcacttagagtacactgtactgagaattgtgtcatggtatcttgtatcattcctaccctcctaagctcacccacatatcactggggctggaagcctagaaactacatcttactttctggcagggttccagctcagtcttcaccaatgacagaggcaaagactgggccctcaccagacactgagcctgctggcaccttgatcttaaacttggaattcccagcatccagaactatgagacataaatttaaaaatttacatatggccttttttttttttttttttgtgacagagtcactctgtcacccaggctggagtccagaggcactatgtcggctcaccacaacctccacctcccaggtttaagcgattctcctgcatcagcctcccaagaagctgggattacaggtgcctgccaccatatctggctaatttttgtattttcagtagagacgagttttcaccatgttgaccaggctggtctcaaactcctgacctcaggtgatctgcccgccttggcctcccaaagtgctgagattacaggcatgagccactgcacccagcctatgtatcacacattttgtggcattttgttacagcaatatgaatggacaagacggaaattaataccgagaagtagagtgttgtaacaaatacataaaatgtggaagtggctttagaaatgggtaatgagtagaagctggaagactttagagattcatgctgcaaagagtctagattattgtgaacagagtattaagggtgtttctggcaaaggttcaaaagaagaaagctggagagaaaggctcaatcttcttagatattataagtatagtcacaaacagaatgatggtagaaatatggatggtaaaggcaattctgatgaggtctctgacagaaacaagaaataagatattggaaactggaggaaaactcatagtcttcaagatagccaagaacttggctgaatcatgcccatgtctcaatgctttctgaaagggagaacttgcaggtgataaactaggatatctggtgaaagaagtatctaagcaaagtgttgagggtgctacatggcttctcttgactgtttatagtaaaagtgagataagaaatcaattaaagatgaatttataagtaaaagggaagcagagcttaaagattttgaaaattcccagcctggccaggacataaaggtatattatggagagaataccaacagtgtggctgagtcaatgtttgataaaaatattaagatgcctgatagggttattagtatgggtgtaaggaagccagatgctatttatcaagacaatgaaagaatgactccgaaggcatttcaaagatctctaaagttgtcactctcatcacaggcccagaatgccatggcctgggggacaaaactgtatgaaaaaagggatcttgggcacccatgagacctcagcactcgctgctctgtgccacctcaagtctctgcttactgaattctggtgtagtgctccttagatgccccagatgtgactcaagtgagcccaagtgtggctcaggcttcccctccagagggcataaacagtcaaccttggtggcatccacatggtgttgaccctgcaggtgtgcagagtgcataagctgtgggggcatggctacctccacccagatttcaaaagatgccctggagagcctcagtgcccaggcagagaactgccagggtgggtggggctgctctgagaaccctcactagtgcaattccctggagacatgggaattcagccactgcagagaacccctattagggcaatgttccatggagccatggagatgggcaacccttgagacctcagacctgtagagccaccatcacgcaacacaagcctgggagagagacaggcacccaaccccaaccactgagagctgctttgtggggcacgcccagcaaagccatgaagaatggggctgcctgggtctttggcccacccttgctgcacggtgtccaaaaggcaggacgtagagtcaaagaagatcattctcaagcctcgagatttaatgctgtttgtcttcttgtgttttatacttacttgggacctattaccttttcttcttccctatttatctcttttaaaataggaatgtctatcctgtgtttgtcccaacattgtattttggaagtatacaatttgatttcacaggcacacagctggagagcaatttgcctcaagatgaatcatatctaatttagatgacactttggacttacactttaaagctgatacaggagtaagacttctggggctattgagatggaatgaatgtattttgtatatgagaaggacatggattttggggcatctggaggagaacgctgtggcttaagtgcaggtgtacctgcaaaattcacatgttggaacttaaactctaaagtgacagtattacgagttggggcctttagaagatgattaagtaatgcggtcagagccctcatgaatgggaatagcaacattataaaagagctggagggaactaggtaggccctttttgtccttccatgtgacagcatagcattcaagccaccatctttgaaatagaaatggggtcctcatcagacaccaaacataatggtgccttaatcttggacttgtcaacctccagaactgtgagaaacagatttctattattcataaattacccattttgtggtaccttttatagtagcatgaatggtctaagacaccactgaacaattccctatctccctcctctccccagcccctggcaaccatcattctatttttttatttctgtaagtttgactgctctagatacatcacataagtacaatcatacagtacatgttattgatgactgatttatctgtcataacataaggtcttcaaggttcatccatgttgtagcatgtgccaggatttccttccttgttaaggctgagtaatattccattgtatgcgtataccacattttctttatccgtccatctgttgatgaacatttgggttgcttccatctcttggctactgtgaataatgctacaattaacgagtgtgtaaatatattttcaagattctgctttcaattattttagatatactgtcacgtgcagcataatggtgtttccgtcaatgacggactgcacatatgaaggtggtcctaggtggatagttggctatagcttctaggtttacaaaaatacagtctatgatgttcacacaatgatgaaattgcataatgactcatttctcagaatgtattcccatcattaaatgatacatgattctatttcaagaactgggattgctagatcatatggtggttctattttttatttttggttttccatatagactataccatttttacactctcacaaacaatgtacaaaggttccaatttttccagatgcttgacgtttatttctttttgtttgtctttttatagtggccaccctaatgggtgtaaggtgatatctcattgtggttttgatttgtatttctctaatgattagtgatgctaaacatattttcttttcttttttttttttttgagatagaggcttgctctgttacccaggctagagtgcagtggcacaatcttggctcactgcaacctccacctcccgggttcaagtaattctcctgcctcagcctcgtgagtagctgggattacagacacacgccaccatgcctgactaatttttgtattttttgtagagatggggttctcaccatgttggccaggttggtcttgaactcctgacctcaggtgatctgcccacctcggcctcccaaaatgctgggattacaggcatgaaccaccgtgcctggccgtattttcatgtttctcaccatttgtttatcttctttggacaaatgtctatttcagccctttttaaaaaaaaaaaaaaaatcaggttatttgttttgttattgttgagtggtaggcattctttatgtattccagatagtaaccctacaagagaggtttgtaaatattttctcccattccacaggttgtcttttaattctgttccctttgaaacacattagttttaagttagatatagtctcatttgtctatatttgctcttgtcgcctgtacttttggtgttatatccaagaaatcgctgccaaatccaacatcataaaactttctacctacattttcttctaggggttttacagttttcactctcatgtttaggtctttaatccattttgaattaatttttgtgtatggtgtaagttaaggatctgctacatgtggatattcaatttactaaatgccatttgttgaagaaattattctctctccattgtgtagtcttggtacccttagtgaagattatttgaccatgtatgtgagagcttcaaaggttttataaacctctaataccctgtattaaaccccttcctgattgaaatacctagaatggtttccgttttcctacctgaatccaaactgatggacacatcatgcttatatatgtttgcagctatgatttagaaggatcttggaagctataggtcttattttaaccttagacactctcagagttcttaaaagacataacatattcttgcttgttcatagctttcacaagttgtttcattgactacaaggctttgaatcctgagaaagtgcaatttgggtttcttaataaggaaacacaacacctaggaaaggaagcaattttaaaagatattggcagatttgaggaaagttttaaaaacagtttgctcaaatatctgttgctttccaaacataaagtatgatcgtgtcagcacagagcacagtgtcaaaactaggtagatgaagagggaaaacaggaggtctttttagaaaagggtaatttctctcaattaccaaatgtctcactgattagtagttgtggggaaataaattctggagttgtacctgtgaaattaatggggcatgtgatagatcactgcagctctgcaaggatgcgtgagaacagagtacgtgccttaagctcaactgggagatttatctttctgtgaaggtctgggctctcagggatagattgtacgtcaggtgccctacctccatatactcatgaagacaaattcctctgcaaagaagcagaagcagttgccctgcttgacagacagacgaatggaggggttaggaccacaggagtcttcaccaatgttttgttttataaatgtatcactaaattcctatgtttagaaatgccttcttcttgattcataaattacaagtcaaagaatgctagagtcagaagaaactgacttctgatattacaatggtcaataaggtccagggagggatgatgtgtggcccaaggtcacagagcaagttaatggcagagctaggacagaatccaggactccttatttttagatccatttcacagaagtgggtgtaggaagcccagagaaaggcagctcaaagtctgaggttagtgacagatctgggatgagttcccagggatgcttccttagccactaggcagaaggccatgctaaccaaaggcctggcagtagagataatgcctacccaattccaccatgtgcctgcagcccacacagaaccacaataataaccacaggaagaacagagctagaggggcctgaggtagctctgttgttaatatgttctacatatttaaaatcacatgtttccacccaatcctgggtaggaaaactgaggtccagaggttcaagtcaacagagcaaggcagagacagaagtgttatgtccatgtgctaaaaggtggatgcctgggagtcatcagtgggtgccactgacttgagctgctttggttcaaatccccttcccagcacttccaacctctatgatgaagggcaagttgcttaatctcttcgtgcctcaattttccatctataaagtgggaacacatgttacctacactgcatagggttttgtgaaccataaaggaaacaaggctttaaagcacctggcacagaatgagtgctttataaatgctagctattactattctcaaagagagatatccctgttggtgggaatacaagtgacgtcataaaaatctaataatctaggagagtattgaccaatagaaacacaatgtgagccacgtatgcaattctaaattttctaataggcacatttaaaaaggtaaaaaagaaatgggttacttttaataatttatctaacccaatacatctaaaatataatcatttcaacatgtaatcaacataaacattattaataagatgtttttacatgattttttcatactaagtttttgaaatctggtgtgtagtttacacttacaggactagccacatttccagtactccgtagccatgtgcggctaatgaccaccagattagatatggcaaatgggacctcaatggattactggattttccagattgttggactttattttttagagacatctcagccatcttgtttttactaaactggggaaaaaagactatatttatactaaactatttccttttcttaccaaatatcttagaatgcatatttgtaattcaaattactataatagccaaagcataatgaaaacctgtttctttactaaggaaaagacagatcacacatttaaaaatgaaaggttcacttgcaggagctctagcccctgcagcagcccaatcggttgaatggtccacgaagacatcgcctagcatcagcatccagccagcatcaccatgatcaggatgattctcagcaacgtcttcctctccggctgccctgggagtggctaaagttgaagcagcaggaaacagaggaatcttgaagaacgtcatctctgtggtcctgttaaatgtgtcgctgacacacgactgtttttgtgatgcttccttttcaaagaatttactccgaacaacatgcaggttcactgtatctgcatttacagagacactgacagacttagacaattcaacaaactgacaggatcaaccctccattaaaagtaaagcatttcttccatttttccagtgagaagacatcctctcctcaaaaaaaaagttttcgggcaactttaataaatacaattttaagtgtacagatgattgaattaggcaaaagtccacttatggtatctaatatacaatttaattacacatacattttaaaatcacgtttcataaaatattaattgaaaaatagagagtggttcagggcacagattctggatccagacggcctgaattcaaatctcagctcctccatttactgtaactcacttttgagagagttgacattctgggcctcagtttcctcctctttaaaataagggtgataataacatccagctcacagtgttgttgaagtattaaacgatgtaaaaacatgtaaagcccttagaacactgtccaggaagtggtatacacatgttaggttaaaagacatagtggtttattatccattcacatagactttagaacctctttattctttctttctttcttcctttcttttttgagatgaagttttgctttcgttgctcaggctggagggcaatggcgcagtctcagctcactgcaacctctgcctcccagacaacccctttattctaactcgtcaaatgcagcagtgtttgtcatcagaagaagcacttttttagttgaacgatgccagtctccatcactttcacttcccattacaccatttggaatataatactttttgaatctaggtatgatgtcacagaaaactgagtgtcaaggcaagcatctatgtggatattagcacagacaggttttcccatttatctggcagctgtatattctgatcaccaaaaggacatcatgttgcttttcaaagccattgttaggacattgttaggaaacttgttcataaccatcaccaacactcgtcattacttgctcatatcctccggaataattactaaacctgcgttcaatttccttgccttttctatcaattctgtgatccctgtaaacatcccaaactagcactgattggggtcactgcaggctaatgtagtttctacaattaattttgtagctccaagtacacgaaaaaccatcttataatatgagatgttttgtaagaacttttctcagagctgtttggagacaaagatcttgtcttttatttgggcacacagaaggcattctggcatttctttcttctcccacctctatctcttaggtgttagttgaataaaccatggttcattcacccaggagaatatcatgtagccttggaaggtgaaaactaactctgaatacagtggcataaaaagagatggatgacagaagagtttgggagctatgattctattcactgtctacactcctaagtggccacagtgcagctgtccagagcacagcctggaccctttccaagggcacgtcctgcctccaccatatgctaacgatgacctgggcaagtcattcaagttttctgtgcctaggtttcctgatctgtaaaatgcagataacagcatctacatcagaggactgttgcaaagattaaataagttactatatttcaagtacttaggatagtacctgacacatagtaagcactacataggtagtacgtctctattactattaccacatacagatactctctgtcttcctccttccctctctccatcctccttcactctctccctttctctctcaaaacacatcaatatgttaatggtgatatttaggctaactgtaatcagggtggagagaggtaacttatatgttcaaactcagcattttttaagaataaatatataatattttgtcattaaagaggaaagaaaaaaatgtactgactcaacaattgctaaatgggaacataagaacttacaactttaaaccaatcaataataatatcaggtgtgattaaggacacttaaaggcccatacttccatatgattttattgtaagcctcacattaaaggaagagtaggtcaatctgagaatagattacatctttccaagaggagccagttacatgtgtcacaagcagtgccacacattcatgagagtgtgccaggccccagagcgaaggaagggatcatccccagtgtctctttatttgcccgaaggatcctgggaccaacttcagagcagaagaacccagaccaatcaggacctgggaccaagtggcccatcctgaccaaagcctcgtcaagctcagagtcgggctcaagacatgaaagctacagatgccccaggtgccacgaaaatgccaaagcaagtggcagcccctttagggtcctcctgaaaccactttctcccaactttcccaacacgaataactttaacaataattcagttatttttaaataaccgccttccttattccaggccccatgcaggatacaaggaattcagcaacgagaggcagtccataccctgcagccactcacaggcctagtagggaatcagagacaacatgtgataaactcagctacagaagcatagtagagaggtaagcgctgtgaggggagtcagggagggcctcctggaggaggtgacatttgtgccggggtttgatttaggaggaaggaaaagtggagctgtgctcttagccttagggatcagcaagtacaaaggcacgacagtgtgacctgtagggtttgtggttgaaacaagagatatcaactatgactatcttttaaaaaatacgaagtttctggaatattgagaagctcataatgaacagaaagctgaaggatcaggcctgaaaaataagcagaaaaaaaagggagttctgggagatcaacaagcaagaagtccagcaactttgtagcacaaacaccatggccagacaccacccctactactgcacaccccaattctccagcctctggctgctggcccatccttcctagatgaaaagtcctgggcagcagggtccacctgctgcatccaggttacctattcagccacacccaggctgccaggaaatgatgagcagctggcatcttcacctctcagcgagctacacaatccactgagactcaacacaatgagagataccccaaatcaagaaacagggttggagactggactcccaaaacaataacacaaaggctgctctcgtgtgattacacagaaggggaaatgaaagagaaaagggcaggagggggcactgaggctcaagatacatgctggggtcgcatcatgagaaagttcaattattaataagagcaaatcatctaacaaacatttgccgctacctactaagccccagcattgcggttacaaatataaatacaatgttgttcctgcctacaagaaccgaagctagctctgtttatggcccgtgaacaagcttgcagttcatccaataaacatgagggagcccacacagctttttacagctagcatccacctggattgactagtgcttggaccattctattcgacaatatttccaacactattcttgctaaagcccagggagtacctaagctaagagctagaacaaggtgcaatcaggggaccatcgacagtgcctggcttgtgtttagtgcttcagaatttgcaaagcattttcccaaccatcaagtcatgggcaaatgtccaggactacatgtttgccatgtggatgatattccttctccagatgtcaaagataatacacaaccattctgttttgggtatataagggaatacagaaatatatacatatgaaaacaaattcgataacttctattggagatgagcacagagatgtatgtacaagaatactcaccgcaacatgattcaggagtaactggaaaggacttaaatatgcaacaatatggggtgatgaaataaatcgtggaacagtcattgcaatgggaaactatgaaacctttagaaaacatggttttatggaacatttaatgacatgggaaaatgctaaagaaaaaagtattaaatagcaaaatacatatttatgcaagtttgtgtgaacatatgactttcatttcattctttatagctatctctattgagcattttctcaacaatgaatacacattatttttgccatcataaatcatgactgcaagtagaaacaatttttaaagatgcttagttgacaacagtaccatgtctgcaatatatatttctctagcctggacatcaagcctgactcctcagccacataaaactcacatgaccttggaccagttgcttcacttctctgggactctgttttctcaaaaacaagtgacaatatctcgaactcatgggatggtgggacattagacaaaatgttgtacaggatgatgcctaacccacttcttagttagagtggacaagtagtaaatgccagctcccttagaagaaagcaacgctggccgggcgtggtggctgacacctgtaatcccagcactttgggaggccgaggtgggcggatcatgaggtcaggagattgagaccatcctggctaacatggtgaaaccccgtctctactaaaaatacagaaaaattagctgggcctggtggtggatgcctgtagtcccagctactcgagaggctgaggcaggagaatggcgtgaatctgggaggcggagcttgcagtgagccgagatcgtgctacagcactccagccctggcgaccgagcgagactccatctcaaaaaaacaaaacaaaacaaaaaaacagaagaaagcaaagcttccaatacttacagagctcgtgtggaaaaggtaacctgggtaggtgatggggtcagggtactgatgtgtaattgacctggttttagtttcctagaactgctattaaaaattaccatgagctgggtggcttaagacaacagaaacctattgtctcacagttctggaagctagaagtccaaaatcagggtattggcagggccacgttgtctccaaaagctctagagaagaacccgtcaacttgccttgcctgacttctggtttctgttgacaatcctcagcattccttgccttatggctgcattgccccaatctccactgccatctgcatgtggcctccttccctatgtgtgtatgtatctttgcctccacgagtcgtattgggttagaacccaatatgaccagcctgacctcatcctaatttgatcatttctataaatacttattttcaattaagtgtgacatttacagatatcaggggttaggacttcaacttatctttttaggagacaccattcaacccaaacagacctcaaccctccctttagacacatgagcagttagagcaaggcaggaacccacagggaaaggccccatggtgtgaaggaacaggccaggaccaccctggagacggtgctgcttccatgacatgctagttgggtgaaatgtgtgtgtgtgtgtgtgtgtgtgcgcgtgtgtgtgtgtgcatgtgcatgtgtgtcacctgtgtgtgtgttctcccaactcctcctccttccaatctggaaactcactaagctttttgtatttttctgctctagaaatgtgtgtaggaaaaatagaagaagctgcttgaaatcaaggcttccttccttcctcctttgttttttctaactctaaacttacttaagagagaatgctggggtctggaaggactgggccaagaagggtgtgcttttgaaggctaagatggtgaggagagaggttctcccattttacgaaggtgggaggtatggatctgctggtgccacactcctccgtggcagtacctgaggaggggcaggcccgggggggtttgtgggtggtgcacctgggctggctgggctgtgacaatggctcctagcctgagaaagcagcagcagaatcactagacctaaagggaatgcagcagtgggattcccagagaaaatcacaacagtctgctgaaaccccaggaaactcatagaaccctagggaagagggagctccaacagtgcctaaaatatagtctcagctccctggggactgagggtcagattcaggtttatgtaaagaagagaaataagtgagtatttcttatgtacctgattttgcaacctgatattcaaccctaatccataccttatgtttaaaagaatgtcctacaagtattcaaaggatatagaagcaagccacccaagccccactacctctggcttcagccctttccgaaggatacctccagcactcacatcttccttcagcccccaggatgccctcctgctgggccctgggctgtaattcagggctgtacctcagggatgacttgtggaaacccatgccaaagatggggaaggcagggctaggaactggtggtagctgtagttagttccataggcaggatagacagctagagagagggtttgtgagtgagtgtactaacccctgctcctctgtgacagcctcaataacgataaggtagtgaaaccaggtctgaagcctggaatgctagtgcaagagcttctcccatggacagagatgaggaaaagtctgtatttaggttgacacaaaagtagttgtggtttttgccattactttcaatggcaaataacagtaggtgtgtgtaacattcaattcacagaggtggggtggaggaaatgtctaagccctcgatgcagcaatgcatcctggacttgaaaagcctctctggcctgtcaggacccacagtagaacacctgctgagcagctcgcctttgtaaagcagcatcagtgagctagaagtgggggcaaggtctcaggtggacttggacttccagccccagagattgcaagaaccagaaaacatttagaaaaaccagcattgactaacccctactccaggcagacagttcacactcatgcagacatcctccatttaactctcacactggtccccaagataaagatgtggaaactgggagttgagaccctagggtcactcagctgttgtgtaagattggaatacactgacttgcaaacatgtctatgataacgattttgaaagcaaagaacaggatgttatgagtgagaataaggaggaagtccatctttagacagacggataagggaagattgccttgaggagtcctgtgagctgagacatgaagaaatcagcaaagcgccagatgcagtggctcatgcctgtaatcccagcactttgggaggccgaggcggaaggatcaactgaggtcaggaggtcgagaccagcctggtcaacgtggcaaaactccatctctactaaaaatacaaaagttagccaggcatggcgatgtgcgcctgtagtctcagctacttgggagtctgaggcatgagaatcacttgaacctgggaggtggaggctgcagtgagctgagataacgccacagcactccagcctgggcaacagagcgacactctgtctcaaaaaaaaaaaaaaaaaaaaaaaaagagagagagagacaaccaaagaacgaaagagaaatcaacaaagtgaagaattgagaaaacaaattctggtgagaaggaacaaggaacaatatgtgcaaaggacccgtgccaagaaagaatctgacacatctcaggaactaaaacacaccaggtatgagagaggagaagaaaaggggcccaaagaagacattggatcatgcaggatcttataggccatgacaaggatttcagatttcatcctatgtgccaggggaggccatcagcaggattaagtcccaaaatgacatggaatgagttacccagaccaagtatagcagggagctcgtcatacaaaggggatgggcaaaaagctgtggaacatctgaataaacagactcaaacttgacttccaagatgaggagaactgctggctttacagaaagaaaagcaagatttcagcctatgcccataagaagaacaaacagttttgcctaatccaaattcgctttcatgcctctctgcctaagaggcacacagagctgctgaaatccacaggcgcatcatgacagaataatttcagtgatcattatcaaatgcctctatttagaaaagcccagaagattgtattagcatgatccaatatttatgaaatgacaccctgccataatgaggggctgagaaaattaatattagaagcaaaagccatgtctttggggagagagagtagcatgagtaaaaagacacacttttactcagcttcttagaacttggttttctgatccgtaaaatgggaaggatagtagcaaagaggaaaatacatgatcagttagtaaagcacccaaaggcctttaatcttttttcattcattcctgtattaataaaaacacttaataaagactatttgcccatccacacatccatccaacaaattgctaatttagtacataggatgtctgatgtactgcattaggcactgaagataaagttatgaacaagattctcatggtccccattcacatagaacttctcatctgggagtaaaccatgcactggatgaataacacctgctgtgatgcgtgctactaaggacaagtgcaaggtgcaacgggaaccattacaaagaatgctgacccagactgagatatgaagaggacgcacaagacagtaggtaggggaaaggctccgtggaggatgccaatctcatgtgagttcccgaggcaggagagagtcagaacattctggcaattggcagaagccagtgtaaagtgagcagagtgggatgtggagcatgatgatgatttggaggtttagggaggatcagcactcagagctttggagaccacaacagggctttggtctttcctggagcaatgagaagcctcagaaagccttaagacagaagctgggtagagacaaggaagaaaagaagtaacatgaacatgcttatattctagaataatctcttcgacatctgtttggagaatggattaaagtccaaagagttaagtcaaggagtctgttagaaagttttccacttacccaggaaacagacaatggttgtgttcaccagggcagtggtggcagagatggagaggcttgggcagacccaaactatacttaggaagtaaaatggcagaacaaagtgattgattggaaaagtgggtaagagagagaaaaaagagaaacatggccccccggtttctgaatcagtaccagtagggtgaagtgagctttctggagacgaggaacagtggaaagtgagtagacagggaaggggaaatgggtaaatcaagagttcagttttggagatgttgagcttggagagcctacaacatgctacagggctttaagtggactaaagatgagcagaaagagcatatgtgaatacacacacacccatacacatgcatatgcacacaccgccatatacacacacccatacaaacacacggacacacacacacacctcccatacacccccatacacacacacccatacacccccatacactctcacacatacccatacacatgcacacacaccctccataaacgcacacccatacacacacaacccttacacccccatatgcacacacacacacccccatacacatagacacacacccccatagacatgcatacacacatacaccaatacacccccatacacacacacacacacacataccagtacacaggcatgcacacacaccacacccatacacccccatacacacacacacacgcatacacacacgtatacacactataagatccagatttattgggccactatcaaggagggccatgaagagtagagcagatgtgctatgtttaagcagaggtgtcttggattcttggggtccctaatgggatgggtgattctatcatgtaaaccaggcagtactttttaaagtcagcatgattgggcaacagacagaggttgttccacactgccttgctaataggcatgcacacctgttgatgactttgctcattcaaagtaaggtcccaccagatctgaaatgctcaattttgtaccacagcctaactttattacacctaaggcttgtatcaacacttttgagaaatttatacaattaatgcccttaataggagctatccataaccatccagtgcctcctgttttggagccagactcaaagtgaatgaggccacaccctcacctgggcatctctgagcatcttctttgctcccactttagtagcatcctggaaaaccccgttctccagaggtagccaagatgacatggcagctgggcagtgggttgtgtaggtgtaaaattcctgagacatctaggctggaggcataaatgtcagaatcaccagcacagaggcagtatctgaggccatgggagtggttgaggccaaccacagaaagaacacccagtaagcctgaagaactcttaatactccatggccagagtgcactgacaggggagactgagaaagagcacctgggggattggtgaaaaccaagacaggtgtgggttaaagtgagggagcctttggtcaagcagaaactgtagaaaatggcctcccttctccaacaagcagttgtctttacaactgcagcagggacatgtgattattcagaaaagtgagcttcactttctcagagtcacaactcttcctggcttctatcaccaggtaagcctcttcaagatgcaccttacgcaggtataccccacatttagagtctaagtgttctctctgagaagacctcctttgggtacttcccctgaaacatatcaggtgtacctcacaggcctgccccatgcaggtatccatcaagaattcacactaggccttcagcgctgctggttaaggacaaaaggttggtatttagaatgtcaggatgtttaccttataatacaatatataataataatataataatatataataataatatattatataataatatgaccttataaaaatctgtggaagtatccctaaatatatatataaattatataatatatatactatgtaacatatataatgtataatataatatataaccttataataatctgactgtagaagtctccctaagtatataaaatatatgtaaataatataacacacaataatagataataatatgataatatataacaataatataataatataattaatataaccttataatagtctgtactgttgaagtttccctaaatatatacaacctatgtccatgtggcctggaagaaaagcagcgaccgtaaattcttcagaagctctttccctgacacgccactgtcatcaggctcccaagcaaaacccagtgatacctacttgtagctaaagcttagaatctcgacgctaaaagaaatgctgaatccaggtgacatgtgactagtatcaaatcctgaagaattcattcagccttggtttgaccacctctgagtgtggggaactcactacctacagagctatcgattgccatctcagagagctcaatgtgtaagtaagttcttccccccatgattcacggtaaaaactagccatccccattacagccccaaacatgatggatcacatacctgtgggcactgcctggtccagcattggtttctcccatgtgttaatctgctcccaggtgaacccattggtccctagagccacactataaccacagttgctgtagtgctcatcaaaggaacagccacctgtagacaaaagagatatgggtaaatacattcccgtgtctgaggcttggttcgttacctctgtctcgtcggctcttcatttacagctttgaattttaaactctggagaagattttccatatatatatatatatatataaaagatgagcaaattggatttttatatttgctttggtgctctcaggaaaggcactggcatctgcaggcctccgtatttaaaaaagttaataaggctagttacattgatttcaatcttccttcctgagaaagtaaacagcagcgtctcattctaagtaggaaaaatgaatgcaggggcatgcctctgtaattgctttgtgcagcacggagagatgctgtgaggcagcggaaggagcactcacttcccagtctggcaaaactagacagccatcaccttcacaaggctgtgtgagctcaggccagatgcttcatacctgagcatctccgtttcctcacctatgatacggagggaaatgtccaacctcacagaaataccatgaggaataaatggaataacatgtgaaaagtaactgccacagaatactttctcagtgcccacctgtttctctgtaaaaagcagtctgaaaaatcatttttcatggagtgagaatcgaattggtaagaaattagacaatcatgcacctggaagataataaagtcaatgttgatcatgtttaaagcttctccctttaactttaaaggtcaagccatccaccatttgacaataagttatattcatttgctgttgacaaggattcactgagcatacgctctgagctgtaagtcccatcaaggtgacattgagagagatgtggggtgtacaatggaggctccaactaggaaacactggtctgtccagagaaatgagcccattatattctggaggagaaagcagaagtggaggagaagtgaacagggctttgaaggatgggagcatctccatgggcggagggcaggaggaatggcattctgagttgagcctgcagggtgcacaaatgcagggaggcagaactgggactgagttctacagcagcctcctggctggtctcccagacctgtttcacactccagtccatcttttccaatgtccctttcttgtctctttaatgttcacagggtgcatcacatcaccatcctcctcctttaaacgctcacaggtttcccaccccacagagaaccaatgtctgctatagattaaatgtgtgaatgcctgcaaaattcatgctgaagtttcaaaccccaaagtgatagtattaggacacatggcctttgggaggtgattaggacatgaaggcagactccacatgattgggactgggattgggaccagtgcccttataaagagaccccagagagctatctcgccccttccaccatgtgaggacacaaggagaaggtgccatcaaagaagcaggagctgggccctcaccagatgctgaatctgccaatgtctcgatcttatacttcctagtccccaggactgtgagaaatcaatttctgttgtttataagccactcagtcatggtattttgttatggcagcctaaattgactaagaaaataaacaaacatggctttattcagttcatcccacactagcccggccatgtgctcattaacatcacactattgtctccatcagctgcaaagaaccaaattctttctctgcaccccagacctgagatttcctctggatagtggtggtggacatcctgttgacagatctgacatagaatacagtccaaacaccatggaagaaaacctgtgatagaaaagctttctccactttcctttcttgttggatatggacacccagaagagctggccttcagcaactactatggtccaaatgtgcgtgttccccttaaattcatatgttgaagcctaatccccaatgtaatagtattaggtggagcctttgggagatgcttccaaaggactgtgagggctctgttctcagaaatgagatcgcacccttataaaagatgccctaggcaaatcgttcaccccttctgccatgtgcggactcatagaaggtgccatctataaggaagggacctttaccaagtaccaaatctgctatcaccttgatcttgaacttgccaacccccagaactatgagcaataactttctattttttaaataacccagtttaaggcattttgttataacagccgaaatggattaagacagcaccccactgagtatctctactctgtagaggaaagccacccagagactcgcctgaccaggaatatcagcattcaacttttcaggagcaaaatataaacttttcttgtcatatgccactgagatcttagggtttaactgttagcaccgtagagctttgtacaacctgactaatatataaagtgtgtcatacctcaacacagtgatccaaagaaagaaagaagaagcatattctcccaagcatttgctctgtgttgggcaacatattcgacaccgattacatatactatctcattagctgtcatgtaatcctcacaaaccacatgaggtacattttatctcaactttaaatctaagagaattgatgcactgaggggataaatgacctgctcaggcaacatggaaggaaagtgttggagccaatattaaatccatggcagcatagctgtagagcccatgcccatcctaatagaccagagagagaattattcccccaaaccaaggataaggtctttcacttataaggtaataagaggggccaggcagataaagaacttccaaggtggttgggcctctccattcaaatccattccttcacttattctagaaacattcaacaagtttttttaatgggctctggacatggcacagaattgacagatatgatccttaccctcacaaagtttgcagaatagagtgaaaggtaagcatgcaaatatacactgaagatgcaatggaaaatatgctttcttatgtatgtgttgatgctaaaaaaaacaagttattattttagttgatggtttaattaaccaaattctcttccttcttctagataagatttaagaaggctcacagctatacctctaggcatcccaggttacagatcccaggcaaggtcacattaacacttgcccctagtccgttggatccattgcccacccctcacctccctgcctctgcttaactgtaggtagacactcagctgatactgagctgactgctgacaggtcctggccctctgaggactagggatgtacctcctcttcacaggcactcactgaaccaccttgcttctcccctctgctgagctctgttggtcacttcaatctgcagcaggtaagcaaatgcttttcccttcttacagtctgctctttgaaactagggttccacagcagcaggccttggacctcagtgacccaatttttattttcaaaccacagtcctctctttgcctctgcagaagaactcacttagagtgaatttaaaagcagctttccactctatcttgagccactatttcttcagaatattcaggccccactgtcaattctattccactctgccaggatttgtcatcacttatgggatgacttatgcattcaggacagaaaatggggaccgtaaggtcactctggggaccttaatgtccctcctacagaagagtttctagaaatgggctcctgttctgcacttttatcactcatacatgtctgaatcccagcaatacacacagttcatgattcttccatggagcccttgggctcccagcaaagcagggaatttcaaggaatgctgcctaactggtcactggtccaaccaaagcagcaggttaaacatagaaggaggaaatactgcatgatgacaaaaatcaaattgaggacaggaaaagaaagaaaagcaggacagaaggagggagccacaaatctatgctgcgattttccacgtgttcctttactaaaagggggttacatatatagctctgagcttctgacacccaatagaaaaaaagcaaaacctggtaaggtactggacactctgtgtttttataataaaagccaaattgctcagggaaatgacaaccatttcaggtgctttgatcagacaagaatttctctgcaggaatactcataacagaaaccccatatcccataatgaaacaacatctgcacaaggggctgaatggccaatttcatgagactgtttctcatcatcattctcaatataaattgatagcatcacctaaacacacaattcagtaaaagctcattggggcccaacgcaatgcagtctggatacccactccctattggtctgacttgactcaaaggtaagttttaagaactattcaggggagatttttaggcaacttttatgagttttctgtctcccacattgagaaacagagtggctatgaactcaagactacataacccaatagcaactgacactgacatctgggtacaacctgttgggctcatatcccttccctgtttctgagccttcattttctgctgtgcaaggcaaagggctgaacaagatgattgcaatgaaccttccacttgtaacatttaagaaatccagagattcagaaagaactggaactctcagaaaccacagagatacagacccatgcagtcagcacaagtacaggctagggtgtcctgccactgagagccaccaagaggaggaggagaaattaaagccaagcttcccctggaccgagaacagaaaacatttaaacccagtaacatctatctgtcttggagcaattcctagtggccataaccaaaacaggccccagacgttgctgcaggtgtttatggcagcttaggggagatttatggttccagagagtccctgatacagtttggctgtgtccccactcaaatctcatcctgaattgtagctcccataattcccatgtgttgtgggagggacctggtgggagataattgaatcataggggtggtttcccccatactgttctcctggtagtaagtctcgcaagatctgatgatttttaaggggtttcccctttcgcttggctctcattctttcttgtctgccaccatgtaagatgtgcctttcaccttccaccatgattgtgccgcctccccagccacatggaactgtgaatccactaaacctgtttctttataaattacccagtcttggctatgtctttatcagcagtgtgaaaacggactaatacagtccccaaagacactcatctggatgctaacctcattcaggtttgaagagcagatgacatcatttaagtgatctcgacctcaccacaatcatttttgggaggaaggaaacccaaaaaatctacccccatcccaggagctgggctcagctgaggtttggtgaagatccacataattgggggaggacagggaagtgcagccactggccaaggacccagcacctccccagaggagctatttccctgggcaggctgaggtcaaaatgtggcaatggccccagatgctctgatgtgaatcagacataaaaagtcaacagagaaatggaaaactgtagcaaggaaattggattttgaaaatccatttgggtttggtagtgtatagcatatcagcatctgtaagggaagtaaaaatagtgcaggatacatactttaggatacattaaagcataaataaagtttatagtgtcaatcagaatttttttaaaaaacatgagctcttcttttgaaaatgagagaggaatagaattcaataaaaatataaatgtgtcttcctctgcatttcttagatatgatcctgtgtattcttgagctgaattaagttttgtagaggaactaaaagattcgttgggctcccactgtgtgccaggcactgtatttgaactatgtaggtgtatgtgtatatctgtatatatattaacgtagatgtaggtgactcaaacaccaccactctctaagacaggagtcatcaaacattttccataaaagactagacagtaaatattttcagctctgtagtcacacagcctctgtcacaactactcagttctaccactgcagtgcaaaaatatgtaaataaatgagtgtggctgtgttccaataaaactttatttgcaagaggtgacagcctagatttgcccaggggctatagtttgccaacccttgctctaagaaagaagtattgctttcttctttgtataaatgaaaacttgtcatcagagctcctaaggaacttacccagcgagggaaaaacaatgacatcatgtacagcagtactaatagcaacacctccttttattcacagttgaatgtaatggaggctttacctacagtatctaaccctcaccacaagccctgccattttgattgtaccattttatagatgatgtatcaaactcacccacatgaaggaatggagccaagatgtgagccctagactggatggtaccaaagcctgggtactttccattgctccaacccagcattcttttgaacactctgtgtgttcacagaatctggtctcaccatgatgcttccagaatagaaagatgttcttttaatatccagcagtggagctaagtaaaaaaaaaaaaaagaaaactgggctaaacctaaaaaaggtggaaaattgcctttacttgccctccgtggtaggcactacttttggtagagctcatcattttgatgaacgtggctggagattaaggtgatctgccatggatgaggatacgcagaaacacctgctccctgatccatagctggtgctgaaagtcctagtagctcactccacatacattctcatgattcttgggggagacgtcagcactggggaccctggggtgggggaagggactgagaccacaggactgcgtccctccaactaaagctccatagcaacagggacatgccacaagggtctctttcctcagagtctgtcccatagtatatgcttgcactttattgttcagtgaatgcctgaatatattaaaaaggacctccattcacgtagaggagccaggctggggcccacagagaaagctctcatccactgtcattgggcttctcctgggggccacggtgaacccaggggaggccttgcaggggagtaagagcgaagaactcagaaatcaggctgggacctttaagaaactaccatcagagtgaacaggcaacctacaaaatgggagaaaattttcgcaacctactcatctgacaaagggctaatatccagaatctacaatgaactcaaacaaatttacaagaaaaaaacaaccccatcacaaagtggccaaaggatatgaacagacacttctcaaaagaagacgtttatgcagccaaaagacacatgaaaaaatgctcatcatcactggccatcagagaaatgcaaatcaaaaccacaatgagataccatctcataccagttagaatggctatcattaaaaagtcaggaaataacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaacgatagactggattaaggaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggtggggggagtggggagggatagcattaggagatatacctaatgctaaatgacgagttaatgggtgccacacacctgcatggcatatgtatacatatgtaacaaacctgcacattgtgcacatgtaccctaaaacttaaggtataataataataaaaaattaaaaattaaaaaattaaaaaaaaaagaacatttgctctgatcacatgaagggccaaaacagatggagattctgaatccgagaaagaagggaagtccaaggttgatctaaggaagcgccataaggccaccaggaaatggagaagagtaagttgagaccacggacaggtggagaagtcattcaaggagaaatgagagtatttgcgagaggaccagaatgacagctgagactgctaaggagtaaactgtgagctgagcttgataacggtttgcaaggaccaagtaatcacaatgcaaggtcaaagagacggggacagaaagctgctgagcagacacagatcccaactagatctgagagatagtcaagataaccatgtccagtgcccagcactgttctcagtgttcaccagtagtaactcatttaattatcccaatcaccccacgagatggatatgatcattaaccccaattttatagacaaagaaatgaaggcatagaaaggttaaaaaaaaaaactatcccaagatcacacaaataacaggtggcaaagcgtggctttgaacccagactagctcagtctatgtacctactcattatactaggttgccatggtgatgaactgaaaagataaccttgacctcgaaaggaacctgttgagggaaataagtggctgcacagttcttccccaatccctgtaaaatggcattcagccagtctgcatgccttctgcccccattcactgcccaggcccaggatgccaatctgcacttctggaggaccaggcatagggggtaggctctgccccttcacctcataacggaggccatagtgttatagggaggagaagaaatggagtagggggcttaaagtcaggaaggcaggcacatgcagagaacagggggtggtgtgggcctcacatagtaatcgctggtatgtgaagagctcacacatgtgagctgttcagacagattcaagatgtagcaagaataaatggttacagggcacagaaaaataatgtggtcaaagcagttattttttaactggggggttgttaaactttttctataaaaggctagatagtaaatattttcagctttgcaggttgtattagcctgctagggctgctgtaaaaaaatgccacaaactgtgtgacttaaacaatagacatttatttttacacagttctggaggccaggaatctcagaccaaagttgggcagggtcaggtgagggcttgcttcctggctggcagatggccgccttctcactgtgtcctcacacagcctttccttggtgcctgtgtactctgatgcatcttcccagcccaatggaactaaggtctcatgcatataacctcatttaaccttcttataggccttgtctccaaacacagtcacatggggagacatcgcaaaattccttcacctttgtcattcactaagataagctaatcaagacagtgaaatccatcacatgcacagtccacgcaaggagtgggaagtactcaggatgtgtaccccagaggccaggaatcttgggggctgtcttagaatcccacccatcacagggggccacatgttccctgtcactagtactcaacaatgttattgttgtacagaaacaatacaaaaagaatgggcatgactgtgttctaataagactttatttattagcactgcatgttgcatttcatatgattttcacatgtcccaaaatagtattcttcttttgattcctaaccatttaaaaatgtaaaaaccattccttatttgtgggctatataaaaaccagtgaacactcagatttggctggtaggctatagctggctgacttctctttaacgacataaaaattcccagttttagcagtcactgaattttaatacagtcccgtgtattgccatttgaatgtatgccatgtgctactgaccctctcctccaaagactcgattgcagaatgtttcttcccgtctctgggaactggagggaggaacacgtctcccattgtctgctagccctacggataagggattgagtaaagaacactagctctttagatttaattaaacacttcatctacactacaagcttgtgttcttcattggtaaggagtagtacttccactttatagataaggaaactgaggcaggagtggatgatgcactcagcgtcagatcagggactgagccaagactccaatcatgggtttgtttcttggccagaaggtctgacaaccaaggcgacctccaagataggtccacctacaaaatttggagcgccccttgcaagactaaaatgcagagtctcttcttcaaaattaagaaatcaagatggtgccaggcgcgatggctcatgcctgtaatcccagcactttgggaggcctaggcgggtggatctcctgaggctggagtttgagaccagcctggccaacatggtgaaatcccgtcttcactaaaaatacaaaattagccaggcgtggtggcgcatgcctgtaattccagctactcgggaggctgacacaggagaatcgcttgaacctgggaggcggaggttgtggtgagccgagatcatgccattgcactccaatctaagcaacatgagcacaactccgtctcaaaaaaaaaaaaaaaaaaaatagaaatcaagatggtgatagcagagcattaaaccaagcacgggctcttctcttctgagttccagggcctgtatgactcagtgcccttgaagccaatcctgctctgtggacacatattccaaagataaaatacctcaacccccaaatcatggagattccaccctcgtgccaacaaatgctttgaaggcagggtaatatctaagtggggcttattaattgtgaacaccctatcgtgggtagctgattcttgcccccggaatgaatgtaaaccagccttccataaattgaattccttttctgaatatataattgaatttggagaagtgtgtgccgggggggtgtttaaataagtgcacaaatatggtaagaaggccttcacaccattacatctaattcagtaagcaaaaataatggcagggcacgttccaattagtgtttgatttatttgctttaacaaatccaattagtagaatgttttataaagtcatccaatgtcatacattcatggactcaacagatacaaacaatactcctaatataaaaaaaagttttaaagctctttgagcagtgaatttattataaataagatgatgtctctctgatggctcgagcattccccaaggaccaagaaaacagtgtctgatctgttcatttggttctttttctgtgagactttgtgcagcaactcaggttaatgtggcccattatattaaatccaggaatgaaaacaacaaaggtggaagttagccaaggaacttcaagggagaataatgaacttgctgctgggtgtcttctagatcagagacgtgtttcgacttccaaggcagcacagtacagtgggaaaagcccaggggtaacagaaacggcggtgccctagaaccaaatctgatgccttcatgcccttttgggtctccagttttctcacatattaaataaagagttcaatgaggttaagcagcccccagaaatgcccaccttgggtggtggatgatgttctttgcccagggagacacagaacaaggtagcagttaaagctatgaactccagagccagcatctaagctctgctatttttttttacttagttatatgaccttggccaacttatgtaacttctatgtgcttcatttctccatctgtaaaactaggataatagtgcctaactcttaaggctgttatgaggattgggtaatttaatatttgtaaacacttggaatagtacctggcacgtagtcagtgccaagttgtgtgttaaattaatatttaatcccaatctataaattagaaatggaaaaggcagatgtattacatgtggtcagctggcataatctcaccaaacaaacaaaatgttttaaagaaactgtatctgagtctgcccatcatatcccttatagatcatcagggctaattgtggtatgctattggtctgcatgggaaatcccagcttctgtcaccccttactactgtgtgactttgaataagtcatgtagactctagggccagcatttctccatgtgtgacagaagcagcaagttgaaccctctccgagaacctttttgttgctgttgttaagagacggggtcttgctctgtcacccaggctggagtgcagtgtcatatcatagctcacttgaagcctggaactcctgggctcaagcaatcctcctgtgccagcctcccaagtagctaggactacaggcatgtaccaccaaacttggctaatttttaaattttttgtagagatgggttcttcctatgtgctcaggctggtctcaaactgctggccctaagtgatcctccctcctgggccttccaaagcactgggattataggcactgtcccccaccttctaagaatcctttgacttctgacatcctatgggactacaattatgtcctcccttcatggtacctagctacatttgctgggacacaaaaagtaccaagagttccctgaaaataagagcctctgttcagaccatcttctctacatggtctgctatgggcctctgcctggtgcatttgtacattatgaaaaaagaacatcatggggtatggcaagcagattctgtcttctcacgggccccagccttcccaggcaccagtttgtgagcagacactgtgagatgcactgtgaccaaggagaaagtgcgatgaaagaaggaggccctctgttgggtcagcgccagcctcaacctgccgaggagaggctgagagaacagggggagagaacagtcaccttcagttgaaacgagtgaagatgcttcaagttggaggccagctggagagtccaaccagcctgaaaagtggtcccgcccaacccagtgagtcttctttcccaaaaacagcatgggagcagatgcagggattccaatgctctatcaaatttaaagagagaagggacggtctggcccagctgctaattttacaggtggacaaacaggcataaaaagggcaaggctacaaagaaagggggccccagcccagagctctgcccactcagatgccagaatagcatctttcatcttttctcacgcaacagtgctatcttttccatttttattttgagggagcagcgaaagaaacagatggccatgggtcatcccccgtctcagagaaacttcagatcagtcgggaaaaggtgaggaaaggttttctcgacacagaaggacaggcttaaactggttcctggcagctgtgtcagcgtctgaagcctgcagaagcccaagccaagctcttcacggtctcagggtcttggcacttgctgttcccccatggaacactcttgccctagcacgtgatgtggctgtctctgggcatcttccacatcaaaaatcaaatgcaaaacagcctcctcccttcttcagtcattctctatcataccaccttgtttatgcttgacgaggctgtttctcaaacgctttagttacattctaaaattgtttatttactcatttacttattttctgtcttcccactaccagcctaagtctaccagggcaggaagtgtgcatcccttttattcactagactcatcaaagagcctagtactttaactcttgagagcttgagggaaactctttaaatgctcatgaatgaatgaatgaaatagaatatgatgaagtgtcagaagcacaagatttggtatcagaggatgatgcatggcttggttatggcactttctttgtgactttggatgagtcagaagaaaatttctgagcctccacttcctcatctttaaaatgggaacaataatgatagcagcttgcatgtactgggaactatgtgctatgcaccgtgctagtccatttccatggattacctcattcaatcctcaaaagagccccatgagttaggtactgtcactatccacactttatgcaagatgaaaccaagagttaaataacatcacccaaatatcacagctgggaaatggccagagatattccgcaaagcattgcaacaggcaaattgccctgtaaatccatcaaagtgggggtgaggtcacattctgagagtcacagactagcaggtggtagaagaaaattctgagattggttcatctcaaagcccagcttggctcaagctaagttatattcacagagccagggggctaaacccaggtccttcccattcagtcaggtgtgtgtgaggccccttcctcagtaataagttataatcagctgtcttcaggtgctatctcttgagtggtccctgatggtgagcaggcagagactcctagcaaacatggatgcctggcttgtccccggtatgaatgcccaagtcctgtcatctctctacccctttccagcacttcctttcatcacagccacatccttgagttctgactggctaaaatcttgcttcagttcaccatgtcccccatcacacttcattcccgtagcatcaaaagtggtaatgccacccagagcccatatcacatagaagacaggagatgaaatctgcatggtgggccctcctcagtttcttcatccatgaaatgtggataataatagtacattgttgggagaaaagctgagtgttgggagaagctgaggcagggcttgcatgtctgacatactgtaaaagagtcttggaacatgtccggggtccagggtctaaaacccctcgtggcctttggaacaccaagctctgtgctaaagggtagaagcctaccctgaagcaccataacctaagcccagggcataaaacccctcgtggcttggaaagaatccagggctcaaggcataaaacccctcgtggcctctggaatgtgtctagacttgctggctccttgctctcccaggactgattgtatcttgagttaaaagaacctgctctccactatctcaagcagcagaacatgttccatatgctgcaaaggaaatgctaagccgtcacagctgtagatcatgcacttgccctttcgacccccacattctcaacacctgtttctctgtttgatcaccaataaatagtctgggcttccagagcttggggtctttgcagcctccatacttgcgttggccccctggacacactttctctctcaaactgtcttttctcattcctctgactccaccggacttcatcaccctcacgacctggtgttgggtctgtccaccccaaaagtacattcctgataagctgtcatgaggattaaataacatgtaagacagcacagtgcctggcacatagcaagctctcaacaaacattagtaattattactcccatcacagaatgtcatacacacacacacacccttctttataaacataaatttaaaagaagaaatgaaacacttgtgtatgtccacactgataaatttctacacttagatactcaatgacatatacttaacacccgcaatcccatacctgtctctgtggaagctcctggcacgtcccccacggtctctgtcttgtttagggaaccagtttgtgtcttctgttctggcttgccacgattgctagaatacatcgacttgaccacagtggtagcacagttctgtgtaagaaacaccaaccccacaagacccccatgggctgcttcatgccccctcctctctgggtgtcactcctcctgccccattaaggaaaggaagcagaaaaataaatagagaaaccaatgtctttctccaaatcaggaagttttaacacagagtacagcaaagtatgacctatgaactagaaacctagcctgcctcctgtttgtgtaaataaagttttattgaaacacagccatgtttatttgcctacatatcatctacggctgcttcccagctacagcagcagagttgagtagctgtgatggagaccacatggtctgtaaagactgaaatatttactatctagcctttgatggaaaaagtttactcattcttccttccaaaggcctgaaggcaatctaatagctgtcacccagggcatgcaggaaaccaggagatggatgacggcagcttatttttgctagtcccaaaagttgctaccactacaggaacatctggctttctaaaaacctcttcttctgaaagtgacttatttttaacatacaatttttttcagaggaaacaaaaaaaggaaaagaactaaggtccagagcctctgttggcaggcctcccccagcaagttccacttcctggaacagtgagtacactgtcctgatggctcaaggtcagtagagtcacatggtccacacatggctctctgtggaactctggagtgccctttgaccccactccacatctcagctccattagtgacctggcttaaagcagctcaggagagacagaagccaggtgctcccaccttggcccagtgaggatcagagggaggagaagacaccggtaatccccagaagagaacatcctgatgtcatgcaaagctttctcaagttctaccctgggaaaatcagcctttggtgcccactcaataatccggaaccattagatgccaggtactttccaaccactgccttattttgtccttagagaagccctgtgagttgttctttaggattcaagacaagattttgcaaaattggaacctgaggctcagagaggttaagtcacttctgcaaggctgcacagcttataaaggacagagtcgggattagaattactttcaacttgatcccaaagcacaaacctgctcaactttatgataatgtctcttgcatgaaattcccactcctccttattaccctcgctgaatttattcaacccatatctggatttcattcattaatgctagatcaagtgtctggtgtatgctagacattattctagctatcagggataaagcagtgattgaaagctatgacctctttctccatggagctcacatactagtaggggagatcaacaatgaaaacagggagagaagtaaagcaggtaaggggcccatctcggctcttgacatgacataatgccttgaagatgttaggcatgcaataaacatgtgcctaaggtgggtatggaaatggatccttattgagcagctaatctttgctaggcatcaggccagacattccatgtaatcttacttaatcttaacaaccatcttgtaatccaagaattaatcatcaccattttaaagataaataaactgaaaatccagcaagttaagaatccaatccatattccctacagttgtggattctgactgttttccttctccaaaagccatcatctttctgctgcaaaatgctatgcatgcagaagcccaaggaacatttaggactggctgacagatattggtttatgtacccagtttttataagtatattaacatttaattacatcaagtaaagactagggttccatacagtcaattaaactcgataatagcatccggcgttctataaatcaccaaactggtaattgtgtagataaaatattattgcggtctgagtattatcataagtacagttggttgtcagaagtcctctcaaaacagtgaagctttggcaatttagtctgtagttgccagttggactccgtgtaccttggccgttaagtgtgcattaattgtaggatggaaggtttttaaggacagaatacaaagaagcctcaactaagctaaagctgaaattatttggataccaagattgggtcaagccaaagggaatggtggattcagcatgttttgagatcacaaggatggtgatggtgtcttgggtagatgtaattacagctgaactagcacgtcacccagttaaatcagcaagccttctgctcttcctctctaatgttgacactttgtttccctggataggtgaatctcaccaagaaggaagtgtacacaaaggagaagcaggcactctcctagcaattacaggaagtggtctttgatgaatttcaaagagagatggtagggcagtcactaaggttcctaagcaaaaaaacagaccatctacctcaaagctgtctcatctctacctctctgatgcccgggagttcatgtgcatccaggatacataaacatgtttctcctctttggaacaagcactcagcaacttccagctctacgcacatttttttttaatctgcaaaggaccaatgcagatgatcctatgagagcagcctctgccaacctcactccacctcaggctaaaactctttgaaacagaagtgaacttctaacgaagctgcaacttgctaaatcacatagtaactcggggcctgacaggacaccacaggcaggtggtcttgaagattgaggatttgcctgagagaaaggagtcctgcatcaaagacttggctcttcctccagctggttgcatgaccttggctgagtcactttctgtttaaaatggatctggctggaagctcttgacagtctaccacagtaccaaggcaatgcccataacaacagtggaagaggtgaaaaccttccacagaattgaaaacaaggtcttgatacgggaagggggcagggaagtgctgggaagagaagggtgggtccctggctagggctccaccccatggacctaggtgaggacaggcatttctgttttcatgcccaaatgttgcacttcccaagaccaccctggcccaccacacccccatcctgtgcctataaaaaccccgagactccagaaataacaccacacatctacaaccatctgatctttgacaaacctgacagaaacaagaaatggggaaaggatcccctatttaataaatggtgctgggaaaactggctagccatatgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgactgaaacaccaaaagcaatggcaacaaaagccaaaatagacaaatgggatctaattaaactaaagagcttctggacagcaaaagaaactaccatcagagtgaacaggcacctacagaatgggagaaaattttcacaatctacccatctgacaaagggctaatatccagaatctaaaaagaactcaaacaaatttacaagaaaataacaaacaaccccatcaaaaagtggccaaaggatatggccagacacttatcaaaagaagacatctatgcagccaacagacacatgaaaaaatgctcatcatcactggtcatcagagaaatgcaaatcaaaaccacaatgacataccatctcacaccagttagaatggccatcattaaaaagtcgggaaacaacagatgccggagaggatgtggagaaataggaacacttttacactgttggtgggagtgtaaattagttcaaccattgtggaagacagtgtggcgattcctcaaggatctagaactagaaataccatttgacccagccatcccattactgggtacatacccagaggattataaatcatgctactataaagacacatgcacacatatgtttattgtggcactattcgcaatagcaaagacttgaaaccaacccaaatgtccatcaatgatagactggattaagaaactgtggcacatatacaccatggaatactatgcagccataaaaaaggatgagttcatgtcctttgtagggtcatggatgaagctagaaaccatcattctcagcaaattaacacaggaacagaaaaccaaacaccgcatactctcactcataggtgggaattgaacaatgagatcatttggacacagagcagggaacatcacacactggggcctgtcggggggtagggggctgggggagggacagcattaggagaaatacctaatgtaaatgatgagttgatgggtgcagcaaaccaacaaggcacatgtatacctatgtatcgaacctgcacgttgtgcacatacttaaagtatatatatataaaaaaaagaaccaaaacaaaaacaaaaacccgagaccacagcaggcagaaacacacaagctgctggacgtccagaggaacacatcagcagaagaacccacaagcgtctggacatcaagaggaacacatcagaggaagaagacacaagtagctggacgtcaaaaggagcatgctggcagaagaccacactggcagacaccagcagatgctggaggctgaccgtcaaaatgacacagaatttggccggggcggtcagaggggagcacagccgctgagtggcccggctccagggggaaagccacgttcccactccatctccctcatggctccctcatctgctgaaagctacttccactcaataaaaccttgcactttttctccaagcccacatgtgatccgattcttccagtatatcaaggcaagaaactctcaggatacagaaagccctctgtccttgcaataaggcagggggtctagttgagctgactaacacaagccacctacagatggctaaactaaaagagcacatgcccactgaggcttcagttgtaaacattcatccctagatgctgctgtgagaccagagccctacagcctacccatctgcatgcttccctagaggtttgagcagcagggcactgaagaagtgagccacacccccatcacacaccctgtgagggggacaggggaacttttcccgtttcagtctcacaataaaactattcacctgcatctggaggaaactaaaatggattttaaaatgcaaatgacagactacctctgttacactcttgttctaatctggaaaaaaaaaaatgtgaaacctcatctgcctggaattaactagataaaccatgtgtttcctccatactgtcaacccccaagttcaaaattaccgcatctaacaaagagcacaccatgtcacaggccccctaatataacacctggtttaggcaccgggagtctctctcttccttacaacctactacctacagtcagaaaatgtaacagtgaggggaaaaaataagaattattatgagtaaatgaaaaaaatgaatacagtaggaaagaaaaagaaatcatcataaacatttaaaaagaagacctctgaaaatgatccactgaaagaacccgaagaacgctttaaatagtgtgaagtgtcctaaataggagacaaagagatgcagccctttgtgaaacaagaagagaaagccacacagagaccccaataacctgaaaaaacaatcggattaggagacagatccgtgtgttcataaaggatctcagggaaagtaaaaatgcaaaaagcagaatccatatcagtgtatcaaaccctccaacctcaacgttgactggaatgaagaaaaggaagcaaaagtaacaaagaaaccacaaacattgaagtttttttttaatgtttttctcattgacttggaggacgcgacacaatttgggcccacccaaaatgccacgaatttatacactacacaactcgttcttaacagagttgtacagtatgagatgaagtggaggaatttcggaaaacccagcagtatccgccagctggcatgtcaggggccgtggcgtgagagagctacaaaaaagatgaaggatgctcaacctgggtgtccttcagcctcttgcatcaacagtacttgaagtcattagtttgttattgtccttgtttcccatctaattcagatctctcagaggccctgggaacttctctcatccaggagagccccataactggaagggtacaagtgggggcagagtgaaaatagtaagaaatggcaaaatgattttccaggtgccccaaaacagcccaccaaacagaaataaaccatcatgattgtgcaactttcctccaggggctgacacaccctgaagccaatgaaagagaagttcctgggtaccccaccaagcataagaacccttcgggaagaggtaacagtctgaaagtcggtgaagtactggtggcagagtagccccccatgtcttctagggctccagccattaggagctgcaactgcgctaaggcagaaagaagcaaagctcacatcccaaacacgacccaccgggaaggcagcaagagaacgggggataagcatcttgaagacactgatgtccagcccacgaccatgtgaccttggacaagtcacttaacctctcccagtttcaatttcctcatctaagaagataataataatagccacccagaagcacgtctgaatttttatagcccgaatcttaaacaccttagggagggagcattctttaaggaaaatagtacaaacttagaaaagagactatctgacatgagaaaataattcacaacaaataataaattcctaacaaccagcaaataccacaaacactgtacaatccagaaaaataatatttttataaattatctttctaacaatattctcccctacatttctggacatattttctgggatgatctctttatgacaataattttgcaatatcattttttatagagagactagaaacttcagtgtcccctctagcaggttaatatttattattattaatatttttaaagtctccttcaagttcacaagtcattgtttatatagagtcatgtaaactttaaggctgtggtcaagtttggagaaatctctatcaaatttctttcatgtgtatgctatactatttcagggtattataagtgtgattgtccactgagtaatcaaatagtctttgaattcatgacattaggcatatttatggaagccatttccacactagggtagctagtattggtttaattatacacaaggaaatacaggatggtgccagggctcatgtttataatcccagcactttgagaggccaaggcaggagaatcacttgaggccaggagttagagaccagcctgggcaacatagcagatcccatctataaacaaaataaaaaattagctgggagtggtggcatgtacctgtagtcccagccacttgggaagctgaggtggaaggatcacttgaacccaggagtttgaggcctcagtgagcgatgatcttgccactgcacttcagtctgggcgacagagcaagaccctgtctctaaaagtaagtaaatacatacatatatacatacatacataaaagagaaatatctatgtgtgtatgtatcctatcatctatcattgctctattgatctagctatctatattctattaacccaagcttgacttcaacttctgcttacccagatttctaaaatgccctgcatactccaaaactgccacctcccacccctcacccctaaaaggacattatgatgaaggggaagttggagtggaatcataatagtcttcgccaattgtggttaaaattatcttacttctaatcattttataaaatatacaactatctgaacatattgcacacagcccttcctcgggccttggaagggtaacacaatggggatagactgtgaagcttaagcttcgtagctccacaggtacagggctttgaaattctcccacagatacacaagagggtgtggcatgtgcctggctctggcagtgatggatgtcctcatctgtagccatgccacatgtctgatggaggcacctgagacccatccagcatttaccaacctctactgcacctgtaaagctgtgtgtctcacctttctaacatcagacctcaggcaggagatgggctgggccttgggggaccagatcaccattattcacttgctttcacacaagcatgttggatttcaccttggggagaaaaaacattcaacaaccgggccagaaaacactgctattgtcgacagctctagcaaaacactgtaattcagacttttcctagtttgttaaaatttgctgatgccaatcggtatttcagagtctcgttaattttctcattactctcctattcttttctccctagcagcttcttccacgcctcaatcacacctttgaatcttttacagggacaccataaagctggttactttatccccttccatccctgcagcttgtttggctgcagatatatttcacatgaagccccaggccacatcagatgacagcccaaaccgcagcccccaaagaccatccagaaatcctgctgcacgcttgggagttcaaaactgttttgattcggattcacaagaatcaccctgatttcctcctatgagtttttacataaatttctcaccgcagcttctctacaaccctggaaggctcctccaggcaagccctgagaatagagctgtgccgcggttggccatatccatgtaccaggaatttgttgggaaacagcaaccagctcagtggtagaatcaatgaaaatttttatatcctcctttatcatttcctattttggggggaaaaactatgtaagatagggaaactctgttgtctagccattactgaaatcttaggagaaatgatgttgacaggatgagcttaaaggaaattcattccactggacttcccccaagtaatcgacagctggctatggggtcaaactaaacagatcactgagagtcacatacttgatctcagccatacattgctgtgagcctctagggaacccctttttctccacgcagccttggtgcccacaagagcatcataagagacaaacacacaaaataagggtgaaatcaaggttgaggtgattacggaacacaaaatcttctttgaaatgactttcaaaagaacattgtattagtctgtttttatactgctataaagaactgcccaagaatgggtaatttataaaggacagaggtttaatggactcacaattcagcatggctggggaggcctcaaaaaacttataatcatggtggaaggcaaagaggaaacaaggcaccttcttcacaaggcagcaggaaggagaagtgccgagcaatgaggggaagagccccttataaaaccatcagatctcgtgagaacttgctcactatcaggagagcagcatgggggaaactgcccccatgattcaattacctccacctggtctctcccttgacacatggggattatggggattataagatgagatttgggtgaggtcacaaagcctaaccataggaaacactttttttttaaatcatggtgactctcttaagaatctaatatatttatcttatatgctttgtgtgtcttagtacacacacagacagacaaagacacatacaacctcatagaatttcttagaggaattcaagtaagatgccaaacatgtagaaccaagaaaaacgtctggcacattttaagagctaaatatatactagctattattattattaggaatacagtacctataaaatgtattcataatttaacaacacacattttaacaagccataactattgacagatattaactagtaattattctgattaccctaaagtgacaaatactccaaatgcctactggcaccagtgcatttgacagcattgcattttttggtgtagttaacatctggaaaatgtatacattatctaggggcatcctccatatatttatttatatataaatctatgcacatgaatctgtatgcatgcatatgtcaggtttattcatttcaatctaattgcaaaaataacacatttttctccaaataatttgaggaaaatttaaaaacacaatcccctctaaaccgcatttttccaggagttgccactgttcatactgtgatctatggcttttgagactttttttccaacaacagatatgcacatatattttccaaagaacatttggaaccagaatgaacataaatctttgcaacctgcttttaaagtacattacagtatcagaaatattttcctagtttactaaatgttcttctaaaacccaattttaatggttgccatcctgcatgctgttaatttactaacccaaatcctcttttcttttttttttttttttttgctttcaaattttactacttataaggcaaggtaataaaccctaggaaatatccacatttatttccttgggataagattctaaaagctgcacttctaaggtcaaagggcaagcacaaattatatatacagtcaaaccatcttccaggacagttgttgcaattaacactactatctgcaatgtataagactgttcattttccttgcatcctcactagtactaagtatcatcactgtttttaatcattgtcatttgtcattttaattggtgaactgcagaggcccattagtttaattttaacttatttgaatattaggtgaggttgaatgttttttataagttcaactggccatttggcatttcctcatttgtaaactgcctggttatgcccttcactcattttatgattggactatttatccattctaatttgtaagtgttcttaatttagtaaacacattaacttattatctacattttcagttataaacatttctctagtttcttttaacctcttaattatttttggtacatgtacattgttgagtataaatacaaatcatttcccactctggtagaaatgcctacatagagtatcagatacttgcgtatcatactacagaagaaataaatattcacctgtatcattcttgatccttttgttaaattatgaatacatttaaatattgacttcctctagaaataagtttaatgcatgacatagtgtaagaatctaactttattttactttttaaaacactttcactattgtttcagcatcattaaaattatccatctactcccggatgtcctatatgaaatgcttataaatacatggctctatttctgagctttctattctgttccactgatctatgtgcctaaatatatcagtatcaacatgttgtaattattatggatctgaacatggcataattaatgctagtgctagagactagctcaggaaacagacaacctgagtttaaatgcctatcctacctcttactacggatggccttgggaaagtttgccaatgtctctgtgccttagtctctccatcagtaaaatagaaacaatcatctcttctttacaaaattgctgtaaaaattaaaacgactgtatggatacaaagtgcttaaaaaggtaccttacacagaatgaacactgaataaatgttatgctatatccatttctgaggagtgttataacaaagtgccacagactgggtggcttaaacgacagaaaggtattatcttacagttctggaagctagaagctggaaatcaatgtgtcagcaggattgaccccttctgagggagaagagggagaatctgttccatgtctctcccctggctttgggtggtttgctggcaatatttggcattccctggcttgaagatgtatcactccaatccttcatctttcctgcatctccacacattgtcttttctgtctccctgcctaattttttttttgtttttacaaggataccaatcatactgtatcagggtccaccctaaggacctcatcttaagttgattaaatcttcaaagacattatttccaaataaggtcacattctgagttactggggattaggacttcaaaataacttcttctgaggacacaattcaacccacaacagccattatttatggtaccttttcaagattgaatgatgaggttatcagacaacttagtcttaatagcaaattctatgccaatatttctaatttttcatgacaaatgatgacattaactttagattgagaaaagctgtttgtttatgtttagtatgataagaactcatctttcaatttccagttgtcccaagcattgggggtgttgggttgcttgctaattttaaaccagaatgagtgtgagatttttcaaaagcctttttgagactattgaactcatcatatggttttctattttttatttatccatgtaatacatattaattcattccctaatgttgaattttccttacaattgtaagataaatcctattgtagcatggtatattactcctttaacacaacactggagtagatttgtgtgttttgttgtttggttttgtttttcacagctacatccatcttcacttgtgtagttgtcctctatagtcccttgacaaatctcacaatcaaattgtctttgctttctcaggaaagggatttgtggatcagccctaggtgatcctcttcaatcactgtatctcctagaaatgactaagtatgaggcaaaagggtggtatcttttccagttcccaccctactcatgtcaggtttttatattttggtcatgttggttcatgtcaaggaaggtggggtgattagttgcctgtgctcaaatccccctctttcccagaagccgggacctattgcacatatttgtatgaatgactcatcaaagcaatcccagtggtctccacagtccgtggatccttaaaacccaattcaaaaaccaaccacatttgcatccatacaataaaatactactcagcaataaaaacgaatgacctattgacgcttgcaacaatatggccaagcatcaaatgatttatgttaactgaaagaagccagattcaaaggctacagaatgcatggttctatttatctgacatcctggaacagccaaaactagaggaaacacaaacggatcagtgcttatcaggagttgagggtgagggaaggatttgacaacaaaggaacagcatgggagaatttggtcgataattgaaaaaacacattatcaatacataagggataagtggataggggtatgggtgaaacaaaattggccatgaggtgttaattgctgaagctgggcaataagggcttattatgttattctgtaaaaaatccttaaaagtgtacagttaaaaaaaaaaaaaatacataccaaacattgcacccaatctgtgtgaggcaggggcttggaaaacatgacgctagggtaccctttaccattccaattttctaaacccttatccctctccaaatggcctacttcataaatatgctatccaatgattaataaaatgaaagctaaggagggaaaaagatataattaaggaagcagtcccaactttggccatctaaagtaaaatgactgtgctaatgtcgttgttaatgtttcgtggtcagagcaaagagaaaatcactccccagattacagcttttgctattttagggcctctctgggagccccactgcaatgcacaatgcggttcgaaatctgagcttccattaaagagtatgtttgaggcacggcttagagaaccccacaggaagactgcttagcctctcagaaaatgccctcaggcctggccaggctataggtaaggcctgtgggtccctccctgacagtagctggcccccagcaagctgccttctgatctgcataagggtccctgtgggggcctggctgctctcctggaccgggaaagactgcacagccacgtaatctacgtgcatcttcagagaggaccagatttgcccacacattctgtcccacacagctcagaggcatagaggcagccaccttaagagtactcctcacagctggggacaggtgaatcacggctactcagttgattggttatctatctatctatctgtctatcatttacctatttattttcagaaagggtctcactctgtcacccaggctgtagtgcaacctctcaaactcggccaatcctccaatcttagcctcctgagtagctgggactacaggagcacaccaccacacacagctaattttttgtattttttttttctgtagatacagggttttgccatgttgcccaggctggtcttgagctcctgggctcaagcgatcctcctgcgtcagtctccccgagagttctgggattacaggcgtgagtcaccatgcccggcccgctattgtttttaaatgccatttccctcatgagtgcccaattgttgttgttgttgttgttgtttttattattattattatactttaagttttagggtacaggtgcacaatgtgcaggttagttacatatgtatacatgtgccatgttggtgtgctgtacccattaactcatcatttagcattaggtatatcttttaatgctatccctcctccctccccccaccccacaacagtccccggtgtgtgatgttccccttcctgtgtccatgtgttctcattgttcaattcccacctatgagtgagaacatgcagtgtttggttttatgtccttgcgatagtttactgagaatgatggtttccagtttcatccatgtccctacaaaggacatgaactcatcactttttatggctgcatagtattccatggtgtatatgtgccacattttcttaatccagtctatcgttcttggacatttaggttggttccaagtctttgctattgtgaatagtgccgctataaacatacatgtgcatgtgtctttatagcagcatgatttataatcctttgggtatatacccagtaatgggattgctgggttaaatgctatttctagttctagatccctgaggaatcgccacactgacttccacaatggttaaactagtttacagtcccaccaacagtgtaaaagtgttcctatttctccacatcctctccagcacctgttatttcctgactttttaatgatggccattctaactggtgtgagatggtatctcattgtggttttgatttgcatttctctgatggccagtgatggtgagcattttttcatgttttttttgattgcataaatgtcttcttttgagaagtgtctgttcatatcctttgcccacttcttgatggggttgtttttttcttgtaaatttgtttgagctcattgtagattctggatattagccctttgtcagatgagtaggttgcaaaaattttctgccattctgtaggttgcctgttcactctgatgctagtttcttttgctgtgcagaagctctttagtttaatgagatcccatttgtctattttggcttttgttgccactgcttttggtgttttagacatgaagtccttgcccatgcctatatcctgaatggtactgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagcaaatcctttccccattgcttgtttttgtcaggtttgtcaaagatcagatagttgtagctatgcggcattatttctgagggctctgttctgttccattggtctatatctctgttttggtaccagtaccatgctgttttggttactgtagtcttgtagtatagtttgaagtcaggtagcgcgatgcctccagctttgttcttttggcttaggattgacttggcgatgcgggctcttttttggttccatatgaactttaaagtagttttttccaattctgtgaagaaagtcattggtagcttcatggggatggcattgaatctataaattacattgggcagtatggccattttcacgatattgattcttcctacccatgagcattgttatcaaaggaaaatctcaggaaaattgaacaaccagtgaaatagcattgccccctatcttcccatcaacctagaacagaagggaactcacctgtaccttggtacttgagagatgagacagctactactgcccccattttactgataaaaaaacaaagtgcctccagaagtcataactagtgaggaatgagcgaaagttgaggtgagggatggagatagttagctcttctccttcattctccatctcatacaaaaggaacttccgctgctgacactggagagggaagtgttaaaaacctttactctttcctccctgaaggtgtaggacttgctcatttgactgataaagcttgccattccttgggctaaatgtactagcggtcgcgtgtcccagaggtgcatctctctgatcctgcaacacttttgcccacctgagctcaggtgcctaggtcctctgatctgctctttcatctccttctgagttcttgtcttctttcagttcaggggcagtaagagctcacttggaaaatgatggtccagggccatcattttctatcctggagaccagtagtgagaggtcaaccagtgccatctgttcatgcaacacagtgggtgggtaagtcagggcagagctgctgttggcagggttgaacttcacccaagccctgtgctcctggttaagaaatccccccatctccaggtaacagcttacggcaaagaaccacctttccctgtacagcttagataagacttgtggatgatcctttaacaaggccagacacaggccctccaaattcctattctttgtctcagaaatgattagctgcactgtttgtctacattaaccaatctgactggatcaaattttagtcaggcttcactccttcccatgggccccttctaaggatttgctgaccacaaagaacatttccagtttggttcatcgatcaagccacctgctctcctcacccacgctgatcctgtccccattgcaaccaccccccttttcccattgcaatcattcccgttgataaaatctttccttactactgtacaaacttgcacatttttttgacactgtctctagtttagaaggaagggagacaaagaccaactttcatttgagagttcaaccgtttatgaggcatgctgcaatcaggggtcagacagtgcttgcccagatgaaaaggactggtggtactagcttcgagttttgtgtgtgtgtgttctgtcagatctccacagaaaagatgggcaaaaagctgaatctgggtgccctaaacacagcctgtctccctcttctagtttctttccactcctcaacaccagaagaggccctctcagctcatgccgcaccacctatgcaactcactaaacagtaaaacagattttgcatagcaaaggacatcagcttctcccacgtctcagggactaagggccaacaccaggaggcaaagcaggcaaatgaaagctcatttctctgctacaaaatgaaacacaaaacactcctggggaagagtccttctctgtaggcaccagggacacccatcacccctccagcctggggatcccccagagatggcataaagggacacccatttatttggtcgggcagctgggaattttaatggaacatcttaggaaacgttactacttggggctttgggctgggggagagctagatggactctttgtacttcctcttcttgaagctttgctctccttactccattgagtatggttgtgctctgtaatctgagcttcctttgaggactggaacacaggtctacagatggatgacaatgggattatgagacccagcctcaaagacatgagagtgatggctggtctgtggggctgccccagagatgccagctggaaaacgctaagagcaggtggccaagtccttaacaacttttccaaaaacaggggttctatgtgattccgacctggcaagcatagattcacatccataaaacattttgcagcacagactatgtgccaagcctgtgccaagtgttttgcaaatattatctcattgtatccccactaccaaaaagaaaaatcatttgaattaaagttacagagacttaatacagaagcagaaacctttaaaccttgtagacaagtaagaagaccttcgaattccccaccctcaaatatagattcctgtccattcatttacttacgaatgttccttttgttcattcttttagtgtagttcagtgaattttaaactgtagtgtgcatgagatttattcaacaaaacatattttatcatgggtgccataagagatttcctaaggttaatttggacaatacgcacttcccagcttaactgttgacttcagaggccaatccccgcctagaattctagtccactttgttacaacttctgatcatcacatcaaagcggggtggtgagccctggtacaggtggggcagtttgcattttgaatgtcctagatgatcaagaacatattaaaagaagctctttggctgtccctatcacttgcaatttaaggatgaataaagtgaatgagttgagtcagagacaagaacaaaaaataagcgaatggcttagcaacttgtgggagatccttgccacggaatattacccagcatgaactattaatatacgcaacaagatgaatgaatctcataaagcatagactaactgaaaaagtcaagcacaaaagactatatgccatattattccttttatataaagttatagagactgaaaaactgtagtatcaaaaagcagataagtggtcgcctggagcagggagttggcagggagggaagttgaggggagggtgataaaaagcaaaagggaagagagggagagaaggaaggggagggactctatatcttgatgggatggtggttacatgattgtgtacaatgaccaaaattcactatgctgtagccttacattttaaagtctaaaaataataccttaatacttttttttttccaagaggagaggaaaaaaagtcatggtcacatacatacaaaaagattagaacactttattccaaacaaaacactattgagcaatttgggtcaaaagaatgcacaaagcagaatcacattcttcctttcaaatttctcctttcacatttgtgaaagaagaggaaaaagaaaaaacaaactgcagcatacatttgaatttttcctttcagagaggggctctaatcagtgcagagaactgggtaacaagtaagaccaagagggtttaattaaactgagcaatcattaaactggatttaagagtgcttgtgtttgcaaaacaacaaaatatttacagacattttcttcatccccttcattagtttcagactccacaggaaatatggaggttgggaacaggtcctaatgagatcatgcaaattttaactactgaggttagcctggcaaagagacagcacggcaaaatgctcatgatgaaatgttaagtgaggaaagcaggatagaaaatgagcttgcactaacattatgagtgattccgataattataagcatggtagggggatgacaagcaggggctggacattaaaatattctatcagtgatggtacaagagcgatggaattaggggattattttcatctctgttttccaaaatttctgaaatatatgagtgtattacttttatttctttcaaaataagaaggtacactaaagcaagaccatcacttgaggccaggagtccaagacaagcctgggcaacatagtgagatacctacagaaaatgtagacttccacacagtgagatctctataaaaatgtagatctcaacatagtgagatctctacaaaaaatgttaaaagttagctgggcacgatggcatccacctgtagtcctagctactcaggaggctgaggtaggaggattgctggagcccagtaactggaggctgcagtgagctagcattgcaccactgcacttcagtctgggcaacagagcaaatccctgtctctaaaataaaaacaacacaaaaattttctaaaatctaatttagacatctaacagtcatacatgttcactatctctttgctgtgcctcagaacgagacaaaaggggaaggaattctgtaatctatagcggcagcatccgatctcagaacactgcaccttcactcactccaatcagggtcttgctgccactgggacagtgaaactgccctcctcaagaccacccatgaccctcatgtagctgagtccagaggtgaattcttggccctcatcaaacttgcttcatcaacagggttaacagcattgatggctccctcctcctttctcagattccacacagcgttctctcttgcttgtcttccacctactcttttgagatggagtctcgctgtgtcacccaggctggagtgcagtggcatgatctcagctcactgcaacctctgcctcccgggttcaagcaattcttctgtctctgcctcccgagtagctgggactacaggcgtgtaccaccacacctagctaatttttgtatttttagtagagatggggtttcgctatattggccaggctgatctcaaactcctgacctcgtgatccacccaccttggcctcccaaagtactgagactacagttgtgagccaccgcgcctggccctccacctactctttctcagcctccatgctggactctctccctcatcttgatacctacctggtggagtgcttaggctcagtccttgaatttcttctcttctaagtcccaaccctgtgcatctcatctaagcccacaacttgaaatagtatccatacactgactactcccaatttcacatccttattctacacctctctcctggactcaggcctgtatatctaactgcctagttgatgtatcgacctggatgtccagtagacatctcaagtctcacatgcccaaagccaatatcgactactcttctccaaacccgttcctctcaatcttcccttgcttggtgcctcagcatcccttgtaggtttccttagtcttgcccacaccactaacagttacttcattcaattctcttcgttacacacttttgagtagaattctatgtcctacaggaatcttgattgtgttccatctaggatgatgcccttggagggcgagtcctcccctgctgcttccatctgccccagaagtcacacctcagcctagattagctgagggtcactcaaacgcactgtagtctgtaatgcccttcatgcccttatctttgtatgcaggtgaagcatagaccacccttaccctgctgtctcctcacccttggaaatggagttcaagtatcaagcctccctcaggaaaatcttccctgaccatcgctcccaccccaagctaagatggcatcccacccctgtggttcccaacacttcactcatggctactttgcgaatggtcttatagcccatctttgtagacacatgaagctccatgatgaatttagggaggcccttcagcactccacccctgccccatcacacctgctggtgccaattcatacctgtaggagagccagtcacacctgcagcatgttcagcccctgcacctggagaaaaaacctagcaatccagaactttaaaggtcacttccaaggacttctgggttcacaggtgacataaataagcaaagccacagattgggtaggatgttcaatgaaccaaagaacacaaatcctatctgaaggcatccaaaagcaatttttaaagaacactgtatactcagaagaagaagacaatctgtgcattgatctgggctcatggtccgtgaatttgcaatctctaagccaaatggccacaaagtacctaaatgtgcaagacctcgcagattaatactgaatgaaggcctcctgacaggaaatgtctgcacattactttccaggtgacagattggcagataaagcccacgcgccactgtctaagtgacaacacacttttcacacgtatcttctcagtcatcctcatcatagccccaggagacaagttcattattatctctattttgcctttaagaaaaccagagcctgaacagggcagatgacttaacaaggtcacacaatgaggatctgaaagagccagaagccctggcaccagtcccaggtactccacgtgcactgctgggccagtggatgcttcacaacctgaaggatggccagggcctcttgggccagcagtgtccagcgtcatcaataccctatccacttcaagatgaatgggacatttttttcttttcttttttttttccttaagacagagttttgctctgttgcccagcaggctagagtgcagcagtgtgatctcagctcactgcagccttcacctcctgggttcaaacgattctcgtgcctcagcctccccagtagctgggattacaggcatgtgccaccatgcctggctaatttttggtatttttagtatttttagtagagatggggttttgccatgttggccaagctggtctcgaactcctaccctcaaatgatccacccacctcggcttcccaaaatgctgggattacaagcatttgctaccatgtccggccagatggcacattcttaatacatgctatgaactctcacaagaattcccatatcatgacttttataacctgccttttaacccttccatttaaaaaaaaaattatagcatgtgctacaaagccctggatgatctttgggtttaaagcagcatgcagctagctaggaaggccatggcatttgtgtgtaaaacagccttctattctggtaatggatgcagccgcggtctgataagcaggctgtgcagcattcactagcatctgaggccagcattcaccagcattgtgaacctcgggaagaaaactcaaacaacctgatgtccaacagtactcctataaggagcaaaattggtgagaggagcccacacttttcctaaaccccatacaaacatctctatctctgccatgatggcttaagcgtaagtgaaatcactttgactcacatcctcaaggtgaagaaagctgagctcacacagaacggctaatatgtgcacagaacatcacagctggcaaatatcccgatccgtacatcaatccccaaaaccagctgctgttaacctcacttttcagataaggaaatggggttgagagagattagatgagttggcaaaggtgagtggagatttgatcacaggtcagctggattcacaaatctgtgtacttagggcctcatctgtggttcccaaatttcactggtcatgtacatcacctgggagcttgttaaacgcagattcttgggctgtgctccagggactctgattcaatagttcaggggttggacttgagcatccatttttaaagagccttccaagtgaatctgatgcaggtggcgcattgtccacagtgtgagaattactgcggctgcattgagcctttcaaaagagagaagcgccatcctaaatgaaaaccttaaagccacaaatgatgagaatcaactcccagaagcattcccgggtctgtgagcacagtctttgcagaaatgctggcttttaggcatgcttcctaaactctctcactcctcatgacacaagcttttccaaatgctagtagcacctgtactaatatttagttaatattttttaatatgtcatttttcttaacttactttaaaaggaaactccgtatcactaccaaaatgaaaacctggtctcatttgctataaacacataatgaggctaaaaacaaaattaacaaaaacaaaaacataagtaaatgttggctagatattgttgctcccctagggttctgaccctagaacatggttcctcctagggaaaaatgagcatttgtaagtgttggaagggcaaggagtgatagaagctctaaaactcagaggctctttttatataaagaggtattagaaaagaaatgaagcattttctccatggaattcaatgctcatggatgccctgcccacacactacaaaaaattccatgaaccaccagtaatgtcccatatttcgggtgtcattggcttgaggcagtgttttcaagacttgagggtgaatcaaaatcacctggagaatcattcagattgccaggccctgcccccttgggtttctgattcagtgggtccggggaggggcctgagaatctgcatgtctagcaagtttccaggtgaggcagatgcttctggtccagggccatgccttgagagaattcagagcagctgaagaaaagagggcttcattccctggcactctctgatacctacaaggagctgtcaactgcacatgagtaccttctggtactgcacagtccctttgcagatttccgaccccagacattcccagctccatataaggtctttatcaatcacttcactccaggactcttctggaagccccctctaagaggggctagaccctgccaggtaaagcttttagatgggccgtcccctctcagggggtgtaggcaggaagttgcccactgactcggggctgcctcaacagaccaggccagcctgtgggtctgacctgcagagggccatatcccaccttcagacctgttgcctctatgcagcaggctctgcacctgcctgaggggtcatttctggtgggccctctctccctgaccaagacttagccttgctctgatgtcaagcctccctgcatccacccctctctcctgttctccatcctggactaccccagagccctgatactgccctctcccaggtcacaggccccaacaatgggctgcactagctctgagcttctccccagcaggtttgagtagcaaataataaatattttttttctaagcaactcttagtgcaattcaccccactgtgccttatgtttgaaggagcttatagcaatcctcaagggatccaggacgacacgggggacataatttagaggggacagatattcctccaccagaagtactttccagagaatctggggccaagactctggctgtgccctctggtgggatgacttccctgagcagagaatgcatagagtgcatcagagccacacacgttccagggtccatagagctaggttaaaatcccagcctctgcttcctccccgtgtgcccaaggacctgtttctgaacctctccatgtctcatttcttcatgtgcaatacagaggaaatcatatttgcctgcatgattgttgtggggatgcaattaaataatacacgtcaagcctcagcaagggggcagccaggcttacaatgcatccccaagaaaggacggcagctgccacaaatgctgccatcattattactgatggagcagccacccagatgggggtcacttcaactcctgctccaggccatcccagagatggctattaccagggaaaggatgtttccctgctggcacacacacactcattcaagatctcagcagccatagaagctaaaacaacatgggttgggatgtgcaggtggggttgtaaggttgctcttgatgtgactttcgatgtccaccaaggaaaacctgagggtgcaggaaggaataaacaaatccccttcatccaggacttcccatttgccctcaggagtaaggcaggtgttggcagctcccagagctgaagccactgcctcataagttaatgggaagagcaaaaggcaagacctgcttaaggggaccagcagaaagattgtagaaaaaaggggggctgggtgtggtggtgcacgcctgtaatcccagcactttgggaggctgaggcgggtggatcacctgaggtcaggatttggcgaccagcctgactaacatggtgaaaccccgtctctactaaatacaaaaaaattagacaggcgtagtggcgcatgcccgtaatccaagctacttgggagactgagacaagagaatcgcttctacctgggaggcagagggtgtagtgagccaggatcgcatcactgcactccagcctgggcaacaagaatgaaactccatcaaaaagaagaaagaaaagcaagaaagaaaagaaaggaaagggaaagggaaggggaaggaaaaaaggaaagggagctactcatggtggtgtggtagacccacgcctgcagtcaaacagaccagagttcacagcccagcaggtcactcaccatcagcatgcaagtccacgtgggacttcacctccaaagggctctgtttcctcttctgtggcccaggtatggtacagtgaactgagctgtcaggggcattaactaaaattccaataatacaaacagacgcttcctaattaggcatgtaggttgtacttagaccactatgtattatttctcctcattttacagagagatgaagtaacttgctcaaggtcacacagtcaacaaagaggagagctgggatctatacccatgcagcccacctccaagtcacatgctattggctgctaagcagcaccgtgtagcacagggcctgccatgcagcagttgtgagtacaaactgggacggggtaaggaggcagggaaggtgaaggttgctttcccaaagcctctatctggatgatgagatgggaagtgaatctgcagactcgattaatctaaacccaagctcattgcacaaggctctggttccctgccccaaatttaaacagctgctccttcaatgtagtggaacacaaatgtctgaagagctttgaattttaattatcacagtcctgatgacaatctgaatcaacagctgctcccagcaaggtggccctcagagatgcccagagaggggcagagggaggggacaggaggacacagtccagacaggacacagatgactgcatctgtctggggagccctgacacctgcagctgggagctgtgggatggacaaacaggttgaaatgcagtaagaggaggagggaatctctggggtgcacctgtccccttgccacagaacatgtgtgtctgtcatatgtcggggtgagtgacaatgcagagggagaatatcaggggccatggggagaccctaccatggtgtttctgatgagtaggccaggaggtgtgaatacaattgcccagggatccaagaaggggtcaaaaagaaaggtgtcagagggatggtcaaccaactaagaggtggcaaatgacagccctgctgtgacaataactcctatgttccaggtattggagcctccacccatccctacccaccttctcttctccaggtgagaaacgtccctcccttcctgcaactatttcagggaagacgctgccactcaacacaaaaacctgtccccaattgcttcaatgcaaaagagaaggacattccctccaagtactgaccctgtcagtcccatcttttgattcctgtcatatctaacacctttcttaccagtgacattgtctggataaccccaaactggaaatactagaataacaaaatggccaggagaacagaacataccccctgctttctttttggctttgcccatcaatttggcaagatggcagcagagcaggtactgcaggtaagacagtaagtcaccacaagatacccagaaggaagttcggacacatgtgtcatttctaacatccttagcatgcgagagtaattctctcctagggagatattttgtgccttacatgcaaggatactcagtgaagtgttctttacaagaatgcaaaaggaattcaaaaacaggagactaattaaataagttgtgatacactcacgcacttgaagtgcgtgtcattatcaataatttagagttccaaagagcccgaagtgtggagacatgtttacaataaaatgttaagtaataaagaaggacattaaatcatctgtcacatgtataattattccaattgcatttaaaggacagaggtgtataaatatgaataggaaaaaatacaactaaaagaaagtgcattaatcatctctgttcttatggatgggttttattttttctgtgtgcttcttcctattttcctaagttttctacagaaaatatgcattatatagagactttcaaatttattttcaatttaaaaattaataataaaagaggacagagaagttagggaaggagagatggtgttcagacaagggcttggagcccattttgaacaaacctggcctcattctcacagccctcagagtcaaaatagcggagaacattttccccttaaatcaattctgcaaaataatatttggtctgatgtttgtaggaatacaagcgtccttggctcctgcaagcgtggatcagacaaagcaactcaagaacccattcttgaaacctaaggattagcagttgccatgacaatgtgttagcaaacaatttattaagtacttgaaatttctcctccactattgattactaaatgggtattggaatgacccattactgcaagttctgtgtccccatctcagtgcctgatctggctgcaaatggtcccccaattaggacgcctggctgtaggcggctgccattcaaatgcttggttcccatccaagaaagcagtcatctgggaaaagtttaagcataatctctccggactagtttctgataaaggagggaagaggacagggaaaggacttggggagtgcttactgatgatgaggaagatgagccctgctttggaagcactgacaacttttgacagcagcctgcagcatcagtgagatggaaaaccacccaactgccctcctaggtccctcttctgatgccaacatcatcatcagctgagggggctggatccctgccactgcaggtctttgtttcagaagatttgggcccctggacattcagctccatatcattcattcaacaaaactccactaagagcacttgcaatgtgatggtaccaagcaagttccctaaatgcctcaagtcttctacccttgtgcacaattccctttactttttttacttatttctatttaattaatttttttttttaggaataggatcttgctctgctgtccaggctggagtgcagtggtacactgatagctcactgtaaccttaaactcctcagctcaagtgatcctcctgcctcagcctcccaagtagctaggactacaggcacaggccaccatgcctggctttttttttattttgcaaagacagggtcttactatgttgcccaggctggtcttgaactcgtagcctcatatgatcctcctgcctcggcctcccaaagtgctggaattacaggcatgagtcaccatgcccagaccctcatacataattcttgcgactttccctctctattatgaaacaaaactttataccatagctaccacatgtacctttcagcaagtagcaagatacagctgccaaataaatgagctgagcttatgataatagttgtagctggtatctagaatatagaagctttaaacaaacaacaacaacaaaaaactccttatctttatgctgtttagaccaatcaaccttcctccctcaaccccctccccatcttagccaccaccaccaccaccaatatccctggcagtgcattaactttgggtgccaagctctcagaacaggagtgggggtaaggagttagacttggacaagagcagggctaagatttgaattatatcccctaaatattcacgtgttgaagctctaacccccagtgtcacgatatttaaaggtaggataagctcttaaaaggtaattaaggttgaatgaagtcataagggtggggtcctaatccaatgggattggtggagggtgagagatctctttctctttgtacacacacacttaggaaatgccaggtgaggacacatggagaatcaagtcaggaagaggcccctcaccagagagaaaactggccagaaccttgatgtgggacttccagactgtgagaaaataaatgcctgttgtttaagccacgcagtctatgcattttgtcatgacagcacaaggtgggagccactgcctcccaaatgctgaagaactagcacgttggctcagaagagaagtggagcctacgtgggcagagggtaaggagatggttctgctcagaatgaggtagaaccttctcatagaagaggcagagcaagcactgtgcaggcttctaggagacaagagagggagcgggtgagcataccatcactaatacatgccgctgcaagatcttccgcatcagatgggagttagatgagaggacacagcgtaggcgctcaacaagtatttgtcaaaggattgacacattttctttgtaactggacaccaggcatgcacagagacaacttacagctggttagcagtggggaggtaggtgccagagacatggctgataccagtaaaccctggaatgatagagtaaaggtcatgtccagtgattttcatttcagctacgtggcactaaaactcatcctgtcaacatgtgtcctgactgaatccatcccagtttgcacatgcaggctggaaaccactatctgaggccacagcagcctccttgtcccatgaatgccacacacgggcctggcttgggcgtgagtcctgcaagttcatcctgtcagagggtgagaaacagagaagcaggcccacacgaccaggggtgactatgagaacacagggctgtgcaggtgcctggggcacacagaaggcagggccccatccctgaggtgccaaagacgtaggttagaactgtggatcagggctagagccaagcctaggggaaatctggacctccccatgaggatcctggactcaaggaagctctgataaggcagacatcacttctcaagggggcatgtgcctggtctagaccaagagatcagggtctggctgcagcgcaggctgcacgtgaaggtgtcaggcctttaaaaggtggccggtgcttatcaaggacaaagaggacagagaactaagctgcagcccagaagaagagctccaaaagtcagaatggggtggtttctgaaggtctggctgagaagcaaggtggaggggtggtggtaagaaaggaagagagccttgtgtctcccaccctaggtagcatgtcatgttgtgcaccctggtcagcgtcaccctgctgacttgggtgaccaacgtgtcccagttttccaagaactttcccagtttctgcactggaagccctgaatcctggcaaaccacgacagctggtcaccccagcaccagcccaggctctggcgggggcttcactgagctcctggagaaggaccttaaaaatcctctatccaccctggacacctaggttacttctgaaacaaccgctccaccttcacgacctcctcaacaggcgtctactgcctttggaattggatgctattaatacaaagagaaaaatgcaaaatggcaagcagtaagtatacttcagagtgataatgaaacaagggtcctcatctttgcagcattggtcagcctgccctcattctcacctcttccaacctctcctctatagggatccttccaaaccccaaatctgaccaagcttgccctatttggacccatcccaggctccctgttgctctgagaacagaatctaatctttaatctggccctcaggctctttctggaccagactcccccatctgtctggcctctttcctgccttgcacccaacagccttgcacaacttttcaattcctccagcctggccaagctaattcatacctcagggcctttgcacaggccaaaccttcagccaagaatgtcttctgctcccctagatctttatcctgccacctaccaacccaatttatttgcctgctcagaaaggcctttatttatcctccctagttccctgcaaataggatcaatttggtctcccacagagcacaagccttcacttcactgtattgcaatttttaaatatatttacatgtttgtgggccacctcactcttccctgaaccctttgataacaaggactggaatctaactatgtttttccagtcccgagcatggtgccgggcacaaagtaggcatacagtgagtgtttcctggtctattgattgattgattgactaaactcacctcccccaaacccttcaatgtgagaatacattttcttcaaagtttttagccattataaatgacagacaagatgtctctttgaatttccaaacgcttatctcaaagcttttagttttgtctaccagctcatgccaccaaccggatgagcctcagcaaggttcctgtcaaagcatccctctttttgttgatttactttaaaatgcaactcagtggcttcaagtcagaagaagaagaggccacgtcttcagcctctccttaagcatctatcaccagccagctgagaagatgtgactgtcatcctcccaacccgacaagatgatttttctcaaccataatacaagcccagtgagccatacaatcatggtgaatcccctatcagctcaacatcctatgcaatttttcagagaatatgattctatctgaaaatacatgcaacagtctggaactcatttttccccagtgcctaactttcagattcctataaataccagatggccttccaggcagtgacacacgttggaattatcgaacaagcatcgcttatgactttgccttgggcagtgtcaaaaggtactgagaatttacccatctcattacggcgttgctaacagggtctcaggcagtttgctgggcctggaggtgtgtcaaattgcagtgccatgaatgcctcaaacgagagacagagaaagagaaagagaaggaatatgtgaatgtgtgtctgtagctgagggaaacaacaagagtaaagggaattaaactcttttaataaaggaaaatagttttcaaacaaagaaaaagaagtctaatggttagctactgctgcataacaaaatttccctaaaactgagcagtttaaaacagtatacatttattatctcacattttctgtgggtcaggaatccaggcagagctcagctgggtcctctctgtcagcatctcacaaggctgtaatcaagatgtaggccagggtgtggtcccatctgaaggcatcactggggaataatatgcttctaagctcactctcagggttgttggcaggactcagtttctcaggggttgttggacagagatattagctctgaactattgaccagaggcatccttcagtcccttgccttgtgagtgtcgctatagagtgtctcacaacacaccagcttgcttcatcagcaagtaaatgagagggtaagagaaagcaccagcaaagagagaatgctagcaagatgaaagccatagccaagcatggtggctcacatctgtaatcccagcactttgggagaccaaggcaagtggatcacctgaggttaggagtttaagaccagcctggccaacatggtggaaccacgtctctattaaaaatataaaaaaagaaaaaaaaatctgggcatagtggcggtgcctgtaatcccagctattcaggaggctgaggcaagagaatcacttgaacccaggaggtggaggttgcagtgagccaagattgcaccactgcactccagcctgggcaacagagcaagacttcatctcaaaaaaaaaaaaaaaagccacaaccttttgcaacctaatcttggaagggcgtctcattgcttttgccataatttttttttttttttttttttttttttttttgcccaagctggagtgcagtggcatgatcatagctcactgtaacctcatattcctgggcacaagcaatcctcctaccttagcctcctgagaagctgggactacaggcacgcaccagcacacccggctaatttctaaattttttgtaaagacaaggtcttgctatgttacctaggctgttctcaaactcctggcctcaaacaatcctcctgccttggcgtccaaaagcaatgggattacagacatgagccactgcacctggcctgccataacttatctttagaaacaagtgtctaggtccagtctacacttgaagggaagggattacacaaaggaacgaatattcaaagacagagattattgagagccatggcaaggcctctttccacagaaaggcttcagaaaattatgatcagagcctctctcctaaggcctggaacataagagtatctgggatattcattcattcattcatttttcaaaaagtatttaatgactgtctgctatggaccaaacatttctcgtctagtccggtctagtctagtccagtccagtccagtccagtctattcttctattctattctattcttaagatggagttttgctcttgttgcccaggctggaatgcaatggcgcgatcttggctcaccacaacctccttctcctggattgaagtaattctcctgcctcagcctcccgagtagctgggattacagcatgtgccaccacatctagctaattctgtatttttaatagagacagagtttgtccatgttggtcaggctggtctcgaactcccaacctcaggtaatctgcctaccttggcctcccaaagtactgagagtacaggtgaccaaacactattctaaatgctaagtgaacaaaggcagaagtgaacaaaacatacaaaaatccttgtcttcataaaactcatattctaatggaaggagaaagaccgtaaatgggataactagtgtgttggatggtgataacagctatagagaaagcaaaacaggaaagggaatgctggggaaggggtgggggcacaggttgaaatcaacaccacataggaaaggctccagtgagaaggtaacatttgagcaaaatcatgaaacaggtcaagaagctatcacatggttgtctgggggaagagcatttagacagaagctgcagatgcaagggtcttgggacaggagaatgaagccaggggctgcagtggagtgacaagagtagtaggaatacgtgaacagaggtgtcatgggcatatcacggaaagcctcataagcatttgtaaggactttgttttttattgcaaataagatggaaagctactggtggggggtggcctgagacacaggagtgatataaactgtcttatagcttaacaagtctcctcttgactatggggtggaagaccaatgtcagtggggtgacaagggcaaaatgcaggaattcactgaggaggctgcaggtctactctagatgagagccaatgatgacgtaatctggggcagcagcacaggaggtgggtaggttggcttctggatatattttggaagcacagcctaaggatttgctgatgggttagatgtggagtgtgaaggcaagaaacaaagaaataagacatagttctaatgttttggccctagcaactgggagaacagaattgaagattcgtttaattctaaacgaagtaaagaccaagagttcagttttggaagtggtagaaaactagggtgatcattagatcaaagttagaacctctgaaagcctcggccctgcatctgggtgatggaccgtggtccacacagcacactcgagcctcagtttcttcactgtacctgcaagtgcctaacacctcctaagtcccacatttagccagcagcccatccctgcgcagtgggaatctcggctttacacgttatgtgcgcatatcatattactgtacaataactcaagtcttgctatataggcacatcataaaactattccaagaggatagattacttgaaaccagcatttaatgtgcagctattacatgccaggcactatccaacgcactgctcctacgttatccacatgcatacacaggcactgggtgtcataggatctctagcagtcagagactgtggctctcaagctccttggcagtaggctgtggtcatctttcccacgtgtgcctgtgtttctctgcattaagattttcagaaatgagggccatgtctgggaatctgtttactactgcagttatgctgagccagacagtctctccctgtaaacttgcagtgatgggaacctcatgaccccataaagcagccccctccaatgttacagctagttctcagaaagtctttcccttttattatcagccaaaataaaatcctatagtttctattcattggctccagttcaccttgtggagccaccagagaaaatttcccctgccttccaaatcacaagctttcagagagttgagagcagctcttcaatcttcatttgacactgatgagaagagtgccagctaaaatctgagacatactctgtgaatcacacttggtaaaagtgtttttacaaatattatcccattcaccatccataatcactgaagattaactgcgaagtatcatttagctatcacttctaaatgggagaatgaatgggaaaactcttggaaaattttgagataattacactctgtatcattgttcccattctgcagatgagaacacaagtgactcagatatgctaagtcacttcaagattacctttaagtaactagtgttaaaagataatcttcaaaacataataaaatcatgactcatacagatatgaaataaatatgtgttaaagattttatcatcaatgatttatcaaagatcttatcaatggatttctatcattaattaatgaagattagaaagatgctacaagtggtttaaaagagaacccaaagaacagacagctaacagaaacatttaaatgggtgtacgaatggatgtaaaattttttgagggggaaggttgggtagctcagttgaacctctactggacaggatggaatgtgcatatcagtatctgtaactcataaaactgtaaaacagtttccataaaatcaaaatcagatacccaggaaggattacccctagagtctagagctagacaattactgttttccaccgaagcaccattttctctcacagcctagcatagctagggtctgcacatggttctttataactctttgccctctaagaaaatctgtttaaaacattcactgactttttttcaggcccaatcataatatagatgggccttcagtggctggcaacatatgagagaaggagcagaggcactgaagaagaaagagtttggcaaggacagttaagttcctgcctctctgcatttttccatgtcagtaagagcctttcccttcctctcttccccagcctgtttctcacttaataaggagttgtgcagggtatttccagcctaactccctcccccccatgcttgctagagagtgctccattgtgcaatgaaagaaggtaaggagttatgcatgtttttggttttactgaaagtctatagtgtttcaatagtctctttgttctctctctcaatagttcctgtgtcttaagaaattacaaattttcattcttcctatggcattagtagtttggaataaaaaaggaaggaaagaaaagaaaccaattaaaaaataaagtgcttaggcttaagaacagcatttataataacttcacaggtctaacctgcacttactggcggcagtttaaacagaaggttccttgagaggtgagcaataaagaagccatttagtacttgatctccagagagggttttatcaattcacttgcccccttaaccatcactggtttctgtgtaatccatagaaagatgagacaaaccaaccaactcgctcacatttgcatgggtcagacctcttattaaatgagttttccccaaatggcagtgcttagcatactctgatggcaaatgcttaaacatttcgtcaatttcaatgggatgtcaatttcccctgccaagcaaggtggccttccaggctaatctggggtgagggaggggagccaattccaaagtagagaatgattctgaatacatacagctttaattccaggtttgctcatcactcccgccatctcagcccatgcttctaccaacactggctcagaagttggaaaagatggagattgtatttctgttagactgagaggtggagcttgtctgtcttcccccctccttttcctttccttcttgagggcaaggcctatcttgttactctctgtacccactgtctcattcagtacctggctcatagttggtgttgagacactgttttttcggtcaaatggaactaaatccattgttttgtctttttcattccttcatctactatttacttgaaacttactagtttcaagttcaggttctcagctaagagctggggccatggcagtgactcaaacaaggtttttctgccttcaaagggcttatattttagtaagaaaaaaagacactaaaaaatgagtgaataaatgatattattattaatgatagcatttcaagtacaaataaggactcagaagtaaaaatgtagggtaaaatgatggagtggtagttttgacagggaagataattcaccttaccttcatctgtctatctaataaatagataaatagatataatcttatccattcagagggtacctgttggacagaaagatgatcttcccactcaacaccactattctgtcacccactgagagcaatggataagaatagactagaatttattgagtgtctagtgtgtgtcagccatggtgccaggcttttaatacataatatctgatttaatctttaaaatataatccccccaggagatagtccttattactttagttctaccagtgaggatacagaggctcgaagtcattaaagtaccttatctgagattacctatctatattgcctgatgtctccacctatggtggagccaagatttgaatatagtttcttctacctctgaaatgcacactttgtatgttatactttactggctctggacctgaggcattatgccaggtattctgggggatgtaaaatgttcagttagcagcctttgatgttgtcaaagagctcacaagctcactggggaaatgagttgtattcgcatagccataaccaaggaaaagaagacatgtatttcaagagagataaaaactgatgggctagaatgaccagaaaagcaacatgaaagggtaaaatgaatccaaaaagacaggatagatatgaaaatcagagatgaagttgaagaggagatgggagactgtttatacattggagcattgacagtgtgttaggcacgtgagtgatacagtcatatgtgatgtctgctcttaggtgggggaaaaaaaaagaaaaaaagctcacacctagctcagacacaagggaaccagaacatgatgtgcatctccctggggaagagtccagagagccacagtatgcttagcaaataaaaaccccaccatatggttttatcttcccatgaagctgggtacatttcagcacacaaaaaaataggatttcagctgggtgcggtggctcatgcctgtaatcccggcactttgggaggctgaggcaggtggatcacaaggtcaggagttcaaaaccagcctgaccaataaggtgaaaccccacctctactaaaaatacaaaaaaattagcaggatatggtggcgcgcgcctgtagtcccagctactcaggaggctgaggcagaagaatcgcttgaacctgggagacgggggttgcagtgagccgagatcatgccactgcactccagcctgggcgacagagcaagactccatctcaaaaaaaaataataataataataataataataagacttctgttatgcggttctaccttgagttccttaaattccatagattttattcctaggtaagtctggtcctcagcaaaataaaagtggagaaaaaagcttcaaagcccactcagctggaaacagcttacctctcagagctgcagtttcctcatcaatgaaataagatggtgattcaaaggattcaaaaatcattaagattaagagatgtcatcaggcaaaggactttgcatagtacctggcccataccagatgctcaataaatgtcagttccaatctccctccccttgactctccttttctgtaaaatatacctggtcatctagaaaatttgcaattgtcttgcctcttccctacccctttttcaatacagatattcaatgggtcataaagtcctactaattttcctgttcaccgtttcattcacaaatagtccttcttttcattcctctgactcctgatctagctcagttgctatggcttcttaacctgactccacgctacatgtttgtaccctcccgtccttctgggccccagatcaaccatcctaaaacctcctttaatgatgtcactagtgagacagcagaaagagagagatgggacttcaacttcacaggctgttcttagatgcccaggttggtcgtgaactccttgaggttaggaaaggaactattagcaaaatggaacatcctccaagtagaaaattatgctgatgtcaaacaatttcatgtagctttaatggatgagaggcaacatgatattgggcatgacatgcttaaaaagcattgctttcagtggcccagaaagtgtcataaaagaggccacatcaaagtagctcttctttagcacattacaattgagaagtcattcctcccattaaaaaaaaaaagcaaaatgcaactctttacaagggataggggtaggagaaaagggttgagcccggaagaaagaatactcaggctgcagaaacactatggctgtagttggagtgaaatacaggccacccagggggagctgctgtcctgtgaagtccactgatagaaacccgattcccaaaatatcatgcagtatctgcagatgcccagctcaaagacatcctgaaaatagtacttgttatgccatgtccatactggctggctgggtcaagaggaggatggggcactgggcaaccaacaggaaaggtaggtcattttaacacccaacccatccgcagtttccagagaagaacatatacaaacaaatgacacaagtgtggtatttctagacaggatatgcactgggcttaaatttcttttccctatggaagccttccccatccaaaaacagaacaggctgggtaccccaccacgtgttcttactacacttcacattcatagcctttattgtttttgtaattgtctagatgtttatctaaagtctgtctcctcacactagactaagagtgaaaggagagcagaagctttatctcgttctctctcgtatctctggtagtcagcatggggcttggcacttggggaacatagtatgggcgtatgattgctggctctgggtttacacaggctaagttcaaaccctatcttcactaactgtggctaaatgacctttagcaagcggccaactcttccaagcctcaatattttatcctcgaaatagggatattgatggtactaaccatcaagttgatagaggattttaagaattaatacatgtagaatatttaggtattccccagcatataagaagtgttcaataaatgtctattattattaactactttggtcaggactccataaatactcattgaattaataaagaaaagcttacactaattgcatattaaactctgcaacagagacttggcatccacagatgtcaatatttagcacttccactttgcatgagaagggccaatcgtttgttgtcatttacagtttttttgtggaaaccatttcactcatccatttatttagatcaaaacccaaacgcaacttgaggaaaagagtctttcaacaggggttcacacctcagctaagactggcattccaagaatatccaggcagacagaagccgagttgcctggctgccaaaaaggctgaggttgggaaaatgtcacagtgtggaagatgtcccgagaagtcccaaacactcaatggatatcatcccagggcagtaagatcagagatcatcagctcctggaagtgacccatccgctctaaagccaaccatttttggggattggcttgtgaagggatacgcacgcagagccttcgggtcagaagcttgtgcccaatgcctaaagttgagcgggtgcagggaagcttgacctaatgagaagagctgtccactgaagactaagttactcttacttcccctcccaggtgccaggcatgagcagcagcagcctctcctaggacacccctacccccgagtggcttcagtcctctggaatgatgcaaatcaggcacagggatgaggaagcacagcctccaactcagcctgaatctttcactttcctacaaccccttcttcctccatgagggatctgaagccatctgcttcaccatacaccatccagttaatctcgttcaacatatagttcacctcaacaaaccttcctggggcagggcacagtggctcgcacctgtaatctcagcactttgggaggccaagacaggaagatcattccagcctgggagttcaagaccagcctgggcaacatagcaacaccctgtctctacaaaaaaactgaaaaacaattagcctggaatggtgacgcatgcctgcagtcccagctacttaggaggctgaggcaggaggatcacttaagctcaggagctcaaggttacagggagctatgatggcaccactgcactccaacctgggtgacagagcgagacactgtatcaaaaaataaaaataaataaataaataaacaaacaaacaaacaaacctccttgaaattaagcccccactgcccagaaaagctctgtgtctttccacctccagtaacaccttccacattcctgggtccactatcttgccactgagtcatgaagacttctgagaaacacacaagggagagcagagaaaacatcacagtttaggattttagagccggggggcggaaagtgcttctgctggaatttctgtcttcctaggcagacaagcaaaggaaatgccggcttccacatggagaggaatacaagaacctgcaaactgctcttcctatcccactcacgaagctctccaaaccgttcttcctcccaatagcagtgacactcctggaacaaaaatccagtcacaccagtgcctgcactggcctccctttaatcctggaataaaatccaaattcgttgagatggcccaccaggcctacctgaagagcatctcaattctattcctccaaccttacctgcagctactttccacttgctgttccctggcctcactggtcttcctacagctctttgaacaagccacacgttctcccagcccagagcctttgcacgtgctatgccctccacctggagacctccccacttttcacatgaccaagagaaggaggtaccttctcttccaccaggtctcagtttacatatcgtctccccagagaatctgtcccaactaccgtatatcaagtccacagttgaagactatctgcattaagcacttggttggttttagtcccagtatttattgtaatttgcaaatatgtgtctgtgatatcttacctcccagtggtatatatgcttcatgaaggcaaagaatattgttcatctgagtcggtgtttgttccctgtgcctggtacatagcaagagctcaataaactcactgtatgaatgaataaacccactccacatttttatggataaaatgaatattcaccagtgtcatttgtggccagacattataaaatgttgtgtgtgtgtgtgttatatagtatttatatatactatatattataaaatatgtaatatttatataaaatatgtgatatttatatatatactttatatattatgtaaagataatatgtatctttacatttattataatgtaactctaaagatacatatatatgtatgtatgtatgtatgtatttatctacaatgatctaggcctcaccggttccattttgcaggtgaggaaactggagtgtgagaggttaaataaattgcccaaaggcacacagctaataaatgacagctgtttgacttgtgccaccaccaatcacagctctggatagtttatctctgttctggaactaaaggcatttaaatccggccactgaggaggatttaaccatgtctgccagggcgtctgctgtttctcccgggactaatctgccatgaagcagatgcaaagcttcatttatcacttccaacaaaacatggaagagacaaaaccccagcggatgctccctgcttccagtgtccaacagggcagggcttgtcccatcagggcctccaaggtgcctgtttccctgaggaagggcccctcctcccatgtcaccggggtcactgccccttgtgctggacccagggctctgtgctctgcatcagaccagctgagctgctctgtccactggggtgcttcgctcttaatgaggtaaaattcccataacatagaacaactattttaaagtgtacaattcagtggcatttggtacattcacaatgttgtgcaatcacacttctatctagttgcaagaccctttcatcaccgccagagaagacccccgacccattaagcagtcactccagttccccttccccagcccttagtaaccaataatctgccttctgtctctatggatctgccttgtctgcacatttccagaatcatatcatatacatggaatcatacaatacgcaaccttctgtgttgggcttctttcacttagaataatgttctagaggttcatccacaatatagctgggatcactatgtccttgcaagtttgggcccctggccagttagagatgtcgagtcagagagcagcacagagtacagagctgatagccagacttttctcaacctcctcagacccactaagaaatggggacatcggaatcattgcacctggaaattttctccttctgcaacaggtgggcaatccctggggggaacttgcccccaaacaatgaatcaccctgaggagtgccacagcagatggcagggcctgaatgtggaccagacccattgaggacaccagagtccagccctggccagtcctgggaggtccaatactcacaaagagaaaggaaaaaccttaatatttacatacctgggcacttttgctaaagaaaaccaaacccagaaatcccaagaactaaccaaccccaaaagtttaaattgtgctgtattttaagtacaacagattgtgatctgacctcactgtggcatcagcaaaagatgttacatacatgacagagggtcagaatgttatcagttccttagacaggggccctgagttgtcactataaatacaaccattagattatctggcaaaaaattcagtctcagcacaaaacacccattacttcctagtgggagtatcagcaacatgtaccatatatactggtataattcttgccctaaatcttcccttctttcttcactcaatgtcatggcaacttccatccaacacaaaaacagcaggatttacaacggggtttctcaacttcaatcaccgcactgttgacattttgagcaaggtatttgccctggggttgtcctgtgaattttagaatttttagcaacatccctggtctctacccactagatgccaggatcacccctcccacagttctgacagccaaaaatgtctccagacagtgccaaatgtcatctgagggtacaacatcaagaaccagccacttcgattcaggtcaaagagagcggctacagggagatttctgactgaggttgcatgagaagtgcaggtatgggattttgagccgtgcttccaaaattaggtgaattagaatcaactctgaattttccaggggccaattattcacatttccccaacccctgtgcccgtactacctgcattccacccaattcccagccactcacaggcagctggcatgatgggagagataaagaaatttggaatcaagaatgcaggcttacaggaaagttggattattttgttttgtttagactagagagacttgtgcttgttaaaatgcaccctccttgcatcttgcaaagtttcaatgctgcccaaccttcccccagcccctggcagcagagtcactgaagaaaagggaaggggtccccttcctctcatctctggatggcaggaattctctcctgttctccatagagcagggaaattctaatgcttcccctctccctccagaggccaatctccttcaggcaaatagacaaggagagaggtcttctctgggggaccagaccaaacaatatcgcaatgtttgagggcacagaagaacaaaatatacacaataagagaaagcctcactttcatattacagtaaataaactttaaaaatctcctcaatgtctctttcactcaagcccttgctccttttctttcctcccctgcacaccaaacttcttgcaagaattgtgctcattcactttgtccaccctcatacctttcactcactctccaatccagtgcatgaggccaccccaccccaggactcccggaaattgtcttgccaaggtcactgacgagtgtctctaccttgtcactgaatctaatgaccactccttcatccttatctaggatgtaaaatccatgagaacagggaattatgtctgtcttgtccacttttgtatccctagtactagaacagtgcctggcacacagtaggtgctcaatacatgcatttgttgaatgaatgaatgaatgaatgaatgagtgaaccccacttgacttctgcaaggtatttccaatgctgaccactctctccctcttcgtatccttcccttggtttctagaaagtgacatgccaatggttttcctcctacctccctgaggactccgtccatctcagcctctttatggtgtctgcttccatggctgatccatgagatgctcttcaaggccctgcaccaggaccccttctcttctcactcaacaacagccttttcccagactatctcatggcctcattaccacccagggagggcagtactgtttgagctgccctacaccttatcatcatttgtatctaggaacacccggttcatcctctggagaactaccccttcccactccagcctgccccaggtatgggcacatatctcagagttggcttctcagagcctcacctgcccctggcctgagtgaacagctcagggatggtcatgtggcccaatacaagccaatgtaagtgtggcccaggatttgaatggttggtgatgaaacttctctcttttccagtgagcttagagaaatagggatttggccatcttgcttccctaaggaaagagtgcatccaggagttcagccagctcacacaaaaaaaaatgcaaagtgaagagataagacagagagagagtgaaagatctgaaactgatgacctcatgtgagtccttaaattcagtgatgcttgaaggaccccaccctagaagtttccaagtaaatgacccaatacatttactttttgcttatgccattttgggttggagtctatcatggataaccaacaaccccagctagagcgatgactgccacatctgtatcaccaggcctgattcaactctgagcatcagacccacgtatccaattgtccatggacatttttatgacctctgccaaatggacaggctgctgggaacacgttccatgaacccaaatctggcttgattaaaagagctgctcaccatgtacacaaccaaccccccatgttgtcctcatcccactgttggatatcctgccaactacaaccctattacaaatgttgacttcctctctactatgatatcatcccattgctaaaaacagaaacttgggatgcttcaacggggaaacttatctccaagatgtctgccatcaattctttgcctccctggacatgcaagtcattctcagctaagggctgagctagggcctattcctactctccctttgcatctgctctggccttagttattttcttccccaatagaacgcagtagtagtgatgttctggaacttctgagcctaggtcataataaacttcacaacatctgctgccactgaagaagttggtctattctgaggtggccatgatggaaggaagcccaagctagccacaggaaaaagccatgtagagacagagtgcaatgtcaactaccctccagctattccagttttctcagccctggtgctagtcatgtgagtagagcaaccattcttggatattccagttctagcaaatgccacttgaagaagaagcaaggttccagttatatggattcatttgagctggccagccatttttgcctttgatccaccccagcgggagcatcaaacattatggagtggagacaaacttttccaatgtgcctgctccaattcatgacccacagaatcatgaacacattaaacagttgttggtttacattattaggttttgaagtaccttgttatgcagcaaagataactgaaccactcagctattttttatgtttgccaaaccattcctgaaatctacccaaaacaaaacactactttctaagctcaccctggccagaaaaaatctctattgtagaactgagacaaagttattgatttgcctgtctttctcccttaccataccttgtactactccagggcttggcacagtggctggtgctaagacatccagtatgtatccaacgaacaaatgaaaggaaggaagaaggcctgagtgccactgccctccatgaaaatgttctgtgagtcctagaactaaccgtgtctttgggactctgtggcagcaaagcggtactgcaagtgttattataataacagtgacagaatccaagcctagtaatcattaaccatccccaagagagctagttagctagcaaagaagaaagccccctcctcagggttgggagcactggtgccctgacggcacttggcttcaaactgaactccccacgccttctcacagagctgatctgtctataaaattggtggtttctatagaaacagaagcactgtagtaaagtgaagggaaatcgtacattctgtcagcgtacagagatcaatcctgttcttatatggggccaggactctttcacgctttatttttgagcatctcaactttcatttccatcccagccatctcatctcatatttatgaggctcctgcactggtaatcctgtcccttctcacctagctgcctttgttaactacgaccatgggcagaagtctgtggaaacagcatggaatccctggcatcccctcgtagtgccaatagctccaaaccccaacctgagaggcagaactgggatccctggtgttctggggtggtaaccaagatggtggacggagtcactacagaggaggcaccacagccttccacctagacattataaaaatctactctgtaattgggtacgtgttttacatgcctataccttagctttagacagtctccatgcccttaaatattaatatgtctgcaatctctgttttgcaccccaaagtgcaagtggctttctagcaggcaaggaaacagagtttggcttgtatttgaattgctcatgctgtctctgatcatctacagagaaaattagaaaaggcacaggttatattttagtattttagatgaaggtccaaattttgaggcacgtgttaactcatgaaaattgtctgcttcaatcaagattcactcttaaaataagaaataatgtgatgttttcttcatcaaagagcacttttatttctgacctaacagcactaaatgtattttgcctttttcctgttctaacaaatgactggttggatgaatagaaataaaatgatagatggatgagagaatgaaggatggatggagggatgcatggatgggtattaatcgtggatgtgtggatatatgatagatggatgggtaaacaggagatggatgaatacatgggtagatggatgggtgggtatatggatggatgcttggattcatggaggggtggatggatggatggagatgaattataaatgtgtgaatggatgatggatgagtagatgggggatgagtggatggatgggcagatgaatgggcagatggatagatggacagacaggagagggatagatgaataaatagatgggggggtgggtaagcgagtggatggatggatgatagagaaatcacccatcagcataatttttctaagatgtaaatctaatcatccatccatttattcatttacatttttgagcacctaccatgtaccaggcaagatgtgaaaagcactgaggattcagcactggatatctgagataaggtcccaatccttgaggacctaagatttcaatatctttaaagtagtaaatagattaaaggcaataagagtgggtgcagggagaggagtgcaacatctattaccatgatccaggtgagagctgatggtagcttggtctaggataacagcagtggatacacggaggcagaaatagattcaagagttatcagcaggccttgatagctgactgagttgcacagccctgagtctaaatctcagttcagccacttacacgctgtgtaagcctcaatttcctcagctgtagattgtggataattgtacctatctcccagagttgctatgaggaataaatgagatgaagtatgtgaaagagtcagacatagggcctggccaagaaaatgtttttaacaccaaaagcctccattttaggaaaaggcacccaaatccctgcttcttgaacccgggctatgagctgtgaggaatactaaatgctattagggttaaacagtagtcagaaggtcgagagagactcaaaggcatagcagggcaggatcatgtggccacgcagtgtccagcctacttcctcccctctcccaaggacgcaactagctgtgtgccacaagcctgctccacaccacatgagtccacacgtcatgccaccatggctagccattaaaaccacttcagaagcctgggcccatccatcgcagttggcgcaatcaccaaaattgaactttcatggagccagaatcaaagggctgcataaactaggattgtgtcctcctccatcagaatcatcttgcctctgcgtagctatgaaggacagtgagaacaaaaataagaataactaggcagaactctaagcaaaacagtgcaggaacaaaaagcagggacactggaacagctaggctgcctgctttaaacctcaattctgccacttactagctccattaccctaggcaatctgcacaacttctgcgtgcctcagtttccttatctgtcaaatgggaataagtaccttcttctaggcttatgataactaaggtgtgcaaatatgtaatgcagctggaacaccacctggaatacagtaagcagtatataagtgtttgctctaggtcgacttcatcactgccaagcactaatatgctccagttacctcactgagtacataaatgcactattccatttggtccacatgacaatcctgagaatgggttacaaagcagggggtctggaaatagatctaccagcatcttgctttatgggcagacacagaacctctctgaggctctctttttcccaccattaaaatgggtacaatagcactaacagcaggtacctaataaatgagacggtggattcttttgtatatactcttaaaaaaaatcttaggttggataaatagtccctttgtagacacagatctgaacgcagcaaagccattacctccactttcatgcccttcagctcatgccttaaatgggtttcttccccaccagcctttctctttttaacaacactctgtgccactgcagaatctgcaaagaaaactggaccaggccaacccaaaggaagttctgagggtggaggaaaggaaaccaaatctaaactaaatgacagctcccttgagtaggtatcctgagagtcagcagaggggcaaggctgcataaaggcggggagggtagacagagctgtgccttccaccactgccaaggtctcagctagcaggtgcatagtgaggcaggcctggccatccacagtgtgcagaagactgaggctcagagatgttaagaaatgtaccagaggtcacacagctcagtaagaggtagagctgggattcgaaagcagatctaactatctccaagtgcccctgccatggtacccactgccatccctcggtgaatcacacaagataaaagtataggtgagtctgtagttaagccataacttgttgttcacttgaagaagagctcagatgacctctgttcctggcgggggaagtatcttctcacttccacctgcagttaaccctgtagaatagagtctatcacactcctagaagagcctctggccccagcactcagaagagtcagccatctaaagctgcccagcccgtggagaagctgagccctcccgtttatgtaaaggcagcagaattccaccttgccaatttcttagtctctccagagaggacctcagatgactgagcctggctaaaccggggtttctcaatcttggtattattggcattttgcaccagattcttctctgtttagggggctgtccagtgctttgtagggtgcttagcagcatctctttcctctggatatcattagtacccctttcagtcgtgacaagcaaaaatatccccagaatggccatatatcccatgaagggaaaaatcacttgagattgagaatcactgccctggatggctatatcacagcctgggagataatggacgagtctgggagatgtcacagggggaggagggactctaagacctcccgtgggatggctgaccctggtatagtcacctgagctgagggtgggccctcgactctgcacaccgttagttcaatcctgccagagttgactggtctcagcgagactaactcagtagatccaactcataagaggttgatgtgtaacttgtattccaggctgttgatgtcccaggagaaacagaccttgcaagcagatcagattttcctgttatctaacctgtgccttcttctctagagggaactttggggaagcaaaatcatgataaggctcttgtttggtgagcaggactggagggaggaattgatggaagacttgggtgagtgctctggggccaaatctccctcccctggtccaggaggacagcatcccagcacctcttatcactttctgtctcctacagttaagccatgacctgacgatacatgcaacagtttgcctatcagacagctctgccagcctacaagttccagaaaggcaagcacagcatgttatccacatcttcagcagtaagtgctacatagaagatgctcagtcaacgtgcgtgtttgctttttttttaccatttgcagtcaccttcctaaaaaggaagggtgtgtggggaggggaggaagaaagggaagcaaaagagatttcctgttgcagaagaaaaatggcataaactctagagaggctaccatatctctaatttgacctgagctgagcaatatatccaggatttaaatgatgctggtcactcacttctttctaggtcacctttgtccaaggagacatccttagaatcacaatagtaggagaagacgatggaagaggagaggagagaagggaaaggaggagggaagggagggaaagaagaaaagggtagggaggagaggaagagggagaagggagaggagaaggttaaggaagggtagaaagggaaaagaaaggacaaagagggaagggccagggaggagagggaggaggagttacacagaagctcattccctatggacaacatgagtttaagaaacgccgcacactctatccccctcttagtgatgcacaacacacgttgccatagcaatataaatcatattaatgatcatcatcaacatttattgagcttttactgtgtaccagacactattctacaagcttatctgtattaacaccattaatccttcccacagccctgcgaggcacagatacattaaataacttggttactctaggttactggccagttagtaaagttgcacggctgaaaaacatggcaattcacagaccccacaaggtcctgcattaaaagcctacaatcccagaatttcccacacttgctttttatgtttgttgtcacaagcagcatcttttaacaggctgtggaacacattctggaaagcacagttcaaggacaatgtcggtttggttcaccctactaagtgcatgcctgaggcctcccaagaataagcctcaattgccatgactgaggggcataaccgtaattagtatgattattaacacttatttattataacatcctttcacttgtacttacattattgttccttaagctttacaatttcttcatgagtaaagtactgagattactgtcctcattttccagacgcaaaggctgaggctcacgaagactacctgactttgatccccagcccacaaaccacagtgcagcccaggaacagaggctgaggcagtacattctcacaaagacttcactgcaggggcaaagccaaggcagaaaaagtgagggagaaggagggagggagggagtgagggagaaggagggagggagggagaaggagggagggagggagggagggaggatgaacctatacaaggcagtgcatccccgggccagccacagctttgccagtaaacatcaccgcttgcttgggcacacggcagtgtggaagcccttggccttagcgcattcccttccaggagaggaagggagaggatttatctgctgccttggttcctggccctctggttaaagctttcccccacacacaggtggttaactctattgcatgtacaggttgtgacactcaagctcctccatgcagtcgttggaaaagccagatcctaccccgtagtatggggtttttccaagcattgtctgcccaaacttggtgagacagtttggatgttatcccctctaaatctcatattgaactgtaatccccactgccggaggtgggacctagtgggaagcaattggatcatgggggtgggatcctcatgaatggttcagcacctccttttggtgctctcctcgcaatagtgattgagctctcacaagatccagttgtttgaaagtttgtggcacctcccccagtaactctctctcttgctcctactctagccgtgtgagacacctgctcctactctagccgtgtgagacacctgctccccctttgccttctgccttgattgtaagcttcctgaggcctccccagaagctaagcagatgccagcaccatgctttctggaagcctgcagaaccaggagccaattaaatctctctctttttttttttaaataaattacccagcctcaggtatttctttcagcaatgcaagaatggcctaacacactagagcaccaaagactctgcagctcccacctgggcagaaagggcagaggagactgtgacaaagtctcaccttctcccctaggggaaatgagacagtcagtgttgttaagagtacaggtgacagcaacaacggtcaggactatgcactggccaagaagtcaaggcttggggaacaggtgggccaagtgaatctaggaggcacataaactgagtccaagataccgtttctttgaatccaaaaatgagtgttccttcattcagtggcaaaaagcattcaactcaccaaccaccccagcgcccaagtcacctggatctaaaccacccattggaaatgcagatttctgggccacacccagaactaaaggagtggtttcattgggagattcaaccacggagtctgcatatttttaacaagctctccaagtgacttttgtggtcactaaattttagaaacacctaggacagcatcaaaagctgccctgagcatgccggaactccccagctcatttgatagggaaaaatcgaaacctagaagtgattaactacagatcaataaaacagaacaatgaatcatgccaaaggtcgagtggcagtacgcagcagtacacggcaagccaatctaattaggggccctcgtaaacgtcacctgctcataaacatttataaaaacagatttcctgcatatggaagggtgttaatttttcatatagctgtaggtaaagtaaatgtatttttaatctcatacattgatttaacactgtatttctttttgaaagactgggagactcagtctttgtttactgatttctatatcagagaaactgctggagagagacgccagagcatactttctctcctcaggaataagggaaatcttctgattcttccacattcagactctcccttggttctcagagcccaggctgacatcagatgctacctaacagagacaaatgacacagggtgaggcaaggcatggaagaggggtgtcagttctgcaagggagatgctgtcacttgtaaagattttcattaataaaccttctagtacctactgttgcactgcactgtacccatctctggaaattttttaacaaactcagatttaattttctttctcattaattaattttttattcatctcttccattagagcctaaaacctcccaattacacattattagctcagaggaaagttggtaattgagatggtcccaggattccaggagtgccctgtgcagaatgtctgctttaattagatttccattaattacttttttatcaattaatattgggtactttgggcccaatacttgtgatctccacatcatgcactcttaaatgacacctcatttattgcagtcagtcaagcaagggacccaaaaagagttcagcagagagagcggcagacaggctctgtgcctcacatgcaaatgacatagcatgcttgcttgcaggggtgagtttcatcccctaatgtgtacctcgagaggctaggcaggttaggaaggagagatagagagagggagaggtggggtgggggacagaaggtgggggacagggagagagggagacagggagagggagaaagggaggaagggagagagtgaggaagggtgagaggagaggagggaaggggagaggaggggagggaaggggaggggagggagcaagggaggagggaggggagaggaggggctgggaagggaggggaggggaagaagaaagcaagggaggaaagggaatggtgggaaagggaagaagggaggaaaggaggaagggaggaagggtgaggaggaaaggaggggggagggggaggggagaagggaagaaaaggaaggaagaaaggaaacctacagaaaaacatcaaaagtgtctagtccaatcaaatcatttgcagatagataaatgatggccaggaagccaagtgacctcaccaaccctacacaacattaggctagaacatttttctcccctccacattgtcccctgcacctccctctacccctttactaggggaacacataatttatcatctacactaggacacttttaagagagaaaaggactgctgttaataattatactggggaacaatagacacaaaccccagcacaccaagatgtattgtcacccaacccttcacccctcggctgttaacttatgaacctcctcctgagagagacccactttttcaaggtggcaactctgcctctgcagccttaatatagctcagtatttgcctggaaaatcaatatgcattgattaatgacaataatatgatgcaacctccaccctctgaattcgcttagtattcccactgtctgtcttaaattaaatgtttcagttcacccagtatcttttcccaactcatttctcaactattcttttatagaatgtaacttaattgtactcaataccctaacctaattagattggcctaatggttaaaagtaacccaaaactggactacttgggtttgaacttagtggggtgtctttggacaggttaagttttctatgtgagctttcttatctgtaaaatagtacctacctcatagggttcttatgacgattacatgagctcatgtacgtcaagtgcttagaatactacctggttcatagaaagtgccatgtaagtacttgctaaattaaataaaaataaaaagttagagaaacggtgatcaccaaaagacataactaatttctcgccctaaactaagcggaatatctcaaagtcaaggagaagaaaagaaaaccagatgtgactgaacatagcttcctgtgccagggactgagacccgtacttcggatgcatcatctcatttaattcacagaaaagcccttgaaagtaggtattgctattatccccattttatagatgagaaaacagagattcagagagatgctgtgactggcctccaccatacaataaagccaaatcccctcaaaatccagcacaggtgggacaactggaaaaaaaataaaacaaaagcccagggtttcaggctgactttcaccttctgcttgaatcctccttgtttctagcttccactagcgcctaccccaagggagctctgctcccttctttaaggtcagaacccatgcacaagccattccttggttctgtgaacagctgacactggctgcaacttgcagaaagatttcctaagtccttaggggggagtccaagagagaacaaggacaggagacacagaaatagcccagccgacaatggacagtgccttatcttctggaggggactcactccttaccagggacctcgcaagctcatctcatcccatgctcaggttcctagaacaacatcactctcacctccaagggctggcccccttttcagacaccttgtccctcccatcatctactcacggagtgtctgggtccttatgtgacaatgagcaagtctggactctgaccacccaacctatttactagctactaggaactccctcatatacagtcaccaactagatcatatgtcaattttaataaatattttcactgatttattagtccatttctgctgatacaacaaaataccttagactgggtaatttatcaattgtagacgtttatttttcacagttctgaaggctgagaagtccaagatcaaggtgctggcaggtttggtgtctggtgagagcctgttctctgcttccaagatggcaccttcttgctgtgtcctcacagggtggaaggggagctggaggacctaacaagctccctctagcccttttataaaagcattaatcccattcatgaagacggagccctcatgacctaagaacctcctaaaggccccatctcttaatattgttgcattggggattaagtttcaacatgaattttcaagggatacaaacattagaccttagtaatagcaaaatatctcatgtagtcgcattaatagaagtaccttctctctgggtatgtgtagtcgccagcctgcatctgtcactgtttcctctccccccagtattgggatcacactaggtacatgcacacaggtacacacacatatacacacacagcccttaagcaactgggttgctaaacaaccagcaggtaatacaagcagcagctgccagagtgatacaacgatgtcataaacagcaccagagcagagagtaagaagcaccctaaatgattcatttccctatgttgggagaatatacccagacaggtatagctgttcccatttgtaaatcactaagaatgaaaaactataaccaatatggggcctaggaagatattttgtaaattaaataagaatgaagtatgcagaaaatgtatatttttctaagatgatttattgtatgaaacgccattaaatttcagactatctgttttgtgttcataaattcaagaaaacctggtttccatgaaaaacaattctttttttaaaaaaatgagataaacagataaaaagagatctggttttaaaagctagaaaaaaaatgaaggtaggtaattaaaataaagaaaagcctgtttgaaatccaattgttgataagaagattttaatgctgtaaggagcacagaactgtggaatacagaagcagcactgtgtacaactttccataaatgaagaagaaaagaaggtggtgataaagattgctatggtgcctgttggtgctccaaaaacataaaaccttcttttatccctcattccaagcagacctccatattgtgatacccttactcagagatgttggatattttagttattatgcacaattgcgtgctggttcaataaggaaaataggaagtaagtccttaaaaagaaagattatagctacatttcactggaaggaagtagaatgagtgtcctcgaacagaggaaaaggttaacacaatgttattccacatcacagacgcttcacagaaatgagcaaagatgtggggtgtgcactcctttagggcaggggagaggaaaagaaaccaactcaactgccttctaaaggaagagcatgtgggagggggcccccacactctccagggaggggtactgtggtcagttgaatgatgggcccctaaaaataagtgtccacattctaatccccagaacctgtgtatatgctacctcacacagcaaaagggactctgcagatgtaatgaagctaaggatcttgagtgatgagaggaggctggattatccagtgaggcccaatgtaatcacaaacgtccttataagtgaaggagcggggcgggagggtcagagaaggaggcgtactgatggaagcagagactggaatgacgcaaggccatgagcccaggaatgcaggtggcctctagaagctgaaaaaggcaaggaaacagattctcccctacagcctccagaaggaatgcagtcctgctgtcaccctgctgagtttagacttctgacctccagagctgtaagagaacagatctgtgtcggtttaagccactaaatttgtgttaacttgttacagcagcagtaggaaactaatacaggtaatgtatccaaaagaagagtagagaatgcaaaattaactctcagctcctacaccttctgcctagtttatagggttgatatcttcctatcattagttgaggcattaatgttgaacaacataataaatgcagaatttccatagagagttcaaagagcactgaaactttagcatactgggtaagcctgttgttacaggtaccagtgcagacagaaagctcccaataataaaatgaccaggagtaaattagaaatatgaaagacaaaagagatatgttatagggatgaaaagaatacctaaattacaaaaaaaaaacctttagaacagatttaaaaataagctacactgaatgtcctaaacatcctgaataacatttttccaagcatacaaaaagaaaaaacaagacatttacatggataaacatttatataagtaaatgactgatctcagatttctttacaatactgggctgaaaacgctaatgattaaatatctgcaggatttaaagcactctgttcatttatggaagaagcagaaaagtatttacaaatgtaaaaggactcagaaaggatgtacagaaacactaccaccaccatttacctcctccctctgccaaatactaaaagaaatgcctaaccaggccaggcgcggtggctcacgcctgtactcccaacactttgggaggctaggtgggcggatcacttgaagtcaggagttcaagaccagcctggccaacatggtgaaacccagtctctactaaaaacagtacaagctgggcacggtggctcacacctgtaatcccagcactttgggaggctgaggcgggtggatcacgaggtcagaagatcgagaccatcctggctaacatggtgaaaccccgtctctattaaaaaatacaaaaaaattagccgggcatggtggcaggcacctgtagttccagctactcgggaggctgagcaggagaatggcgtgaacccgggaggtgaagcttgcagtgagcttagatcgcaccactgcgctccagcctgggtgacagagcaagactccgtctcaaaaaaaaataaaaataaaaataaaaacagtacaaaaattaaccagatgtggtagcaagcacctgtaattccagatactcgggagactgaggcaggataatcgcttgaacccaggaggcagtaagccgagatcgcaccactgcactccagcctgggcgacagacccagattctagatttggtctcaaaaaagaaataaataaatatataaaaataaaaataaaaaataaaaaaataaaaacaacctaaccaaatggggtcatttttaaaaaataaaaaatgagtagttacatttttaaaagttggtcgtgagtgcccaagcaaattaaatatgaaattttcttaaaaattgatgtatatacagttatagaaagaatataaatgctataaatagttctttgtaaaagatagagacataactttaaataataattattaaattagaaacacgaataaaaatcccatacttaccattaacaactgagaaaatgagtaaggcttatataagggtaggtcaaactatgctacccaccctaccctgcacaggggaaagccaataaaatactttgtattctgaagacaattaaaaataagttttaggaaaaattaaatttagatacatacttaaggcagctaaacgtatccaagagtaaaaccaaaagcagaatataatagaaaacctaatcacccaccacagaatcagcaagctctctaagggccaaacagcaaatagttcaggctttcgggctacatccagttattgctgctgcctgttctttgttttgttttgtaaccctttagaaatgtaaatccaccattcctaacctgtgtgctgtcaaaaacaggcagtaggttgccagcccctgcaacctactgcctgtagggagttagggaggaagtcaaatttaaaaacaagcataagaaatagaaagcattaagtgagataaaattcagacacaatatagttatcatattagtataaattgcctcaacttctctagcaaaagaaattgtctcacagactgagtcaaaaatcaagtgtatcgaaatattttccataagatgtgatcttaagcaattagattgccaagaggttaaattgaaagcatgggtggatttaataggaaaatgtcaatagaaaaaaaatgcagatgtaccaatatccatatcaaagtaaaattcaaagacaagtcattgaacaataccaaaaaagctattctacattgataaaaggtataattcacaaagaaatatatcaactatcatgaccttttctgtagcaggtagcaatgcattgagatatagaaaggaaactgttagaaacccagaaatcaacaaaatacagtaatagtttgagaatttaatacaactctctttaagtcctgacagatcaaaaaggaaaaatttaaataaggaagtcatgactaatataattagtaatattgatttaaagacatatatcaaacctctctccctacatggaattaattatttttcctgtgctttgagtattttttcggtgatgattaaaataacaataaggccacaaagaaccatcaccagataatttttaaatgtttttatgttgtattatctgaccatgaggctaaagtttgaacaaaacaaggatatttcagcattcataaatcaattaataggtttaatccaaagaggaacatattttaagttaaaaatcatatatcaatagatgccaaactgtatttgattagaatatccattcttgatttacattcttagtaaaatagttcaattattattttaaagtgattctctacctactaaatccaaggttatcaacagaaaaattattgtaatttataaacaagttcagtaagatacccagcataaaagtaaataagtaaactcactgctttttcatataaccccaccaacaaatttggaaagataacgccagggaagaagacatcctattccataaacacacacaaacccaaaatgctataaatactcatatataaacagaggtgtgattgcaaatgttcacaacaggtcctctgggaaagaaagcccggatttatagtatttgctgctctctgtggcttaaataatgccacgatgacctacttcaaaagaccaacatgttaccactgaaggcagatatacaataagatactattatacagtgtttccaacttacagatatacaatagacatgaataacctcaagagtgtagataataaaccgtagtaaaataattagggagtcatgagttttgaagataacctttgtttttacatatagtgtatatagttgtaggtttctataacttaagtttaagaatgcctgtgtttaacaaacacctcatggaaattctgaaaatttaatagctcttatgagcaggtaccaggctgattccagcatatcaccgtttaaaaaagtccccaataatcttaaccagaaagattcagtacttgcaaaaatattactgaacttaactgagagccataaaacttcaacaaatagaggcacacaaagctcacagatggaaaaacttaacatggcactgatgttgattttctttcaattcatctatacatttaagaaatcccaaacgatacccccatttaattttctttggggacagtggagaagggatcctgaaaaagcaatcctaaatttgatgcataaaaacaaacattcaaggaatagctaggaaaattctacaacaacagtaatattcaatgagcatttaatcttaaagacattacaaagctagaaggtgcagaaaagtgtgtcactaaacaccggagaagacagaagctatggtctcagtccagtggggtagaaaactacccagataggtcattctagttccacacggtaagaaccatgatggaatagccaagaggagttgggggaaatgagaagcttgggaataccagagaaaggaagtgacatctgaattgatttgccttttcgggtcgtttgaacctttcgtcaaattggcgtccagaaagcttgcacaatttaaaatcccacaccagtatatgaaactattttctaacatgcttgccaacactgggtattataccatttttattttatcttgcctagtagcttaccttaattagcatgcctgatgtttaacgaggctggtaatatttcataaacttatcggttatttctatgtctatttttgtagaaatccctctttcctctgtgttccctcagtccctcctgctctcttattatagatctcaatacactatgtcacacgagctgtcacagccgcttgcccatccatttcccccagagaccaaaagtcagaagcaggcctgtgtctgtttggtcgctgcatctgcaacagaaggtaccgcccaacttatagtagaaactctgagaacatacacccagtgaacaagacggtgggttttagaacatcttcacctgggtgtcaagagcaatcacatgtgaaccacatcaaaatggtgctgcttcccccgcaacagagttctgccaacattattaacggcagctgggcacaaacaaggaggaaaaacaaaaatagagcaaggctgtagttcattccattgtacgtgatcatcaggcagagaaaagttcgtaaaaatcaaggagaaatttcttcagaaaatacattttccttaagagattgtttcagtgtacctgcggaactgtcagagaaaattagattctccgcaaataacagtcacttgcatttctactttatttctaaagaattcctccactttaacttccatttgttgtgcttttacaacaacttctttaagagaggcatttggtctggtattatctactcatcagactttggaaaggcacctcgggaggtgatatgactctttagcagacgatgagtttattcaagtttgctgtgacatttgtgcaagagcccagcccttcctcttgtagctacttaaagacaccctgagaacaggaactgctccatccctttggtagctgcagtgggttgagtggtggcccccagaagataagtccatctcctaatctcttgaacgtgtgaatctgaccttatttggaaaacgggtcttagcagatgtaattaatttaaggtatttaatttaattatttaaggtattgagatgagatcatcctggtttaccaaggtgggccctaaatccagtaacgagtgtccttataaaaaacagaagaggaaaagacacagacacgtggaaaagaaggccagaccaggtggagatcaaggcagagagggcaatgatgcggccacaaagaacgctgacagccaccagaagttggaagagacaaggaactgattgtcccctagagcctccaaggaagtgcagccctgctgacaccttgatttcagactgtggaccccagaactgtgagagaacaaatttgtgttgttttaagccaccaaatggatggtaatttgttactacagccctacgaaccgaaaacagtgaccaaccccattcaccagccccctaatacctttgtggcatttgtattcccccacccccacatgctgcctccttccctcctaggctgttattcaaaccatcgcagcagcctcctcattgccctcgctgccttcagcctcgccctctccaagcccacccccgctaccagatgtcaggaagaaattccaaaactcaaaccaaaggctgatacgttcttgccctacacttcactcaatgctggcaacccaatgagggacatcaggataaaatcgagaatgcgcggtctgtgcttgtgaattcctaccacctggccccagctagcctcccatcccttatatctgccaagacaaattcccccaaatcccctctcccctggccagaagtgacctccacattcagccccgattatggaaggctgtcacaggctattccttttgctgggtaagcccttccccctttcaagtctatgttcaactgtcatatcctttttgaggacttcctttagctcttccctccacctctactgccacacttaacagagcggagttgtctcctctggcatcccattgtcgatagcccactcctgagttacagcaacaacggccacctgactccactcatctgttgacctgtccatttctccattagcctatgatctcctttagggcaagattcatccttatctgattcatctttgtatcccagatcttagccaggcaaacaacagggatccagtggagagagagatggataggtgggtaggtgaagacacagatgtacggttgaacacacaaactggcaaagttccaaatgaactaataagtggacacctcactgagagacttaaatgcagaagggtgccaggacataagaggaacggctgcgagttatgaaaatgggctccatggggcaaatcaaaagtccactgaaggcaaatgcatcataacaagactggcatttcctggagtttccgggctgatcaatcactttcatatgcatcattcatttactcctcacaatgacctggtgaggtaatgagttactattagctcaatgcacaaggaagctgaggcttgtggacatcagctgaagtctcacagccagcgaatggcaggccagggcaccagggcctaggtctgcctgcctcttccatccaccttctgtcatcacaagccttctgatctccagccctctgatctgccccagtgggaccctcctgcgtctctgctctagttgtagaggacccatcaggcacttagagagaaatgagtggtgttgtgaacattcgactgtgtccatgtggaatccacacacacagtttgcctgaaaatgactgataggatggaaactgacaagtcatcatccgcttcgggcaccagcgatgactggttaacatgaatattgtgttgatttccgctagatagaagaagatgtcacttgtcgttaatggggtgtcacacgtacacttgcctaaaggaaaatgctcttttggtgattgttctcaattttcacctcattttatagccataaaaaagaaaagattcagcagaaaggatgaatccacctaggggtaggatggaaaggcattcttctcatttatttccttctttctttaccagaacaaccaaaacccagtgaaaatgctggtgcaagtcagaagagggggacctgggttctaagagcagccaggtactctgggcttcagatcagagcctcagaatccagcagttatgcccacaaggtagccaaagtccagccagtaccaccggtctctcggccagctatacttgcctctgctcaacaatgatgatttgaacgtacatgtacaaataataacagataacattactgagcactttactatgaactatggaatgtgctaggtaaagacgttactccacgtaagccataaaatcaacctatggggcaggtgcagatccacaaaccctgatttaagaattctgaatcctcaaaagctttgaaaaccaaaacattttttcgtaagtttggtacagacttatttggtgctaagatttgagttaaagtgatatacattgactaatagttttttctatctccttcttactattaatattcatactttttgctacaaaaatatcaacatgcttgatttaagggtgctaccacagcctctgctgagggatgttattaataaatatggtacatttactatattgctttcctttaaaagttaaataaatctaaatccgagcacatttggccccaaggactgcagacaagaaattgagaacctgttaaacccattatatggatgaggaaacaggctcagaaaaggtaggaaactttcctgaggttacagagctcaaaagcagcagatgaaggtttacatctaggcagccttgctccagagctggcccggttaatcagtgggctttgctacctttgacaaatgcccctgctagctggtctcagccccatcctcccagcgcagcagttcagtccctgtttgttcttgagcaagaagtaagcatgtgccttcttagtcgaggtacaaggcaatccccagggtatccggatcataattacaatgctttattaatataaatctcaggatatagacctgtgtttcaaatcaagagtcaaacacaacaataacatcagtcttaggtaactaccagtcaaggattcggatccagacttgcgcttttacaatgagaagcaaacaaagacgactattaattggctgatggtcagccagtatcaaattatcacattttctcacactacagtggttatacagaccctggagctagacaggttgtgctgaaatcctgggtcagccacttaatagttatgcgaccttgacaagttgcataacctctctgtgcctcagttcccttatatagaacatgggggtaatgctagcacccccctcaccagtcgtcatgaggattaaatgagattgtatttaaagcatttggaatatagcaagtccaatcttagcctctgctcccagacagacagatgattaggatggataaatagatgctttgcttcacattttaacttctctgaaattggggctcttcttaccattgatgtgtacttataatgtttatattgttattctcagaaagctgcagcttaactaatggtgcttctttttctttattgcatcttagatacgtggtaatatggtaaaatactttggaggaactggatgtatttttcctctggtctccagagaagaaactgagacgacagcaagtcacagattcaagctgtgttcataatgtgtttccacgtggaggtcacactttcatgttcatgggcagatgaattctaacaccaaacaccaggctgaataggtgttcccattgcaagagaagtgctgtgcacaatttttatttgcatttcaaaaccctaacaaatggccacaatcaactactacaaatttctcctaattagttttagtctgcacttctgtcacctttaggagagagccaaagattttaaccttcaaaattatcagcaatgcatgtcagaaagcatttcaaagaagagtcaaagtgcatgtagaaactaattgctgtatctgaaagtgctgtttgaagaatttttcagtcttcagagaagcaagttccccaccccttgggaaaactagtcttcaaactaaaagtttccccaaatcatatacctgagaaaaatgttaaaacagacttacccaaaaaggcaaagaaataaaactgtaagaataaataaatcagaaatcagatgtctctcccctgtttaaaatcctccaacagcttcctactttacttggaataaaacgcaattcctttaccatcaccttccaggcctcatgtggtctgtcccccacccatttcttccatttttttttcattctgtgttccccttcacaaactgctccaaacataccagtctttgttgttgtttgcttcaaacacatcaagtatattctcgcttcaactactttgctcttggtattcctccttcctagaaagattccctaaatattccccaactcccctacccacggataccaggctccgttgcacaggatcgccaacacacaaggtgacttagacccgaggtaactttttctgattcacacaaaagaaccatatgggctagagcagtcctgcttacctacaatgattcattcatttctagaacaaatgttaattgagcacctactatgaggtaagcactgttctgggcactggaattatagccttgaacagacagacaaggcctttgccttttggaagctcacatactagtaggctgaggcacacaatggatgacaatttaacaataagcgaataagcaaaatatcagaaagtagccagagtgcacagacaacctgacgtggttatatgacagtgactgaatggtaggtagtcaaagaaggcctcctagaggtggtgatacttgtcgtgaaatctaaatggcaacaaggaatcatcatggaatgccatgcctcccctccccaaccccatttgtttgtttggggaggggaggcacggcattccatgcagaggaaacccaaggtgtgaactttcacaaaggccccaagtagtgcacaatcaatttgttttagaaacaagaagttggaaagtaatggctagagaagagaaagtcaaagataaggccagacaggtgggaaggagccaggtgatgtggggctctacaagtcagaataaagaatttgaagctgggtgtggtggctcatgcctgtaatgccaacacttagggaggccgaggtgagcagataacttgaggtaaggagttcgagacctgcctggccaacatgatgaaaccccgtctctaccaaaaatacaaaaattagctgcttgtgatggtgcacacctgtagatcccagctactcaggaggctgaggcatgagaatcacttgaacccagcaggcggaggttgcagtgagttgagatcacggatcgtgtccctgcactccagcctgggcaacagaatgagactccgtctcaaaaagcaaaaaaaaaaaaaaaaaaaaaaggaagaagaagaatttgagctttattctaaagtgagctatgaaaatatttgaggttttaagcagggaggtccatgagctggcgtctattttggaaagatcactctaactcagggttgtcaaaaataactttctgcaatgaagtcctatatccacattgtcaggtgcagtagccactagccatgtgtggctactgagtacctaaaatttgactggtgtgacccagaaactggatatttaattttattctattttaattaattttcatttaaatattcacatgtggctggtggctactctattgatcagcacacctgaacagctgcatgaagaatacatgaagggtgtggggaaagatgagagtacaagcaggaagattaatcaggaggctaccacagtggtccaggggagagatggtagctgcaagcagagatggagagaagaatacctttcagggtggagccaagagtgtgagagggagaaaggaagaatgaggaatcgtggataccacctagatttgtggtttcagaaccaaatggatggtggtgccattttgatctgggaaagactgaggaagtagtacgttttggggaggaaaaaaaaccttgaaaataaccagctcctccccaagtcttcatgtggcagcttccctcttaacttttggacctaaaatgtcagctcaaatgtcacctccccagaggaactgttgcaatctccaccccacttctttatcccatcctctctctctctctgtgtgtgtttgtgtgtgtgtgtgtgcatcatattgctccattgttctcctccctgtagattatctgcaattatttaatcacgaatgcattgcctctctcttctccaaactgtaaactctctgtgcagcgacctcagccccttttcccacagtggtcccacctacctggaacagtatctggcacatagcaggtacttaaatatgaattattaaacaaacaggaataattatcttgccaaacaaaacacggctaaagcctcaaagagtatgtttctggtttgaatttcagacaacataaaatagaagaagacaaagtatgctcacacacctgctcaaataattgttgggatataactgggaaataattaattgggatacattttgtttggggttattttaccagtactccatttattcagaaaactgagtatagtttccaggtaatgagccacctcatctgacagatgcagaagagagatgctaatcaggacggtgattcctagcactacagtcccatttctctcccagagtatttggggagacagctgagagtgtgtagaatgaaagcagggtaatcccaggctgccatttttgaaagttcagagtgtccttaagagccacttgcccttagttaagcacaccaccatcacccacccatatcccgccaaccagcagcagatgctaccccagctgaacaggtgtacgtggctcaatgcaatgagaagggactttgcaattaaacagataataatttgaattcagttttaaggtcttgagaaaattgcatagcttctctgatcaccattccccatctgaactccccaacaaccaaaacctctagatattttcttgccaactacagctaagccacatcacccccaaatttttaagccccagagtacatctttgcatttacttgcttcagcaagttaagcaggagtttcactcaactttgtcattatttttcccactctcctctccaacttcattctctctgtaaacgcatcatacctcagtgcacgcgcgcacacacacacacacacataatcatacaattccacacccacagacacacacagagcttctctgcagcttctttcactctacactgactcacagtcgtgagaacacatttccttttcctcttcacaggctcctgaaatgagatcatatctgctaaaagcaatcgcaagtgctgggtgaacaactccagaaaattagtacaagttccactacggctagagacagagaagaggaaaaatctgttcaattttgactgtattcgcattacccacaaaaggaaacatacttcttatttcttccacttatcccaatccttaacaaaaattaaaacaaaagctataagctatttccagcactacccccaatggtcatttttaatttgtcatcagcattcgttccaaatcagaaatgtaccagtcacttcactttttgagtatgatttctcatcagtgctgctgcatcatctctatttccaaggaagctaaagacaacataacgttttaaaaaataactagaatgcattatagatttaaccatgagtcatcacagacattgaataaaagtataactctgcctccgtgagcctgacatatagacattctgaacaaggaaataatctgtggaatatctgatatagacacaaaggacaagagattaaaaaaaatcagatgtgaaaaaaatgttgttttccattgctttgaaaataattgaaatgaaaaactatctaatatccactcaatggaatatcatgcagccactcaaagctatttttacaaagagtttttaataacatgagagaagtgcatatgctatggttacatggaaaaaaaggcaagacacatgataatatttacagcatgatttcaattatatgaaaatgcaccaacaaccctaaaaggaaacacaaaaaaataccaccgatgattatctttgggtagtcaaaaaaatgtatggattcttatttttgtaatccattttcctatattttccagactttatggataggtacttttttatataaaaacctttcatttggcaaatttttattttaaaaaatcatctaaactttgtaaacttcttttattttgtgaaaatattttctgcaaaagcttctgtcttaaactgccttcatagtattgtgacgatgcttgaggaaacaagacagaattctcactacgcctatacccactaccaatttccaagcgggggcagctaaggttccagccaacactacttttctggaggctatagatgggtgggaaatctggcagtctagccgttacgtagaaatcccaaggcaatcagcaaagaaggctaaaacattaaaaccaccatggcacacgtatgcctatgtaacaaacctgcatgttctgcacatgtatgccccgttttggggaagaaataaaaattaaattaaaaattaaaaaaaactatcagtccaacttacccccccaccaaaaaaaaaaaagagagaacatcttagatagggtcatgaagcactcgatcttctcacatgcattctctcctcctttacacatgaaatccctgcaaggccagcgttatcatgcccatttgacagataagaaaatgaatgtatacagagaggaggaaccttgctcaaggtcacaaatcagtctcctgtcaacatctggaagcaaatccatgtctgtgatgctaatgatcaggatctttgcattataccatatggcagctttcatctggactacaataattgagaaaactgtatcagatacagggagccctgcatatcatcatcatcaggaaagacctgcactgggcctcctgccaaaggatacctaactgtataagtttaatgaatacaggcaaccaaattcccaccttatcccttaaaatcctagaaagaacacagagttgaaattaattgtatttaaagtatagtatgcattttttatttatttttttttttttattgagacagagtctcgctctgtcgcccaggctcaagtgcagtggtgcaatctcggcttagtgcaacctccgcctcctgggttcaagcaattcttccacctcagcctcccaagtagctgggattataggcacccaccaccacacctggctgatttttttcatttttagcagagacaggatttccccatgttggccaggctagtctcaaactcctgacctcaagtgatctgcctgccttggcctccccaagtgctgggattacaggcgtgagccaccacactcaggctgtttattattatggaatactatatcctaaacatgggattactacatcaaaatacaggaagatgcttaaaggctcttgatatttcttttcaaattttcctaataaaagtttatgtgagtttatatgtccataaacatggtatacaaataaccatttagttacatctttgccacctctgggaactgcaattttagaaaactgtcaaactgacaaaacaaagagggaagaaatggaagacttcctatgtcagcttttgaagaggtcatgtatgacataatctgaatatcccattcaaatttttaaccacagcactgccgaagccagccagccagcctgacttagccctcttatgggaaaatgtagcaagtggttctgtggttaaaacaagcacagactcataggagaattcaaaaaccaatgaagaccctgggttccaaatccaaaatgccagacagatgaaaggagagaatggaggatctagcattatatttactgatggtctatttggtaccacattctttcctatgttctaaattagcccttagaataatcttgtgaagacctacatttgctcccattttatagacaaaaagagtcaagattcaaaaacgtcaacaagggcacccagctagtaaatgcaaagctcaaatttaaactcagactcttccacccaaaactttttgattctttacccttatgttttggttttaatattttattttcatatcacttattacactttccaattttaaaagaaatacttgtttattataataaatatgtaaagtagtttggaagattctctaaagaaaaaaatcaagaattgttcataatctaccacccagagacaagaactgttaatactttgtttcattttcttccatttatttatgtttacatataatttaaataaaatcagtactagattgtatataaaggctagtttgctaatttttaaactaaatagagtgtgacttttgacagggcatttagtattacttgtaattatcattttttacatctgcagataattatatcaaatgaaagccacataattattttagctactctctattgctgaacatttaaaattgttttcctcagttttctatctcaatcttgtgataaaatccttttatattaccttttatgtgcatctctaattgtttccctaaactaataaattcgtgggaatggaattataatagtcctcccttatccacaggaactatgttccaagatctccagtggatgcctggtgcattggatagtacccaaccttatacatactacattttgtcctaaacaagatctccagtggatgcctggtgcattggatagtacccaaccttatacatactacgttttgtcctaaacaagatctccagtggatgcctggtgcattggatagtacccaaccttatacatactacgttttgtcctgaacatacatattaatatctatgttaaagtttaacttataaattagacacagtaagagattaataactaataataaagtagaataattataatgatattctgtaatcaaagtatgtgaatgtgatctttctctttatctctctttctcaaagtatcttattgttctgtacccacctattttcagaccacaggtgaattcgggtaactgaaaccacagaaagcaaaactgagaaaagtgagagaatacagggtcaaagagtatgcacattttaaggttctaaaactatatactaaactgctctccagaaagattgcaagaatttatatcctctagatgaacatatcactttatcaccaccaatactgtcagaggcatttgatccagagcaactccatcttgagcagtggctgggtaaaatgaggctgagacctactggcctgcattcccagacggttaaggcagtctaagttacaggatgagataggaggtcggcacaagatacaggtcataaagaccatcctgataaaacaggttgcagtaaagaagcccgctaaatcccaccaaaacaaagatggccacgagagtgacctctggtcatcctcactgctacactcccgccagcgccatgacagtttacgaatgccatggcaacgtcaggaagttaccctatatggtctaaaaggggaaggcattaataatctatcccttgttcagcatatcatcaagaaataaccataaaaacgagcaaccagcagcccttcggctgctctgtctatggagtagccgttcttttgttacctcagtttcctaacagacttgctttctctttactctaggaactcaccctgaattctttcttgcacgagatcaaagaaccctctcttggagtctggaccaggacccctttcctgaaataacactattgtttaaattgttgtcaacgtaaatcgagaaaaaatggtacctttattctttttaaatttatatttcagcaactaaaaggaaagctaattttttttcagatttttattgactatggcaatttttcttacatgagttgtaagaaaaacaactcatttttctgtcaagacacctttttgttgcttattagtgttctttatatatcaaggatagttagccattgtgaatcatatttgctgtaaatatttccctcaagttgttctttaccttttttgtaattgtatttttacttacaaatgtttatgaattttacacaactaactccattatcctttctcatcatttgtttcttggtttttacacttggaaagcccttgctccccgtaaaatcaaatacacattcacctatatttttgtagactttgttctttctactgcacgctgtgctgattcttatttcagacgggtgaaatgtcaaacaactgaaatatccttaaggtttgaaaaaaaaaggagaagtaaatctatctgagaggacacattcactggcagataaattatggatgatcctgccccctttgtaatctcagggatgacaactccagtgtgcaccaaaaacccttagaaaaattctaaatccccttatcctaggtctccagtctgggccttatgggaaccctaaagctgtgattctccccagggagtataaaactttggtctaaaggtgaataactgtagagtcaggtaggttttgtcccaaaatctcaaatcacccaggtattcccagaacgtctatcctgtgtccagccccaaatctcagccagagaacccagggagcacacaggcatgcctggagggggtctttttgagattccagaagccggagagcatgcaagtatgccggccgggaagggggggtgggggggggtcttcctgagagaaagcaattaaaattcacatcacaaaaggaatgaggctttttttattctaaactgcaaaacgtggtgtggttaatcagagcaattataaatggtaacatcattattcaagcttctatttccaaacgaagtcatttaaatgaatacattttctgccttggagcagtagctgccagtgagcctttaaaaagaaaagaaaggagaaaaagaaaaaagagaaaaccggatgaagccgctggtgcaaaaccttggaaaatagggtagaaagaactcagcattgggaattgggagcctggggtacaaacatagatccaacacggtctcattctgtaaccttgggcaagacttcagttcccacctgtgcaacggggaaatagatgaacttgtattcgtgaccccttcttgctctgacattgtgaatctagattttaaccactaaaggtctaatttttctacatgctgcagctgcaattttatagaattcatcaatgtgttaaatacattctcttattcaaattcgaagacaaattcttcagaaactgcctaagctgtctctaaatggtgacagacttccccccaccctactgcagcctgtattgtgtgtggtcttgaaggaaggagcacgtgagtgttgaaatcagatggtcctgggggtcaaatctcagctctgaccaagaaagccttgacattccttccccttggtttgactaaagttttagacaggtttcttcctgataagctcctcacctcccttttgttagagcgtctactttagaaaacttgtaactacaaattctttctctgctcctttaaaaaaattctgctggtcatttactagttttacaacccaagtaatgtctttctcaaggacctgggaagcaaccatttgaaatgtgagcattgaaggagagagcgtccctatctcccagtctgcggaagagtgggagcccaacttcagtgtgcctttctccaactttttaacctctcctatcatgaagatatgagaaagtttacttttcctttagtaaacttaagtagcaaacacagatggcctgagaattccagctcttaagaattcctcgtccctttgtttcaggagagttaagtcctgtctcgacctgattacaatggtcttgaataatatcttccttgcctgattaaatttgtcaggtgcaatttttacttaggcagttccaactgtgtaaatgtacctccttcaacttccttgaacttcagggtccctatccatgaaaagcaaacaacagaaaaagtccttcttttaaggagtgaatggtatatttcagggaataaatcagaacatgcatgtaatcacctgcacagagaaggtgggagattgtttgcaatatctacttccctgtaaccacacccttgggttatcccttcccacactgactgtggccctggccacgtgagttgctttggccaataaggcatcaacaaacatgctgcaagcagaggcttgaagaagtacttgcgcattgggcttgccctcttgttgcacttggaagcctgagagcatcacagggatgaacctgacctagcctgctggatgggaacccacatggaggagaaccaaggtgctccagagggcagcctgctgaactccagagatgtgagcagggcacttgagacacatgagagaacccagcagaaactaaacaagctggccagagaagaataaccacctactggacacgcatgattgtacacaaaataaaacggctattgtataagccactaagttgtgagatcatttgttacacagcaaaaactgacactatcaggcactgcatttatgttcatttcctttttcccttttctaatggatggctttgggtgttggctaggaaggctgagcactagcaaaacagtcaccaacccaatcagaaatggcaatggtctctttatggggcgctcttttcagctccttccagctccagaggccacaactagaccgagggaagaagacataggtgggaagatcccaataagtccctaaactcatctgaaaagatatgtgggtttcctaacaaactcatatagcatcaccaatatgtgggtttcctgattttggctcaggcacccttgggaaagtttcacgcattcctggaagtactgaaagaccttcgttaggttgacgaagaggtgtcatccatgagtttctgcctacacttaccaccaaattttcaaacgtactcagcatcattatgctgccggcacggggctgggtggtggagagagagagagccatgactaagaagccatccatctgtcctcacagagctcactgtgcatgtgggaggtagaccttaatagagtaaacaaacaagtaacataattatatcatgtgataaagattatgcaagaaatacacacagagcttggcagagcgtgactgagcacgggaccatgaacacccactcagcaaggagggaagggaaggcctctctgaggaggtgagatgtgaaataagatctaagcgtataaaaaaagccaaccattaggaaaaagaaaaatctgccaaagagaactatgtgaaggccctgaggcagcaaggagcttctagaagtcagaaggtgaccagtgtagatggatcgaaaggggaggagcgatgggagatgaggccatggaggtgagcagggccagctccgtccactcggcttccccagccaaggacctggttgcctcccaggtccttgatgagcagcctccatccctctgctcctctcccacacccgccctcctgaggttcagctccagggtgccattgctgctcttatgacacggagagcagaggttgaggatctgatgactgcaggcacaattcctctgtgccaggcactgcgtgaactttctgcccaacttcttataatctatccaggtagatataatcactacctcccacataccttacgggcattagacgatcttcccaaggtcacacggccagccggggtcagcaagcagctgccagtgctgggatttgggcagcaacctgtctacacaggctcagactccaggctggctccggtggctcctttggtgttatagtcacttccccactgggtgctttgtctcttctgctcttgttatttcaagctctcccatcctttgtgtgcacatcctttgtgtgtctcttcagggagccccaaaagagacccttaaacatctcctcttacatttcactaggttaaatttaggccactttgtagcctgtcacagccatgctgagtgctaaaatgccctacaactccaaggttggaaataacaatgaaaatgagttgagaagggagacccagtgttggctgagtgatttttctctgccagtcacagagctaagcactctacatcctcctgctgtttaatcccttaatcaaccccaggaagctgagcaacttcccaaggtcacagagacaccaaggcagagccacagtgggagtccaggcaccaccagggtgttctgcctcccaagtgaagtccccctggatgccatatccactatcagagggacatctccaagctgggcacatgacaccagcacagaaggtgtcttgcaggtcctgggctcctcctgggatctggggatgcccacttcacactcctgagacaagtgtagtccacagggaggtgtggccagaggccctgcccacaacccactagaaatgagagatggtttcacacaccttggaggtactgcccagagcttccccttccacttccaccccactgtcgtgtttctttccagtttcctgccttacttctggcaacctaatgttttgtgtataggccttattccattttccctgtttaacataggttgtatttccctgggcacgctggccccatctccatctcccatgggtcccaatttgcccttctccaccaccaacacacattcttccaatcagacaactccactttggtctcagctccccagcctggagctgactggtcaggtctaccatgcccatttgagttttatctgcaggataccaccatgttcgctcacaatcacatgcatgcaaatatggacaggtacactcagctgcaccaaaacatacaagttaataggcatgcatttatccacatgtgcacaagcacacagctccccatatataagcaggtatgttcatatatgaatgcacatgtatgtacaaacatgagtgtatatgcaggctcacagacacatacatacatgcacccttcctcaattcacaaagaagtaactaatcaaatgccacaagtcattcacaagccacgagaagactggaattgacagaccatataaagagacagacagaaaaagtcctgaacatgccagttaaaaaggctctgctattgtctatcacacagaagcttgtaaaaagaccacattatttctgacacaaatacagctctccactttctgtagaaggattccaataaagataagagctttctcattattctaatgtggaacaaaaacaatctcccctttccaaatcagcacacagaagtaaagtctccttagttaactctgcagctccctaccccatgatgctcagctcactccaccatcatgcagcaaattttcttgagcacctactatgggctgtcatgcaagttttattatttagttctcacaataacttccaaggtaggaatcattgcttttatttttacagaaaagtaaataggctcagagaagttctttaacttaaccaagtcatataggtagtagaagaagagcctaggcttgtctgacaccaaagtccattctccttgtatgatgccagtcataagaacaaagagttcaagaaagactcaagacctaggaatcagcaacagttaaaggaatgaatgcatagcatgtggtaagcagagccagtaagtgctaacgacagaggctgaccaggtggcttaggaagttttaggtggcctaaagggtgaatgtactggtagaagacagtggggtaagacagcaggcaattcaggaagaaggaatgaggaataaccagacatgaagattgagtgaatatgacccaactgggagctacagcaggagggatcttgaaagaacggaatggaagttgcaatgggggtcaggactttgaagagcaggttcaagagcctggatgccattacttcaacatttttacgactcagcaactccatgccaggccctgtactagaaagtgggaataccgccgggtgtggtggctcacacctgtaatcccagcgctttgggaggccgaggtgggtggatcatgaggtcaggagttcgagaccagcctgaccaacatggtgaaaccccgtctctactaaaaatacaaaaattagctgggtctggtggctcgtgcctgtaatcccagctactcgggaggctgagacaggagaatcacttgaacccaggaggcagaggttgcaggagccaagatcacaccattgcactccagcctgggcaacagagtgagactccgttgctaaataaataaataaataaagtggggatacagtggccaacagaacagaacagaacccaacagaaccaagacccctgctcttgtagagcttactctcttgtgggggtaggggtgggaaacagatcaaaaacaatgcacttttttaaaaatacagactttttaaaattatatagaatgaaggtggtaaatactacagagaagaaaacctaaaagtagatcagaggtaaaggggaggggccataattgtaaatagaatggtcagactcagcctcactgagaagatgttcaaagtctagcggggggatgaggagtgcgccccccagagccaggggaaggttgatgcaggtatcaacagcagccaaggtgaaggtacgcctccctgttcaaggagcagcccagcagtgtggccagcaaggctggagccagatgaatgagggtaagagaagcagaacacaaggtctacatttatgaccgtgaaccacaggagcctcaaaaggcaagacaacagggacataaaattagtacaatggtgtagtgagtccaagttaccgcggatcatttcattcatctctatcgatcattcattccatgaacagagcagcaggaaaaaaaggatcttaatatgatattcaactaatccttgacattaatatgaagctctgacactatgccaacgaatatgtcattgtacacacactaccttcctaaggccacaggaaatgggagcggcctcaagccagattttcttctgtaccagaatcattttcaagagcgattaggtgggagggcacagaccctgaggtgttcccagcccctctgtgactcactgaggtgttcccagtgtctccaaagcaaaccagcttcctgcagcctccacctgtccattttaggacgaccagcgtttgatgaaaatagacctaagcattctggcatcttcctccacctggactcatcctgagtcacccactcccctctgcagcatcctgtggaatccaactccagcattccccttagtacagctcgagagacagtttctgaatggagctttgtctagccctaagggtcatatgaggtcagatgaggccagcaaacagaactagagattcctagctcatggacgatgatggtgactgtgacaaagaaagcgacagtagatagtcatccattcttccatgcgtcactcactgtgggaaggagtttacatggatttatctcatttgaggctcatgaaactcctacaaggtagatagtatttatatcctatctgcagatgaagaaactaaagcataaacagtaagcagcctccacacccgactgtgaagacaccgaaccacacccagccctagaaagagagctgtacagtgggggcttctgtgaacaccagaggctggggacagactctcctctgggagaggactaacccatccatcctttgcagttgctgtcttagaggccacatccctgcatcaggctagaccaggtagaaacaaacacacactgactcccgcttcagcggttccaatcctcatatggtactggggctgtaggaaggcacaagaggccacagaactcaggacagttggtgggcagccatcatctccacctagacccccacatccacccctccctgcctccctctgttgtttccacccatcctcgcccctgcaaccagcactgcctccctacaaactcctctgaggtgataccactgccctgccaggagcttctcccccagctgcccttgcactttctacactgccctagagggtgcctactggccacatgaggctacttgaatttaaattgactgacattaaataaaatgtcaaattcagttcctcagtcgcacgagccacatttcaagtgcacaatagccaccaatggttggtggctatggtggtcggcagtgcagatacagaatactgccctcaaggcagaaagtcctgtctgcagctctggcttagctgacaaaatcccaacccctcatggggcctgccagacctgcatggtctcaccttgcttgcttcccagcctcttctggtggacacttggtcatgctgtcacactccagccacccaccctgtcttcagttcctcaaacataccaaatgtcagccacctcagacactcaccccgcccacactccgcccacccctcccccacagtttcctcggctaaagcccccattctatcaggagtcactgcaaactttgcttcctccaagccatcatccctgacacccccacaccaaaattcacccatacagataaacaatagttgcagtaattatcataacctctcactgcctgtctctcctttcatggcacttatgaaacgtgtaacatcttaaggccacagtcacccgaaagcttgacgggagctggggatcctcctccatgctcacacatgtggctgctggctggaggtcacgtgggcctcttcacaggacagcttgccattgcttccctctgagcaagggatcccacagacaggccgagatggaagctgtagtagctcttattacaatcgaatcttggaagtgacaaatcaaagcttctgccaaagtccactgatcacacacatcagccctggaacaacatgggagggattctacaaggaggcaaggattttgtgccccatcttggagacgggccactgaaggctgtgtgtcctgtttatcactgtgtccccagagtgttgaaaatagaataagtgctctgtcaatgttaccaaaacaaagaatggcagccttctcatcagaggggcctcactttccttgtctacaaaacctaggagtcaggcgtgaaaatatttaatgttcttccccattcgaaaagtcctctggtccatgttgactatgcagtccgtgcttgtcttgcccttagttgaagtggtgacatttaagtgaacagctgtggatctgtgctccacgggtctgctctctcagggacagggtcatgggatgggggagatgtaccaggcttccctccctctgacttgggtctagtccaggcttcccatcccccatgtgctgcaagcagctcggtcatacaacacatggcaactgacaggttcatgacggccaatgaaattatatgcaccatacagcagggaaacacactcacacaggaccagcagagccactgactttttattagatgcttctcccaggcaataaaccaggagagacagtggctgcagggaaataggaacccctggtcagaacctgtgactgggtcagtcatttgcagcagagatgaacattgagtcttggcctcaggggtaaagagtcaaccggagggacatgctaggaatgagggcaaccattcgacgaggtgacagtgtgccttgtgacctgcaactgccaacacccatgagcatcacaatgatggaatagtaatagctaccttgcaagaagcacctgctacatctaagacacttcacatgctttatccctaatgcttgcatcatcttctagacactaagcccatgtttatcctttatcataaggtctcaggataacatcacacagcatatgacagagagtaagcactcaataaccattgtgtgaatgaattagtaaatgaatgggcaaatgccatcagattggcattattatgcccattttatggaatagaaaacttaggtttatctctttgctccaagttatgtgggtggtactgagtaaagggctgggtttgaactctcaactccctgattccaagtctgagacccttttcacattacaccaaatccttaaatattttgcacatgggtgcaagcacaattagtaaaattctaccaatttccatgggatagcacagttcttcatgaaaacacagagatcaggaaatatttgtgtgagcagtgagagatgacaaaatgtagcactgccgtggtttgggagaacccgggagtatcactttagcagttagccagtgtacaaggcataccttggcccatgtggctggtgcccttcctgggtcacagcaagtgagcactgggctttcccagtgaggctgacaaggactgcccaggtagaaccaggggaacaggaaatgtgtcaccctagaaacgagtattggtttattattatacaaaactccactggctcccacaaatcaactcaggtaccacaaggatgttccatcaatgttttcattcccaaacacttgattccatttccccagccactccctcctccctcccttgacagcagaagagtctacagactgctgtattttctgatttgctttcatgcttcatttaccttacttaagtatgatttcaactgggaaaattgatgattataagctggaattttgagatgtaaacttgaaatcactgagaatgtgaaaggcaatgagcacagaaaaacctccagtcacagaaggtcacaccacagtcacatccccttgggcttctcccaataacaccacagcccttgtggagatgttgaatgaagactgagcagcattcaccaatgagtaggatgcacataggtgctttgtttcttataggcttgtcattattgattattgtagaaacaaacaaaaaaatgtgcctaagtatcatgacacgcacaaaacatctatcatcttacgaagccgtcaccgtttcaaagagatattaaaaaacatatgcacttttaaaagacattttaaagtctatgggaaaagaaggcatgatggtgaacaacttagaacaggggtcagaaaactatggttggctgcttattctaaataaagttttattgggaaaaaatctattggaaaaatatttcctagctggctttctagagaaacggttgccaacctctgatttagatactgcattgaggatttgttcagcttttttttaatgttggtatttatgaagatgttaagttaataagtgactgataataaaatcatctggtgcatgggatttagggttgttttgtttcgaagggagaaaaaaatgtttttaatgtataaacttacacactaatgggcccacatcaagaatgggtaaaacttcagagagccatagtgtatatcaaggccaccatacaccctacgacctaggtttacctctgtatctctcactgacactctcaccaaaaaagtgtgttcaacacaatagtgaagatgatatgtcttggaaaaaataaagcaaaatggtcacctcaattatatttttaaacaaactcactgtaaaatgagaagtgactttgaaaatgtaggtactgtcatggtttcagaactctaagtcaaaatcttatttttctttatgaagggaataaaatggtgacacaaagaaaggtcaaaatctaaataagaactaattcattactcaccttaatgaaaaggggagtttgcagagttagataatttagcagatattgtttcataactgaaaacattcttatgtgaagtggacagtattgatcagaaagagtttttgttatacaaaaaggaaagaggtaaagatgacctggtaggaataaagggtattatattagaaaatttagggggtgaaaggaaagctttacaggtcatttcgaccttgtggagagaagcaaacccaggagagaaagcgggcggaactctgaaatggtttgcattcttttaactacaaaaatgagggaagctgaaaacagtaagaatttgaccaggctgagttaagggttgtagttacatttatcgtgtaaaaatgcaccctcaagggactggacctgaggctcctttcccatgctaatgaaataatcatagaggccagccacctccagtcttgttctgaagtctgaaaagtttttctgcaaggcactaggatagtaagtatttttgggtccacaatacatacattatctatcacaactgctcacctctgctgttgtggggcaaaagcagacacacataatacataaatgaatgaacatagctgtgctccaaaagaaaaaaaaaaagaaacgtatttatataaataagctatctgaaatactgtatgattccacttccatgagttacccaaaacaggcaaatccacagagacagaaagtagagtggtggtttccagggactggtggggggcagatggaaatgggaagttactgtttaatgaacacagctttttgggggatgatgaaaaagttctagaaatggataggaatgatggttgcacaacacctgaatctacttaatgccactcaattgtacacttaaaaatggtcaaaatggtaagttttatgttatgtctattttaccacaataaacaaattaaatatatattttaagataaacacataatataagcatatctgattccttgttgcaaatatttgtctcacccttggggtccaagtgataactgggtggaaagtcccacgggataaatttaaaaccaggttcaaacaatcccagcccataaaaatttcttaagactgctagcaggttaaacagtcttccaaatacagccaataaacttttcattctattaaatattttttgcctgttgagatgagaatagaaacaaaattcttggttttcagtttactcaaagtactatgtgtgacataatttctctagaaattatattgaaatatttaacattactatttaaataataaacaaaaatcagcaattaaaaaaataaaagactgcccaatttggtccccaagtcatagttcgctatcccctactgtagaatttggaggacacatccaagaggttttgtgtgctacatcaagaatgatgtcatgagagaaagaacttgaggtctggataaaaggattaaattgaacccggacattgaaaaaacccctctgctgattctagacaagttgttgtagttcatatatagtgtcaatgcacatccatgttgcctcacctatttaactcatcagtgcccatccctggaaaatggagaaaaggaggaaactcagtctattggtgctcagtctattgggccagtaagctggcccaggaagcaaggaacctagctgccctgcctagcctttcttcctgacagccaggagggtgaggagcagaaaaaggagttagcatctttatccagcaaccaagaccaaaaaactcttagtgttttaatggcatgtgtcaagatagctgagccaaaaaagaaatcggaggattggaagattagacttgactagggagactgtttcagttacctattgctgcataacaggtcactcccaaattagttgtttaaaatgatctcaatcatttatggtctccatggatcaggaatcactagctcagctgggcagttctggcttgatgtcactggcacaactgcaatcacatagagactgatgcagctaagggctggtgagcacctctctcactctcttcatgtagtctcaggcctctccatgtggtctttcatgtggactagttagggcttcctccaagtatggccacctttaatatgttacatggtgacacagaactccaaagatgagtgtctgaagaaagagaacaacagttgcatagccttttctctaacctagccttggaagccacacagcatcagttccactacattctatttatcaagtcagtcatgagtttcaaggggaagggacacaaactgaggcatgacgagcttccggaaaagcacacggaacagaaaatatgtatttggccttttaaaaatatacaacctgcctgtaatcccagcactttgggaggccgaggtgggtggatcacacggtcaagagactgagaccagcctggctaacatggtgaaaccctgtctctactaaaaatacaaaaaattagccgggcgtggtggcgggtgcatgtagtcctagctacttgggaggctgaggcaggagactggcgtgaacctgggaggcagagcttgcagtgagctgagatcatgccactgcactccaccctgggtgacacagcgagactctgtctcaaaaaaaaaaaaaagtatgtgtgtatatatatatatgtatgtgtgtgtatatatatacacatatatgtgtgtgtatatatatacacatatatgtgtgtgtatatatatacacatatatgtgtgtgtatatatatacacatatatgtgtgtgtatatatatacaatctgccataagaactaaaactcatttgggcctttcagtttatttacatatgaatacaattaaaatactcatgataaagaaaatattctcggtcctctttctttgctcacacactccttggaccagcatttcccagactggtaaaccaagacatatgacatgaacaacctgacttatcaccaaaactcaccaacattagcctaaaatattgcatcatgccacctttctggtaggattcagtacctctctgcttggtgattgccctgacatcgcttgtcacacagcgaaataaccaatttatgcgagtaagccctgttgagatatcctgactcaaatagaagagaaactgtctggacacaagcccaaaacacattgtcagctctccactcagtatagtcttctcagtgacagacttgagtcagtgcaatttcatccattaagtaacgggaatagtagaaaacttttgggatgttattctttggattataatttaaaatatgtgtggcaccggtatgtattcatctgctatgtatttatccactcccatttcattgatctctccctaggcacataagaccacctcatttctgagcttctcttgcagttctatcgagaccatgtgactggattccaatcaactgcatgacttgtaggccacttccaagccttaccataaactccactctaatgctccacactttttctcttcttccttccaggctgaactcagagaccaaatgtcaatatgacaagttagaaggaccccagagtcaccacttgtgaggtgccacaaaacctattttgaaatgtgacttgaattagaaatcacctttgtatgtatgtattaacccattaggactttttttttttcctgctccaaaggtgagtaccaaatgaaaaaatacaaaactcaggtgctactggaacctagaacaatacaattttttgttatacaggctgtctcataccttagagagccagatgccaggcacacatcccaaccaaaaagccactgaaatgttagagcttattggtattgcagtataaccaagactagtctgactaatataatgttataaccaatatgaatatattaatgagcagaattaaaaattcacataaatttttaagttaaaacataaaactttaaagaaatgtcctccttgaggcaggttcatctggctatgccccagactcctgggagcacatgcactttctcatctgctattaggaaaacttcaatggtgatgtctgagaaacatcctacagcatttggcagagacagcctctgaaaccagatgaaacccagttctgctacttcctaactcttgaaccactgagcctcagattatgtgatgggggaataaactgttattgtataatgtggttaccactggtgccagttggccaagaagaacagcagaatttgtcatagaaaagcaacagctctttgtttagggaaacatcctaatctgcttataaaaggtgaggcctaccaggacatgactaagatgaaaggacattggctgatgagaattccttgtcgtattggttatctactactgtgtaacaaattaccccaaatcttcccagcttaagttgacaacactttgtttagttttacatagtttctactattcagaagttcaggagcagcttatctgcgtgcttctagtgtagggtccctcatgaggttgtagacaacattaatgaataaatagttaaaagtagaaataaccccactgattctgttttaagtcagagggcatattgaaagcattctagcaaggggaagagcatcagagctgggggaactgggagaaccgagttctaatcccgtatttgtcttgcaaacttgtgtgaaccaagtgacacacccaatttaggcatccacttcagggctcaggtcatccttaaacccctcctacctctgaaacactgggctccttgggcccaatgtgccatcctgacattgtgagcatgagaagtgaggacaggcaagcacccctgtactgagcacaaaaatgtcaggcctttccgagtcttcccaggaaggactgtcttcttcttcccacactctcagaacacaggatcttaccatccaactcactacattttcccccagagaagaaatcccatgtctaaaagcaagagcctcttgttttctttctctttcttcatccttttttgaaaagtctgtttctattgtgacaccaatccaacccattccattgctacctcctttataattttttttaatagtcagcgtatcactctgttgcccaggctgaactgcagtggtcatagctcactgcagcctcgactcctgggctcaagcgatcctcctgcctcagtttcctaagtagctaggactacaggcatatgtcgcacatcactatacccagctaaatttttattattttttttgtttgtttagagacagagcctcactatgttgcccaggctggtattgccatctacttaacacagttccctctctgcatgtcatggtagaacacaggaaaggtgacaacctgattgccaggtgaaagaagagagttcccagcaccaagtgtgcttccaggcatattaggcagggagtgaggcaggaaaggaggaggaatgccagcacacatgtgagcaacttctatatgtctggctccttgcatgcacaattttaagatccttacagcaatcagctgaagtacccacatgttacaggcaaaaagcagtgaggctcactccaagcagttacattggccaataccctgcagcgactgcatatgagaagtgagatttgaatagcatatgtgaacccaaacatggggtaaagaagaaaagaaggaaggaggaagagaaagagggaagatgtatccgtgattgcttccttccagactggcacaaaaatgaaaagctagctctccttgatgggacatgttgatggtatgcaaggttggatccactttgcacacacaagctccttctgctatgaaagagatttaacaacctcaatgaatccttagggtgtatggagtggtgacggagattattagaaaaaaattcttatctacctttgatgtggaaggaaaggggggcccaaagtggtcattataaccaacttgaatcattacttgagaaccagcacagcatatcgtcaagtgtggagactccagaggctgagtttgaatctaagctttgacacatatcaatatgaccttgagcaagtctcataatagctatatgtctcagcgtcactatttgtaaaatgggaacaatagtatctactgagaaaacttgttagaaagattaaacaagtcaatagatttaaagtgctcaaaagagtagctggcatactcttctgtaatactcaataaatgcttgctataataattagtggtgaagaatgtgtactccaaagccagactgccaggattcaaattccactcaaccattccaagctcatgaccatggagaattgacatagcctttctaagcttccattttctcatctgtgaaaggagcgggaaaaaaatctatctcagaagagttttagcagatggtattttccaaagatgactacaacagtatctcccacccccatttgcttctacactgtgactttgccactgccccattaacacgggcaggctcattctcctcccccttgaacctggttgtgactgttaacctttccacaaataggatggacatagcagaagtaatgctgtataacttctgagggtacattagaaaaagccaggtagcctcttcctggttccattgagatgctcacttttaaaacacagcctccatactgtgaggaagcccaagcagttcaagaagaggcacacttgagagaaactgagccctccagctcatagctaagctgagctcccagcactcccttgatagtcagggaagtgagccattttccagccctcaaactgtcccagcagatactgcatgaaacagacacaagctcttccactaagccctgccgaaaatgaatatgcatgagcaaaataaatgattgttattgttctgagccactaagtttctaggtggtttgttatgtatcaatagtaactaggacagaaacgctggggaaatttctaaatgacaataaaataaggacttagcttagtgcctagaatgtgtgaagaagtgctcattagcgatgatcattgttggtatcgttcagtaactttccaaagtcacacagctaataaaggtcatgaccaggattcaatccgaggcctccagtctcacttcatattatgctgaggatcaggaaggtaggcaaatccaatgttcaaggaaccaagcacctcttcttccactgagctggaaggctggagtatcaagatgatgggaacatgggcaatgcctctttgtggctcctacactcaggtttggattgcaagcagagaccccagagactatggatgagggaacattggctaacattctttcttttcctttaagctaagtaccaagagtgtgagatcgttgattctcaagggaaaagctaccccctctatggaaaagtaaaatatgcaaacattaaccagaggatagatgggaatgcataattcacaactagctgtctctctggaccaaagcaggaaggagttggttgaacttcaggtcagagaaaaacaattctagctattgcattccagcacctacgtattcaattaccataaagttttttgcccctggggagaccactggaacctgcatcagcatcaaaacctttcttaatatgattctgcggtaagctgagatatgcagcaccctggcaattgatatgcaaattaaataaacaaaacgacataataaataattaaatcagtctaacttgatgaatgaattaatcatattggagtgatgagaagaagccggcactgtcacccagaagatcattgagaaaaatgaaacattcataacaaggccatttcagcataggatgttgcctcctatattgattacctgcactagcctttgaaaagaataggtgctcaataaatattagtggaatcaaaagaacttttatcaccaagatcatctctctgcagtatatggaattattcattcaataagcgattgcatcaacattttctcatttcagtcttatttaagaataaagtaactctgaaagggagacaagggcagatacttactgatatctcccatcttacagttgaggaaaataaagctaagaccgagtgacttgcccactgtcatatggttggaatgagaggaacttagactcaatttgggagtcctggcctctattaccctcctctgcaccccactgatggggatatttctgtctacataagtgtgtatgcagggagagatgctacagccacccactacttctccaaccatttcccgtaataaatcaattccagattaatttcaagtttatacctgaatacattttgtgcctccacccatttttgccttttgtttagttactgtacatagcatctctttataggcaactaagaaatggaggtaggcatgaggaaaagaaaagtactgtgcagccattaaaattaatggtgaagaatatttagccacataggaaaatttccgcaatatattgctaagcaaaaacaaaggctttcaaactgcacatatagtaatagacacacacatacacaaagagacaaaaagactgaaagcacacgtcaaaaagcaaacagtcattatttccacatggcgggattataaggggtttttatttctctctttgggtatttgtaaatacttttagaaatttatacaataagaatgtattaacttttgtaatttaaattgttatttgtaaaactaaagcaaattatagtggtgggggtggggaataaaatgcttctgaggggtgggaatggtggtcaggctcatgagtgtaatcctaacacattgggaggccaaggcacgtgggccactggaggccaggggttcgagaccagcctgggaaacatggtgagacccagtctctaaaaaaaaaacttgtggttttttttttgttgttgttgttgttgtggtggttgttgttgttgttttaatcagctgggcatgatggcgcatgcctgtagtcctagctacttaggaggctgaggccagaggatcacttgagcccaggaatttgtagctgcagtgagctttaattgagccacggcactccaatctgggcaacaaagtgaaaccctgactctaaataaataaaaatgactctgagcccacatctcatagaagtcatatatgtttcagtattttgttttaaagaggatttcttatcaatatggctaaattttgaggctgtgtgggatgcgaaataatttagaacttcatcccacaatgagatgggatatgccctcaagtcagtggctctgaaacaagatgaaataattacaaaaaagaaaaaggaaggaagggaggaagggaagaatggaggaagggaagaagggaaggagggagggagggagggagggagggagggagggagggaataaaaacctgccaaaggaaaactccctagttttcctggaaatacccaaccctttcttcttttcccaattccctaaagggctaaataactcaaaacagaatataaacttcagagatagcccttatttctggctctataggagattcgatggtgccaaggaaaacaagttatgtatcaaagaaaaatcaactagactatttcagaataagtaagagacctgaaaatatacacttccattccaaaacgagttaaagaaaaaaaaaggcagaagggagaatcatgcagcacatctggggtgaaaaaaaaagagaagtaaatagatttttaagtgaattataagtttgctgtgtgacagcaatgacttgaactctcaaagaaattgaaaaaaaccacagaaacaatatatcaaaatctaaaatatgaaattataagacaataaagtgacatgatagagctaggaaaaaagttaaatcataagttcactgcagaatgcaaaataacataatggagcaagtcaacaatgtaattataaaaaaatcaaaacttgagattatcaaatagaatgcagaagtacatgacagactcagaaaaagcaacccaggagacaatattggatgcaaaaaataaacaacaaggatctagaatgagcgggcccaagaaagaactgagaaagcaaaatagaaagtagtcagtgatacgacagaagaaaatattcataatcttaaagaaagtctaattgtgactattagcaggactcacaggcaacagaaaaaaattactgaaaagcaaccaatatggagaaacatcctagtgaaatctctgaataccaaggattaaaatagaactgcacaagcatgtcattcaaacacttggtcacctgcaaaggaaaatatcttttagcatctctagatttcaggaaatcatccatgaagatctgaggaagaaggtattattcttcacccagccaaccagttattcatataaagggtgaaaaaggaggaggagaaaagagaagatgatcgtgaagacattagaagggaagaaaaaagatgaaggaaaagaagagacaaagatgaagaacatattctcaaaatacaaggaatcatgaatgcactattgctgaactgaaagctaggagtcacattctaaccaaaagttcaatcaaaatatagatctcaaaaaatgagtaagcagtaatatgaaggcatcttaaatttttggtgaaactcaaaaatagaattgagtctaaataattatggcatagttatacaactttttaattgttaaactttattatttaaaaaattttttaacctacagctagaaataaaagtagattgtgggtattccctatagcaaaggtggatactcataacaacaacaaaaaaaaaacagatttaaaggtaaagatatcagttaaaactaaaagcagaatggggttaactcaacagtaagacattcttaaaatgaatccaaaaccaataaaaacaagtatacaacatttatcaggaagaagactaaagctgtaactcaaaaacagaaaataaagacaaaaatataccaggaaaaaaaaattctaagaaaatgaaagcagagattattcttttatacatgattaagctggattcaacaagagaaatagtattaagttttaccaagaaagatcactttcaaattgacaaatggcacaatccacaataaagatataagtgtcaaaatgcccatggtctggattacacagtatcaaacattgtaaaacaaacaaacaaacaaacaaacaaaaaaacaaacaaaaaaaaccaccattgaaaatactaggtggatgttgtggggctgatatggttgggctttgtgtccccacccaatgtcatcttgaattgcaatccccaggtgttgagggagagacctggtaggaagttattggattatgggggcggcttcccccacgcggttctcgtgatagtgagtctcacgagatctgatggttttaaaagtggccatttctcctgtgcatgcactttctccttcctgctgccttgtgaagaaggtgcctgctttctcttctgccatgattgtaagtttcccgaggcctccctagccatgctttctgttaagcctgtggaacagtgaagtcaattaaacctctttcctttattattacccactcataggtagtattttttatagcagtgtgaaaacgaactaatacaagggcagtgaaagaaaataacagcagtgactaatcagaaagataataagtattaacgtaggggatctgattaatattattaaaatcgatataaaagctttacgcatactttgtgtactgtaaatatttagttccttttctaacactcactaaatcattataaaatcaaccaaaattaaacaaccaagaaaacaccattaagttttcaaaaaagaaattaataatacagattacagtctccatttacactacaaaagccaaaaattaatttcaaaagtagaacaaaataattatttcaacagcttggaaataatttttgggtcaaaaataaaaccaaaatagcaattacagatttttagagaatagcaataatgaacccaatacatatcaaaatacatggaaagtagccaaagtataccaaatgtaactttcatagacttaaatactttaataactgagcaagaaataaaatgttaattatttaagaaatcagctcaagaccctagaaaataaagagttgaatgaagcagaaagagaggcttaataaagataaaggcagaaaacaattcattaaaaaaacagaaaaacatcagaataaataaatctaaaatctggttctttgagaaaaagaaaataaactattaatagataaaacatgaattaatctcatcaaagagaaaataaaataaaagcataaaccaaagtagaaatgagaaggaaacagttacagaaagaatttcaaagtttcattcagtagaaaatacttcatctgtcaacaaatttgagaacttgaataaaattataatatatatatctttcaaaagagcactggatccaatcattgtctagggtaattcttgtgtctttatttgcttaattttattgatttattttttgagacagggtctcactctgtcacctaggctagagtgcagtggtgcaatcatagctcactgcaggtctaccaactgggctcaagcaatcctcctgcatcaggctctcaagtagctgagaatacagatgcatgccaccacacttagctattttcttttattttttgtagagactaggggccggtgggagggtctccgtgtgttccccaggctggtctctaactcctgagctcaagctctcctccaacctcaacctcccaaagtgctcggattataggcttgagaaaccacgcccagcctcttgtgctattttaagtcccttagaaccttgctacacaaaatgtcggccctgagccagcaacatgggcatcacctgattagtcatttttacttatactttgtgatttaaaatcccttttgcaatacagatttttaaaaacttttaagaagtatctcgcattgtttttatggtttcctgatggttcaggttactgctagttagaaaggcagactctcaagccccactctggacctactgaatcaccatctgtattttaacaagctcccagatgattcataggcacatttgagaagcatggttttagatctaaagaggaaagcttccattctttaagaatagtatgtaagagatctacagattattttatttatacagactcaaaagtccaagttgaaatttctagcaaaaagaatccaacacttcattaaatagataccattcaacaaagaagtggatttcatttcaggaatgtgacaatagtttattgctaaatttattaagagaaaagaagaatataagtgaatttactttaaaattattttaggctggggaaggcttttttgagtacaaccccaagccaaaaatataaattcagtggttgaaatacttcataaaaacttttaaaaatctgtattgcaaaaaacgttttaaatcacaaccaagatgtaaaaaaaaaaaaaaaagactacaaatatatatgaagcttcaaagaggggattattatctacaatgtacaaagagctactaaaacttacaaataaaaagacaatggatgaaggatattaatcacttcacaaaagaaaagcaaatgatcaataactatgttcgtgtcttccctcattcaccagcaagcattaaatggcactcatctagattctgaggactcagcagcaaataaaacaaggtaacttcccacaagattatctaactaataattaaacaaaaatgtcaactaatagactggtacctgacagactggcaaaaattcaaaagataaattaatatcctgagtcaacaaatacgtcaggaaataaacaccttcatacattcatgatgggactttcaactgccaccaattgtgctgcagtttaataaaataaggcatagcttctaacagaatatatccatagaaaatagacaaataggtatgaagatcttcctcacagcattatgcacaatagtgaaaagaaccttcgtgtccatcaacagaagaatggcacaatagcatcaccaacatttttcatctattgctatttgttcatatattaggtatgtattatttgttatcatatcaatagcagaataaaatactcttgaaatatttatttcacattatttcagatccaaggctaagatatgttagaggcaatagaaaccctaatacattttacatgacgatgatgaaataacttgtgtgggaatttggctttgtatataagatacatatgtttagggatgtaagcatcactcaaagcttcctgaaagacagatccaaggctgcctatgtgtctctgatagctgaggctgaccgtctcagaaccacactcaaacacagtgtggtgttcagatgccttcatcatcatgttcctcctatagttcacatcccctcctttgcatctcaccagcacccaggaaccagggtgctttttaaaaaaacacacaagttaaatcccagctcttcctccattggtttcttactgctgtaaccacaaaaaggtaaggtcccgattctaatggcccacgaagtcctgagtgacagtcaccagctcctgcccactctccaaccgcatcttgttgcttctttcctgtgactcccggtgctctggccacatgagccttctaacaattcccagagtattccaagctctgtgtcacctcagggactttgcacgtattctcaaactgggtgttcttttccctgttctcttcagaacaggcttttctgtccttcaagtttcagcctaaagatgctctctgcagcctggctctactccctggccactacaacaccctgcttgtctccttcaatgcacttcccacaatctgggggaaacagaggagagaattggccatactttgtgcattaattatttttttacttattcactgtgtgtctccttcactgcaatgtatgtttcagaaagctgaccctgtgtctattttgctcttcaccgaatccccagcagtctagctcagagcctgcaatgctgacggcattcaaattctggtaaatgaataattgaatgtgaacacaatttggacagcagatcaaaaaccttatacaattttaaaagaaatatttgtgatcatcttttcctcaatcctcagaaaataatcacaagaagtacacaaagattaatatccaaagatgctcgttacaacattcttctaacagcaaaaaccagacacaacctacaagcccaacaagaggaaaatattttagttgatatataggatggaatagtcaattataaaatatatcataatgtggtaaatttttaaaggggagtaagaaacaatgtgtagttggaccctgaacttacaaaatcagcatacaattctatacgcaaaatagaggaagcatatattacaaaatgagtcatggtttgtcttctttcatatatttcctacgttttccacctcgacatatttttaaagttttgacattgagcaagaggatacatttttaaaacagaaatgcaaaataaacatcatttttaaaaattaataaaagaggtcactcctccccatgagtataacctttacatctcatgagaaagaaaacttttattttctaatatattttaaattgtgtgagatacttaaaattgtgtgagattctatcaacatgtgaagcatatgttaattcattctggttctcaaaacccaaggaaagaatcattcatatgggctttcaccccaaaatctacagaaaccctctacatcctccagttctcctgtatctgcctgcctctgtagtgtctgctctggtctctccatcagtgtctctctttgcttgtgtgtttcacgatcagcttccctttgaactcgacatccttgccacccctattctccccgggggctgtcttttctcctcagttggccatgatatgaaaatagatgagaagcatttattgaactgtctttgtttttctcccattaaaataaaaccagataagtgaaatcatctgtttacatttctctcaaaaagaactgcattaaattactattggtcctacaggtcaccgaccctccgctgctcagcagtgcccctcaccagaggcccccagaaagacatgtccttgctgagaagtctagcacttgggcacataagcagacactgatgataagctgattagaactgcgaggcagggtatagtgtggcaatgtagagtctgcacagaagtccctgagaccacacacagtaagtgtaaaacttctaagaggtcacaaaaacagtatcttgttctaattcgaggggacccaccttcatacatcagcatgaactgaacccaggtgaatcttgccagaacaatcacagaaattagaacaatctaaaatcaatataaagagaagtctagagagagacgatcagagctcatgagatcctgaagtcaatcaaaaggctaaacaggatttgaaacctcatcacttatgtagaaaataaagtacccagcagagcaaaagtgaaagctgtctcctaactatgcagctctctcctttgacaatttaaagggttccaaggaaacagctgaacctcaggaacagaaaggtattttttggttctgatttttgatgtggaaacagaaacacatatttgattttaatggttctcagaatggaaatagtggcttctgaatttaaatacaggcagcatcagatcttattattctgctatctttagccatttttgccttcatgcgttatttatcatttcactttcaataactttgatatgtaaattaaagctactgtaccaaatgttatgatttagataaagatctagaaacactaatatttctcattacggattttgcttatccagctgaatccaacggaattatccaatttgaaccatgtaggggaatgtctggacagagctcagcagacttttgagaccatttaaaatccaaacccaccacccaaagcttttctaccgtaagggcttctcagtttgttgatgtggcacattgtccggcgacttcaaaatcatgactcagctttctttttcaaatgcaggcagaatcattccctggcccagtttgaaaagttctgagacttcaggctcagaaaaatagttagcatagttgttgatacttcaggcattatctgcacttaccagctctgtgaccttggccaagttataacctctctttgcctgagtttccttaactgtaaaatgggtgaagcaatagaaccctctatgagtgtgaaataagaaaagccaagtaaaagtgctgacttagctcagtccctggcacatgataagcactaagtgttagtaaattattcttcctgaggcagaatgctgcaggagtggctttgccacagatttaaggattcactctttaaagactgagaaatggccatacagtcttcaatggactaaatgtttaggtcccctcaaaattcataggttgaaattctaaccccacgaggtaagagtattaggaggtggaggcctttgagagataatgagataatgaaagtgaagttctcatgaataggattcatgaataggattagtgtccttaaaaaggggctccagaaagatcccttgccccttccaccatgtgaagctccagcaaaaagatgaccacttagtaagcagacactctccaaacaccagatctgctggtgccttgatcttggatttcccaggctccagaactatgagaaacagaccaggcaagatggctcacaactgtaatcccagcactttgggaggccaaggagggccttgcctgacttgtgatcaggagtttgagacgaggctggccatcatggtaaaaccccatctctactaaaaatacaaaagttagctgggcatggtggtgcatgcctgtaataccagctacttgagggtctgaggtggaggcatcacttgcatccgggagatggaggttgcagtgagccgacatcacaccactgcactccagcctaggcaacagaatgagactccatctcaaaaaacaaaacaaaaaaagaactacgagaaataaatttctgttgtttataagccaatctatggtatttttgttacagcaacccaaactcgaattaagatacaggctcctagtgagcccagagagccacaaagaaagaaagtctaatgactctcttgaccactcatgctgccttccattgcccgtctcctgtgttctgtgatagtcagagtgaacattaagctaccttggtcactcaagcacctctcaggtgggtttgggtctctccgcctgacttcacatgtcaagggcttccttctggaaacattcggaaggcttcatgagaacaaggtggcccatgagttcttgttcagctaatgatcctgataccttggtgagcaagaaagagctatgggcagcaatggcaagacagggcaaggagcaatgggagctgtgagtctacttcaaggtcaatgaatttttccccagcagctgccacgtttcttccccaaataagtcagaacatgagaactatcactgaaaaaaaagactaaacatagacaatatttcatctctcaatccatctattcaatcatttacccactcgctgacatatcgttgcatcccctgtgcccagccctgtgagagaatctgaaatcccataaagatgcccaggaggcagccctcatccttggggaacctacaggctactggggtaaaggcctatcaataaacacagcccagagtgttatgggccatgaaatgctgagctgggatgttgaaagacggtagagacacaggcaaaaaggaggttccaggaaagggaattggcaggtgcaaaactgcagaagtgagaggggcactatgcattcttcaaagagaagaagggccaggagaatggtgtaagatgaacttcaggcctcaagggaacttggaggcaggctgaagcactgactgcagctgagggcagtggagggccatcccgtgacgcgtaggcaggaaagtgacatgctggatttgcatgttaggaagatcgttgcaccatctttaccccagtccacacttgacttcttccattgactgggcatctgcgacgatggctacatttacataaattctgatcatctgaccccctcagagacccagggttcctcatacttcagtactctttatttcaggtttagtcgagcggagcagagaggaaaagcatctcccagctggctgcagagctgcatttccagctgcctgatagatttcaccaatctgccctcccagagccagtgtgaactcaacacatccaaggccaaactcatcatctttcccaccaaaccagctcttccttcttagtcttccagtcacccaagttcaaaagctccttcttactacctgctacatcccatccctcaccaaggcctgctgtgtcttccttcagaaatgtccccacctcctccctttccttgcagtgccattgtttcaccctgtctccatgtcgtgaactcttcccacactgacccacctgtgtcctctgtccccatccccccaatcatcagcctgtcttccattatcaagtcacttcctgccaaaactggtagactgcaaactccctgcagtgtagaaccgatgatcattggtaaggcttccaagacccaagtagttgggtctcaaagaggctttccagcagtatctccttcctcacactcaccttgctgatcctcacactcaccttgctgatcctccccattgagcaaatcacccaatccacctatcacatcctactctggcttctgctcatagtgtctactggatcaaatagtgttccccaagaacttatatcaacctagaactttggaaagtgaccttatttggaagtagggttggatgagatattgaggtaaagcatttagcatgcagtctcatacttagtagcaaaacgtatactggttgacagcatcatcgtcaaccacaacaatcaacatcatcatcgcattatcattgaactttgttttaaaataccttgcatcagctacgaacacagagttgcatgaatccaccacttgcaagaaaaaaaaaaaaagaataaaaggcacccttcaagattaatgcccccactaaccatgagtactaagcaggttcttcacgtatcaaggacagtgtattattaccctcataaaattcctttcttcctaagagattaaagagctggggaaatttcattccactcaggttcacaagtcccctgagagagaggcaacaggtgagcatcacttttccattgtcctcaggtgtgtcaaagcagagacaagaatcaaggtggccatctctagagctggaggctgctgtctccccaggccttgagagttaagaaaacgtgggccatcctcctgcttattcgttaggtattctttgcctactctgaaagcaaattagtacgctgcagggtgttggttcttattcattcacttcttcactcattcattcattcaaaatcattgaatgagcctatgttcccacaaactctactaagcattaggcaggctacagagaataagaggagccagagtcaagtgtggccacctaagaaaatgcccacgccacaaatggccagagtctgtcctgtctcctgaatatgaatggggaatgcttctaaaacttcaccagtcttacatgtctcctcctgtaatttttaacagtggaatttaaaaattcaactcaacttcaataaatactccaaaagaagatgatcccccaaacaggagtctttcctggccagaagtaagacccaccagcccttctgcagccatcatgctccagaatcaaagatacacatgaagtggagatcgatgcctcaagtgaagatgctccaaggaatcagagccttttattgttgctcctacctggactgaaatgaatctgagcataaaatgagaggaagctggcaggtatttacagtcatagcagcatttctcatgatggcccaaaattggaatcaacccaaatttccacccatggatgaacagataaacaaaaatgtggtttatacatatgtgatggttaataccgagtgtcaacttgtgtctgtgagggtgttgccaaaggagatcaacataagtcagtggactgggagaggcaaacctaccctcaatccgggtgggcaccatctaatcagctgccatgtgactggaagaaagcaggcagaagatggaaggacttgacttgctgagtcttccggccttcatctttctcctgagctggatgcttcctgccctcgaacatcagaccccaagttcttcagcttttggacttttggtcttacaccagtgacttgctaggggctctcaggccttcagccacagactgaaggctgcactgttggcttccctacttttgaggttttaggactcggactggcttccttgctcctcagcttgcagatggcctattgtgggacttcaccttgtgaccatgtgagtcaatactccttaataaactccccattatatatacatccatcctattaattctgtccctctagcgaaccctgactaatacaacacaggatggaatatttttcactcctaaaaagcaacaaaattctcacacatgctgtaacatgaatgtaccttgaagacatggagctaagtgaaataagccagacagaaaaggacaaatattgtatgattacacttaagatgaggtacctagagtagtcaaatttacagagacataaagtaaaatggtggttactagaggctgaggggagtggggaatggagagttagtgtttaaagggcacagagattcagcttcaaaagatgaaaaagtttgagagatagatatcgggggtggttgcctaacaatgtgaatgtacttaatgccacttaaatgcacacttaaaaatggtgtgttttgttatgtatattttagccacaaggaaaaataattagtgggtgcaatcaggagacttctccaaagccatgagaagaatgggcagtgctattaaggatgctgctggtgtctgctcagttcccctttagtgagctggtgcactctaccctcgccctggggagttggctccttggcagcccacaggagccaccgggaggttattcccccacagactaatcaccatcaccatggggatggccagtggacctccatgaaggtgcaaaatatctcttgcctccaggtggaactgagtctgtggtgcatctcatgccccagggctcacccacaggcttggttaactttcttgccctcacctgcttgacctgcctcccttgctcttctgagagcaagccctccataaatcattcacaggaatccctgcctcaggctctgttggaaggacagtgttcctcaaccttgttttcattactgccctcctaaggagtctttttatgaatttttttttcctaatcacccactaacaggtacactgtatatctgcttatgtactgtatatatatctctgtgttttttacttaaaatattgtaatttttttcactctctaataactcatttttattcttttggaagtgagttcatctcctctgaacatgcctggtctacagaacctgagctaacgaagtgtggattcgcctaaatgacccatgtgtggggtatggaattgtccctcaaagcatcgagagcttcaaaatgatttctgctgccatcaatgcattttattcacaacaagcaaccagcaaaccagccaatccaagaaaatataaaatctgccacctcttttgtgcccagagggtgtgctaaaccctgaagagacagaaaacaatgaacaagccagattcttgagtctgcttgcatgggaaataaaagaacaaacaggtggtacaatagctaagacagaaagtggggggtacatatctggaagtggtctaccctacccagagaccctacctttttggagtctgtggaccctctagggatacacagagacaacagcaattcactttgctgtcacaggataagcactccttgaagaagaaaagggagaactactgctgttactgacttgttcactcattaattcactcagcagacatttctgagcacctactttgataccctacactgtgctatccctggggatacaatacaaacgcagcaagacatagggagctagaagaaagggctccaggcagacagaactgggtttgagtcttcaatggctttgtgatcttgggcaagttccttaagcacttatgttcctgatctatgacatgaggagaataatagcaaatatctcaagggattgttgtgaggattaaatgtgatactgaacataataaggcgaggtcacttattgtcttaacacacagaaaatactcaacacatactaggtattgctgattctttcattaccaactggatacattcccttccgtcaagtacttggtggagagataatgattaaaacatagtgccatattgaatcatgggaaaaacacatctattctctcatttttggaaaaagagttccccctgaggacctggtaaccacatggcacttccctgacatgactcctggccattcactctgatggctggaaccctcctctccaagtctgtcgctctgttatctgcatataacaagataagcctacacttccagctcatttggcagatactatgaggaactaatgcctgcaactgtcaccatttagtgaaagatttaataaacggggtattttttcaagtccaatttcacaagccaagctgatgtttcattcccccagcattaatgctgccacacgcacatcaaaatgggtaccaagggacagggcattattttccagccacagtgagacacccagtgacttcagagaccacagccatatatccacatgaccagacgaggagaattaaaatcggcattccggggatggcatcaccaacactgagtttcagggggttatttatttattatgtgataatggcccaaaggtatacactactccaaaatctgccatgaaaattcaaacatctttgtaatccctgtttacaaagcatacagagaaattaaaacaggcttaatcgagcagtgtttgtgcatattaatgagcctaaattctaaatctggattttggaaataaaaagggtaaaagaggattcatttcagactaatttgtttttgaatatgacactttgcatgtcaaatagtataggggatgtgaaagtgggggcctagataagcattttaaagcatttccacacaaagtatggggcataagatctgttaaaggaaaagaaccactttccatggtctacctaagactttaatgacacaaatctctcttcagtctcctgtgtcctgttcagtgagggaccaataaccgttctccactgtgaccatagaatccttctcttttatgccctgtataaactttcctttggctaatcattatttacaatgctataacatgagtgctgggtgtcataagagacatgttcttttaacttgtacgctaaggcacttgtatcttagaaaacagagaggtagagggaggccagcctccgaattcagaatcagatagaccagagttcaaatctcagccctgcctctcaccaactacaagttatgtactctctcctccttgcttcaccttccacatctgcaaaatgaagtgataattcctatcttttcggccaaacttacaaaacagaacatagtaggtgtgcaaaagtgctaactccattctttgtgcttttctttggagcaataataaatcacggagtgaccaaaagtattttacgggtatcataattcagtgaatagccaacacccaatttcctatggtccatgtatgcaggaaagttaagagaaaaatcaaaaagatcccaaaggggacacttgggaacggggatggatattgggatgggcatgaacatacacacacatgtgccctctggcttgctttgcttagcataaggtgcatgatacaagcctggcaggcctcccgcactaaataagagttagatgtgggactgtggaatcagatatcctgggctagactccatgctctgccccttacaaatgactctgggcaaatcacaccagtcacagcacccttccagagactggtgtcctcactgtaaatggggacagccaatgcaacctccctagctttgcaattcatataagttacacctgtcagcagattcctttgcagatataaacataagataagaaaacaggcctgcaggattatgccccaatcagaaaggttcatagaataagaaaacacactaagtatttcaaaaagaaaaaaaaaaaaaagcccacgtccacattgcgacatgtcccctctctcagaatttgaccttagggatcccagatggttccagaccatccccaagctgaaagcatcctgttctctcctgaggattatctgacctgagagccccctgcccccttcactcataggtcctgtccaagggggtctacagatcacacaagagttcagagtttggggacagggggtatggagcaaggtccccactgggacagctgcacccacagcctccccctcttttccccatgtttcctccagaccctgggcactgtggagccaagagtgggctggccatgctgccaagcaggacccttccttgctctgccatcaggctctggcttataacagattctcactgttccaaccagcctctccccttgcctctggccctctccctctgttacttccctctgctgtctcgcctcatccttcctccctggactgtggtctcccctttcctttccctgcctgcatcagcgtcccctcctttccctaccacagctctccatgcctctgtctcggttgctgtctctgactctctgtctgctcatttctctaactgctctaaggccactttttttttttttttttttttttttttgaggcagagtctcattctgtctctatctcggctcactgcaacctccccctcttggcttcaagtaatcctcctgcctcagccttccgagtagctgggactataggtgcatcaccacacccagttagtttttgtatttttagtagagacaggatttcactatgttggccagggtggtctccaactctgacttcaagtgatccgcccacctcggcctcccaaagtgctgggactgcaggcatgagccaccgtgtccagccctctcactgcctatctccttttatgtttctctccttccctctctgtcagtctctcattctctttctcctgatttcactgggtattcccccatctctgtttctccctttcagggcagggactagggtgaggttggggtggtacttgacccaggcacaaaatttaaggaggtgccaaaacactcagtaatccaaacaaatattactttaatgtaatatttttaaaaatcaaaattaatgcaaaaaaaatccctgttgaacaaagaatcaaaaatacaaggaaagacaggatctgtccaccactctactccttgccccaacctaatccattcctagtctgaaacattattgacaagaacaggtggctggcccatagactgtagttcatccatttaatttttttaaatattgcattaaaatattactgatctcgatgattacattctgtgtaaaggggcatgctgcctgtgtttgggccctgtgacctttctgtgcgtttccttccctgtctcttctctcattcctctctgtttaccctcaccctccttctctgcttccgcccaatcgcatctccctccctcctccggcccacctcggtcttgctctccatctctgcccagccccgtgtgtgtttgcacaccttgtccctgttatgtctgtctgtcttccccctctgcatctgtttgtccccacttctccctgggactgactttctctctctcccttgtcaccctccccacctctcctcacttgcctgcacctgtggccatcccgtcaagcctgagcactgccaagagcacaaggaaggacagacgagcttcctcctggcaggaaagctggactgggagggaaaagctccaaattccatcctgtctcagacctccaaatctgcaccatctgccagagctcctgtgaagcctatcttgagcaatagatgccctgtgtcccagaggtagaggaggaggcagctggcagatgctgaagtcacacgccatggatagaagacagtgggcactgaggcagtgcgcagagcaagcctgctggcaggagctggaggtgctgcagttgggagggctcagattcccctagaaagggcaattcaccctccatgtggccatctcaggacagcaactagagaagtgtcacaggtggtatctgcctaacgtgcctggatgtgtcggggatatcatactctctgtttaacttaaccctaggtatgatttttcctattctgcaactgaaggaactgcagttcagagaggttgagggatttgcccacgggctcacagcttgattcaaacttagaacatctaagggtccaaaaggtctgaagaaccagcccagggccctttcctttaccatgttatctatttaagaacaaacttctcacaaacccagaggaataagaaataaaggccaagcaacccaataactctgtgttcattttttggaaaacaacgttcagagttggctaaatgatttgaaaaaaatattacattctccagattacaccaaactcagaataaattacaaatggattaagtaattaaatgcaaaaagaaaaacataaaacatctaagaagaaatacaggactgtatcccatgatctgaaggatgaaaagactattttgagggtgacataaaatcatacaagaaaaggttgactgattgcattttttaaaattgagagttttcgaattgcaaaagacatcgtaaacaagattgaaaggcaaatgtaaaatggcggggggtgggaatcttcagtctatatgataaaaggttaatatccttaaaatgtgaagtgtgcttatcaaccaaccaaaaagtcaaataactcaacagaaaatatgaacaaaagatttgaacaggtaatttatggaaagcactcaaccaaagcaaataaacaagaaaaacaacgcaaacaaaactcatggattcaaaacttcaagttaaactgatacacctttttttcacatttgaagttagcaaagcttaaatattcactatcatcaagagtttaaggagtggaaaacttttacaggattagggagaatggatattgttacagccctctattgggaaatgtgacaatatttattaaaacttcaaatgcacattcctgctgatccattcatttcactcttcaaaatttatcttactgaaatacatatatcacatgcacgtttatcacaacattgtttgaaaaaaagcaaaatatttgaaatatcctaaatgccctacaatagtactgagtaaattatactatatctaggtaatagaatacaatacactcaataaaaggagtgaagtaaacctatatgagctattgtagaaagatcattgtgatggttgatttgggatgtcaacttgactggattaagggatactcagatcgctggtaaaacattaattattctcagtgtttcagtaggcacaaaacccatcccatttctgctaaaagggaagccaaggtggtttggcatttgattagaataattgggctgtggccgggcacagtggctcacaccagtaatcccagcactttgggaggtcaaggcgggcagatcacgaggtcaggagattgacaccatcctggccaacatggtgaaaccccatctctattaaaaatacaaaaattagctgggtgtggtggtgcatgtctgtaatcccagctacttgggaggctgaggcaggagattcacttgaacctgggaggcggagattgcagtgagctgagatcacaccactgcactccagcctggcaacagagcgagacaccgtctcaaaaaaaaaaaaaaaaaaagaataattggactgccccagctgtgtctgtgagaatatttccaggagagactgatgtgtgagtccatggactgagtggcaaagatccaccctcaatgcaggcagcaccatccaatcagctgagggcccagatggaataaaaagctggaggaagagtgacgtctctgggtctcccagagccaggagcgtttcttctcctgcccttgaacatgagaatttcaggttctctagcctttggactctaggatcactccagcaaccctctgggctctcaaaactttggtctcagattgacagattgatagtaacaccctcggcttctttggttctgaggccttcagacgtggaccaatccctgggtctccagcttgctctcagcctccataattgagtgagtgaattcccctaacaaatcccctctcctctccctctctttctatatatatgtgagtgtgtatgtgtgtgtgtgtgtgtgtatatatatatatatatacatatgcatgtgtgtgtacatatgtgcatgtgtgtttgtctctatataattacatatataagtaatatgtaattatatatgatatttaattatgtaatatatatatatatatttatgttatatatatatttggttctttttggatagcccagactaaaacaatattcaaaagaaaaaaatgtagaacaaaatacatagatattatgatcccttttaagaatacatgtttatgtgtgcctgtgtatttatacgtagggaaacagacctagaggcacagacggcaacagtgcatgcatcagggaaagggagggacaatggaatactcactcttcaaacatcaccctactgtttacatttgtacaatgagtgcctgttacttctgaaatcttaagaatattcccataattaaaaagttggcagacgtgatttaaaatagaacagttttgcaaatggaaagcaccctttccaccccaaccctgccatgccccaccaccctatctgatcagtgagagcggcctgccctaagcatgctgggaatctgagataccgctcccatgcacacgtgacatgcatttatttgtaattaaacttatttatgttttgaggttttcaaggccccatgacatattctgaagcaaagctagaggaggcactgccttttatgtaatcaatgcttcatattttgtgttttataagctctatctttcccattgtcagaaagatcctattaaggatgatgctgctgctgctgcctattttactgaagaactttaggcacctgcttagagccaggattggaacccaggtctgttgtacaataaagctcacgtccatttcaacccaagccctgaagatgactggagacactccatgccaactgaccaaaccagattcaaagatactacacagaaactgcttacccagggtactattaaaatcaagaatatccaagatggatatattaaattatcatgtgtatcctccctaaaaaatcaacaattaaataaagaaattaagaatacagagttaatacctactcaaaggagatgatggtgagacctgataaggtaagctgacagagaaaatgctcctctcatacaaaccccatctttgcaaagtcctgatttgagagactacagagagaggccctacagaaggcatttcctaaacacatgttacctcaatttgttgaggaactgcaactgtaatagctgagcctgtcgctataaaaagttctggtcttttccctcaggttaggaccacctctcaaaggcaagaacctgataatttttgcccagagtccacactggagcccacccaccttggaaaccaacagtggacgtgaactcagttggatggggtaggtcatacttccagacaagcagaggaccagggacaggtgggcaagttccctggtctgttctgcctgggccccagatgtgagatggctgaatgggggctgggctggggtgtctcaggggccctagttaatcttggccagagtcctttccaacctagccctaacagaagagatacagacagttaaggtattcagatcactgaagcattgttactaggtgtaaatattaacacctgcactcaactgtaacagaaaccaaattaaattaacctgacctgaatgaattagggttttatttttctcacataatgggagatacaggaaaaaaaaaaaaaaggctacaggcattgagtcaagggtgtatggttgtcaggctgagaactctgcaattctctatccacatagtgtccctgttgtcacagatgactctccacctttagcatggtatccctgttccagccaggacagaagagcagggaaaaggacaaaagaggtatgagctactgagttggcttcccttttaaggatctttcttggaagccccacccacagctttctcttccacctcactggccagaactccatcgtgtggtcactcattctgcaaagaaggctgggaaatgcagctttgaagctagacacattttccaaaatagtcagaattttctagtgagggtatgcgaagaatgcatattgggtaagcaactagcagagtctgtctgaccagataatcaatggggataaacttggtgaattcttcagtgcactgatggtggaatgggtggcacataagattagaacgccctggattgctggcaatgggcccaattgttgcactagaggagactctcaaaagtccaccaacacaaggaaggcaaattatccttgcaccatagacacctgtggcttttccagtctcatctttgccctccagagagctagatactgagtagaaactaataacattaagtattaataggccttacatgattctatttcctttttaactgaggtccaaagatcatctaaggtgatggtacaccagtaacctaagaagtaaaagagtaggtcaaattgcttatcctatgtctggagagggggctgattccaagagctgagcatgctgggaagaggagagtctctcccagaacaggcagagaggacctgcattatggcaggggaggagttatctgatcccatcaggaggcggagtgaaagctagaagcaaaaatagaatatgtggccaaatgaggaggatgtaacagctgggtaaaaaagcataagaacacacaaggctgtgtgggagggtgagatgccaggcagccttcagcagctgcagactttgtcttccaccttgctagagcctgatattgaagagttggcaacatggttactccagacctgcagggatttaaagggatatttaaagggatgtaattgtaactcccagatgcctgaggacactaagagtgcccagccaaggcaaaatggttccaggggcaaaggccctcatagcaagggcaggtccctccagcctaccagcctatctcttctgaaagaaggagaaaagatatatacattgatcttgatgttaagagcttctttatcctaagaaatatgaaggaccagaagtatgaatctgtgcttgatgattatagagatgtgtgtaacatcgagtctgcaggaccagacccagccataacagaaaatggccctacacctctgaagtgagcccactccccaaacaaggtagattgctcagcctctgtgacttgaaaaactttgacctattttgcataatgactgtgtgtgacctgaagcatcctcctcaacatttgtcaactgcatgctcatgctgttctggcactggctgtgtgcaggtcataagtgtcagcttcatatgagggtaaaccaagtgctcatcccctctgacaggcacaacaaaagatgctcccctctgaggccaaataggtggcccatgctgccaagatttcctgctcacacaagcctgcagaaagtccatgttaatttccaatcatgttgcttcccttcctgagtggaactgagacaggtgggacctgaggccggctggttacttggcatctcctcacactaatgttccttaaatatctgttcaatgtttagagaagaggcagagagctgcctgagcaagggcctagaagccacggctgcttctcctctcatctccagcacagttcagctctggcccaattctgcatctctccctcaacgaagccctgtagctgccctaacctctccccataaaaggtagctttagaggctatgtcttgttattggagatcaccccttggcctcaccctttaccccagatgtctcatcaaagtgcctctggcccccacactgaggttcccccgagacaaacatcctggtaaatatagctttgtgtgctttcattatttattcccagggatgcctaatgcccctgaattgcctggcatcttggctctgctgcctgtcagtggatgtgtctctgaggacagcaggctccccacagtctttgcagcagcccaacacggggagctggggaatgagcacagtgagtatgagcaccgtatccaaggcacagtgcctgggtgcaaaacaaacccctgctccaccacagactggctctgagaatatgggcaagctactcaacctctctgagggtggcttcctctgcataatggagcaatactagtgcccaccttatagggttgttgtgaggagtaaatgagtgcatggatattgttcatcacagtagttgacacaaaaccaaggcagaattagaatttaatattagtatcagtgttactactaatgcaagagggggtaaaaaaaaatggctccaaggctggtagatcatgaggtcaggagttagagaccagcctggccagcatggtgaaaccctgtctctactaaaaatacaaaaaattagccaggcatggtggcacgctcctataatcccaactactctggaaactgaggcaggagaattgcttgaacctgggaggtggaggttgcagtgggccaagatcacaccactttactccagcctgggcaacacagcaagactccatctcaaaaaaaaaaaaaaaagcctcacaaacattcccatgtgaattgaatatgcaacttaaaatgcttacatgaaatggtattaataaaagtattgacttgagtagaaatgctggcttggccactattccattgggcctgcccaatgtccagtgttagatcccaagagctggcaatgagactcttccaagatcatccccaatgccatttctcaggccaacacatgctaggctcatcacaacctcacagctgccaatggctccagcttccatgcccagcccacccctgggagaaccaactctgtagcctcactgggctgctttgggtacccaaaatgtaccatagacttcctggtctcttgaccatgctgttccctggctcttctttgccatcctgaaaattttaaacatctcaaaagatcattcatacactaccatctttccaacaccttccttgactgacagaaacacagccatggcctttctgtggtcccagaagctttgttggtgtctgtatccacttacaggataacctgttctcccaatagacaatgagcctcctgtggaatatatctttagctcaccatgcctgatactaactagataccttacaaatgtttaatgattaaaagaagtattagaggtaagttttacttggcttgtgcacagctgtgtatgcacaaacacatacacacaaggtctcctaatgactatgtgaaggcaatttcaatgtggaaaatacaacagtatcacaaaagttcagtaagtcagggaaaccaacttccagaacgcagtccatccttttacactgatggtaaaagcattagcagcactttggcttgtgtggtacttaacagtttacaaagcacttataaatggaaggaccctgagggttggagttggaggacacgttctcaacatctagcctaatttcctgggtaaagcaggaatctcctggaaaaaatcatcactcagggttctgtagcctcttgccaatgcatcctgtgccccagagtttcctacctttcagaataattcacagtatttttagagatctctaatcattcaaaggttcctgtcttaggttgagttaaactttgcttcccaggacttgtcacctattagtcctggaatatctctcaggaacacacacaaaaaattttcttctggcagaattcaaattctattggtaactgtcatgtccaccctaatcttctgtgaggtgatccatccccagagcttcagtatttcatcctttgacttggatctcagacttgtcacctctctggcacccttgcttaggaagatgctacaccatccttctaggaaggatgccaacaggtggaataatgcacacagcaggtgtctgactggaagaggaggcatcattcacttggatgtttaggtctttagtgcagttatgtcctgcctaactgttctgggatgaattgtggccccccctccaaaattcatatgctaaatccttatccccctagtgcctcaggatgacactatatttagagacattattgttttgttttgttttttctctgagacggagtcttactctgtcacccaggctggagtgcagtggtgcgacctcagctcactgcaacctccgcctcccagattcaagcaattctcctacctcagcctcccaagtagctgggattacagatgcgcaccaccacacccagctaatttttgcatttttagtagagacaggattttaccatattggccaggctggtctcaaactcctgacctcgttgtctgcctgcctcggcctcgcaaagtgctgggattacaagtgttagccaccgaagcccagcctagagatagaatttttctaatttttaatttttgagagtgcgtagtaggtgtatgtatttctggggtacatgagatatattgatacaggcatgcaatgcataacaatgataataaccataataatcataatcttaagtggggtatctactgcctcaagcatttagcctttgtgttacaaagaatccaattatattctcttagttattttaaatataaaattaaattattggctgtagtcaccctgttgtactatcacatagtaggtcttattcattctattttttgtgcccattaatcatccccaaccccttccacaccctcacttcccttcccagcttctggtaaccatctttctgttctctattgttttaatttttagctcccaaaaataagtgagagcatgtgaagttggtctttctgtctctgggctattttactgaacataatgacctccagttccatccatactgttgcaaatgatggtatctcattcttttttatggctgaacagtactccattgtgtatatgtaccacaatttctttttccattcatctgttgatggacactcagttgcttccaaatcttggctattgtgaatagtgcttcaataaacatgagagtgcagatatctcttcaatatactgagttcctttcttttgggtaaatacctagcagtgggatcgctagatcatatggtagctctagttttagtttttaaggaacctccaagctgttgcagagaaggtctttaaagagctgattaaattagacagttacagccaggcacggtgattcacgcctgtaatcccagcactttgggaggcagaggtgggcagatcatgaggtcaggagtttgagaccagcctggccaacatggtgaaaccctgtctctattaaaaatacaaaaattagctgggtatggtggcgggtgcccataatcccagctacttgggaggctgaggcaggagaatcgtttgaacccaggaggtggaggttgcagtgagccaagatcgtgccactacactccagcctaggcaacagggcaagactccacctcaaaaaaaaaaaaaattagacagggtgggctttaattcaatctgactggtgtccttatgagaagaagaaatttggacagagagagagacagcagggacgtgtggcacagaagaaagaccacgtgaggacacagaagttggccatctgcaagccaaggagagaggcctcaggagaaaacaaacctgccagcacctcaatcttcaacttctctagcccccagaactgtgagaaaatacatttctgttgtttaggacactcagggtatggtaatttgttatggcagcccctcataaatgaatacactacctacatgtgtaactcacttctattacctacacagcaccgacagcattgaagttgccaatttctggtcaagagatgagtgacaagataccttctggaataaatctcagagccagttctgctccctttctgagcttccaaagaatgacatgcagccccatcagcatttccatcccagcactgcccgtcaccctaagaaacacttatttctctgttgaagcgaaagacccttccctgatacaggccagaattttccgaagtaaggtctttgtttttaatgaaacataaaaggacaggaagaatatcaaatcataaggcagacgagtcactgctaagtcctttaaattatcatacttgttcttataccacccatttagcctaatggagaacagagggcatgccctattgtctcctgcatggactcagttacgagctgctctccaacatatggagagaggcccttccagatactgcaagacatggagagaggctcttccagatactgcaagacacaagcacacctacttggagtgtcccttttgtccttgctttgccctttgaacttgatgcatagcaatattttcctagtaacaaacttggttcccctcccacctcccaacttccctgaagtgtcacaggtaaaatactctctcttcctcgacctagttctagaagcctccaatatcctgcactatccttacccctggtttatcctcatcttagggaactgaatgctactacaaagtagatccccttttaaaatgacataagcactttggtcttctccccagggttctgctatttcagggagacaagcagaggtcacaaagcatctctagaagtaaaatgccatccaggggttctgggccaccaacagagctgctaagtgctacttcctttgtcctgggcatccgatagcctaaggcaaggtacagatccctaggggctgaagacagagtgaatcaaatctgatccaaacgcctaggagcagcaagagctaagttgagaaaacctccagtaaatgccaaatctgagaccaagaggagaactgaaatcagggccacggctagagggaataagtgaaatggaacaacagggaggcagcgatggaatgggacagtctacagacacgggtcaggaagaaacagagtcaggcttctcagagtcaattctttatgcatcaccccttggagtccatcacccagaaagaaggctgtgcatcttcaagtcagggcaggaaaagaggagagtgggcagtcatccatctacctcctctcagctgcctgcccagaggtacaagctttgaatttcctctcctaaccatgagatctatcttgtcactaggattttctgttctttccacaatttattccaccttgtgaatgattggaacaaatctttaaaagggcatttttcaaagccatgatggtacagtagtcacactgtctggccctgacagctctgaacaagtcacaagcccccaaattacacggaacagctgtccatcaagtattgccatagtctactggctgcttgtgagatacagttaagtcatgcacacaggccacccaccaacaagcaattgtgattggaagtgcttcggctttcatcaccaacttcggcagcagagaatatggcatcacgccacaaatggcagcttccagaaacaaatcagatgtatcacgtagcacttcattctcctaccttcaatggccatgcatcctgcaaactggctccaaaagactccagggcagttagatcggggtatcacttgtatatggccgtacagtctacggtaatttgtattattgttcaaaatactactgaccaagttttctatctgcccctgccattgatattagtcttagccatgtaatttggagtgtttctccttggaggaagattatatatcccagaccctgtggtcaaaggcttggccttatgatttctggcatccttcctaatggaagaacatataccctcactttgctgagcttaagagtggctacgtaatttgctttggtccattaaatgcagacagtcatgtgtcatttccagtttaaaatccagctcatagttttctgtcagtttttgctctgttccacagaccacctatttccgagatagaggctgttgtatcagcctaagtaccagattagaggccatgtaaggtatggccacagccaacctgatatgcagcatagatgaaaaatgaacttttgtggttgtagtttactgaatggggaacatttattttcagaggttatttattattgaagcataatctagcctatcctaactaaaatatcttcttcctttttctctttttttcttccactaattaagcacctactaaaaattgagaatgctttataaattgagcacctactatgtgacaggtactggattgggcagggaatgcaaataaaagacatacctaatgggaagacccagatgttgcacaaatacattttgatacattgtggcaagttttacaacaagatgcatcagcagcttgaaggaagccattgctctgtcttctctatcaggagttgtggagggcttcatagaaatacccgtcatatatgatgctccaaaaataaataaggttgattgaatgactttgatattggggctaactttaagaaaaagatcaggggtttggttggcaaggaagaaagaaaatggcattccagtagcccaaaagggggaaagggcatttcagaacaaaaaaaaaaaaaaatggcataagccatgttgtgaatatacctctgttgttcagtgaggatggaacttaggatggacagatgaagagttagataaaatgatttcagataattccactggaatcaggttgagaataccgaaaggccattccaaggaggtttgacttagccttgggggttatggaggaacaaatggagacatctaaagcaggggaatgaggtggtcttcctgccacaggaggtggtgtggagcaagggatgtggctgggtttgggaatcacaaaaaatggagttcactctgggtaacatgagattacaacatttagaacagcaaatctccagtggagaaagggaaaagcacaaacccaccttagatcagcttccctaagcaacagactctgaaaaggagatgagatgcaagaaggaggtttactgaggagagctcctgagaccatcacctggaaaggagtgaaggatgcaggatggagcagaggaagaagtccagctgtgatgcagttgcaacatagtccatggctgatcacctagggagctctaaactttggatggcccatcagagttgtcttgaactgaggcaagagtatcagaccctcatactctcacatcaaccaggctttggatatgggttacccccaggaaagaggtgtaatcttgggcaagggacctcctttccacagaaggacgttaccaggacaagattctgctaagctgtcggtggcagtacacactcttagcagctggggcagtgagtgcctgggtgctgaacagggaatcagaatcttagaggcagctgttggcatccactacacaccctcacacggaacaacaacttgccttccaccaagtgaagacacagcaacaaggcaacatctttgaggcagagagcaagccctcaccagatactgaatctgctggaaccttgatcttggatttcccagcctccagaactgtaagcaatacaattgcattgcttaaaaattacccagtctaaggtatttcgttatagaatgctgaagggactaagacactggcacaacactttccagtacgttctatttttacagacaagaacatggaggttcagtgaggttacattatctgcccaagtgaccatggaatcagactgaaatttaactttagcagtgtctgactcagagcctacattctccccatacattttggtatttatcttcaaaaggtatgaatatctctatacaggggccacaccacagggaagaccaaccaaaaggacaatataagggactgtctctgaagaggaagacctccaatgccctttcatgggttctcaaaaacacctggggtctgagtctgatcagtactttgaaatcctgctgctcaggggtttctgcattaggtaactgtactccccaaccacaaagcctctccatgaccttcttccctgccccagtcaaggcagaacttggcttggaagggagctcagtgaagactgggcaataggtgacctgagatttggggcagaacggccagaaatcatcacaggcaccacgcatgactatgagtaccaggcactatcacccataccaccccattatcactcccattttacacttaagaaaactaaagcacagaaacctgagtcccttgtctgaggcacataacatgtatgcagctgatccagaattttgttctttcttcctggacctgcatcaacacagagtgaaacaaaatttaaacatcagttcctcaggtgcactgtctacatttcaagtgctcagtggtcacatgtggccagtggctatagtgggtaacatattgagtaggtcaggtctaagaatatttccaccattgcacaaaattctattgaatagtgctgataagggctgctttgaggtcctgggggagcaaaagagcctcggtgattatctaaattttctctatgcccctcacccactgtcccaaatcttttcattaaaaaaaaaaaaaaaaaacagtggcaaataaacctaattaatctgaggggggaaatatatataattaatccagaagggagaagggaaaccatttttgtacctgtttatgttcacttgataaacagaggaaagctaatgcctctgtagttccagaagagtccacaggggaattggaatctcttatcttagccccccgcagagcgtcaggcctgagatcaaagcagatctgtgcatgtcattactgcatatcctccccttccctcctacattttcaagtcttcttggttcagaagaatggcctacattagcctgcccgtaaaaagtgaagcctttatttcacaacaatactaataagtaaaagcaaaatagcagcagctagatgtccagctccctttccagacacctcccagatataaacgcatgatgtgcgatacagaattgcagaggtcttggcggttctctggtccaaatttccatctataaaatttatgccaagccattgtgtccttaaacttgaattaatttgaatgtctctagcagtgtgtgtgtctgtgtggtgtgtgcggtacctgagacctcccaaagaagacaactctattttgatacctacaaatgtcacaatagaggacttttttggatacatcttttacgttgtatccaaatttgcctttttgtggccactgcccatttctcttggatccctctttggggacctaaagaacaagtccagggccacatgtcagtagatgtgaagacaagacttaggaccccttgagccttcctctctgggtctctctcctgatggtctcaaggtgtggctttaatacctctctccctggcagcttcctcccttcgtgtgttcagttgcacctgcccacctcctgttgagagatggacagccccacttgagtcccagcctgtaggggaatggaaacaaccctctccaccaccaggacccataagtgaaggcatttgggagctcacaccttcagaagctgccacaccaaactgccctgtcatccgcacagggactcccacccactgtgcatctgcttctggactccttcctggtttctcataataaagtccaggttgggaaggagcaatgttaattagttacaagttgaaagctattaccataataatgaaaagatgagtaaatgcacaatctccttctttcacagaggtatttacaaaagaaagattaataaggtaattttacctccaaatctgcaaggagctcagcagatgaagcacagagaagatgggaaggtggaggcagatgctaaggtcatcaggaaggagggagggtatccctgctctacagaaaaacactgagcgcagtgaccttaagtaactctcaaggtcatgcagcaagtggtggagctggaattgaaaccccggaacatccaaccccggccctagagctctcgctcctgaccaccctgctgcctctcaccgcactacgccttcaccttcataatcccaatattgggtagtgggtactggccccattttataaaggggaagactgaggctcagaagaataactcatttgccccagccacacagccagagaagctctaagagtctgggtccgggggcctctgccctggagctcatgctctttcctgactgtgtgttccattctagaagaaatctgtctttcctgacccacagaaagaaccatccaaggaagtcccagatgggggtacacaaaagtgatttcctcaggcagccaggtcacaatagcttctcagtacaagagcccagactttggcataaagttcaggaccaaaacgcacctagaaggaaagagggaaaccccctccctttgatgcatcttgtagaggcagggatggctgaaactaaccaggagctgagccctattcacgattgctactgctgttacctgcctggtatgtgttgtaggctggggaacacgggaatgcctggtgtggctactgcagaaaaagtcaggactctccaaactcctacagtcctccaagggcaaacgaaccttccaggaggtggaattaaataaagctgagagatgatgtcttcactaattaaaaaaaaaaaaattaaacagcctcaggattcagaaactgaaaggagagaaagccctaatcctaatattaggctggtgcaaaagtaattgcagtttttgccataaaaacagcaaaaactgcaattacttttgcaccaacctaatatttcaaaaccgtgaacacagatgttagaggcaaataaattcacagtagaatgaaaaagtccaaaaaacactaatgctccacctctcctgttgaccaaacccaaggaattccccacttcagcactccggaaccgggttttgtctgtgcttagctaggattacttgctggagaggggggtccctgtctgtccccacaacgcctgccttcacccctacctcaaccccacccccaccttttcctcagcatgtccaatctctacctatgcttcaacacttattagtaacaatgctgggattaggggactcacccactaattctacccacctccagtgcaatgtgtagaggagtcacagcagaataaacagagacaaaggaaaatacagcactacttcccggttggctgggcttgggcacccaactgcaactctgaaacctcagggaagtgagaacaggcccctcgtagtgccccagcccctcagcagtccagaccaaaggaggctggcccagcacaccaagccatgaacacacctgagggtctgcaagaacactcccgcctcgaaaccacccaggaagtggatccaggccttaccaagagcacttggatactttagagtgtctggaggtctgtgttttctcaactctctgtatcagaggtcagcaaaaggcttctgtaaaggaccagagagtaaatatttcagaatttgtgggccatacggtctctgcggcaactgctcaactctgctactacagcacaaaagacaataaaactttatttacaaaaacaggtggtaagttggacgtggtcagggtctggtccctgccacgctgtcattttctggcctctgttctagaggacaagagttctgtctgattcatccttgtttttgcctttcaacactgtgggtatttcataatcctttgcggaaggaagagaggaaatttgttttcaaaaaccagatgaacaaaggtaactactgagacctgatatgtcctaaggtatgcttggatgtcaaagctaaaagattaagtgcaaagaagttcccaacagtttaagaaaacagaatttggagtccactgagcaaggttaattactcttctgtgtcaatttttttccacacttacagcaagccacttagttgaggaaaattccagataaagcaccattattcaaaatgtacatggcatcaccataatgtccaagactgatttcatgctcctgtctggaagctgaggatggaaaggagtttgccctgaaccataaacatacactggataccatccctggaccagcaatcacacaccagtaacactcattcccctgggcaccagggagtctgtcccagcatcagtgaggggcccaaatctaaggacaaaggcaaatgcagctggagaaaaaactccttcttgaatgcttccttcagagtcagcaaagaaaaagcaacaagattatattttatgtattatgaaactgaatgagctggtcatgtaaatcacttgttgctttaaaaaaaattttgttttgctatgtattttcctcactgtgtatcctggtgtctcactgtgtatcactgccccagctggagtgcagtgcttattcacaagtgggatcatggcatactacaactttgaactcctgggcagaagtgatcctcttgctgcagactctaaagtagctgggactgcagatatgcaccactatgcccagctttatttttagattgccttcccaaaaaaggagaaaaatgcaacctggtccatattattcaattttgatgggaggaataactgtcctcaaatttgtcataaggttttgtaggatgtagggtggaggcagaagagaagaaagaaagagaaaatttaattttgtgtttaagaatttacaaaaaaaaaccccatgaattccaaagattaaattctacagctcacaatggaataaaatctgaagttagctatgaaaggttagatatttaaaaactcaatcccactcaaaaaccttaaaacaataggctaacctatttcattaaggaggaagtaaaatataattacagactaggtaggaagatggagaaaaaataccatttaagactttcaggttgcagttaaagctgtattcaaacaaaaatacatacctgacttttcctattaagttagaatgaaaatttaaaaaaatggtcaatcaacttataagtttaaaaaatacagaaatgcaggaaaatgaattaataaactgaaaagaatgtttaataaatctgaaattttctaagtgataggattgattcatataatagctggttcttttcaaaagaccataaaatacataaatctttggcaagagggaaaaacataaacatacaacattagaaattgactaggtgaattgccaaattcaattcttctttcattctgcaaatattcattgatcacctgtaaagtggcaaaaactggtgacacaacaatgaattaagcaaaatctttgctttagctccctgtaaaggagaaagataagtaattgcatttatggcgtgttatgaaacatatgcaaattttatgaaagactactatgtgaaactatgctaggaaactacatctcctagaaatgcactattttacaggaaaatataaaatcaaaactgatttgactacataaataaccgttattctaaaacttaaatatttatcaaatttgccttcaaaaactgtgcaatgacaggtggcttcgcaggctacttctgaaaagccttcagggaactgatgattctggtgcttcataaactgatctacagccaaagcaagagagagggatctcgtgcactttaagccaccagtaaaaccctactaccaagctaaagtgggacaaagcaaaggacaaaacagcttcactttgggatgttaaagctaaaattgaatacaagtctacagtcttatccagaattctgaaagtgaaaaagttctgaaacctgtttttttttgtttgtttttcataagtcatctggtggcaatggcctgtgctgtccacactcccctctcttccacataaccctcattgggtacacctatgacagaggcatacaggaacgtaaaatctccagcttccttgttccaatagagacagccctaaagagtcacctatactatttccagaactcccttgtgcaactgagctagagtcaccttctgtgggactctgcgtgatatcatacccttgttggtctccttctcttccatctgtttttcctgagaacacttctgaatcaaccattctcacatgaacccttgtctgggggtctgctgctgggaaacccatcgtaagacagtaaaaaaatctgacctaaactgcttctgtggctacacctgacctgagcctatttatagcattatttatctgacttagctttgcagtcatatgtttggctgcataaatattaacatgtttgattaaggagcacttcctcagactccactggggttgttacataacattcacaatatacgtatcatattacctccctaaaatctaataaaatacgaattacaaacacatttcgcccaaagggtttcagacaagggattaaggagctgtataaaatactagtagatcaaatctagcactatattaaaggaataaaaaccatagacaattaaagttaattacaacaatggtttaatatttagaaatttagtcatacaatttgtaaaaataataggtcaattgagtaaaaccacatgacaatctcaacattcgttcctgatataaaaataacctagaaatagcatgcgagttcctcaaaatgattaagaatatttatctgaaaaaacagtcatcatacttaataaaatttcaggagcattataattaaatcagaaaaaaggatatctgctatgattatttaacttcattctagaatttatagcacaagcaaagcaataaaaataaaagagctataagcatttaaaaagagaaaacagaagtatcattatgtgtagatgacattattgtctaccttcaaacccaagagcataactgaaaactgttggaaatgataaaagatttttagtataggagccagatataaaatatgtgcctaaaaccacatctatttatacgagcaatagccaattagaaaatataacggaaacatttaacccatatacaaaagaaatacagataaataaaaaataaacaagaaatatgcaagacctaaaaaaagaaaactcttaaactccactgaagggcataacacaagcgatttgagtaaatgccaggaggtatgttgtacttagataagagaaatcaacactgtgaaaatgcctgagatctctaacttaatctataaatccaacgcagagccaaccaaagttcaaacaagatttgaggggagcacctgacaaaattactctaaagtttttctgggagaataaaaatgcaaaaatgcctgggaaacttttgagattttagagtactggggaaataatcctctccaatatgaaaacatatcatagctacagtagtaaacaagatagcatcactgtatggatagacataaatgaaagctaattagaccccaaaatacatattattctggttgcatgtcctgtaagtagaaaacacatgaattattcagtaagaggtattaggacaactagctatcttcttgaaataaaatgataaaaaaaaaaccacaaaatctctatctcactccttacaccaaaataagggcctgatatggtaaagatttaaatttataaaaggaagagaggaaaggaagaagggagggaaggaaagaaaaccataaaagcaccagaaaaaaaagaaagtatattttatgagagtgaggaaggcctttctgatgatgccatgaagatgaaaaatcagtaacatactgataaatttcatcacataaaaatttaaaaacaaataaaaaacttattgtgaccaaaaataaaaacccaaaatcaagtaaaaagaaaaccaccacctgagaaaaaaactactgcaacataaatgataaagaaagaactaatagttctggtgtccaaagaccatttacaaataaaaaagaagaaaaccaggccgggtgcactggctcacacctgtaatcccagcacttcagtaggctaaggtgggcagatcacctgagctcaagagttctagaccagcctgggcagtatgacaaaaccctatctctacaaaaaacacaaaaattagccagctgcagtggcatgcgcctgtagacccagctactcaggaggctgaggcaggagaattgtttgagcctgggaggcagaggttgcaatgagccgagatagtaccgttgcactccagcctgggcaacagagcaagacctggtctcaaaaaaaaaggaataaagaagaagaaagaaggaagaaagagaagaagaaaaccacctaaaagaaaaatgtgcagagtataagcaactaaagcacaggaaggaaaatgaatgccaaacactaaataacacttgaaaatattttcttacctcactaataactgaatgctaatcaaaaaatgttttcatctatgcagtaagaagataaaaaagactgatgaaaaccagtgctgggaatggaagataaaaactacaactcttttagatagctgtttgtcaatatttagaattatgactatcaatcataaaatacctaaaagatatataactcacacagccaatatggttgccaacagagcagaactggggaggaaggacaaaattattcactatatatacttataaaacaataaatatttttaaaatacacgaaattataacagccaatacttactagctgcttggcatatgccagactccgtgttataaggcactttacctgcacatacccgcaccccctcacaacccattgttctactttccccagaatgacagagctccctcgctgtccttggtcctgaaagatgggaatacctgctaacacttcctcctcttgtcagaagaggaccaaagaggaagcgccggtttgtctcttctttccttgccaacccttccagaagaagcattgtgaataaaattgttgagagctagacctgcctgaggccatgtctgggtagccatggctgattttcctttgcttcaaaagctgtgtctccctgtgcccactcatgattcctgaggatacagtgggaattccctgcttcctgcttccactccattcctcattcaaagactgtctgttgggaaataattcgaacctggaacatttagcattcttttgcccagtgtttcccaaattgtggcaccccgaccagcagcatctgcatcacctgggagcgtgtgagaaatcaaattcttggatccaccccagacctactaaatcagaaactccatgcatagagcccagcaatctgtggtttaacaagccctgcatgtgattctaatatagctaaagtttgagaccgtctccaatcacttaccagtgaagaaaactaagactcggagagcttaaatgacttgcttcagacctgcagctagaatgtgccagggctgggatctgaactcagatctttctgtttggcaaaccatggtcatacacactgtgctatagtactttttaatgtattgcttgtgtggtataaattcagggaatacaaattttcttttaaaactacaaataatgttcttaaatgttgttataattagctttagcattggctttttaaaatttatgaaggtgacaacagagcagaaaattatgctaatcttatctcctttcatttaactccatctacatcacaggactcctgtgtgtggacaacagggacaagtccgccctgtctccccaaagccagcaacattgagttgtaggaaagtacctataagagccttgccagccttgggtgatggccataacgtgccacctacttcccttagatcatcgtacaagggctacctcttccaagaatcattttcggctggaaagtaaacctatccaacctatggtgagcaaatgtggtgtttactgtcatgccaaatattcttgttgtcatgccaacaagtgttggcaagctgcagtccacaggccaaatatggcccactagctttttttgtaaataaagttttattggaacatagctaagcttatttgtttatgtattatcaatggctgctttcatgctacactgggaaaattgagtacatgaggcagaaatatgtcccacaaggcctaaaatatttacaacctgtcactttacagataatgtttactgacccttggtctaaatggttgtcactcaaatcgaaagagaacagatttttgcatgcctgaactcaagttctaggactgacatgtaccagaatctgatgttcagaaagttctttaccctccctgagcctcaatttccccatttgtacaatagctgctccactgaactgtggtgatggttagatggaacaagacatgttaaaggcctggtgcacagcaggtgctcattacgggctattttcctcccttcacctacttaggtacagagattcctaaagaccagtggtgtcatagctccagcacatagtaggtacattgtttattcagggccaattccctttgtaaattcagaatgcagaggctctgcaaagcctgtaggctgcaatttaaaatgtctcatcgtccagtgatccaggcgataatttactaaccaggcagcacacttagacactatcatctcccaaagccaaacttgtcctgcccagagccaacagtcagctctggcttgaaaatgaaaaatgggctcctggggatagcagatcccggctgcaggagggaaagagaaaggggcaaaacggcaaaactctgttcccacagatctctgcctcaggaagagtccccccttggtgaccttagaatctttcacaagcagaggttttataactctcagctgcctcagaacagagagctcaatctgtctctcttcttggtcaagcacaagagcagccacacaaggaaagttgccttggacctgggtagtgagaagggcattcttccacccaccctcccacccgccatctctcctcccacccaccatctctcctcccacccaccatctctcctcccacctgccatctttccaatatttcctctatcccaagcgctaatggtttatgccactctctccttccaatttgagcttctggcatctcagatcatctcaactgtggttttgtgccacatctttgctattctcctcctattttgcctgtactccaaccatgttaccatccatatgtagaatcatcaattttcagtgccaagtatcctattgcccggtgtactgggcaatagcccatggtcacatgtggcccatctgaatcacagaaaggatacagacaacctgtaagcactggatgagataaacacattgtgcctctggcttccaggactctggtcttaatgaaaaggaagccttcttttgccaaagcgaggtgcaccagatgccaggaacctggtcccctgcaagttgaagtgctgattgcaaatacactgtatctggcaggggtgtgagaggctagcaaacgacgccctccctcagccctcagggaggcattgggaacatcctttgatgggttaattgtactgattaatttcagtacaaaaggtagaaaagtgaagagctccatatcctgagaaaaaaagaaagacaaaaagacaagagggtgaggaattagggcaagaaggaaagaaaaaaaaataagcaatagttagtattaacagattttattgtgtgctagatataagctaaataatttgtctgaattatcctgttcaatcctcataatctttgaggaagatttgaatgttgaccctgttttacaaatgaagaaatcaggtctcagagagcagaactcattttcctaaggttacacagcctacatgcagccaaccccgccttgagcctttctgcctctgagcttcacaatcctaacccgcttcattcctttgcacggaagtaggttaaagttcaaggacaggccaggaaacaggcacagagaccccaggccacagacttgcaaaattatccagtccagccttcctatttaacaaatgggtaaactgaggtctgaggcaagaatatgaccttttgagggtcacccagtgagtcatcagcctgaatactgtgaagaagatgattttttaataaagtgctttcacatcacaaggctgggaagtgggtaagaattctcagattcagcgcttctttctccttcctctgtctgcttatcccaccacagagaacagctgatatgcccaagtctggtctcttgtgatgctggcctaagggagtcccagggctcgttcaatggacagacacccaggagaagtgtctgcgagatggcatcattgtggttcaagtggtccaaggcagatggagcaggaccctggagagcagcaacaatccagccgccagcctgagaaaatgattaggctgaatttggagcacctgccagccttgggtcctggcaggagaccagaaaacaaatccaggaagcccagcagaagggcaaatccacaggtgggcaggggctgggagaagacagaaggcaagtctgaccagagggcagttgaccaggagtggccacctgcatacatggggcttagggcagcctggaaggctggtggtgatagtgtccgccagggagactggccagggaaggttacagtttccccctctccaggaagacttgcacagtggagagtgggctgcaaagctactaatcctttccaatgtgtcactcctgctgcgatcagtacattttaaggtcctcagaaacaaacttcataacgtactgaaaaggggactgaaagaggaacatttccctcttttcagaattgccaacacagatggcatggattcaagtccggcctcagcacctccctgccgcatgcccttgttactgaggcagccccttcaagcctgtgccactccacctgtaaaacggggacactgatagcacctacctcaaagcactgtcaggaggattaaatgcaccaaggtgtgtaagacgctcagcacagggttcttctcatcctaagtagtagacagccagtgtagtgcacggtgcagacaactcaataaaatattattgaacagattaaaactttcacacagaattcatttaacttgttaaagcaaggaagtgtgcagctgcagtgtaaaggctttttgcttttaactactcaaaatcaaattggtattccactctcctatccctgcactcaacgctaaggttatttggcaggtctggcatatgactacttaagatggggtaacagcctctaattaagccttaaaatgtcactgtaagacgggcaggcaggaaggaacatctcctcaggaaaacatttctgggccaggcttgggccaaagagctgtcaatcaagagattattatgtttcagagttttacacccaaacaaatgttgagatccaggagggaggatccttgaggataatttcttttagaaacagagcacccaagtccaaagggtagaggatttggcccagatcccctgagttagtagcattccttccataatacctcttctccctaaaattcctcccttcagttaatttcattagagctaactggtactgacacagcctccatgggcggatcagatacaataacccaatctttatttgtttattgagcaactactttgtgccaggcattggggcaaagcaccaagcaagacggacaagaactctaaactctaacttttttctttttctttttttcattttttttttttttttgagtcacagtctcgctctgtcacctaggctggagtccagcagtgttatctcagctcactcttatctcaacctcctgggctcaagtgatcctcctacctcagcctcccaagtagctaggactacaaggcatgcaccaccatgtccagctaatttttctattttttttttttttgtaaagacagggtctcactatgttgcccaggctggtctcaaactcccgggctcaatcaatcctcctgcctcagccccccaatgtgccagaattacaggtgtgagccaccacacctggacaatccctacccttttgagtttataatctcctgggagaagaaggacacgcataagaatacaaataatgattccaaacagcaattacagatgacaaaggtgaaaagggatgaaaggaggcaggggaaccgaatttagattccatagctaagaaatgtctactgagccaaaacttggaaactcacaaggactaagtcatgcagagttcaggaatgggcattccaaagagatggaagagtgaatgcaaaggccaagaaatgggctaacacaggggagggataagaggtgagtaggggtagaatcatgcagcatctcgcaggccacactaagattttattgcaagtgcaaaaggaagccagatgcagcagagagccatgagggtaacatgttctgtcttatgaattaagacaatcactgtagttggcaacgaaggcggccagcagtggtgggaactcagagagaggcactcagggacccagactaatgcagctgttacatcagtcccatccaaggcctaaaaaggctactgaggccaggcgcggtggctcgcacctgtaatcccagcactttgggaggctgaggcaggcggatcatgaggtcagatcgagaccatcctggctaacaccgtgaaaccctgtctctactaaaaatagaaaaaattagctgggtgtggtggagcgcgcctgtagtcccagctactaggggaggctgaggcaggagaatggcgtgaacccgggaggcggagcttgcagtgagcctgggtaacagagcgagtctctgtctcaaaaaaaaaaaaaatggttactgaaagcttccccgtgggctaagatggcttggacagcgggactgaggtcgggctgtggtgggggcatgcagttctccagtggcttcgcctcatctcaccaggaatctccctggacccaaggaaccagccatcccaacaccagcatcctgcacagttccgagactggccctagagacaccctgggtttcaatgaacacttgttcaactaaaatgaactcagtaggcaatccctcgagagatacaagctctgctattgatgaaggctcacagtgagacaaggataatgggttcaaatcttgttagcaaagtcagagaactgagaaatttctgagctccaaagaataatttcccttctgctttcaatatttttgcagggtgagaatctttcatagggcggccaggaataattcttcggcaattattcagcatctcttggactggttttgcttattttcatcaagttaaagatcattcacgccagtttcttttcaataccgccctcccttcccctccctcctccctcttcccctcagatctatgcctcataatctgttttccccgattcgccctctgcctttctcccccatcctcctccatgcctgatgcttctcatgtttcatctttcctgagaacccacagtgctgcgcttgagctcagcaactcccaacttttttatttgacgtcccagtgtgtctccagtcatctccaggggagttttgaaattcattttcattcactttaatttaaaaaagaaatataggccatttagttcttttaagagggggaaatggggtgtcactcaaccagcagggaggtgaatcctgacttcagctattagcttattgggcaaagtggctctcttccaagtgttcttggttcttgggtcgcttaagcaagtaaagtgttttgctaatgtctgagagacattcactcttggggggcaggaaaataaagttcagggagaaaagagacatgagaaaattaatgttttctattaactccatttccaataaagtaggaattcaacaaaataactcatatcactcatccatttagtcattatattcaacaacttatttagtatttaacattttccaggacctagtcatgctaatcatactaatgatgatgatgatgatgatgacaccgatgacaatgatgataacagcagctaacattttattcagcttactcactctgtgccaggtagagctctgcaataattacctcaattaatccccacagaactccataaaataggggttcttttgtccctactgcagaacagaggctgagaaaagttaaacaaattacccaaagtcacaccaatgtaagtggaatttgaactcaggactctctcatcaccaccatgacacactgcagccttgtctcagggttacaaaggcaaatgaggtacagccgtgcctcaaggatctcaccttagcagtgggcaaaacaggcaggtaatcaactgcatggatcatttggaaaagccatagaaaagaacatgggagtacaaaggtggggtctctgctcagcctggaagcagagaatgcataaagatccacttccagaaggaggtaaagaactcctgggagttggctgggcagagggggtggggtccaggagaaaagggcttccagagagatgaaaaagagaggaaggggtcgctcaggaggatggaccatgcctgagaaatgcagatatatggaagaggctggtgccaggggttggtggatagacagtccacgagccctggctggggagactgtcaggggtccagtggttattaagtccctttctggcaggctaactatgggtcctagggagccagggaagggggtgcacaacagggtggcacaaccagtcatggaatcttagacatggccccatggcaacccggatttggcaatatagagagaggttcagggggcccacctagaaagatgtttgatagacatctaagcaagcatgagcagatgtgggcttggccccaggcagtgggccaagggggtgggaaacagcagatatttgagagaggctaaggggagagaaatgatcgctgttggtggccctcatagagaagtctaagaatattggccattatttttctaaattctcctggggaaaaaatgtttctgcttttatttttctggcgatagtgaatttctaatgtatttttgccatctgctccacaacagagaggcaaataggattaacaaagtttatgacatggagagaagccctgtcctgtccttgggcctgtggggggagagaggtggctgaccaacagcagtcttcctgcaagtgaccctcacgaagacacctgctcgcctctgcccagccaccctccatcacaggtaacacatctgccctgctcttccccacaacacccttggcctgactcccaagagcagcaggggtgtcagatgaagcggtcaacacagataacctgacagctaaacaagagaacgaaatgaatattcagcagctggttctgcttcagaggctgttaccctgttctccatctctccttcaatcccaggaacagaagaaaagaacaccaatcacctctcagccccaccattctagatccaggtccatggtggtagagcagattgtggagattaacattcaaattcaaacagtcgcagcattctgtcagtgcttttaataagaaaaagtgtatatcctttggataaagcagacccaatttatatatctaatgtatgatctcttgaattcataaaaggccatgtaaaacatacatacatacatacatacatacatgcatacatacgtagacacacttactttgaaagctcaaaacacaaagccatctctctacttcaacatctgaaaaatactatcttgccaatgtatttcccaagaagaagacagtaaaaaggagtataaacaagaggaaaaaaagtataaaacctgattatcatcttcaatccaaacatctcagacacaggtagacccaaggctttggagaatccattccttgcatacaactcaattcctgctgagcctatgtgaccagacagacaagtgcagactggctttgtgtttaaaccctaaatgataccattaacatgaggctttcagttctcctgcccaagtatttcccggggaaatcactccgacaaataagctttcctgggggcaactggcatcctctttcagctctaaatatgctttagttaacagcatgaggcctgttcatccctgccctgctcatatatcctaaatgagataggagctagaagacctaggctcaaggacctgctgtgtcacaatttgactatagaaattagactaattatgggatctccctgagccagtggctatcagtaagaacaattgctaatatttcctgagctgctggggtactatcaactttatgttaagcattttacatggattatttcagccaatccttccagtgttttatggtgcccatttcaaagggaaggaagtggaggctgtcagtgggagtgctgggtggctgaccacaagcatcctcaacatggtctctgagctccagggcaccacacaggttaccaaggaagggaacatgcagcttgtagcaaggctggttcattcagcactcactatggtgcaggcactgcattgaccctgttggaaaacagggagagacaagagcatgggcactgcctggaaggagggctgtggcattgggacacacgactggtggtgatggtattgggctagttcacttggtttaggcagaatttcagctggacaagaagacgggaagggagctccagggagagggcactgcaaggacaaaggtctggccagcttagctactaaaggcccggattggtgctgagcaaggccacggccacccaggcagggcgttcacaggccatctaccaccagctctccctcatacggcgtctctgctcattgacagacccagccctgggccagtggctttctgctcataccacaaggtccaaatccgttacaggaaaccagtaatggcctaacctttgacactgggtaaacataagctctgatcctgggtctacctcttcacagatgaataattttgggcaggccacttcacttctctgagcctcatctgaaacatgggaatcatgtgactattataacccaaatgttggtgtgcatagcaaactttccattcacccctttcctgataacagaacctccctctctggtgggaaactcatcccatgggatacagatgggcctgatctctgtcctccattcccactggaaggagcacaggcctcaagcttgaccaatcaaagcatatcccatctcctgggtgcactgataggttctaagatgagaaagtgacccaacctccctcaatctgaatcctcccaaggcagttttttgaagctatcagaagaaagtggctctattctctggaatgacaaattgtacaagtgacacaaatctagagcatctgaatatatagaacattctagagaatgagctcaatagagagaaagcaaagtataatagaaccaagatatggagaggtggagagaggctgaaagcatgtttgcatgttctagcgaaagtctttgagttcttggatcaagctatacctgaaatctggaccactccttagacttcctacatatatgtgccaataatattgcccttcttttgctaactccagtttgaattgggtctcttgccacaaaggtcctgtctaaagcctggtaagtaagttagctacaaagattaaataagtcccagttaagtaaaactgaattgaatgcattctgtgcatttcaatcaatgctctttcccttcccttagttctaggtctcttgtcctaggcagatgtgaatctgtaataactacagaatatttgtagaaacttactgccataaaatgttcttaaacaaatctaaatcattcagttataagagtaagacacaaacatttggccaaatcatctatttaaaactctgctccaatccacccatttcaggaagctgccccagattttggtcacttatggtccttccagccacactctgtaactgtaaaaaaaaaaaaaaaaaaaaaaaatctacattattctatattattttataaatcaaattcctgtgtttcaaatgcaacttattgaaccgcagctgtatctctctaggaaaaaaatctcatcaaagacaatattttactcaaaaattcagcaagctttaaacaactaaaccgttaaaggaaaaaactatatagcgaggtagataagtaaaatcctatttcactaataacttttttcaccaaattgaaactatatgcctccaagggaaccaaaatgaaaacaattatcaaaaaaaattacttgaaaatgtagcaaattttaaaaagctaaacttttaaaggtaattttgattttatattttaaagaataaatgtgaatgaatgaaaaattcctggaactacttttgatacttgaactaatggtctcacggaaacaaaataataaaagatgagttggacacagcacatgtaatagaagaatcctgggctctcgtcatgggattcccaatgtccctgaagacagcccaggctttggcagcccagcttcccatactggcatgaggtaaaagcgattgcctttatagtggtagacttggcaggaaacacagcaacacaacaggggtaatgattcaaaattcagcataaatgaacaaagaaacatgtttactgaacccacctggctattgtgtaaaacaaaatatcacgtgctatctataataagccagttctctggactacaaaagcagttcacttactcaacagatgtttattggctatttggtgtgtgccatgtaccatgcaagggttgggaacacagcaaaaagctaggtgtggcccctgccctcagggagctttcaatcttgtttgtgcaacaaaaagtgtgcaaataattgcacaattctgaacttcaatgggtgtgtttacatttgaatctacaagtttattaatgctttgtgaaaaacttcatataggatgaggtcattctatttcccttttaaaaaaataggtttattaagatataattcagataccatatgattcaccagcttaaaatgtagaactcagtagtttctggcgtaatcacagatctatgcaaccattgccacagccaattatagagcattttcatcaccacaaaaagaaaccatatcctttactaagcatccttcaatctccccaaatgctcccagctttaagtaatcactaacacactttctatctccacagatttgtctcttctggcatttctttgctaagttcaacatagaattaccagataacctggcagttacattcttaggtatagaccccaaagatgtgaaaatgtaaagatgttcaaacaaaacactgtacctgaaacgttcatagcagcactgttcacaataggcaaaggtggatatggcatatccatatgatggaatatgcctcagacataaaaaaaaaaaggagtgaagtactaacacaggctacaacacgggtgagccttgaaaatatgctaattgaaagaaactagccccaaaacacgtatgacttaattccatttatatgtattcccttggcctgaaagttctcttcttgtgttccttctctctcttccccatcactcacccatcctctgtgatctcacatccaccccctccactctgtccccagatccactgttctggatgccagcatcagtgctcatatctggatcatggcggctgactcctctttggtcccttgcccctgggctttcccctccaacctaccccatgcaccagctacccgggtggtttctctaaacacaaatctggcagagctgattacaacccatgagtggcagctccatccaccatcatccactgaattaaagcaatccccatcacacacaaactcccaggtaccagcacccatcattcatataacagacatggagccatccagcatgatgaagttccctggatcctgcactcttcactacccacttctgttcctgcctctgtttgtgctccgcctggattcctgcctttgtctttcctacctagaaatactgctctgtcttccagacagttcactccttctccaatactgagctggccaccaccctggcgattgctctccacagtgtttgaggactgtttaattaactactgctaaaaaccaggagctgtatctgctcaccgctataaccccatgaactagcaccaagcctgccttgcacattttcccaatgaaaatgagggagaaaggaacagaagaaatggaggaagaagttaatacatatttctaagaaattaatacatatttctcaataacttaggcacctatttatcaaccaacaaataactattgtctcagatattgaaaacatcttggcctccttaagctttttttcctcagactcgcctagtctcataagggacaaaatcaaactccagagttgaaaacaatagcaacaatagagaaaccacaagaagcctcagctcaagtcccaaaccagggtaagaataggaagtcctgccttcctggagtcttgttcattttagaagcttcacctccaatctacttgagaaacaaaatagggactggtagagaagagttaatagaagcatcaaaatggagacattacaaaggttttaggaccttgatcttaaaaccttggttcccagccaggcacaatggctcacacctgtaatcccagcactttcggaggctgaggtgggcagatggcttgaatccaggagttcaagaccagcctgggcaacacggcgaaacttcgtctctacaaaaaatacaaaaattagccaggcatggtggcatctgcatatagtcccaggtacttgggaggctgaggttggaggatggtttgagcccagaacgtcaaggcggcagtgggccaagattgtaccactatacttcagtctgtacaacagagtgaaaccctgtctccaaaaaaagaaggggaaaaaaaaaaaaaaaaacaaccttggtccctgatctctacctcccaaatctgagcttttaggctttttccttcatttctattttctggaatcctgaacacactgatcttttctttctgatctcttgtttggagaagctcttgtggactctgtagtccctgacagcacctcttttcaggtaagacacataaaggcaaaatcatagataatccatttgcctccagtgggggtggggggagcagcaaagacagcaggaaggtttacagatttttctaaagacccatctagttctaactctctatgatacttggtagaggacaaaatagcatgaaataatagcaatatgcgtgagcccaatcaaagaatttattttcaaagataaaaatgcaaaggtgttgttcatgatgattgaaagcaaaaaataataaatagtgacatttgagattggtcttgatcactcctgatttctaaaatctccccatcaccctaccattacaatttcccactaattactacaagcaattttattaatatacttttcagcctcattaaatattaccttgggcctaacattaaaaatgatgaggctcagtaatcttaatgagcatccaagttgcaccgacccctgaaaacccagaaaacagagaactaaattcattgctgaactactctggtccccaggcatgcaggaatcaacttcagaaacatgaaagaaatgatacgtacaacccagaatgaagcctgattggaagcacataagtttagcttggcctccttcagttcctgtcaactaagggggcaggaaaacgtcgaggaaacatctgggctttatcttctcctcccctttcaccctggttataaacagcatccatcagcatgctgttcaccaatattaagtctttcctgggactctgacaggtagagcttctagtgattgtgggctgggccaagacaaagcaaactggaaatgaggtatccactgctctagcaaacagaaatctgtggctttctctgaaacggtagtggaagcacaaagaatagacagttgagggaattaggaagataaattttatttgttttcttcctagcatgaccagaattgtctgcattcctcaaacagcaagctaggcaagacagtgagaccagcttcctggttctcaaagtaaattatttatcaggagctgaatttactgctttcctgactaaactgtcaaaaccctgccatttacaatagcagttgtactgtgtgatccccaagatgcttaggtttcccctagcttctaggttaaaaatgaatgggtaacagtaaaccaggggatcagctgaagagaccagcccagacttactgaatccacctttggccaagatctgagagagttctccatgtgtccgaaaccagtaaacttagcacaatgtaaaactattatattagacagaaatctttggaattatctaatttaaaccactaattacctaaaagaaaactgaagtccacagagaggaaatgatttgtcttggatgaacaagaagagtcaaatccaaaacctgaactcttgggtcccattcattatactaccatggatattgtcaacctgaaatgggggctgtaatgggaatggaggcagagacaaccatccaccaaagaattgtggtgtccctctttcatggcacagtgctggctctgggacgtggctacctaccaggaactacatcttcgcatccttccacccactctcatcccactaccttgcagctgagtccagccacaggaatgcatcctagccaatgaaatgggtatgaaagtgctgtatgatgccacttctgggcgtgacccatgcaaacctcaaatccagagcttctccttgccttgccctatctaatggctgggtacagggaagtttaagatcataggagatagtgaacctagatcttcaaatcacctgagggaacaaagtcttttaagatgaggcatacacacacggtctgttgctgaagcaagatataaaattttattgcgtgaatctattaaaatttttctgggggggtgttattcattacagcacctgctattaacctaacaaataccaggaacaactttatagtggaaaagatctcagacacattgagcccaaagcaaaactgaaagcccataaaaagaaccttgttataacagtgggaaaacattaacaaatcaaataataaaaatgataatttatcaatttgccaacttgctcagcagactcaaacggattaattgttccaggtttctgagggggaacaaaacccaagtaaaggctagtcttgaaaacaaagtatttttgcaaaggaaatttttcctcaagcgtccttattcctgcttccttttatcttaaaagtgatggcaaatgaactatcgatgcatgcaacaaccttgatgaatctccagggcattgtgctgagggaaaaaaggccaatctcaagggcctttctactgtctgattctacttatataacattcttgacatgacaaaattgtagtgatagaaaacagatcagtagttgccaggggcttgggtggggaagagtgtgtctcttaaacagtaacacaggagagtttctttgtggtcatgggtcagttctgcctcctgactgtggggatagtcacttgaatctacacacatgatgaaagttcatgggggttgggagggtggggaatgaaggaaggaggaagggggggaaggggaggggaggggggaaggaatggaggaggaggggggaaggggagaaggaggggaggggagaaaggaaggaagggcagggaggtagggaaggaagggaaggaaaggaggaaaagaaggaaggagggaaggaggggaggggaagagaggggaggaaggaaaaggagggttgaaaggaaaggaaaaaggaaaagggaatgaaagggaagaaaaaaactaaaaaagaaagtgcatgtgaaaactagtgaagtccaaataaggtagatctctaagttaacaatttcctggttttgacaatattactatgattatgtaaaatattacctttagagaaagctgggtgaatggtacaaggaactctgtactatgtttgcaacttcttgtacatctgaaagtatttcaaaataaaaacttagaattctttaaagtgatggcaaaggccctggaccaccaggttctgagttgggaaatatgccttgtacttccagattgggcaacatgaatatgataactgcagagagttcaggggctactcacaggacctttgccattagtcacatgattatttgtttattctttgtcttccttctagactataaatgcctggaggtcaggagccaagtcagttttgttcccccactcaatgcctaacccagtgcttagtacatagaaagcacccagtatatatgtgtgagatgaacaaaaaaacaagaaggggaacaggcaaggaaggaagtatcactcacgctttacagaggcagtggtgtgcagaggtttccatgccttgcccttgtgcacacagctggagagaagcaggacaggtacaaaaaccatcagggcttccagagtgcccagtgaccttttcttagtgccatatgcctctcaacttagatccctggtagttgctttatcttacataataaaaaaagtaagaggggaggaaaaaaagagcagacacagagagagaaatgagacagagagacaaagagatatgaggaaagtagtgagagagatcgggtgaaagagggcaagaaagagggaggaagagaaagtgagtggggagagagaacaatgaagagagagagggaaggagagaagagagaaagagagccagagaaagaaagaaggagagaggaagagagagagagaaaagaggatggaaggaaaggagagagggaaggcaagagaaaatctgccccaacatggaaaatgacattgaacaaatggattccaaattttaacacggccccacaccataggcccaggcctctgtaactgctctaattgctcagaaatggtattgtaatgtgaacaatatgtcattaagcaataaacgcttcatgcaaaataacaaagtggtcatcagtgagatggaaaccaggaataaccaagggaaattgtgctccacatctctccatgctccaattatcagactgatcagtggctccttttgtctgttcagaaggtgctgcagttttcagtacaacataatataatgtgaaatgcaatacaccaagactaagaaaaccttatttttttttcagtcttacagagagagcaacagattcaaatttgaattcaggctctgctatcttctttgcagccactgcggcccaagctgcactggggcccactggagaccacctcgggtgaccaatgagtatagcatcagagtgtggggagcagagtcttcaatgtgaggtggcgccaggtagggcatgtcaaggtcctgcagccactgggagctcttcctttgaaaccagtctgcaccctgcacctagcccttgcactctgagcctatgatggcaggggcaggtctgacgatctcagaatcaactttagggtcattcttccactgtcttggagaatagctcctggcttccgttaagactgctgattcatactaatctccttatcaaacagttgcttggacatagccttaatgttctttttttcaatatgtataggctgagaatttttcaaatctctaagttttgattcctttttgcttaacaatttcatttttgagtcatttctctcttccttgcattttactctgagcagtgaggaggagccaaggcataccttcaacattttgcttagaaagagcttcagctaaatatccaattttatcattcacaagttttaccttccacaaaacactagaacatgaagacaattcattcagctaaaagctttgccgcttgataagagattgtcttttctccattgcccaataacgtggctctcatctccaactgagacctcagcagaatggcctttaccatccgtatttctaccaacattctactcagcattacttaggtattctctcaggaggtggaggctttctcttgagctttcttcctcttctgagccctcaccagaatcacctttaaaggtctgttcaacagccaggcccagtgactcatgcctgtaatcccagcattttgggagactgaggtgggcagatcaactgatgtcaggagttcaagaccagcctggccaacatggtgaaaccctgcctctactaaaaatacaaaaattacctgggcatggtggtacacgtctataatcccagctactcaggaggctgagtcatgagaactgcttgaacccaggagggggaagttgcagtgagctgagattgtgccattgtactccagcctgggagtgcaatgtattctgagacagagtgagactttgtctaaaaaaaaaaaaatacattattttatttttgttattattatgtctgttcaaggcagtgtaggctttttctagcacgtacctcaaaactcttccagcctcattatccagttccaaagcctgttccacattttcaggtgtttggcacaggagcacccccatttctcggtaccaatttttatcttagtccatttgagctgctgtgacagaacaccatagactaagtgacttatcaacaacataaatttatttctcactgttctggagcctgggaagtccaaattcaaggctacaagaagttctgtgtctggtgaggacctgcgtcctggaacatggatggtcttcctcttgctgtttcctcacatggtgtgagggacaagggggctttctgaagtcccttttataagagcactgatttataagagctttctttcctggcctaatcatctcccaaaggccccacctccaagtaacacacatcaggggttagatgtcaataaacaaattgtatgggaacataaacattcagtctatagcagtcacttttcatctatgtgactatgagcaagttaatatttttaattcggctttattatctgcaatacaggcacaacaatacatactttgcatggttattgtgaagattgaatgaaataatttatacaaatgtggctactagcacagtgcccaccatgcatttagcactaaacaaggacctctgtgttctcttccagagagctcttcatccagaagctcaacacaaaatgttgcacactgtaggaccattcatatgacgttctacaatcaataaaatgtgcctagtaagaattagacttgtttgggaggaggagaactaaagggcacaagggtactttctggggtgacaggttgtgtattttggtaagattataggtgttacaggagtgcatgcattagccaaaactttctaacccatatatttaagatctacatactttacagtatttaaattatacctcaataaaaaatttaaaatagatagctagatatctagatagccagatctgtaggtaggtgggtaagtaggagggtgggtgagtggatgggcggataaatgaatggatggatggatggatggatggatggatggatggtcagtcagggtacctacttcagcatgaggctcacaataagcattccacaagtatttctgaagttccagaatcaaaattaattcctcttaactcctttccgtcactactctcgctcctccagaaacaatctactcaactgtagggtggcacagccagttctaaaagtgcttccttctatgtgcctgaatcctggtccctgatactccgactcaagaggccaggtggatgacatctgcccactgcctccttataacagaactcaacggtcttgagtatcaaatgtgctcggcctcatgttgagcacctttaagtccttcactgtactagtcaccttcaattcttcaaaatctccttggaccgtgagcccagatgggcctctagatgtcatcttttaagtatgtgtcctcaacgaatgggctctgggcagctctactgctatgaagtggtgtccaccatctggagctcatgcctgtggtttggtgcatagtaattgccaatatctactgagcacttactccatgtctagcactgttctagatacaacatgttttcactcctttagcctccacaataaatcaaagaagtctatgtccttcccattttacagatctgatccaacagaatttcaaggtaactctttatctcagggtcttttcagaccccattaaatcccatctgcaaatctcatctccacacctttatcccacccatcgttataatcgaattgctgtgactcaggcagaacaactcttgcctaacatacaaagcaggagttcaatttaaaacatgacagtggagttttgaaggaacaattgactgatacaacaatgggtgaagcttaaaaacattacgctgagcaaaagcagatgaacacaaaacagtacatactgcatgtttccatttctagaaaagatcaatctaatctatagtgaccaaaatcaggtcactggttgcctggggcttagggtggaaggaaggactgcaaagaggaaggagagccatttctaggtaatgaaaatgttctatgccttgatcagggtggtgattagctgggtatgcacattggtcaaaaccaaaactctgcacttaaaatgtgtacattttattggatgtgactaaagctgatatgtttatgcaaaaacaaagaaaagccttctgagccaacagctctagctttcaatctcgctttgtcttttcctggctgggtaacctagggcaagccacttaacagatctgagccttagtttcaggctgttgtcagggttggagataatacatgccaaacacctgggggaaaaccaggctttcaataaatcgcagcttctgttattactgttaattaataataatgagaaataataatctgagtaacagcttcaattctctacttcacttcgctgggagatcttgaactgctaaatgttccttactattagctctccctgaaaaccaacacacactcttttgcagcatgcaatcacgttaacgctatgctagaagaataatcaagaatgaataccaaatgtatgtagatgaaagaattcatgtttatatatgaatatgggccatgaaatcttggattaattcaaacctgaacatggttgacagttactattttctttccaaggaatcagattttctgcctaggtaactccatgggagttttctactatattgttacacagggtgtaatttctctaataaggtcattgaggggaaaagaatcctggactctctaatccctttgtattactttttcctaagagtgtctttctcaagggatatgacatggggtcagcatggcaaatttcaaatgtatagcaatctggtttgggtcgttttcaagctaaaatctgtgagctcatctctttgttttttggtcacttacctccacactcagaaaattgctttgtggaaaactgttcagctctatttaggcttataaataatttatccaaagctcaagcaaaggtgaattagaaattttcagggttcttggtggaactaagactcagtgtgaggtcacaaaagattaaacaataatggcaaatcgtatgtgaaaatgaatgaaagggactaggtagaagtggcctcaaagttgcaaacatgttagtcaacccatctttcagtaaattcctccaaccatccttcatttggggaacatccttgttccactgttagtcatccaaagagccaacttcgggatgtgagggcaatctggctgcgacatctgtcatcccattgattgccaggattgattcagctgatctggctggctaggtgggtgtccccttcctccatcaccactccatgtgatgtgcgtccctcctgaagctgcgcagtgggtcaaagaggatgaccatccccgagagagtaggaccagtcttcagtaaagggtataccaatatctgcgctcccctgatagaacctccaaacaaagagccaacttctcctgctaaatgccatgctggtggcattccagtgtgctctcggtcttagcacagatcaactcagtgtcatgagtcatctcccttttggaagaaattcctaaatgttctggcttcatagtgagtgctggagaattgagagccttctaaagacttaaggaagctccaaagaaaagaggaaacagtcattgcctagacaggaaccactgaaatacagctcctcaacccaaaaagcagctctgcaagttcccaggtgttaggctccattctgagttcacatgaaaccaagttcatcagttgatggactcaacatgagttcagaggtctcagagagtaaaaactagcttccagtcctacttggactcctcaggaaataaaatttgctaatagcatggtacgtttatgatttgactttccttatatttacccgtggactttccatgagacccaaacaacttttcttaaaaaaaaaaaagttcccttctatggcacagactactacctattcatcctacccaatttcctcttcttcttgggaacagagtgagaccacatttcccaggatcccttgcagttaattcctaaatttacaactgaattctagcagatgaaaggtagactttatatgataatggcaattcttaggcctggtccatgaaaacctcctaccccatcctccaccctctagtttcccatcaccagttgaatttcacagacctataggaagacagagccacaagatgggaaatctttagtcctgaatgactgaagagtatagtcctctgccagtcacactggagtgatggagaaaacaaatctttattatattaagacaatgaaatgttgaggttgttataagagttagcctgtcttgactcgcataccctcctctatggtcatcctctcaaaaactccattaaatgatttcaaattaaaaaacaacaacaaaagaacgttaacacctagcttatgcaagacaaatacttttagatcaaatctcacaagtcagcctgactgcttcagtcacagctgcttcaagttgtgaactgcctgtgggtgtcctcatcccctcctctcaacaaacatcaagttcaaagaagtcttctggaagtcaagagctgacaggagctggctgatgtcaaggaggaagcccacatgtctcaagccacctctggtaacacttcaattatccaccacctgcttatcatgaggttctgagtacagctttttccactgtctcccaaagaaaaggttaatggaaagtgtcaagatccaacaggccgataaatcccaacccttggttgagaaaacagagcttatttctagacttagtcatgattctggatgctagcttatattaccctgacccctcctgtctttacatttgccctttcctctgttgtggacatggcttgccctcatcggtgatgatgatccttctatccatggtcaaaacttcctctcttccaacccacactcttaaagggtcatgctctaaactgaaggaaactccaaaagaagaaaccatctccttcccctttgcatctcctgccccaagcacacaagaggtgcactcatcagcacaggataactgctacagcaaaaatcttgatattttggtggcttaaaacaatgaacgttttctctgcgttcatgccacagtccaatatagattcacagatctaggatcctataattccaccaaactctgtggcatcagagtcttccgtagtcaagggaggagaatgcaaatcacatgtagtaaggatttacaagagccaggcctgaaagtggtatttgtacataactttcactcacatttcactggccagaactcaaaataggcccatacctaatgacaaaagggcctagtaaagtattctcactagagcttaaaaggaaagaggaaatggattttggtgacctctccactgtatgtgacccagtgggggagggagtgtctcacagaaggcagttagccagcttgtaaggacatgacccagagatctgttggtaggaaaatgaaatttcccagaactatgcaaaggagatctgctaccttagcacaatgaatcagatgatgtacaccagccagaggttcaggtaaggtgggacctcacatgaggtgagagcaagttatctgaaaggagaggctcacatgtacatgaaagagaccaggaaaggtctaagagggaagacaaggtgatgttgcctcatagattcacgctggttgaaccaggctgacttctggtttcctacagagtcaaagagctcagagtaggcagacctctcattttacagttggggaaaaaaaggtgtccatagagttaaagcaatttgcaagttgcacatctagcaagcaagagaaccaggactggaactcctgtccctgactctatcactcccagtccaccttgtcagctctgtatatacccctatatctgcaaaagtctaggccttaaaaaaaatagctaccagccagtttattctctcagacaaaagatttccagaaaccatgtcttccaccctggtattttgctcttcccaactctctctctctctccttccaaatttacataaactatacacgtggcaggtgcctgtatgaggtacaaggacaaaggctctcacacacccaccagtctgtgtcacccagatggcttcctgctcatgcaagaaggacttggctcggttttcatccataaatgtgtcttcatttgtccccggaggcctttctgtcacctacgggagcacttctctgcaagctctgtgaattataatcttctagagggtatgttccagacaatgaacttctttccttccgtcttttaaaatgagattaacccaagaacattgcagaggctcccagtgataagcatttctcagactccctaacactggtgcaggaataagtcggtatgcttttctgaatctgagaaagcctagaaacccaggcctcatctgaagaagtacgagagacaaacagttatttctggctacattcctgtgtattccaaccgaattgcacttccccccatccacccattctcccttgttctccacacctacctcaccttaggtcacctctaccctgttccaacctgaactgtggggcatagcacggagtggtggaagggtagggaaggtggcaccatcaaggcaaactctgaattcctgggagagtggcttcatctttgttctacagcagggctcagcaaacttgatgggtcaaatctaacccaccctctcttttcgtaaatgaggttttgttggaacacagcccacagccaagctcagttgttcacatattttctctggcactttttgtgctacaatggcagagttgattaattatgacagagaccctgtggcccacaaagcctaaaatatttgctctctggccctttatagaaatgtttgctgagccctgttctgcaggaataaagaaccagttttctttcaaacaaatattcatagcagcattatttgctatagccaaaaggtggaaacagcccaaatgtgggtcaatgggtgaatgaattgtggcatagccatatgaaatattcttctgccataaaaaggaagtaccgacacatgctacagtatggatgagccttgaaaattatgctaagtgagagaagccagacacacaaaaatcacattttgtataatttaatgtatatgaaatatccagaataggtaaatccatagagacagaacgcagacgggtggttgccagggaatggggagtgggggttggagagtgactgtttaatgggtacaggatttccttttagggtaataaaaggttttggaactgtatcaaggtggtacttatagaacattgtgaatgcaccaaatgccactaaattgctcactttaagatggttattttatattatgtgaatttaacctcaatacattttttaactcaaaaaatatgtaattttttaaaagaaaggagtcagtccctggagattttggagcagaggagtgatatgatctgagatgtactttcaggcaagaaccaagtaatgcttacaggaagggaagtcctcggatgactgttgggtacctgagaagagggtggcaacaaattagaaacaaagggcaaggcacagtggctcacatctgcaatcccagcactttgggaggccaagacaggaggatcacttgagcccaggagttcaagaccagcctgggcaacagagggaaacccccatctctacataaaactttttaaaaaatagctgggtatggtggcacccacctgtagacccagctactcaagaggctgaggcaagaggaatacttgtgtcaggatttcaatgctgcagtgagctataatcatgccactgcattccagcctgggtgatgaggggaggggaggggaagggagaggaagggagggaaggaagggaggggaggaaggaaggggagggaggggaggaaggaagaggaggaagggaggggaggaagggaggggaggaagggaggggaggaaggaaggggagggaggggaggaaggaaggggagggagggaaggaaagaagggaggaagggagggaggaaggaagagagaaaaggaaggaaggagggagggaaggaaggagaggaggagagggggagattgatttttaaaacgaattaggggccaggcgcagtggctcatgcctgtaatcccagcactttgggaggccgaggcaggcggatcacgaggtcaggagatcgagactatcctggctaacacggtgaaaccccttatctactaaaaacactaaaaaattagccgggcatggtggcggggaacctgtagtcccagctactcaggaggctgaggcagaagaatggcgtgaacccgggaggcggaggttgcagtagccgagaccgcgccactgcactccagcctgggcaacagagagagactctgtctcaaaaaaaaaaaaaaaaaaaagccaattagggaaggggagctcagtttgggacacactgagtttgtatacctgtgggacaactgggggtataacaacagggagttatcagtgtgggactgagatttaagagcaagatcaaggacagagctagtgatgcaggaatcatacttagggaggcagtattgccatgagagaagaaaggagaaagaattggacatgttagaaaatcccaataactacagggcagtcggataaagcacagcctgaagtaatatcaaagaaggtataagaagagggtcagaaggaagccaggtgaaaagatagccatggaaagggtacagtcagtggcaccaaatgctccaaaagcatggaggaggagacagaggaagaaaacctgatgaaaggtcactggagttgcagggtagcagtagagctcaaaacctactacctggttctcatcttttcttctgagcagcttaggttgctggataagtgaggtcatgaataatgaggtcatgcatgcagataaatgcatgcagtctagaacccaaaggaagtgagattccaaagatgtgagctctgctctcctctgaccctcagccccaagcttggaaggacagcacagacagcatccaatacatgtttgatcccagccatggccctaggtccaaaggctgagctcccttcccaaaattcagataggatgtctctaacactagcacacccagcatatgcttgggtccctcggttaacgcgcgcatccagctgggacacttcgtagccatgccttgatgttactactactcaaggtcttccaacaccagcagctactaactggtcagtgctataaccatctccatctgcaataacaaatcttctacaatgttacattaacatcaaaatgatgacattcagagtataacagcaaattaattccttagaaacagaatgaatccaacttgccattattaccttaagtgggaatccaaaaaggctgtaataaataatataaacccattatatttattcatccctgatctatcctttataatattaaaccaaagaggtaagcaccatggaggagaaatcattatttctggtatgacaaggaagagactttgctggggaggggggcgttgcttgacaagaagcggtgaggtatcttttagcaaaggcaagtttataatgaggactgagtcggcttttttatataagagcaattcagctgtgaaatgggcttccccagaaatgaggtgggagtccctcagcttcttgggagccgtactaatgggttagtcatgtatgacagcttgcatagtggttactccagttgagaaggctttggacagccttcctgtgatttatacaatatcaattggaaaagcatcctattttgccaggaaagatgtcctggaaaaccaagcccacgggctcctataaggcaggtgcttcaagctaacttcaggtgataaatccaccagccccctaatatgcccttttagaaaacgcttttgcccaaaagtcacagacaggcagcctatgagccaaatctgacctacagatgtatttcaatggcccagaatacttcctttgtgggttatttttttttaaacatctgaatctgctcccaactctccaaactttcaagatgcagtgcatgctgctggtgcacagtccggatagtcttgaccagcaggtgaccagccccagatgctgtgggctcacagcttcctccttctccaaagaaatgcaaatcaaaaccacaatgagataccatctcacaccaattagaatggcgatcattaaaaagtcaggaaacaacaggtgctggagaggatgtggagaaacaggaacacttttacactgttggtgggactgtaaactagttcaaccattgtggaagacactgtggtgattcctcagggatctagaactagaaataccatttgacccagccatcccattattgagtatatacccaaaggattacaaatcatgctgctataaaaacacatgcacatgtatgtttattgtggcactattcacaatagcaaagacttggaaccaatccaaatgtccatcaatgatagactggattaagaaaatgtggcacatatacaccatggaatactatgcagccataaaagaggatgagttcatgtcctttgtagggacatggatgaagctggaaaccatcattctcggcaaactctcgcaaggataaaaaaccaaacactgcatgttctcactcataggtgggaattgaacaatgaaaacacttggactcaggaaggggaacatcacacactggggcctgttgtggggtggggggaaggaaagcattaggagatacacctaatgtaaatgacgagttaatgggtgcagcacaccaacatggcacatgtatacatatgtaacaaacctgcacattgtgcacatgtaccctagaacttaaagtataattaaaaaaaaaaaaaaaaaaagaactgccctcaaccaaaccagggccacttacctctaccacagagcagtggccaatgactgaccaacacaagggtatggtgatgacaaaggcaaggcaaggagggaccaaatctggtgcagtttgcagtccggggttccttgaggcatcaggctgaagctggacaccagccaaggccacatccttgcggagctcctatccctggctgtcttgcctccttctctactttctccttagagcagggttctcaaaatgtcgtccctacactaacaacattagtatcacctggggctcgttagatatgcaaatctcaagccccactccaggctttctggattggaaactctggggatggggcccagccatttgtggttgaacaagctctccaggtgcttctcatggatgctcgagtttgagaactgcagcctcagagtgcagcctcaattaaactgcatttacatgggcccccagctccagttctgcttcagggaacccagttcaagacaggaaagttcaggccaggcgcggtggctcatgcctgtaatcccagcactttgagggggccgatgcaggtggatgacatgaggttgggagttcgagaccggcctgaccaacatggagaaaccccgtctctactaaaaatacaaaattagctgggcgtggtggcacatgcctgtaatcccagctactcgggaggctgagtcaggagaatcgcttgaacccaggaggtggagattgcagtgagccaagatcgtgccattgcactccagcctgggcaacaagagcaaaactccatctcaaataaaacaaacaaaagacaggaaagttcacattttcaaaagaatctgctctgtccagcacctcttgaaaacggcttctttcccacagggaggcaatgcacttggcctggaagagctgctgccccacttaaacagtcagtcaccattgttttccattggtttgcacccagcctatctcaggcatactgcctggtctatgtgggccattctagacatatgatctagctctctagactgtgagcctcttgaaatcagcacttgcctttctcatatttgtatcctcacagcctggcacatggcactcatcaatgtctaccgagtcaaaccaaactgcaccaaccctgtctcttgaaagtggccaacacttctgagactcgaaggcaaaattaatgcaattaagaagccaagaaacaatccctgcaacaaattaatataatggccttatagacatcatagtcatgcattggctataatagtgcaaagatgtaatatgcaagagaaattggttgctggttcacctgatagccatcctaaggcctgaagcctgcagattaataacccttgtaattttatcccagtccatgtaattgcaagtgccatctttacttatttaacatctaattcctcaaagtaggtttgcaggcctctaacacttggttcaaatattctcattgtcttcttagctcagagagacattctttattaaagaatcaagctgaatgtgaaataaacacaaaataaaatctggctgcaaaccttagctctggaaaaaagaaaaaaaaactcatttccaacccagtgctagctgcttgcaaattacccatgtagaaaattgcccaaacttttctacccaaactgcatttgtttctgattttaaactaagttccgttcctaatttttcttcctttctccaaagcttctatctttagaaaatatggagcccaagttctataatttgcacttcatttgaacactaatgaaaagaaatgctcttccccttcaaactatttcctcagtcaattaaacaaatcctctaagtggagtgtgtgaagtgatttgtgtccaagaacttaattagtacttaattctggaatttgtatcttcttaagctcacatccttttaagtttccaccaagctcaaaaactggtccaggtgtggtcctttaccataagatcaaggcagaagctgatttgaagaagtcaggaggaataaaagaccatctgtgtgctcaaaaagacttccaagcagccttatggccaccaactaaagtcccttgcaagtccacaaaagagacagggtcaaagaggacttgcttacactgcaaaatactagctctcttatcataaggggaccacacgctcatgaaggaaaaaatacaaaataatataaaggagaaaatgcaatcagctacctagagatagactctcttcctccatgttttaactgttaaatatacaatggatgtattacattgtagatcacattctgtgtatgtgtacatgttttcccatattttcaaaactgtttccatacgtctgtctcttatttcaatgtgctccgttatcttggtaaatttgcctttcagacccttctgggctgttactctaatcatgcatcctcaaatctttagggggaaatgagtggcaaaatatagcttactctttatgtagaaagcacaggaatatatatatatacacacacacacacgtgtgctatacacacgtgtgtatatatatacataggtgtgtatatagcacatgtgttttttatatatataaatatattaggttggtgcaaaagtaattgctgtttttgccattactttcaatggtaaaaaccacaattacttttgcaccaaccttatagatacatattacatatttaattaccactttattcaaaggtgtctccttggaaatcctggctaccctctaggttacaattgtttggctggtgggaagggagagatacatgatccaagcagagccagggtctcactctgttgcctacgctggagtgcatggcacaattacagctcactgtaatcttgaactcctgggctgaagagatcctcccacctcagcctcccagtagctaaaactataggcatatgtcaccaggcccagctaattttttaaaattattttgtagagacagggtctcactatgttacccaggctggtctcgaactcctgggctcaagggatcctctcacatcaatctcccaaagtgctgggattacaactgtgagccaccatgcctggcccacctgtgctttatatacaaacatatagtatctctgtggtattaaataaatgttatgggccgagtggcaattaggaggaaaaaatgtctaaaagacttcttaagggggatgtaatgaaaaaaggttgaaaaactgtgcagtagatgactataatataattgacttaaccaattcttttaataaaatctgccgacacacacttattacttgatgtcagacttaaaagcaaaaacaaaattttataacgtctattaatgatcatacgttctttttcagtgtaaaaagatcagtttccctaatgtctggatctccaacaatctcagcattccatttcattaaaatgaaactgatctacttgttggcaatctgtactgggctcccaagcttccatatgtccatcatttaattcgactctgcaggatggaaagtaacattgaataagtcctcatgtaatccttggcacacaccatgaagtttgctcgtgcatttattcaaacatttatttaggttctgagaagttatgtgacttgctcagagtcacacatttattcagtggcagagcctaaatttggtcctaatgtcagtctgctttccacactcccacagaaccttaatgaagtcactcttggaactttctagtacttagtttctctatctgtaaaaagagagagttgaactagatttctaattgggtcttgccatttcaagagttcatttaatcgagtagctagatgtttaggttcatgggtcaaacaccacaatgttaagaccactagaaaatggaaggatatcgatcttccttttactcctccaacattttggaagaaatatatccgcactcttgagattctgcccacagagccaaagctttccagaaagaatgtgctgatgtgcttacttcaactgcgaaagcacacatctcattctgccccttcccagagcttttgcataggctcattccccggacagagcctctggggagatctctgcatggatgcagaacataaacatccagcccttcatgaacagtgttttgtttttctccaggccatcgtcctgctttccggcactaaacagcagagatgtatctgcatcaaaagactactgtctaattaaaagaaagttttaagaactatgagtcctggtgggatttctcacgaaagtgttgagcatccccaagctgaaagaacacactgagtttagaaggtagcgttgcatggcagcgtttcaagtgcatatggcctgttttatctttctccatctacctggcacggtgaagagtcctctcctgcggagatgcacacccagccgtcgagagctccgcagagcgctggaatgaggcatgcgctggcacgcgctggatggcagttgcttttcttctactgtgattcattatgcagccaggctatgctctaataagcactcgtcaggttccatcccacaggttgttgttgcatctcgaggatggagctgggattcctgcacatatgggccccagcagcatcccaagtgaaatgtgttacccaactagacatcattctcatttaacatgaactcttccatttaaaggtaaaagcagaataaatcttccctgactttggttaggcaacttagaccattcccctgactaacctacagctatgttgtgggctaaatctgcatggaccgatggaagaactaacagcaaataaaatctgaaatggagagcatgtcttagaatttggaataaaaataaatgtgaagaaactaaactgctaacagaacaggtgtgcacacagttagaatttctaaagcttttgcataaagtagtagtgagagctgtatgctccctttcaaagcaggaaatgtgagttcccaggtttcaaagggtcgaaacctcttttttgcttgccaaaactccagaattctatgccttacagagttaaagaacccctggtcagaggcttaattttatcaaatttttctaaacatgcatgtctgtcaagaatcttaaatctcctacttaaaaatcattcccactactataattagaagaagataataattattggtttgggatttttttaaacataatagtgaccacagtataactaaattgtttcccctgttgggtgggcagatagtgccttttccttctgtgcgtgtcttttcttctcatttttccagcaaaatctctaccttcccagtttctcatgattcctagtgtccactgctaagactcctggagtctaacactaaattctgtgattcatctggaacacggtaagtcgccttaattatgtacaacatgaaactaaaataaaatactaccatgcaatatatttaataggatttgatcttctcttcctttatttttaatgcaagccaaatgaaaccaaaaaaaaaaatacttcaggaaaagaagaagcctaatgagcctgctttttactttgatgtggtcttcaactgaccttttactgtagatatgtggtccttaattggaggagagaaaaaatattcccaagagccttctcagttccccaaaaaagattccaagcaacatgttctcaactccggaactcagaggccacctactagttggagcaaagaggaagcaaaagtccataccacccattacccccacctctacccactgtcctctggtccttatcccatgatggtgctgctgcccacagggtcacccaaggtaaaggctttcaggagagctttgattcctctctttcccttacctcctacaaccaaaggtccctgggtctctattaaagcatttctaaacaccattctttcctctccctttccctcccctcctcaagtcatacccttctctcaggtcttctgtgcatctcagctggatttccaaccagctcccaatgggacttcttgtcctgcctcccaagtgtctccagagtgctggttctaaactacaaatgggatcacaccagttcctgctcagaaaacatgaattggtcctcattgccaaagaaggttcagaatatcaagcatggctaaaaggaccaatgtgatctggccccagcccactttttaatttcacctccactcaattaatggtagcattcagtggaatttgatgaataaacagatttgggtcaagaaaaaaagagtgtaagattgtggcaatcatgacacccaacactacaaactgcataatctcctaagggttgtgccaagggcttcatgtgcattatctcaatcttctcaacaaggcaggtcttattaggtcccccacttgtcaatctgaaaacaggctgcacagctcatgaagtgacaaaggatgaagctgaatccaagtggaaatggcaatgtccacatccttatgtatataccacactgcattccacacactgtcaacatagggagcctgggtgacctggagtatagcggtgtggatcaaaattttgttgcaaatacccaccaggtactgatcatgatactcacttcagccaaagcccctaaaatgtgcaaaagagagccccttattgaagctaagagctcagctttcagagggttcagaagacatcaggagttctgagttccagagagagtagaaaaagccaggcacatcccatgctcataatctaaaaacacaccggcttcagttacctttcccaatcatccctgggtatatgcagagggaaaaaggatactgaaggatcccaactcccagtaaccccttttgtggagtccactgctcatcaagcaccattctaatccctgctggcttgtggtgtggaacaatctatgaaaatgagaatttacaaagcagtagacctcaggacctttgctcatgctgttctctttttctagaccaaccctaactgtccacaaccctcactatttgtcctaattaatgactataccatccttctatatcaagtgggaacatcatttcttcagggacaccctccctgagtatatcagatacaccattagatgctcccagcatgttcttcatcacagcacccaatgccattataatttttacctttgcttttgtagttacttaatgtatctctctccatctcggttacaagcttcatcatagcagaaactgtgtctattgctcagtacagttcctggcacagagtaaatgaccaatcagtccttgaacaaatgaatgaacaagcaataattttagccttcttaacagttagatttgtcattataaattagtaagttcagcatctggttttggcaccagtgtcttgtgaacttggtcagggaagcagtctccttgaagctgaccactcagccagccctgaatgaatgagtctggcacctgtgaagataaggaatagatatctctgaatagatattggtgaccgaacacagcccagcttgggcatccaggtgattttttttctctaatatttctctctcatcccttgcacccagaaaactgtgtccaggagtggtcactgcattacttatagacattactaggcacataaattttggtttgatagctcctgtttcacgcacactcactctctaaaatgaaacaacaaatgcaaggtggcacggagggctgggaaacaacaaatgccatagggaaagcaacaaaaatctaactcaaacaaacgctttccacttagagatgataaatacaacatgccatggcagcatacactgtcagcaggctgcccctttaaaaatgtaaccatcaatctgttgttaagcccacaaccagttgcaatattaatcatacttttctggcaaaagaatccatttcccaataaagtttgagtggcagagaaaaggcagagccaacaatcaggaaataaactctgcttccaaatgatctaaggaagctgctcttcttgccggctgctctctcaccatcctgctgctagcaccagacacacataaatacacatgccactctgcttcccccacatcatatttccatcattgcagagtgctctacagttctgttctagacccatttttcactttgtgccatttttgtatactttgaacccagatattccctggaaattaagagtcactttttaagcacgaccaccacctctatttagttgctcactcataacctttctttcctttttcttttttctctctccctttctctctctctctctccctccccccccccagccccctctctccctctctatttctctctcccccctgtcctctaccattaacctggaaccaattatgataagcaccatttctgttcttctgcctcaccttcagtcaactctcaggatgctacacccacgttgcaggctgtaggaaaaattcccactttgatccattgttattttttctttaagtagttactcatgaatattttccttcaatacaaatgttaggatgtcttcaaccaaatccctctggaaatgctgtgatattattgcacctatgttaaatatataggctaatttgtaatgaataccatatctacaacactaagtcttccttcctatccataaacatggtatatctctctgccttctttcataccctttagagtttctccaggcaaactgcatacaattttggttaggttaaatcctagatgtattacagtggttgctattgtgaataaacatcttctattatatattcttaatttattattgtggtacaaaagaaagttattaattttcatatgtttatattatccaacaaatttgttgaaccctctactgctaagggttggtcggttaattatttttttctctaagtaaatgatgttatacgcaaataaaccatttttcttttcccttccaatccttttaactttctatctgctttaatgcattagccagaagctttagtttagagtagtagcaatcatcatgtgtattcctatttctttctaaccttaaaagaaaatgcttctaaaatttattaactaaccataatgtttgcagtaggctttcggagaaaagcctttattagattgagaacatttccttccataatagattatattattgttctcaattatttgctgcctctctctaccaggcctacctccatggggcccctcacattgggcaaagtatggagccactacactgacatcagacttggccatgtgacttgctttgaccaatgaactatgaaaggaggtgacatatgtcaagtccaagctgacacttggagccattacatggtgcttctattgatttttcctgtctgctactgtaccaccacatcccaggcaggggctgctcctccagcctggctcctgcagtgacgactacagagagcagaaacacagccaacctacaaccaacatgcaacatgtacaggaaatcaacctttgttatcataagccactgacattttggagttactgctacagcataatgtagcaaaagctgactgatatacaacctatttttatttttctctgggcttttgtcataatagctgcctttactacacccattgagatcactgtatggttattctccttttgtctgttaatgtaatgatttcagaggttaaatttgtagcagacattagctgtccatcaaaaatactagtgctcttcctcccacagtgtggtattttcactgggaaatggctgcccagcctgtagctacactctccagctcttcttgcatgtagaggtggccatgcaactagttaccaccaacagggcatgagcagaagtgacatgtcacatgcaggtccagagctcttacaaagcagttagagattctcacattctttatttttctgctggctggaaatgcaggacatggggccttagtgagaagtcgaaccacaagatggagggagcctgggtccttcagtcatcacatggatcacctgccaaccacggcaccattccatgagcaagaaataaacctgttgtatacaggtgcttatttgttagagcaaccagtgttaccctaatacaccatccttgcacttcagggataaatccagtgatatatgattttttaatacgatgttagatttagaatgttatcattttatttaacttttagctgaagctggcttgtcatttgtcttctttggtactatcctcattcagttttgatactgaggatataaatttggtattacacttcagaaaataacaagagcagctttctcctttttataaatctctggagcaacttgaaccaggcagggattatctacttatataaaactgcatggccctaatgattttgggaggaggagaaagtttttgccatcatttccatttcttcagcagtgattgttctagtcaagttttccatttatcaattggccaacattggaatttcatattttttctacaaatctattcatttcataagagttttcacatttcacatttcacagctatacatttgtttatatacagttgctgaaccaaatctcttatgatatctaaattgcttctatagctatgattatttcatatgcaccttctctctttttattccttgatcagtctctctagaggcaaatccatcttcctaattttttcaaagaacatttggttattctaatcattattatttttccatcccccttttattgatttttactctaccttattattttaatccttcattgactcagagaatatggtctgaatgatatcagttcttagtccaagactgactttctgacctagaatataatccatttttgtgaaaataccatgtgtgccccaaaataacatgcatttagtgttttctgagtgtgggattgttaattgtgtttttcaaatccttctttgtcttttttcccagtttgttctgtttccaagaaaattatattcaaatctccatctacaatggagattatctatttaccactataattcctccaattattactttatatagtttgaggctatgttgttggttatgtttttgtcatcactattatatcttcctggaatattgtggtattgtggcattcccagaaaaaaccatttttcatcttttttgatgttcaccttaaattctacttcatctggtattgaaactgctagcctggtgttattgtggttattttcctagaatgccattttatccctttattttcaacctgtgtctttgtttatgtgactgtcttaaaatcacatattgcctgatcttttctgtaacgtaatctaagagtacgtgcatcttaatcagtgagattaaccatttattctgtaaccactgatactgcaggtttgatttcctcaccctattttgtgttttctatttactatgctttttttattttctgatctctcactgaatatattattttcttagttttagcttaacaaagtatatttttatgatttccatggttgcccttagcttaagtaaggcctatatttatatttgtttattcctttaatatctaaagactattcatgactatatcctccccacagcaagacacaacccttggactgctttcctctacctgtgatctttcacacacactcacacacacaaacttcatttctcatgttagcattgtctggaaatttagttccaggttggttatgggtcactccctccccctgttttttcagacatctccagaaccctgagcagaggaagagaccaggagaccatgctttgtttaccacattgattcaaaccagaatttaaaaccagcccaattgtgccatgaaactaatgcttatgggtttttttgaataaacatagaaattgacccccccaagtcttgaaattaacaaagttgcagttgtcttatctgagttcctctctcaggaaacaactatcaggcctcccagatagtatcaaagagctgaaactcatcagataacacctggacaatgagatgccagacccctcactcatcatgatggcctaaccgaccacctgcttcctgctgacccactcttcttcttcacccttccctaattcgtatttttccccatatagtcagatttctttcctgctatataaacccctaattttagtcggtcagggagatggatttgagactgatctcccatcttctcagctgcagcgcccgaataaagccctcttccctggcaatactcattgtatcactggtgggctgtctgtgcagcgaacagcaggacctagactgaacccctggtgtttcagtaacaaattatccttctcatttcttattattttttgtttattgctcattgtgagttatttagaatactgattctatgaatgctattattttgaatgcttttttgaggtataatttatataccataagattcacccacttcaaatgtatatatatatatatatatatatatatatatatatatatatatatatatacattttttgagacagagtctcgctctgtggcccaggctgtagtgcagtgtcacgatcttggctcactgcaacctctgcctcctgggttcaagcacttctcctgcctcagcctcccaagtagctgggattacagtcacgcaacacctgcctggctcatttttgtattttaatagggacggggtttcaccatgttcggcaggctggtctcaaactcctgacctcaagtgatctgcccaccttggcctcccaaagtgatgagattacaggcatgagccaccgcacccagccttaaatgtataatttaatgattattatttacggagttgtacaacaatcacaccatcaccacaatacagtttttagaatatctccatcactccaaaaagatccttcatgcctgttcacagtcatccctgttcacagccatccctgttcccacccctaccccaggcaatcagtaatctaccttctgtttctatggattcaccttttctggaaatgacctatacatggaaatatccaagatgtggtcttttctgacttgtttcacttagcatgatgtttctgaggttcatacatgtggctgcatgtgtcaccatccatttcatttccttgctgaatcgtattgcattggatggatgtgccatgttttgcttatccatttgccagctgatggatatttggactgtttccactgttgtgtacctgtgtcttcctgtggacgtaggttttcattactcttgggtagatgcctaggagtaaaactgttgagtaatatggtaaatttatatttaactcttctaagtgactgccgaactgtttttccaaagtggccatgccattgtacatcctcaccagccctgtgtgagggttccactttctccacatctttgctgtattagtccattttcacattgctatgaagacatacctgagatggggtaatttataaaggaaagaggtttaattgactcacaattctgcatggctgggaagggctcaggaaacttacaatcatggcagaaggcaaaggagaagcaagaaccttcttcatatgatggtaggagacagagcaagcaatggggaaactgccaaacacttttaaagcatcagatctcatgagaactcactcactatcatgagaacagcatgggggaaaccgcccccatgatccaatcacctgccaccaggtccctccctcaacatgtgcggattacaattccaaatgagatttggaggggacacagagccaaaccatatcatttgccaacacatgcttttaatcatcgtttgttattgttcttcttgttgttacatccattctagtgggtgcacttactatatttataatcagaaaaaaataagcatgtagataagtatatgaaatttatgtatataccatatcttaagggagaaaaaagaacaaaaatatcagaaggaaatacaacaaaatattaaatatggctgtctctagatgacaggattatgggtttttcttctttctacctttctgtatttttctctttgataagcaacaggtatttgcttttataaacaaattcattttaataaagtaataacataccatgaggtgttttacagctagtataatctaactttaactaccttaacatttcccagtagtgatgattagataccaaagcttcccttctgctaaagatcatacatacattgttgaattactgaagaaattacttgcctccagattgactcgcagggtaactgttggttttattaaactccagagaagaactgcagagcttccagggcccttcctcaaagcagctaggaggcatggatgcacagctgtcaccgcattcctctcacagtgcttcctgggccagcatcaaggctattcagaaacatctcattcttttacaaccatcctttgctcctacaccaaactctacaaggtgtatggcattcaagtagttttgtgtttggctagtgatgacaaagccaccccatcacaaaaaactgtttatatgctactctattagcatataatctgggaatcttgccgaagcacattcatccaacaagtattatctgagccccaactatgtgaaaagcattgtattagtctgttctcagctcctaataaagacatacccgagactgggaaatttataaagaggtttaattgactcacagttccacatggcttgggaggcctcacaatcatggcagaaggtgaatgaggagcagtcacatcttacatgccagcaggcaagatagagcaggtgcaggggaactccccttttataaaaccatcagttctcatgagacttatcgactatcacaagaacagcacgcgaaaaaccctcccccatgattcaattaccttccaccaggtccttccccgacatgtgagaattacaggagctacaattcaagatgagatttgggtgggaatacagccaaaccatatcaggcatcttgctgtgtccccttaagcttacaatctaagaacaaacactctacccaaagtacagagcgctaaggatcctaagggacaaacacacagaagggcttgtaggagtttggaaaagagttgtcttccccacccccccacaactgaaagaggaaagacatttcaaggaaacagtcacttgccagttttgggtatcattgaacatggaaccagaggtccaggaattacacgatggcccaagacaagcatctaaagggcaagaccaaaggaagagcttcccttccctgcacccattttccctctcaaatgatctttccctgatctttattctctgtcaccaccaaacttcttgcctctgtctagacaggcatacaagggccaaccaacccgctgtgaataggtgcctcaggcaactgaagtccaaatagaatgaggcaagggcgccctcactcaactcatccaaaacgagaaaaaactaagaagtcccaaccagagtcatgtttcttctacaccatgacactgcatgtgtaagcccaccctacatccttttaagaatgcaacattttacaaaagaataacttaactgcacatcatatgccaccgttttatgctaaagatcacacgtactgtgttgaattacttcagaaatgactttaacatcgacagccaaagcaaaacctttaactagaggggactgggtattttggcctgatgaataatttgcactcagtaatagggagtcatccaagccaccaagcgtgaattactaattttcaaaagaccaaaaactaacaaagtacattcaaccttaaaaccattttgaacataatcttcctttgaggattcaaaaatgcctagaaacactttaaatctgtgaataaggaccacgactctgtgttgtcatatccatacaaagttattgaataaaacctagcaggcttagagcttactaatcctactgttataaccgggggctgggagggaagaattgctcttctaatagtaaatgtaggtaaatgccagcagaactgggtataagagatgtgcctattaaggaatgtcactggttttattttaatttattctgggtttattggatacagcaaaattcaccctttatagatgtacagttctatgaatcttgacaaacatatacaattgtgtgggcaccaccataatcaagatataaaatgttcccatcactttcttaaattcatgcccctttgcagggaaatgcccctccccatttccccagtccctggcaaccatgaatctaatttctgtccatacagttttgtcttttccagaattatgaatctaatttctgtctctatagttttttcttttccagaatgtcacagaaatggaatcatacagtctgtagcttttgactctggcttctttcacttaatcttttaagagctatccatgtcattgcattgattttgtttgttaaccaatattgaaccgagacttcaaaatggtgctggtggcctcacacccaccaggttcttcgtcactgttcacactgtccgtcctttttttttttttttttttttttttctccgaaacagggtcgcccaggctgaatgcagtggtgtgctcttggctcactgcaacctccacctctcagattcaagtgatcctcccacatcagcctctcgagaggctgggattacaggcatgtgccaccatgcccagctaatgtttgcatttttagaagagagagcctttcaccatgttggccaggctggtctcaaactcctgacctcaagtgatctgcctgcctcggcctcccaaagtgctgggtttacaggtgtgagccactgcaccttgcccacattgttcttttcaggggcctctgagccactcaataccttcttcatatattaaaggagggacgaatcttcatctttcaaaagggagggcgatggttttaaaagcaaagctctaacctatgagcttttactccaggacacaaacactggcctatggagctctgtggcccaagcacagggcagggtactcagtgggggcacaacacagaggacactgaaggctgggaaggggaagaatggatgggagcgagattcattaaaggttacaaaattacagctagataagaggagtaagttctactccataccactgtaagatggctgtacttaactaaaatattctagtttcgaagagttagaaggaggatacggaacatttccaacacaaataaatgatcaatgttgagacgatggatatgctaattacctggatccaaccactacacattatactgaaacatcactatgtgctccataaatatgtacagttattatgtgccaattaaaaaaatttaaacctgttggttcaacttgactgaactgcaatctgatcagtagtcaacatgaataataccatcttagttcaagagtaaaacaatctcactgagaaaatttctcagaaaaagactcccaaaatgttatattgtgttaggttttgttttgctttggggtgtgtgtgtgtgtgtgtgtgtgtgtgtgtgtgtgtgtgtgtgtgttgaaaactggctctgaaagcatttctaaaagtggagtttccaacatcatcgtgaatccactcctgcacctcctcattgtacaaatatttactgagtgccctgtgtggctacaccaagttcactgctaggaatgattcaacttctaaacaccatcaggaaagtacagactctgggttgagatggttctgaaatcaaattcccacttttggccctttaactctgactctactgccctagagattccccagcagggtcacccaaacagagcttgatgacccaggtgctcaaaccctctgcccaacccatcctccagcacactctgccgggcccatcttttgtggtctgcacaccttgcttgttaccagtggatctgcgaaactttcagaacatccatcctggaaaaatgctcacctctgaataataatttaagtctcgaactgtcatcatccagggaagaacttctcactctgaatctgtcgtgattctagagcattcctagaatctagaggttctagattctagatcctgactcctatgcaagtagctcggcaaggagaggggagcaatggctggagaaagtgataaattctctaaatctggtttttctcactcataaaatagagttattaatccctccctgctgcgaggataaaataatggataataataatagcagctgttattaattgaaagcttatttgagggccaaataccacagaatatgcattacttatttattgattttaatccatgcacccaatcttatgagtaagactattattatccccaactaataaatgaggaattgaggctcagagatactaagcacttgctcaaaaccaccagctagtacatgcttcactgagggtgtgaactcttcatcgttatatttaacctcattcaacttctggcaatcaatcccaaagaaataataataagtcactcatacacacagaggcgcctcatggtttgagaagagaaaatcagaaaataattaaacatccaacaatgaggcattgctaatataaactgcctccatgttggtcaggctggtttcaaatcatgactgcaaagaatagtctgtgaagaccagctgaagacatgtgttcacctcccacttcttcccaaaactcactgatatcccagtaaataactacaagtgagacaatatcataaaatcactgtgaactgataaaacagaagccaggtgaggtggtgctggtagcagaaccagggcaaatggagaaggagagggaggtggaatggtgaggagaaagaagctgtttcccatcatggaagcaccagcatgggtggatacagataccaggagttggaggaagggcaccaatggtgaaggctgtctgcaggaagagtccatgggctggcctcccccagtctactcaacaatcacctctcacctcttcccccaagagcagcaaatgaattttcccaggctgaaacaggaaatataaccactaaggatccttaacaatcttccaagaaggtgcttaaatttccagagtggggattatcaccccaaaatatgttcctctttggcttagcatgaggagcagcacaacttgcctgcttttgttccacaaatgtccaagtgaaatccgccaatcaactcacctgcccgtggacaaacaaaactactcagcaatctgtgccaccacctagttctacattcctaaaatgaataaacaatccaaatcattaatgctggtggaggcaaacaataccaaagaaagaagtaagctgaacccataaaactgactccaggaaaaatagagaatccagacacaaacaagaactttcacagaacccttaattaatatcttccaagatactgaaggagattttatacacatagaacaagaacaggtgactatttttttttttttttgagatggagtcttgttctgtcgcccaggctggagtgcagtggcgccatctcagctcactgcaagctccgcctcccgggttcatgccattctcctgcctcagcctcctgagtagttgggactacaggcgcccgccaccacgcctggctaatttttttgtatttttagtagagacagggtttcaccgttttagccaggatggtcttgatattctgacctcgtgatccacccgccttggcctcccaaagtgccgggattccagtcgtgagccaccgcgcccagccacaggtgactatttttgaaaagcaattaaaactcagaagtaacaaatttacagaaattaagaacatgcctgctaaaatgaacgccaaaggaaaaaatatcaatagaaaagctgaaataaaaaattaaagaaatttcctagaatatagagcgaggagaaatatttagaaaacatagacaaaataacagacacatgaaagaccataccatgaaacaaatatccatctactagatgctcctagagagatcatagacaaaataaacaggaggaaataattaccaaaaatatatatatacttcacagaaatgaagaaagaaagaaaatgcaaagtgtccatcaagtgccgaacaggataaatgaaaaataccttttaaaaaatcctggctgggcacagtggctcacgcctgtaatcccagaactttgggaggccgaggcgggcagatcacttgaggtcaggagttcaagaccaacctggccaacatggtgaagccccatctctactaaaaatacaaaaataagtagccgatgtggtggcaggcacctgtagtcccagctactggggaggctgagacaggagaatcgcttgaacctgaaaagcggaggttgcagtgagccaagatggcgccactgcactccagcctgggcgacggagattccatctcaaaaaaaaaacaaaccctgaaatcttccaatgtatgtgtgttgagagaagtggcgtgcagacaaaacaggtaatccatgaaggaatggggattttaagtactgagctaattagcaatactgaatgttagaagacgactggatgtactttgaaatgtcaaggagaaaattattttgactctagctttctagagtctctctctctctctctctgtatttctctctctctctctcccccctctctttctctctctctctctctctatttctctctctctctctcccccctctctttctctctctctctctctcacacacacatacacacaaacacacacacatacagaatgtgaggatgaaaaagagattttttcagcctttaagaacaaaaagttttccacatacctattattttataaaatattaattaggaatagactgagacaaaatgaaaaggaatacaagaataaaagaaggttggggattctagaaagagaagaattccaggaccgcaagaagagcagccccaagatgatgatgagctcatggtcccaggaggaaggtaggagagcacttcacagcgtgcaattgaacaacggtgagatattcatgattcggtgaagaagacatccgcttcctccactcacaagaaaagcaaatgacaattagaatataagaagctgtacaataaggtcacaggccagcaaaatcaaacataacatgccctgagtctagcaactgatggagtgatcaagaaagcaaattcatctcatcacagttctgggatggggtacggttctcactgcagagacattcatccctgtcttgcctgggttttctcaaaaaacaaagcatacaacaaggacacatgggaaagtggtttatttggggaagtgattccaagtgacagtatggcaaactgggaagagtggaacagcaaaggagagaaaaatcaatccaggagtgtagcacacagtggatccccacaggggacaaacgagactccatcccactctgagaattatctgcctgggagaaggaagatgagaatgtgtactcatcggcttccatcccccattgaccaagggctgccccatgggtctggcatttccagatgtccattacatcagaatgtctgtgcaggaggcttcccaaatgccagatacagaaaagtcccaggatataaagtgagaaatatgcattgtagtatttagaactgtattttccacatacataatattttgtaatagtaactgtgttaaggagagacacaaatactatgtagacattagcactgcttgccaaatgtttttggctctcagcttcccaaacatacgatggaatcacactctttggcccctatgtggttgagtgcaaccatgtgactagttctgcccactaaactgaagtgaaagtgatatctcacttccacgttaaaacatgtgaattttgacgcaagacactccagagttttctttcctccttcttcttcctttccagcaacataacagataacagttgttccatttccatgggttgccaaataaagaggacccacagcagaggcccagttcactgtaatagacatgagactgacgagaaataaaaccttccttgtgtaaaggctctaagatctggggattatttgttactgctgcctaacctagcctatactgactgatacaatgaggcaatgctttataatgttgtttgggaagacaagtttagaaaagttaacacacacacatatacaatgattacactgtacatttaaaaagctaaatatagagaaaaaagggatatcaagtgctaatagtgtatgcccttggttgacagaatcccaaggaaggttcattattagatggtcactttttaaatcttacataacaagcatgtattatttacacaaaaacaaacattaaaagaaaacctcaagtgaggggctgtatcgaggaggagagattggtggacatcccagttatgtcacgtgcttatgaactctaaacttcagtaccttttccaccccataaaatacacaaatctcttttcaggtatcagggcaggtgggtgtcaaatacccaaaactttacttccactttacaatgtgcatatattcaaagtcttccaaacatccaagaaagttttagttgtacgttggactgtttctactcccttcttccaagtctcccaataacttgttcagcttttgcaaataggaattgtttcccaaaagggaaaagaatttgagaaaatccagtgtctagaacttaccaacatgaagccttgtgaatgcacaggtgtatgctcacacgcatgcacacacacaacaggtctgttaagtcctttctgggcccagtcttccaatttcttccacatccctctgatctattttccaagagcagccagagtgatcctcgggaagttaacacttcatgtcaattccctgctccaatgccccactggcttcccattacacttatggaatgaaatcgaaacccctaaccatggccctggagatgcaggtgatctggcccctgtcccactcttcccttgacccagtatgtaccagccatgacgatattcctctcaggtccctgaacacaccaagctactctttccatgtctgggcccctgtgctgaccatttccccttcctggaatgctgttctctggggttcccacaagccttcttccttctcaaccttcaagattcagcctaaattccacttcttcagggaaaccctccccaaaggccaccattaaaaatgagccccatccccgtcattctctcccactatcctgttcctttctttcagacacttcatcacaatcctatttcttctctgtttttttctttctttctttctttttttttttttttttgacggagtcttgccctgtcgctaagcaggagtgcagtggcgcgatctaggctcactgcaacgtccacctcccgggttcacgccattctcctgcctcagcctcccgagtagctggggctacaggcctgcaccatcacgcccagctaatttttgtttttttagtagagacggggtttcaccatgttggccaggatggtctccatctcttgacctcgtgatccacccatctcagcctcccgaagtgctgggattacaggcatgagccaccgcacccggcctctttcttttttttttttttttttttttttcagacggagtttcgctcttgttgcacaggctggagtgtaatagcatgatctcggctcaccgcaacctccacctcccaggttcaagtgattctcctgcctcagcctcctgagtagctgggattacaggcatgtgccactacacccagctaattttgtatttttagcagagatgaggtttctccatgttggtcaggctggtctcaaactcccaacctcaagtatctgcccgcctcagcctcccaaagtgctgggattacaggtgtgagccaccatgcccggcctcttctctttatttatcaccttaggtgtttattgtttggcttccctgttactacgggagctctatagggcctcatctgtctacacatggctgcatctccagcatttagaagagtgtctggcacataatgagtgctaataaatggacgaaggattacagacaggctgtggaaaggggctaacaggggtgtgcacagagtatggaagaagatgaagcaggttaccagggtagatttctaagagaaggggatgcttaagctgaacgttgagggatgatcaggtgttcagggggaaaggcatgagcagcgagggaaacagaggtgtgcaaaggcctccagccaccaaaaagagcaggaccagtgtctggggaggtctttctgcattttggatattgagtgtcatgcccatttgggagccttggagagagcttttatgccagccacctctgccttgggagagacaaagcccatttccatctgggagctgggttggtgcaccccagactctggttcctgagtgccacttgcagggtggcctctcatcaagcagtttcacacccagtgatacctcgtactttcaccctgtcacctgccattagtcatttctcccaccagcactgagaggtaaatcactattattatttttcagttttacagctgagaactaaagagtgtggaggttaagtgactcgtcagagttagtggccagatggggttcagaattcagcacctgtgatcacacccaaggcctagggcccacaacatttgtgtttctggacactcaaaccagaaggccccatgtggctggacatgtctgcatggctccccacccaccttgcaaattttcccagccccccggctatctctcaccctacttttctccttccttgccctctcctctctttcttctctctcatctctctctcccccaccgatctctctccctgactctctcccacctctcttccctttctctctcccttctccctgccctctccctgcttcctctctctgtctctgtttcttcctctctctctctctctgctcttttctccctctccttctctctccaacctctccctcccttttcctctctcttccacacctctctcctccccctctttctctcccccaccctctctctctccctctccctttctctccttctctctttccaccctccctctctctctcttcccctctctccccacctctctcctcccgctttctcccctcccacctgccttctctctccctctctcccttctctttccctctctctccttctctctttccaccctccctctctctctcttcccctctctccccacctctctcctcccgctttctcccctcccacctgcctcctctctccctctctccctctctcccttctctttccctctctctctccccatctctcctctctctccctctcttctctgcctctccctgttcccccttcttctactctatctccccgccttgctccctcactctctctgtctctctgttttccttttctccctctccctcctcttttcctctctctccgaccctatttggctctttagattgaaaacttcccaccacctgacttcagacagggatgggatcatttgccttctcttcttaacagtatcagaacctgtaggctcacaggctcctttcttaggagagcccagcatgtgaggaagggctggtgatcccaagtgagagcatagaaacatccttggggagtcagctttgggaagaggctgctggcaagtaaggcctaatcctcatgcaggagctctgcgccccattcagcagctgggcccctcctcctcctggggctcctgacagagggggttcctccactcctggccggttccccagctcagcaggctcccgccccccatccacagctctgcctgtgtaaggccagaagcccagcatgcctgcctggaatactaaacagggcccttccagatccagatgcactgagaaggccagacaatccctcacctcccccatccccaagggcctggctggagagggctggaatctagtgcattgcagggagcagggaagctcatcacagtcctcatgtggggacagaggaggcccctgatccctctgggatgtgggtggcaggctgccagctgaggaggttggaggccccaggctccccttccagacagcataaatccaatggtgtggggtccagctccctgtggcccagcacacaggcaggattgcaaggatgaaggcccgaggtaagtttggaggagattaaattaaaaagccaaagcttctgagcaccagaaggcctcagcgaccataaatctacttgcagaggagcacacagaacacgaggccaaaccagttttatttaagttgctgatgagcgttggcctctgcaaaggcataattcaaccacacttgggcctggacagtccctgcttccaagcaatgcacagtaagggagccaggaagtggaagtatggaacacttggacagtggcgaggggcctgagctacaggatcagagaaactcatgctcaaatcccatctctgtcatttctgggcagtgtaatctcaggaaggtcgcctaacctccctaaccctctttttccccactcagaaaacgggttaaaccagatggaccttccagagtcattgtgagtacctgccccacaagccccaacaaaatggtggccatcacaacaaagttgatgatgatataggaaagtgaagttaatggccacagaacattaatgagctaacacaaggcactcattctatgccgggcactgtttactctttcagtccttagaatgatactgtgataaaatgccatgatggttcccagttcacagttgcagaagctgaggcacagagatgctgagaaacttgcctaaggtcacatagctggttatggatagtactgggattcaaacctgggcagccaggctcttccacagtgacagacactgcactctcctgactctcagaatttgagagcctaaaggaacacaggaatcattttttccatattcttggaagagggagacacctaagcccagagggcaaaggacacctccagacagtgacaggatagctgaacaccagccacagctccttagaggaaacagcacaggggtctttatgatcttaagtatcttctgtgtggctctgacaaccccaaaacttctcttgttacatgaaaatcagcttacattaatatggatgcaagatgcaagtgcagcacagtgcgcgggctgtacaaagcaagcagggaggcttccgaagatgacccccaggctatgccttggcagtccccttcgccagcttccatcccccgaagccacgtgaggaaggccagaacaccaaggtccctccagaactctgagtagagaaacagagccagccggcccagccatccccagagatggaaggaagctccaaggggactgatgacaagctaaaatttggaactttatcacagactcatggttaccaacatcaaatatttaatttgcagctaagactctttttgcttaaagccatgaagcagcagcacagcatattggctgaatgcacagaccttagagccagacagcctaggttccggtcccagctgaaagaccttggccatgtgactcaacccttctgcctcagtttcctcatctgtaaaatggatataactgaacttcccaggatcattttgtacattaggaatattcatattaacagagtacgtagaatattacccaatcccctaagagtgccaggtaactaagtattcgttaaataagaagcgctccctcataagccagccctctcttcaaaaggtgacaactcttttttttcttttttttttttttgtttgaggtcttccttaggatcttcaaagatttcaccgaagaaccagcatgtgtccctgacctgatggaatgtgtccttaccaggataaaaaatcgatgcaatactgttggaaagtgaccccatggtttgaagcaaaccaaattatacgttaaagcaaaaaattacctccagaataaacgctaagcacagtgactgtctacaaaggccatgttttaagcattcgcactccaggaccctgggcttagtggcacattagacactcaataattgcatatctagcattcagaaacttttaagtggttcttattttgattcctttcccctctctgtagtgggaactgccctcaatcattctgacaggtatttctcttgccgcccacaaattttcagccctgcagtataccacattggtctggactctagcatatgcaggatttatgccaggcttgcaaaagatccctgaatcagccagtccaaaccccctctttgtgccatgtctacctcgggtgatggcagtgtgacagcattctcacctccacccccaagacacacacacacacaccctggatatctcaccataataataatgtattttatatcatgagcaggggaatacgattaaatcttcctcctataccccaggttcagaaaagaataataatgatttcctatattatgtggaatctcatagttcacaaaataatttcagatccaccatctgctttgaatgtcacagcaccctgtgtaataagtaagtcaggaatggtgtcccattagccacagatcaaagaagcatggaccagagtaaggaagcaattttctgaaggacacacagcaaattaggaggaggaatggaccccacacacaagtctgtgtactctgggctaatgctcttcaaggcctttttcctccttgctctgagcttacttcttgcaggtgtcagaaaggtacattgataggacaacttgcttcccccagacagccccacctcttcaaagatatccacaagtttgcccacacaagtattccatccctacctcctaatttccacctttacaaatggcacgtcccagccccacattgcccacagcacctccgggtctctgcttctgtctaaaatcctcatctccattcttgtgcctccaatcctgccagtctttcaggcccatctttaacagctctttatccaggacactctctgatgctgccatcacagcctgcaacagccacaggagaagccacccctctctgtatccctgtaacccttgattcttcctcgcatggtcatcatttctggtcttgggacttctcttctattagcccagtgggtacctggagggcaggaaccagggtacacttgccttgggagctcccacagacctcacatggtacctacatctagtagggactcaatcaatatccatgcattcattgtattaatcttggaaggaagcacaatgtgtattacatagagggaggtttacctgtgcaaggacaacccctttataaattcaagaatatagacacaatgtgtcgggcacagtggctcatgccagtaatcccagcactttgggaagctgaggcaggtggatgacttgagatcaggagctcaagacaagcctggccaaccagggtaaaaccccatctctactaaaaatacaaaaactagctgggcatcatgacacacgcctgtaatccccgctactctggaggctcaggcaggagaattacttgaacccaagaggcaggggttgcagtgagctaagatcgcgccactacactccagcctgggcaacagggtgactctgtctcaatttaaaaaaaagaaagaaagaaaggatatacacacaatgtaaaatcactgcaccgagtcagtataggggctgccttaaactcagggaacagccaaatctgtttatgaattaaaagaacagtcactaaggaggcaagatcaagtatcatcaaaacattaggccttgacatagaacctgaaggattcccccaagccctagggctgtatccagacagaattttcattccataactatcacaaaatgtctctttcatttccagctctgtgttagaggtcagggacataaacggctctcatctccaggccctgccatgatggacctcacagcctaatggggaaaagagacacaaaaccagacaatgacagaacaatataaaagcactgggggacacccagacaggcataatagcgcaaagagggaaggtgcccaggtgggagaacctaggctacgttatgaagatgacatttcccatgcaaatacacataaacgtgtctatcactcttgtgcacatgtgtggggctgtgtgttgggatggcattaatagtagctaaggtgttaaaaaatacaatactaaaattcccaggcaaagcaaaagtttccaccaattatccgaataatttttccaaaagttcagataataggcacgtttaagaaatttctggtacaaagaaacaaacatgtggctaccttttcctttttagcaggatgctttaatgccacataaacacatgctcattaccaagctgaaagctgatttacatagcatcacctctgaagcatacaaagataagaaaattcaagtgctccgaacctcagttttcttaacaataatacggaagtaaaatacagacctcgcaggatttgctggggggagattccatgagatgatgtatgtaaaagactctttgcaatgaaaaccacaatagcaagctcttgatcacttttagctcacacgctgggaatcagcatagtattatgggcaggaacatggactggagtctgtggatgtgggttcaaatcccagctccacccaactgcaatgatctgaggcaacactacctatgtagcctttcttagcctgagtctcctaaactgtacaatgaggattttaatgcgtacctcatagctctaatgattaaatgatgtaatatggtgaaataccacagtacaggtagtaaattctcaatacagcataactagcatcatgttactcttgtcaaatattttgtctaatatttcaagggaaggtcagaagatggagttcacaatctacataatccacagatgctcaggtgttacaagtagtgggagggagacggcacaatatgggacaggctaagagttctgggtctgattattccattcagctgctggcatggggctgactctgggagacagccacccacagtcatgggagtaggggcaattctctgaagagggcaaaaacaatcaagggtgtcagctgcatgtctcagattattgattatcttcatccatttgtgctgctataacagaatgcctgagactggataatttatacacaacagaaattcatttctcacaattctggaggctgggaagtccaagatcaaggttcagcatctggtaaagacctattcatcatagatggcaccatctaggtgtccttacatggcagaagggacagaagggcaaaagggcatggagccctagctaattcccttgagcctttttagaagggcactaatccattcatgggggtagagcttcaccgcctcatatcatgacattgctgatgaagtctaaacatattaatacagggggcatacattcagaccatagcatatgtctcatgtacttacatttgaaataagaccagcttttcactggacatctctctctctctctctgtctctttcactcacacatcacacacacacacacacacacacacacacacacacatacacttcctatgaggagaccccagacatctttttaaatgtgtacaactagttttggaaaataaaatattcagctgacctaatttttacattgggaataggagacataagtgtattttcaataaatccaccaaaatatttattttatttcaacattaagatgtaaaaagtcagagagagagaacagagtatgacagcgtcagtgagccgcccacctccctttggtgctccccaaagcctagcgcctgcagaaagctcctgccaccaccaggggcgacctgcatctccagagtgatggcaatttgtggctgtgggtgcagagcaggctggaagtgacagatggtggagaatcatccctacttccttataccttggtgggcaattatgagtctctcaggaggttccagcaggactgcacgctggtacctatggcaggagcccctggttaaccctctttgtgggcttttcctcacttccttgtctcacaatccctctctccagctgtggtttcttgggatcacctccagaatgaactacttaaacccaaacccttggctcaaggtgtactttgggggatgcaaaactaagacacagagagaaaaatgagaaaataatttagaaagaaagaatgaaggcaagaggagcattataactgatggcaaggaagacctggagggaaagagatgagattaagtaggggaaggaaaagaccagagatgaatgtcaggcttccatgaccaggaagcccctgtttactacctgccaacccaactcgtgccatctgccaaaccacacaccccaaaaacccatgcacctgcccccagatgttctcagatcccccgtccccactggcgttggtgagcactcaccccttgtcacctggtccaccagccaatgcagaggacagagtctagccccatggctccaactccccaacccaacacctccaggtcccaccttcctccaaaatcatgggtggggattttcggtcagacaactggccctgtgaggttagagaccccaagagtgtaagtacaataggaacctacactcttgataaagcccctggctgagacaaatctctttcccaagaacgtggtgttacaagagatgcaagagacaaattttaggaaacttgctgagaggctgagacccttttcagatgacaccaaaagctaactgcagccatgataagggattaccacccttgccataaaaccccactttggaccctctattctttgactttacaatgctttatataaatcctgcatcctcaatgggggcaatatcacccccaagggggcaaaaattgttcttaggatggagagccaaataatctcagatattatcgtggtttgtgaccctccaaagctcaaccctgcacaacaaaatcttatttcatttcatttcatggagaggggagatcagtaataataataataataataataataactaaaaagattccttagggtagtaataatgaaaaaaatctcaaaaaaacactgatataatgtgaaaatcctgttctggattcattttcaactcctcttaggaaataacatctaccgcaataagattttaacttctatctctcatctaatatcctgtggaaaacaaatatcacaaagtaatgcatggagagcagatgctttaaacatcacacgcgcttgccacagtaattgcactttgtaacttttctagcactttcataaattccagaagttatcttaatctccaatgctctgtagtgaggcaacagaagaaagatgatcattacttccaagtaaattctaagacttattaattgaatgactcatgctggatcacagaatgaagctctaaaaatgtcaacatttggagtcttgccctgtcccttcatcacctcgaatgcagctcccagcacacaatagggccttcagcaagattctgatgaacttccttaacttcaccatgttcaaatggaacccatttctgcccccaaacttattctgcttcccgaacccccagtgccaccagctacaacatcaccccctgaggtcccagacaacaatcttggggtatgtgtgatccagtcaatcaacataacaaagcagctaagagtccaggctacacccagcttccaaacccaatattgccacttaccaactatgaccccaggcaagctatttaacccccctgaaaaacagaaataacacctgccttccttgcaaggtaataatatggtttaaatgtggtgagacatattaaaatgcttagcacagtgccaggcacagagttggagctaaatagatggaactttccatgattgctcctgtcattgacattgggaatgcttttgctctgcagacttctaaaacagttgcacagtgtcagtgagaagactaacatggcagacagactgacaaaagtataatcccagctccataattcagtagagcagactcttcgcagaattcatttccctcatctataaaatgtgggcaacataacatctaccttgcaaggttgtggtgagtattaaatagataatgcacacagcagatgcccaacaaagagtgtggtgactgctgtggacttaattacaacctatctcaaattatcctacaattgtttctcacacagaatattgttttcaagtaccgggtcaatctggggtacaaaatatcaaagggacccctagtttccaaggtcctcttaccaagaagaaaagcaggcattgtgaggcaaacttagcccaggcctctgaggtctggaaacacatccagatggacaggggaaggtagagtgtaagcaaggtcatgggtaaagagcgtttaggctaggtctgtagtagaagcatactagaaacgcaaattttcaggccctacctcaaacctactgaatcagtaacaggggtctacaatctgcgtttacaaaccctttaggtgattctgacgcatgctaagtttgcaccattggtctatatatatggactccactgcttccagcttcatctctcccccacttccccagcccccttcatagggaccaatagctttaccgactccatgaagatcagtagttcattctcttctgatactcttttttttttctgagacagagtctcactctgtcacccaggctagagtgccatggcacaatctcagctcactgcaacctccacctcctgggttcgagtgtttctcatgcctcagcctccccagtagctgggtctacaggcacacaccaccatacctggctaatttttgtatttttagtagagacaaagtttcactatgttgcccaggctggctcaaattcctgagctcaggtaatccacacacctcagcctcccaaaatgctaggattaaaggtgtgagccaccgcacccagccttctctgctctttctcatggactcatcacataaaattcttcatgtttgcagcctctaaggaatgccaaagggcaaagtaaaaataaatactaaataagacagcatataatcatggctcatggcaggatttcaattatagttggttcccttctcctttgactcttggtgggagttcttcattcttgggtggttaagcaagtccaccctcagattaatacactcttcggcactccaggtgctagtttccactgtcaaggaatggtgtgcactgaagcccatcattcacaaggatgcaacaggttcagggggtgaggggcaggtgcctggggaggcagccccagacagactgtgcctggacaagccaaggctgccccagaccaaacaaaagatgaggcaacaaccaactgcagcagactggtgcagtaggaacagcatgaaccagaggtcaaagggtctctcctctggacccagacagctacctaacttctgggttcctctgcccaaaccacctgccctctctaagcctcttcagtaaaatcaatgtttagactgagtttcccaggagccctgtagccccatgcttttcagtgcaaatgttcagtaaaataacaaaaagaaagtaaagggttaatgctcctccatccagttttcttccagtttagaaagagacatatgtggccgggtgcagtggctcacacctgtaatgccagcactttgggaggccaaggtgggtggagcacctgaggtcaggagttcgaaccaacctggccaacatggtgaaaccccatctctactaaaaatacaaaaattagctgggcgtgatggcgggcacctgtaatctcagctactcgggaggctgaggcaggagaattgctggaacatgggaggcacaggttgcagtgagccgggatcgcgccattgcactccagcccaggctgacaacagcgagactccatctcaaaaaaagaaaaaaaaaaaaaaaaaaaaggaatgaaggaacaaaggaaagaaggaagggagggagggagggaggggagacagacgtatttgtgggaaagtaaacatttaattaaaattaagtaaaatatttttaactttctttttttttgaaacggagtttcgctcttgttgcctaggctagagtgcaatggcatgatcttcactcaccacaacctccgcctcccaggttcaagccatcctcccacctcagcctcccgagtagctgggaatacaggcatgcaccaccaggcccagctaattttgtatttttagtagagatggggtttctccatgttggtcaggctggtatagaactcccaatctcaggtgatccgcccgcctcggcctcccaaagtgctgggattacaggtgtgagccaccgcacctggccagtatttttaacttcttaaacatttttctaattgtttctacttaaacagatgaaagaatataaactgctttaaagaattttcaagtgaaatgaagatgccagatgacccaaaccctccaaacagagtcaaataaggaagaaaatagtctcggattgatatgcagctggggtgtgtggcagacagctagtcggctgaggatggacatttcatcttcccaactattcaccacctttagaaaagtttgctgaaagaaaaaggcagcaaggaaaagaagaaaaataagcattaacccattcacttgactaatatctcccataaagtaaagtggcaatacaacttgaagagtttcacatcctctggttgaaagaatgaaataaaatacaagacatcaccttccactgggctgagaaaatttagactaagtggtgtaaccgaaaaattaaaaacggcagtcattttacatcaagatcagcctcctggttaatgtctcaataggcagatggagtcagccacgttaacaggcactttgttctcagcttaaaggatcaatatcgcaattacacagtgccagcagaaattaaaacaggtttacacactagggtaatctaaacacaagaagaggaaaatcatcaggaactcggttcctgaacagagtccagaaaaacaatttaaaactcgtaacatagctgtgtgtgtgaagagggatgaggcgaagaaggtgtcaagtttggaaagaaatggcatctaaatctgacatgcttaatatttgcttaggtaatacctttaaaatgtcagagatcattagtgaattaatgttgggttattcttccgtgtagggaatcattcccaaagcacactgacttttggaataactgcaggcagggaaagctgaagaaatgggagtgaaaatgttgcatagtgtatttttcaaagatggttgcaacaatatctcccatctccatttcttctacaaggtgatcttgacactctcccatcaagtggtagagtctctctatccacctgaggatgggtgggtcttccgaccactttgaccagtaggatatggcagaagtcatgtgctggctccaggcatacctcttaactggcctggcatcttctgttttccacctcttggaactctagttttgaggatgttccctctcagaactcagctgccatactgtgagaagctgaagccacatggagaagctacttgtggacaatctggttgatagttccagctgcgtgccaagctgatgcccagtatcaactgccagcccagttgagcctttggaagacgccaatcccaatgctatccttccatattctcatcacagacctcagagaaggaagtgcccagctgagtccagtcaacccacagcaccatgagagataataatacattgttaagtcattatgttttgggcgatttgttatgcagcaatagagaactgaaacatgtgactcgagacagggttgggggcgggggcttgaggacagataagaaatctgcccctcaaaggtcttctgaatcagagttgcccttattttcttataaggacctcttcaaaaataaagcactccaaattccctagcatcgcacagaggcagggttggcgtgggggatagagggaggatgtatttgaagccaataatgtgaaaagcaaaataaacatctcaccacacataccattttaagggtgttaaaatcactgctctgagccacgcaatgggacaatcaaaataaaattttaaggtctgaaatttaaaaaaggcttcgaaaagatgcaaataaccttatcctctttaagtccctagtttaaagtaataagaaatgcattcacccaatgcattgccttcagcactaatctagaatgaagtcacttaaattctaagaccagaccccactaccccataataattggatggctgcatccaaggagttatctgagagctcaagcccttactgagttttcccattttctatttttttttccccgctttccctttctctgctgttttccttgctctccaggacacaataaagcaatggataggcggcaagtgctataatgcagtgattgcagtcatgtgagcaataatatcaggactgtatgggaaagggaccagacttcattataaataggaaaataataaagacagtagactgtggctggatgaacctcccacacatccaagtggatttagggctgagtcctcttgctgattgcttggatggaaactgggagtgcgtgcttttcgaaactctccagatacaaagatcacaaacacctccaagactcaggaaccacaggcacccaccaaaaccgggcctgatctcgactctgagcacttagttgtgagacctgacttcacttccagcctttagtccctcaagatttgatattcacactcagtatacatttttttcattttttacatctaatatttatttagctactcttgtgctaggggctgaggatatggtgacgaacaagtcagacatggtcccttccttcatttgagtgaacattcaagtggaaagacaagcaacaaccaagaaaaaggaaataaagactcaagatattatagacaatgataagccaatatagaaaaatatagggaacatgacagaagtggacaaggaagatcctgctgaaggggtagcatgtaagttaagacccaaagtgaggaaaggagttggagaaacagcactccaagcaaagagctaagtatgtgcaaaggtcctggggccaaaaagaaatttggcatgctctaggaatttttagggggaccagtgtaatagagtggggagagacaggagggagatgagtcaagaacagaggcaaaggtttgacacaaaatggtaaaaagcgttttatctcaggagcaatgggaagttattggagggtatcttaatcctttttgtgttgctgtaaaggaaaatctgagcttataaagaaaaattgtttacttgactcatgattttggatgcctggaaggttcaaaatagggcatctgtatcaggagaaggcctcaggctgcttccactcatgatggaaggtgaaggggagctggcatatgcagagatcacacagcaagaaagaaagcaagagagaaagtgaggaaatgccaggttctttttaatacccagagggaactaatagagtgacagcttctcaccctggagagaggcaattaatccattcatgagggatcacccataagttcccgatgacccaacacctcagaataggccctcctccaacactgtggatcaaatttccacatgggatttggtagagacaaattaaccatatccaaatgataggagagggttttaaggaggaaagtgactaaatctggctgatagttttaaacatcactccagagttaacagaggttacctttggggagaacagtaacagggaggggacagaggggggcttcctgggtaaagacgctatcctatttcttcatcagggcactgtgtacatgactggtttcagtttgttgacagtctgtcaagctgtatatttaagatatatgcccttttctgtatatatggttttttcagtaaaacgtttattaaaaatcactctggcttctcccaggaagtggggaggtagacagcttagttagaaaaccagtgtaggcactcggggtgagaagtgagggtggtttgagtggggctgggagcagaggaggagaaggcaaatggagaaagtcaagagacacctgtattttcatgtagttctgccttcacatgcagtgagcctcttttctgacctccactcttatgctagctccagggactcaagtaccatctcagtgacgaggcagcaccaactcgaatgaggtccaatgtgggtggggggagagaaactcagacaacaacaaatccatccaatatttatcatgcatctactacatctggaaatggctggaaaagaagaaaccagaggctaggaagggaaaggaaacatgagttatcgtgtggatagggtgatccaagggtaggggatagacaagcagcccaaggtgcaggttggcaggcacctgagaccctccgtgtagtctgggtacaagggggtccccacacaagctataggagtaagtctctgttcatactactgtgtctgatcactcctcaagaatggtcacataggctgggcacagtggctcacgcctgtaatccaagcactttgggaggccaaggagggcggatcacgaggtcaggagtttgagaccagcctggccaacaaagtgaaaccccgtctctgctaaaaaaaaaaatacaaaaattagccgggcgtggtggcacatgcctgtaatcctagctactcaggaggctgaggcaggagaacctcttgaacctgggaggtggaggttgcagtgagctgagatcgtgccactgcactctagcctgggggacagagcgagactccgtctcaggaaaaaaaaaaaaaaaaaaaaaaagaatggttacataatgggacttgtatatccactttagatcttctctaaggctctgggttctaggttctgttttaaagaacagaactgtttaaaggaaaaaaatatgatctggtgagaagtgaggtctcagaggcagagagctggagtcctcatttggaaaggaagaaaaaaaatggatccttaaagaaacttgtataatgggtgactcaaaattaatcaccttttgggaaacaggccatgttaattattcctggagtgggcaagtcagcttttgaaatgagctgccagtcatcagactttcatgtttagcagagccaaccacagcttttgtttaaaaattgaaagcccattcggatgtcatggtttagtgccaaggagggcatcatctcatcactaggcaggacatttaacatttccccagaagaaggcactcttctcacctcccgcccactccaggggagaattctccaatccacttgggtgggacatatcctcatatgtatacagcaatgcaacaaagaaacccaaattacctctattggtttagcaggaactagagccacacttagcagggtgctatccgaggaacagtgcattctattggcttatcaattacgtaacatctaacagctccttctcatcttttcagatttttatttgattggatagaaggcaaagtagttcaataaacacacacccaccctaaaagtcaaactcataaatctatccaactctaaagggtgccaaggactattgatgagggactgcattgtagaaatgggatcctctttgcttgtaaacaatggcatgggaaatttccatatgggataatgagacgtacctgctttcaaaaccagaggttgttcatttcattccattctattctgttgcatgttacgtaatataaagggcatctaagggtcaggaaactagatgaggaaataatgaaatttgagactatgtggaaagaaaggatggagtgaaaagaaaggaaggtaggaaaatggaagattgctttcaaagtaagatctttgtgcatttggaatgaaaataaaatcaatagggagtgcaaggaagttcctctggtttgaatgaatctgcccggcttcaaaaagttttacttcatgattgaatcgaaactcaaaagttgaacaaggaaattcaagcacgatttttattaaccccatatggcccagggagacttttaaaacagagacacttgctgctttctccagccctggatgttggggttttgcatgtaactcattcgtgatataaacgtatctcgtggggttttgcatgtaactcattcatgatataaacgtatctcctggggttttgcgtgtaactcattcatgatataaacgtatctcctggggttttgcatgtaactcattcatgatataaacgtgtctcctggggttttgcatgtaactcattcatgatataaacgtatctcctggggttttgcatgtaactcattcatgatataaacgtatctcctggggttttgcatgtaactcattcatgatataaacgtacctcctggggttttgcatgtaactcattcatgatataaacgtgtctccttcttttaattaactacttctctcatcaagggaaggggaaataatcccaatctaacaactcatccatgatgaactttgctgtctttcttctgtttccaaatgaatttggcttattaaaaaagtaatgagctattaattaactctacactcatacaaagctgtttaattctcaatctaattagccgcaatctgatgaaggattttaataattattttaactttgctaacagaaacatcttttcacttttcataagttatttatagaacagttcacattggatcctgcttggtttttaatttgatgacatttttattagatcctctactcttctaccatctctgtgtgacagagtttagaactgtcatcattgaaaagcccagaaatagtatcctgggtcacctacatggccaagacagtgcacccttctgtctttgaaaaaatctccaatggatgaggtatgggaggaccagaagccctgtccttctgatgtccttcttaaacaagaggcaaaactcaagtacgaaccaaggatagacttaaaactcccagtggaaagatcaaaggcttggggttactgctgaggctggatttggcagggagggaaggaaacatgccaccacacctataggaatgactttttcataactgatgcaaacaagggtattcccgaatctcttgtttaagaaacaacaggcagtgagttacatttcatttgtgtatagaatttctactggagccactacagtacaatgtgaaaagatcaaatgatattttatgtgcatggcctttatgatatgcatttctgcagacattagaaatttctatgtaaattacatattaatgtaaaggcctatgtacatcaaactatggattcaataaacacacttacacacatacacaaacttcacaaaaaataaaatgtgtttattcagaggcatttttattcttccctaggtattataagggaatagattatgttcagtgagccactctgcttctctaagatctaacatgagataagcctatttcacagttagtctcgccactttcctctaacacaggagggaacatgggagactgtttcctatgccacccccaagacttagtacatgaagaggctatatgtgtaatggtttagaaaacgaattctgaagccaactgcctgcgtacaaatctcagctccgcacttacttagctgtgtgcctttgggcaagtcaataacctttttgtaccccagttttctcatctaaaaaaaaatgggaatgaaatagtacctacctcacactcttgctaagaagattaaatgaattaatatatctaaagtccctggaataatgcagcacctactacatagtcggtaacttctaaataaaataaactctagctgggtacttctccctataaaatacatagagtttgagacactgcaaggccattatcctactaataacaatattttttaaaagctagaagctcatattatagagaacatttggccactgtagcatttcttataggcatttttttctgttgcttttttgagaaaacatagatatggtgctaaattaaatggcttacgttctgagccctcaccagtgttattatttattaaatgtcattattcattaaaatcctaataattcactaggtttttaaaaaattaaacacaggaccttgaaaaaattaaatttaaataagtaagttgaatattaatggagtgggaagcctaagggagtatgttctgaaaactagttatttatttattttaccaaaaaaagagctgtagttataaatagtattaataataacagtaataatagccagcatttattaagcattatccacattccaggcagtgtgctcagtgggttacatgcgccatttcattgcatatatagatgtgtgggaaggcattcatactggtggtcctctcctctctggattagctctctctcttatacttctttccccccaattacttatcccatgtagccagtactctgagaaggacatggcctcctccttcttgggaaaagatgcccaattccaatattcctgccctagaaggccccacaggagctgagaaggtgcctggaagacagcaggtaccaagcagatggatgaagcctggtttagaccttcagctggggagcaaggtcttcccatgagcctgtgtgtccagcatagttcatcaaggtcagagaacacacaggcatttaaatccaaagcccatcaagaaacgttctctgggagttctccactttgttcaagccccccagtcaaaaattctggtttcctttaatgataccccatcgatgataccacagagccatggttctcaaccaggggttattctgtccctcagtggacccttggcaatgtctggagacattttgggttgtcacagctgaggaagagaaaagtattaccagcatctagtgtatagagaccaggaatgctgctaaacatcccacagtacacagaacagcgcccacaacaaaaaactgccaaccaaaatgtcaattcaattaccaatttcagccaagaatatgaaacactgccgtggagtgacttagaaacagcacagcctttgggtccagacaccccgtccagggctctattacaagcagttgaatagccctgggcaactaacaatcaatcagtgagctctgcttttctcatctgcaaaccaggagcctgaggaagtcctctgaaaatccccttgcacagcactgcgaactcagcaaactgcagcaattatcaccatgactttgtcctcaaataaacctcgcaagccactgtggaatctccatttttctgtaggtgccaactctgggtactcactgaaaaccttacctttgggtaatgagttccaaaagacaaatctaattgatccttgcaggggactgaactcacaaccttggcctcattagcaccacatacgaatctactgagcaggacaaatgaagacacccaagaatcactttttcatgtaataacattcggcagctcactcaacacaatcaaagcacgtcaaacacaggatcagccctgcagaatcatgagtctcaaatgccgcatggaaccactgactctcagataccactgactctcagataccaccactggaaaagcagccatcacatcttaatggggattaaaaaccagaatacacaaggtggtgggggattaaatgagatcaggcaagcaaaacacccaagggctttgccttagacagtgttcaccagtgttattaccatcaatatcctgaaattaatgacacaacataggactacaccaaagcccaagagttatttatcagacatacctttgtgaaaataaataatagcaaaatagcaatgtcctttccacctgccttacttattcacataatgtctactcaggcttaaagacttagctcacacattatcacctataagaaatcctacctgatgagccctcaccccaggactggctgcccctctgtgtttcagtaactcactaggcttaccactatcaccactgctttcccactttattgtaattgtctctttttctttttccaccacaaatgtaggtacttctaatggtagggaatatatttttgttcatgtctacatttgcaacaggtgcacaggttagcacataccactactgaatatccatcaaatgtggactccatgtggttgaagcatggctgtattagatagctcttgcaacaaaaaaacactggcaccaagcccagtgacccaaaacaaaaacattcgtctgtgctcagatgtctgtatgttgtctggggtcaagctgaccagggtgtggcttagctgggcttaacttgggcttcaggttgggtccagatctgttccacatgactctcatcctccttggaccagtgaaccagccaatgtgtgtttctcatggcaatgaccaaaacacaaaaggggcaagcagagacatgcgctgcttcttacggcctgggtacagacacttccacctatattttattggcttaagcaagtcacgtgcttgacagcaactcaatgggtggtaaaaacatgctgcatctctactgggaataggtgtcaacttatgtggataaagggaggggtgaagaattggaaacagtaatctagtctaccatgagaatccttggatccaacgcagaaagctgcatttacacacttctagagtttgtgtatatttatggaatgtttatcccattccataatctgttatcaggagtcaacttctaaagccttcctccaatcttattttcctgttccaagcattagttttgaagtattttgaaagcagtgtgacatactcaaaagacttttgagtaggaggtgggggtcaggtgggtgggggacagccaagagccagcctggtgaactgagccatatctccaagctccatcctcatccacgcaccaaagggacagggtaacagaaactctcagacattctgtgatctgagtccaagggattgtggcccagaatcaacttcagaaaaacaagtgcactgtagcggcaagagtctcagagtcagtcctgcactcttacaccaaacacttccaaaacattcccagtgaagcttcaagttggacaatgccaggttttgctctgaaacacacacaacatagataggaagcaattcgctctcatttaaggtcaacctcactttttcccagggaagtctaaaaagattggtgtgtcaatcaaagtgtaaggcttaaatcttcttgttccttttgtaactagatagcatcgacattcagtagagtcaactcagccatacacagcttgggtctatcctctttcatggaaaaaaaattgtttttagaagtacaatgcacttacctttcatgagttcagaaataaatattttgtggttgatttgaaacagggatcagcaaaattcttctgtaaagggacatataataaacattttcagcttgtcgctgcagtgtgaaagcagctaccagctgtatgtaaacaaatgagcaaggctcatgaggtcgtgctccaatataactttagtcacaaaaacaggaggtggaatggattcagcccatgggccatattttgttgatccttgagctaaaagaatgagtaaatatttgcctaatgttctagaacattggtccatacctccaagaagcccaagaaaatgtacaaaattcaggtcatttttttggcagagtctgatttaaggaatgcctctgaacacctggtacttcatttaatcctcctcacgggtcgatgaaataggaaaatatattcccattttttgttttttgaatgagtctcactctgtcacccaggctggagtgtacagtggctcgatcttggctcactgcaacctccgcctcccaggttcaagtgattctcctgcctcagcctcctgagcagctgtgactacaggcacacgccaccatgcccggctaatttttgtatttttagtagagacggggtttcaccgtgttggtcaggatggtcttggtctcctgacctcgtgatccacccgcctcaacctcccaaagtgctgggattacaggcgtgagccaccgcacctggccatatattcccattttataaacgaagatactaaggtttctgaacttagtgatccacccaagatcacacagctagtacatggtaaagctgggattccaaccaaatcctgtgtaaatgttggttcagtagttttcaagaatcataatagatgttatcattacgcaccctgagcctaaaatggttacaaagaatgaccagaaaatgctaattttattctaagaaagtcaacagtgatgaattcaaatttatgagtaagctgttcattaaagccctttttacaatagtaaaatattgcaacaatctaaatatccaatattaaagggacgcttgagcaaattacaatataacctttgaaaataatgttcataagaatatgtaatgatattggaaatgttcgccataatgttgtttttcaaaaaactagaaaacaacacagtggcaaaggcatgactctgttgttttagcccttatattaaatgtataaaaagctctggaagaagacaccttgtttatcatcatttagctcctggtttggggacggcaagtagttttatttttattctttgaactcttggttttgccaaactgtgttcaatatacataaaattctataatctgataagtatgtctttaaaatgcaatttatccttgttttctattttttcttctattgttctattttattcattcttttcttataagtaagttgtccataagtgaacacttcaaaagcaacaattccatcccctggattcaaggaagaatcctatgcataatccttcacatgcatcatgacccagattatactggtgtttagaagggtgaagcagtggtcctttgagtgttcagacccagttcccaaggagcacagatacacctgaatcccatcttgggttgcaagccctgttgagtaaaaagaaaccttctggtttcaacattcatcctttttatgattattgccaaaaaatttttaacaaacattaatataatgcataacatcccagtaccacttgtgatgtgtttaataaattctgtgtggtttttacatagccctgagaggtaagcaatgagtcaggagtttcctccaagcacctgttaagtggcatcatataaatagcaatgtcaggaaatcaggtaccagaagaaccaggcttgagtctccagcaaggccacatgggagctgactgaccctggttaagtccctgaaaccctcgggcttagcaactttattcttttggtttttgttgttggtttttgtttcagtggtgtgatcatagctcactgtagcctcatactcctgggctcaagctttcctcccaacttggcctcccatagtgctgggattataggtgtgagataccagacccgtccagcaccctgattcttaaaccaggagtagtaaccacactttcaacacccacaatagaattacgaggatctaatgaaaatcacaaactatatcaaatatataaagggtgttctgccatgatggccaattataatactgggagtgcttcctgtccctaccacttccagatccagtttttttttttttaaatggagtctcactctgttgcccaggctggagtgcagtggcgcgacctcggctcactgcaagctccgcctcccgggttcaccccattctcctgcctcagtctcccgagtagctgggactacaggtgcccgccaccacgtccggctaattgtttgtatttttagtagagacggggtttcaccatgttagccaggatggtctcgatctcctgacctcgtgatccgcccgcctcggtctcccaaagtgctgggattgcaggcgtgagccaccacacccggcccagattcagatttttaaaaaacattgttatcttggaaattggttatctacttctgtactggaggaagacagtgtgtgcatgttgctgcacgtgtgtgtgtccatagatccttgtttcattcagctgtgcagcaacaggggtcaagtctacatgaaaacgactgacatattcttccagccactgccagtcttactgcttccttcaatcaagctttttggttttccataaacatttttcatgttttgcataggtattttaagtaaatttttgtattgaaattttgtattaatatatgtaaatatacatacagaaaaatgtacaaatcacaaatagattgctgagtaaattttcacaaacacacttcgataactgccagccaggtcaagaaataacatgctaccaacatcgcagaagctcccttcattgttctttccagtccacatctcccggctccttctcccaggataattgctgtcttgacttctatcactgtagatgagtattgcctgtttttgaaatgctcattaatggtatcatacgctatgttgttacctgtgtctggcacttttatacccaaagttgactgagattcacccatttcattgcaagaagtagttcattattcattatctttgctggatggtatttctttgcataaaatatatcacaatttatccattctactatgggctttggggttgtttccagtctttggttcttacaaatgctgctgagaacatttgtgtacatgcccatgagtaaatatgtttacccacttcggctagctatacctctaagaatgagataatgcttcataaattatgcatatatctagcttattagatctgccaaatttatccttccagtagcgatgtatgagagtttcagttgctccacatccttaccaacacaggcattttgtctgtatcagttaatgaatctggtggatgcatactgaaatatcagtgtagtttttatttgcatttcctggtgactaatgagattcagcacctgtgcatatgcttagtgtccatttgaatatcctccctggtaaaatgcctcttcacatctcttgatacaatgctttctttttttagagacaattcttgatttattcatgccaagacaagaaggagtggcagagaaaataaaaaataataggtgtttcgaaaaaatattttaaatttgtctttggattttggttttgatgctaaacttgagtaggaatttccttgaatttttcaaattcataataatgccatccatagagaagctagaaaaatactaatgaaagctgtcatttaccgagtcatctcacataaagtgttctatgaggacactgaggttcagagaggttgaataacttgcccaacactgaacagctactaagtggctgaaccaaaattcaaactctgtctggggactccaaaacccaggctcttgatcacctagctattcctcagcattataggattctagtccccggcttcagcatgctttagaatccccgggaggatcccatcctcagggttcctgattcagtagggctgcggttaggcctgggaatttgcatttctaacaagttcccaggtgattcccaggatgccagcccagggaccacactatgaaaaccactgttctgaaaggtggcaatcaggtctcacttatctctgtatccaaaggccccagtccagtgcctggcaggtatcagacatataaatgattgattactaaatgattcctactccctcttggtcctctgtctggcacacagagccatgccgctgtgacagctgtcagctaatgtgagtgaaacccctctcagtcctagaaaggcctgtccacaaacatgaagagagcaagaaactccacttatgatacggtttgggtgtttgtcccttccaaatctcatgttgaaatgtgattcccagtgttggaggtgggtcccagtgggagatgattggatcatgggggcagatcccttatgtatggtttagcgccatccacttgttaacgagtgagtgctcgctcagttagttcatccaagatctggttgttttaaaagtgccttgggcctcccccttctctctctcttgctcccattctcaccatgtgatacactggctccccattcaccttccaacatgattgtatgcttcctgaggtcctcgcaaaagtagatgttggcaccatgcttcctgtacagcctgtataactgtgagccaaattaaacctcttttctttatacattacacaggcccaggttttgttttgttttgtttgttgttgttgttgtttttgagatggagtttcggtcttgttgcccaggctggagtgcaatggtgcaatctcggctcactgcagcctccacctcctgtgttcaagcaattctcctgcctcagcctcccaagtaaactgggattacaggtgtgagccaccacacctggctaattttgtatttttagtagagatggggtttcatcatgttggtcaggctggtcacaaactcctgacctcaggtgatccacccaccttggcctcccaaagtgctgggattacaggcgtgagccactgcacccggccccctggtatttctttatggcagcacaaaaatggcctaatacaacttatttcttccactttcttttaaacaagaggtggataaatcaacacaaggggaagagtaaaactgttccctggcctggttgactgcatttgagcaaacatgcccatgacctatctcacttgaaacactttccacactaggtcttttagaatgcatgttgtggcagaaactgtcagtcatctcctcgaatctactctttcctttcttattgagtgacaagcaccatgactactttctgagccataagatacaagcagagttagatcttccagggagtcctcttaaaagagagagaacacgcccttttctatgtcttcctgctgctagaactcaagtagccaccttgggccatgaggttcagggccacaacccctctgaatggtagatgagaaaactggaaagagcctgggaccctttcaactgtaaagtgccacaagaccagctgcattgcctcttctgtgacaagttttacaagaggcagaaatcaatttttatcttgtttaaactactgttaatttgaaacttctctttaatgcagctggacattatcctaactagtacctacaggcactatgacccagctgaaagaccaccagatgagatttagccttcctcttttgtagtatatcttaaggcaagtcacttcagttcctgaggctcggtttccccatctgtaaaaaaggaagaaaaatgtgtgttgccattgattcgaaaggcttttgtgagacacaaatattaccttgttcagacatgctttatgaaatacagagccctatgaaattgtgaaggacttttatttccgacaaacaaaggaatttttaaaagagaaaatgaagtaggacaaggccttttataagaagtcttttctaattaaggagaaaggactgaactggaccaacagcttctctgctcatctctgccaagtctcctctcccaattccatccaggtcattctttattttccaaatgggaatttaattttgctctaacaccattattacatccaaattaaatatttattgggctgactatcaattgacttttagaaataaagatttgaaatttatgagctaacagagtaattcgataattgtaaatttcacaaccgagctttgtaatcaattactgtttagtaatgatataaatgcatgttcttctcaggagaccccagtcaactataaattagattctgcacacataacaatctggcaacatctccacactggctttgtctcttctcgggaggaaccaaggccaggaaataatcccgggctggctttccctggctgtgcatttggaccccagttcacccatcagtcaggctgtgctgagactagacttaatgagtagtcacacaaaacataattcagaagataaatcacctgcacataaaacctcacaatccaactcaaagagacgctgtacaatgggtaggtaacagagacaatctttcacgcattcaacgatccaacagatagctactgagtgcctactatgtgccaggcacctttctacatccgtgtagaaaacaaagatacagtcaccctcctagaggatgagaatagggtgcaatgaaccataaacaatacatgacagaaataagcaaattacactgggctgactttaggaaataaagatttgaagttcatgagcaaacgtggagtgtgaaaagactggagtgttagaaagtcataaatgctatggaaagaaacagatttttgagataagcattgtcctaattttatgaataaggaaattagagctcaaagatcaaacttagaaactaagttagatttgggaaattttttttttttttgagacagaatatcactcttattgcccaggctggagtgcaatggcacaatctcagctcactgcaacctccacctcccaggttcaagctattctcctgccccaacctcccaagtagctgggattacaggcatgtgccgccacacctagctgattttttttttttttttaagtagaaatgaggtttcatcatgttggtcaggctggtctcaaactcctgatctcaagtgatccacccacctcggcctcccaaagtgctgggattacagttgtcagccaccgtgctgggccagatttgggatttgaactctgaccttcctggtgccaaattccaccctctttctaccacccacactgaatgaatgaatacctgtacacaagcacttttgacctcatttctcactgactgcacaatagaaaaatccctgttaataagctccccccatgtaagagactctcaaactcagaaaataaagctaagactaaagaaatgctctatagctagactggacgttagcatctataagcatccaacttgcttaaatctagacttggcttgagcaaaacttgtattttaattttgatgtgataaatgctagcattattttcactatgaaaaaatgttcaagcaattgtgtgtattactgttcatttgaaacccattctttgtctttgcaggactggccaactataagagaatgcattctaaattgagtttctattagaagtaagcatggtcaaaggggattctgaagccctcagggagacctctgtcataatccacagattctggtaattgattagagagcttttaagtgaacttgctgattacattttgaattcttttatattaattattaaaggcgaattatgttgttgaaaaggaaagccacagaaagatggtaatttaatcaaataggttagagaggcattctggataaggtaattgattttaaaagtgaaaggcatttgggagaaggtttgtcaaaaatggatttaaacaactgaaaactgtgtacccaatcactgtttgtgtattgcttaaagatgaaaagaaaggaccgggtgtggtggctcatccctttaatcccagcactttgggaggctgtgaggcaggcagatcacctgaagtcaggagtttaagaccagcctgaccaacatggtgaaaccccgtctctataaaaacacaaaaaatagccgggcatgatggtgggtgcctgtaatcccagctacttgggaggctgaggcaggagaatcgcttgaacctgggagatggaggttgcagtgagccaacatcacgccattgcactctagcctgggcaacagagcaagacttcgtttcaaagagaaaaaaaaaagaaagaaaaaaaaaagattaaaagaaagtcattgagaatttggtaggacctgtccaaataagaagaaaaggaagttttgttatacttgtaaaatgcacttgcccactgttatagtcaatgcctgactgaacaatccctgcactgctatctctttataattttcagtggatgagttcacacaagaaaagatttcacctgaactctgtagttttcttcaactgtcccttttcaacaaagatgctaagacttcccaaagatacaaaaagatgttacaaaggtcagagcccaggcttgaaaattactatattatttaaagattgaaaaataaaattttgttctcttgagaatgacaccaccccctccagccccaatatccctttcagtctctcctcaggagacgaggccaccttgtgatagtaatagtaatagtggtagcaggaagagcaggaacactgcacagagtggtggtgcttcccaggagtagtaaacatccatagagtgcttcttctcaacctgggtcccagaatcatcccttgaaggacatctgcccagaagcaacatcgaaacggaatcaactgcattggattctgcgtgaacaagaaatagacttacgattattatttccaattcttcttttcattgccacaggaaatggaaataaggcaagggtgaaatatttgtggggtagatttacttatgattgtaagctatttttcccttctttggattcctcctaatccctaaacaagaaaaaaaatgcaactctaaacatggcggccgggcgcggtggctcacacctgtaatcccagcactttgggaggcaaaggcgggcggatcacaaggtcaggagatggagaccatcctggctaacatggtgaaaccctatctctactaaaaatacaaaaaattagccgggcgtggtggtgggcacctgtagtcccagctactcgggaggctgaggcaggagaatggcgtgaacctgggaggcgaagcttgtagtgagccgagatcttgccactgcactcctgcctgggcaacagagcgagactccatctcaaaaaaaaaaaaaaaaatagctaatcagaaaacacagccaggaaacatcaccaccctaatgcacctgctaacattaataagagccagagaagcccggaggttcaataactcccagcaagctccttggccatcctctagccatgttcctgcagccacaaacaccagccagaaaaggagatgcaacagaaagcccaggccatcacactgaggcacaactcagtgcagacgcagcttcttatggccaacctgggcccagagggatgttaaagagcccaggttggtgagtcatggacatgtccttctccacctgggcattccaaagagaaactctttttggaaggaatttgcaaaaagaaaagtaggagggtatagtttctacaataagagagcctagggccttgctgtttctgatggtgggtgaagcccattccttccatgctagacttaggctaacctctacctttcacttggttttgatgcatggcattttgattgagcgattttcccaattttcttcccatagctgcaaatctggatacttggagatactgctagttctttgatggtgacaactgccatggaataataagagcttaacaaaaagctactctttccatagtagcggttatggctttgattggagtgatactccaaccatgagcatgggaaggcagggttagttagatgtaacttacaggaagaagacaaagatacccactgtaagagtggtgagaagcagagcaagtctgcatgaagtaaacatgttagaggcagatgaagccagcccaaggcccccatttggacaactgggagatgttcagttgaacacttacggacataaaaaaggacaaacagatacaaagaaacgtcagaaaatttttaataagggaagatgaataaatgaccaattgttgactgatctgcactcagtcttgtcttggaccaattgctacatctatcctatctcatattacaaaacgcagaactctgaaaggttcaagtccctacgacaaataagcaatttgttgctcttgacagtcttggagttaccaacccattcttttggcctgccccagcacaaccactatgggggccccaaaatagtcaggtgaaaaggacagaaggcagaacagcacttccactgggtaggtcaccaaatgagaaagttccagcaatgagaagaggtttcctaatatcaagaagggatgcagagatgcaccagtctccccattattaccactgctcctggccgaatggacttgggctttaggactacagaggtgccaaacccttggcttcactggccttcagcacatttgaaagacaacaaaaaatcagacagcaggctaccagctgttagcccactctgtctggctgggtttcaaagttaggaggtcatctgtatccttctcccacagctgcccacactgtaagctgagggaagatgccccaagtcattctcaaactatacctatcacccttcatcacaattttaaagttatatttattcgtacatataaagttatacacacatatatgtatacagtacatgcatgcgtgtgtatatatgttttctatccatctggcctacaaagctataagctccttgaaggtcctgcatgagggtcctgcttgttttcttgttgtattcactctcatctagccctaaccctcaccaggtcattcataaattagttcagttaatgactggacctttagttttagagcctgactctgcccaagggggtgtagggggcatagaggccgaggtataaatggcttccccagcatttcaagtaggctctaaccatcactgtaagaggaaggaggcagagtcctgatcccatatgtcaggaccaccgcctgtgatccttcacagtgtgccctgcaaaggagcaccaagccacgaggacaagagtcgaattgacaggcccctctccccacatttagctaccaggggctgcatccgtgaagagggagtacttttttccagtttgtgcacatcgcgtggctagtgagctctgcctgccacaccctttctgagcccacaatttttatactctgatgaaaaaagtgactgatgtgtgatcctctgtcaagttcctctcttccccttcttaccaaacagaacgctgcctttagactcagctgctcctccagctccactcccctccccgactccaaagagttctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagcccaaagagttcttttcgggagattttgtaacacagaatcaagaattcacagagagacctagaactaaagaggcaggagacacaaggaaagaatttaagccaaaacaactaagttgatctacgtaacaaaaactatacaagtgggtaagagcaggaagaaaaaaagaaaagaatgttgtgaaaatatatatttggattcccattgatagtcttgatgatgtgagtggataagtgaatgccctcttcatttgtttgtgctcctaaaacacaaccgtcattcagagactgaaccacatgggtttatgggtttataagtgttatcttttattgagatggaaggaggcaaatcccagaaaattagacagacactggggaaaagtagaaaacactggaacatattgtcttttcccttaccccaccccctacccccagaataaagtgcaccaggtaggagcagaaataaaaagaagccaatatttattggtaccccctggtaccaattcaaggggaactgtttaaaggccaaacccatgacctacacaacagccacaggattcaagagaacattcacctaccacactcacgaacaatgcaattgcctcgtttctcaataaacatgacttctgaatagattcaatcctgttcacagaagaataaagaaaaaaaggaacttattttttacatattgaaaaaaaattggggtggagaactgcatgaagataccctgcaggtatatgcctctgaaaataatctacagaatccagaagaaaatttcaaaaatctgttcgtcatgctgaaaaagaggccaagggctctgagagtcagtgcagagagtcactgggagacataaggcaaacacgaaaatgtaacaagatttggtgaaataaggaaggattttcaaaaaaaaaaaaaaaggaaaaagtatgtatggtactaaaagcaatatctttttaaaaaatcaatgaaacggaataaagctcagaaacaagccaaagtataacaagatcaagtcttcagcaactggtgcagagacagctggctaagcatctaaatacaaatgaagccaggatctccacctgacgcctacaacagtttgaccatgtgtcaccagtctgcacctatcaggacgcaggtagaaacacattaacagtagcaattcaataacactggcttctgtcctattgctgatttagcacctccagcctctaacaagtactcccaagtatgcctgggcatccccaggaggtgtttcatacaaccacacatgcatccaccctccacagcttcccatcagacttggtccccacaccactgtgctgagccctgacacagcttcagggaagcacaggtgtcctcggatccttccaaggacaagcttcaaagtcattcatgccaaaattgggaatcacacctccactcttgtccctgctgggtaattccagggcagatctgctttttcccagtatgcaacagacattagtaaaatgactttcatgctgttttcacgttttggaactttcaaatgtttctgtaataatgatatattatttctataataatttgaaaaatctgacttgacagaaaataaaacagaattttcctcgaccaaatttgtttttaaaaagttacttacttactttctatttcttttaagtatcctctgtcttgtcaaagaattattcctcaaagaaacattcaggcctagatggattcataggtgatttattcagacaagcttttatttttcaaacaaagccagcataatactgataccagcatttgacaaagaccaggaaaaaagagctcaaaatcaagtaacttatgaacataaacaaaaatcctaattaagcacttagcaaatagaaattagaaaaacattttttaaaataacgcatcatgctttaataagattcatcccccaaacacaggctatcaaaataaacaccatattagtaaattaaagagtaaacattttatagtaaacttaatagataccaaaaaagcatatactcattcctcatctatgcctgagctaataagaaaaaaaacacatcttgataaaatagaactcttgcttaactcaatgaaaaatttacacacacacacacacacagtcacaaccatgccacaaaataatcagcacagtacttaagggaaaaatgctagaagtgttcccattagagaaaggaaaaaagcaagaatgcccattatcaccattgttactgaacattgtactctgagtgctattcaatgcaattagataagaacaaaataatataatgaaaaagagatagtaaaactatctttacatgtagatccttgtatatttgaagaagaaccaactaaaaagcttatagaaaaactaagatttcagtaggtggattttaaaaaaacataagaaatcaattgctttttaagccaagaatagaaaaaatggaaaaagatatttctcaaaagagtaaaaacaaaactaaatatttaggaatgaattttacaaaatcacccgtaaccctggagggttttatcagaggacaaaaaggaactactgaattcagtgaatatgttgttcttggatactctgtaatatccaatgttgtgatactgcagacgtaatcccaatcaaaagtctcaatttatgaaccttgacaatatgactccaaagttcatctggaagaataaacacagcatgaagaatcagaaaaatctaaaaatatgattattttaaggatttgaggagacttctcctgtaaagagtaaaacataatgctgtaatgcaggaagagacaaggaaatataaccgaataaaataaccaaactagacacaggccaatatggaaatttaatataagctagaagaggtatttcaaatctgtaaggggaatagagagaatacaatagatgatgttaggacaacttgatagttatttgcaaaacttggataaaagatttaaaagctttatatatagtttatatgatataatatgacatataattatatatgagtaaaggaaaaggtaaagtgttttatcatcttggattggataatgcggttcttaacgtgaaaccaagttgagaaaccaataactactttgattacataaaaaataaactgggcagaaagagatagcataaatagtttaaatacaggtgcttgcctggggaagaggggcggacatcaactgaaagggagctcaatggggggttctggaaatgttctatatcttaatctagatggtggtttcgtaggtgtatacatgtgtaaaattcgctgagctgtacagttaagatttgtgcatttatcatgcataaactattcctcagtaaaaaagaaaaaataataaagaaaataaatcatgcatttatacttcctttcccataaagactacatttcagggtaagaaagacttcggactgagggaaaattcttcttcatgcaagttacagctaagaaagacaaaagggatgaaagaaatagaaactcgttattttgcaattcctactgaagtaatctggacaatgtcaatggttgttaaaagcattagagtgctggccgggcacggtggctcacgcctgtaatcccagcattttgggaggccgaggcaggcggatcacgaggtcaggagattgagaccatcctggctaacacacagtgaaacctcgtctctactaaaaatacaaaacattagccgggcatggtggcaggcgccttgtagtcccagctacccgggaggctgaggcaggagaatggcgtgaacctgggaggtggagcttgcagtgagccaagatcccaccactgcactccagcctgggcaacagagcgagactctgtctcaaaaaaaaaaaaaaaaaatagtattggagtgctggttctgaaacgctagcctgcatcagtgtcagagggtttgctaaaacacaaattgctggctcccactcacagagtttctgattcagtagacctggtgggggcctgggaactggcatttctcacaagttcccaggtgataggtgataatggtgctgctggtccaggcactacactttgaaaactcctgcattagaaaaaagactgatgttgaaatttataatgggtaaatcaggctgaaaacacctgaacttacggatcagtctgagcttcgattccacgggacatggaggaacagagggacatgataaacaccaccataaagatatagtcagccaaatccagtatgggaaatctacagaacaaataacccagagtctccaacaaataaacacaacaaagaaaaggaagggggagccgttatagatcagtttaatttatttagaagtgaaaagacaaatttagatactgacaaagattctttgcttggccaaactttagtcaggcttctgaaccttttccttggcccatctgtgtacttccttgtaaaatccagctgaagaaagagtgctgctaggtcagtttagcaagaacttcccacctttgctctctgatctccctcacttgaaatctgaagtttctcgtcctccatcaccctggcgtgtcttcaggaagagtcctcttaggtcagtttagccagaattccccttacccctcatgtttcttcctggtaattttctatccactgatccccaccctgctccttggctataaatctcctcttgcccatgctgtattcggagttgagcccaagctctctccccaactgcaagaccccattgcagtagtccctatacccatcatgatggccctgaataaaatctgtcttactatgctttaacaagtatcactgaatttttttcttctttaacagggctgattcaaactagctacctattttctaattgggaggttaaagaaaatttggtggtattaatgaattgttgtcagttttgttgtctgtgataatagaatgctgtttatcctttttgacatcctgatctgttagactaagggtttattaacctcagcactgttgacatttggggccagacaattctttgacgtagaggactatccaatgccttgtagggcacgtaccagcatccctggcctcaacctgttcacgccagtagcacccaccgccaccattcccagctgcaaccacccaaactgtctccagataatatcaaatgtcccctggggagggagtgcaaaactgcccccagttgagaaccactgagttaggtatatcttctggaggatttgcaagtgaagggttatgtctggggttttttgtgttttaaaatactccagagaaaagcaatggggagtgagagtaaatgagatgcagctagaaaggcacgatgctgccaactgtcgaagtggggttcagagtgtacctgggtgtcgttagtctattctctgtgttttaatatatgtttgaacacttcttaagaaaagtgtttacaaaaacgtgaacacacataaaatcatgctgtagaaacatgtttctgacagatgttcatgatagtatgtggggaaaaaaaggaacagatcatgcaatatgtacgcggtgaccccgtttggatataaaagagacacagagagaaactcagaagagagatgagtcaaaatattcacattgatggtctcctggtggttagaattgtgggtaataattttcctcttccagtctgtagttttcaaagctctccatgtgaacatttacctcctattcaatgtagacaaacaaataaaataaaaactaacaaagaataaagggactgttacaaagaaacacactgttggttgggaaagaaacagaaagatccttcaaagcaaacacaagatcttacaaagtacaacaataagagaccactgagtgtagtgaccaagatatcacacagcccttaaggaaatgctgcattaaagaatgcaagttcattgacagtgtattggaggcggtggggggctttcgtctttcctgattctgaccttgaggcatctgaattccacttgatctcccctgtttcagaaggcagagtcacatggaataaattttagaatgccttctctctaaacagagaatggtgtttttcctgccaggcaaatgtttaaactaaaatttttaaaataatcacttggtgcttaaatccacagcaaagtggaaatagtcagctattaagctagtctcatgcctcaaaggttctgggcaactggagttttgctcttctgcttttcaaagccaaatataaattatctgctatttaatcacctgttgctatggctcacctgagcagctgcagcccggctttagcacaagtaattaatggcgagccagaatacccagttttatgaatcattctgtagcatctggcctaaatgtcagtttcctttccatcttaaactttcccatagtctgctgtaaattcatctccgccttcactagaacatggaacccataaagaaatttgcatgttgcctccttcaatgctgtagctttactgcctagaagaaagcccagcacatagtaggtgctcaataaatgcttgctaaataaatgactgaatcatgttttccgcccctttcttgatttctggccttccaagaaaagaacaaatgttctaataaatacgaaaatttattatttctaaggctaccaaatggcctgaattatcagcttccttagactccagtaacatgctgcttacctgtatttttggtgagtgaatgaaggtattaacacagacctatctacccccatactacacacatgcacagtacatgtgcaacacacacacacacagagcactctgcaacaccctcagacacctccacacccttggacctaatgatacgtgtattttctgtttactccctgtgcctcagctagtaagcgcttgatctcattgtcttcctaataaaatgaattaattttcagagttaaaattcatgaggcagcatatgtaaagtctgtgtctataactgcttctgaattccctccagctgcggacatttttattctgcccacaaaggctcccgagtttatttgaagacgtttctttgtggccttccccagggtccccagcagcccacagtgggttttgctgctacttccagacatttcctgtcaattcactccagtgtttggcaggagaactaatgccagattctagaatccaggctaactttaagctaacaatctccttccattcccgtctcctggtcttctacctgtgactactcaggtcccccagaatgtcactccaaatccttcctaaccaacccttagacatctagtccaacctcctcctgaggagaagggaaaactggggcccagaagggtgaggcagcatgttatgggtacatggtaagtgagaagcaatgcagggacaatgacagaggtctcctgacccccaagatgtcagtgttctttctccagagcaagaatcagcaatttacagcctgtgggccagatctggccctctgcctttttttgtaaataaagttttatttgaacacagccatgcctactaatttccatactgcctgtggctatttggggctataacaacaggactgagtagttgtgacacaggccatacgaactgcaagccttaaatatttgctatcttactagttgcagaaaaagttagctactccttctagaagggtcaaaagaacaggaagatggatgggaaagggctgacacaaacaccccatggaaaaccaactgagcctctggctgttctcctcacaggaggccggctccacaggggaatgggaagatcctctggggcggcaccaaccatttccctgactcctcttcccccaacgctatagtggcctctctcctttgcagagactgcagccctatctgctggcaggcaccttaggctgaccctgccaacacatgcacacatgcactcagacacacacacgcgcgtacacacacacatgcacacgcaagctgagttccaagtgtgacatggctgccataaatcagcctggaatattaaactcaagctgccatgaaagagcctctcaactccacagcacacagaagaccaagaggtatgggacccatcttcagggaggaagccttttgcagttcaattcacttccccgggttcaagttttgtctaccaccctcgccagctgggtaacctggtgttacctaatttctcagcccgtggctcctcatcaataaaccaaagctgacctctgttgtgaggattcactgaagtgatgcttgcagagctccaagcatagggcccggcacagagtgagtgctgagtgggcactggcaagaggctctctagggattgcccgggctctctggacaatgcaaggcatgattctagtgtccagaacagcctctgacacacagggtctgaaacagccttctttattccaaaagctcagaaacccaaagctaaaagccaaccgagtaggccagagccaggaggcccaggccgccctgtttggctggaacacccgggctgccggcgtggctcggagccagcactgcaggcaggcagccttgacttcctccttcccagtcctgatagacatgagccatgcgaccctgggcaggccaccctgtctccatgagcctcagtttcctcatctgtcacatgataacagcatttaccccacagggttactgtgaggactgagtgaaacaaaatacccgaggacctttgtaccgggcacaggtgggcccctccataagtgagtcactgccactgtcatgtaacacggtaatagttcagcctgggaatgtcttccacagtctgaccacagaaccccctcacctgtgacggggtcactcgcatctccgcccactctacccggggattcagtctaagtggagcctccctcttacccttcccagcctagcctcacgccccaccagtcccctgccacagccacacatacctggaaggccacaccttgccactgaccctgttcccacatcaaatgattttgtcaacatgaaaccaaaccacaaccaggtggatgcagagcctctgtcacactcagtccttgctcctcagtttccttcctgtgtgaccatgggagagtcattcaccctctctgggcacaaactcaatcatttgtaaagaacaggcttcagatcagatattcaagttccttccaccttgagaaacactgcagagattctactatgaagccctaatgaagacgccccatgtaactggctaactccaatgtcaatttccacccaaatgcatccacttaatctaatagagaccgcatggtacaggcaagaagtgttgctttgctaacaagaccactaaaggcctcagctggagactgtgactttatcaatcgtcctggcctcctccctgtcttgtgctcagtctcttttgcacgtgtcttctccccactcgattgttgttaaatcttgatttttttctgttttcgcttacatggaaccatggggcttttccagctctcctccatactccctgtgccttcactctctgtggcttcttggtcagtttgatttttcctgaattagaattaaaggccttggagaagctccgagcagtgcaagtcctgggagaccacgttccaggacaccagaccttgtttagtattgcccatcgcagtgtgaacactctaacaacaaagaacttgccacccgcagtggcagtccaccccatgttcacagcattctgaggctggaaaattctaattttctaatggcccgtccctcgacagcaacagaaggcagtgtccgagggtcccctggagccaagccagacactgggctattgatttacctatgagggagggaggtgttcttcctctcccaagtgtaaagtatctaaggtggcccaagctggaaaacggtcaccccaggcctagaacgcacattagagccccaagttggtgttcccaatggctctgccacgtggggccctttctcctccttctccagggatttagaagtggagcagcatcggcatctgggcctcattgcagaatgaggggacaaaaggcttcttgtacgataaggagacaaaagcctccaagggacttaccacaaaacagaagcaatattttaaatgctttttagaacatttgcatgaagataatccagaagtacagtgaaaaagaaatacaaaagatttgcaatgaaatctccttcctgtttctgaccacaggccacccaggccccttccccagcgtttattacaatcagtttcttgcatttcctctcagtgataatttatgcaaaaaactacatgtatttaaatatgtgtgtgtgcatatccttttgttttacaactgataaaccagaagacaaaattctgtacctcgcttttttcaattcatcgatcttggatattgttccattaatgcttagagaactggtgctttctctttaatggtatttcacagcatggacatttgcctcatgtctagccttttgcaagtatgagtaaagctgcaataaacatcccagtacatacatttcctgcacatgaacacacacacacacaaaatcagataaaattcctagaaatagaactacttttagatggacaagagttagcaaacctctgggtagtgtgtgtgtgtgtgtgtgtgtgtgtgtgtgtgtgtgtgtgtgtgtgtgtgtacatacatgcacgtgtgtgtaagtacatgcatgtgtgtgcatgtagtgtaaagtggttttgggtttttttaattaatacaatgggctgagatcttctagttgtagagtattagagctaaattggagctcatcctatttcacttcatctgcttttctttgagtctgttgttcctcaatttcatccacacttttggttattaatgcccccattcagtgtttcagattcaccagggcttcttaagccagtttacttttttgagacttaatgcccttacagagccactgtgtgtgaaattatcttttacaatgctgaatccaagcagtttatagttttcagtcaattactcccaaccaccagagctgtgctcaggataacatttctggctaaatttcttacttcttggatcatgaattctcagacactactaatcctggtgtctggtgagtcaacatattcggactcacactcaggccaaagactctctccaaacttagaaatccacattcaataagccacatgtgcactggaaaattgtagcacaaatgccaggctgataatctcgataatatttcacagtccctgataaagagctaacttttaagaaatcctgaagcaaaatcatttataattttttaaatttccgtggctaacaaaaaacaaatcactggtcattaattcaaccatgtcagttagctctggctgtataacaagctacccccaacattcagtggcttcaaatcgccaccacttatttaccttatgattctgtgggtcaatgctctgagctaggcccagtcgggcagctcttctgctggtcgtggcgaggctcagttatgcatctgtgatcagcagctgctcagcaaggtggctctgcttctagggatggctggttatcagctggggtgactggggcaaccgggccatgtatgtcaacatccagcaggctgatctgggcttcttcacatggaggtgtcagcagggaccccaggaatagcaagtaaacaagccccagacacaagtccctttcaaacctcaggcagtgtcacatttgctactctcccattggccaaaacgagccacgtgtccaagcccagattcaaagggtagagaaatagactctacctcttcatgggaaaatgtacagtgttgcattgcaagggtatggacagatggtaaggggaagaattaatggccatttttacatttatcacatcaacagtgtataaattcatcaaacctaaatagtatttgtataagacttcgcaataaatagaacagctctcaattactctctttattcccagaacagtttcttgaaacaggatccacataaaagcaacacctggagagacttctagtgcccgtggttgagtatccacagaaccattccaagccatcctacaagttagcattcaggcacccttgatcagatgtggtgagcctccgagcagctttccttaagaccacagacacacagaagaaaaagcatgcgacgtggagtacagaagactcaagtctaacctcaactctcaaagcaaattacttcagctcttctacatgccatctgctccctcatttgccagcaggaacagcaggaacaatctaagaattgctaagaggactcaaaggaatcatcctatatgcccatgccctaggcacctggaagtgcctggaacagcacagcaaagaccttgaaacagtgaatcatgcccaacgttctaaacggacttgaatgctcaaataaaaatgacagatgtgagcaggaggctccaaggaaagacaaggttgtgagccagcacacagaagtgggagacagaaccagcctggccacagggcacacgactgtcccccgggcaggatttgaaagttgaagatggcagaactgcatgttctctgtaccctctgtggaagcagccaggtcttggatctgcacaaaacattctctcccctcaaagaagagtgagtcccaggcatgtctttcctggggaaacagccctgcctgacctaagaaaggcatgtgaatctatagggccctattaagggcctgaagaatcgtgctgcttgctgtctacagaaggaaaaaaccatcccccatcacatatatttcaaggtaaataacaagagctatagctacaatttgttgaacagccatatggcagaacctgttccagtcaacccacctacattaaataattagcattcatgctgcaattatctacccaaagacaactgtgtgcctatggtgtaccagattccacccaaggggcaggagaagccgtgttgacatggccataccaggcatggtaactgcccagtggagtcttacagtctggtcacaatcattaatgctacagatgctgcctctaccaacagaaagagagcacttaacttttatgaatgagcatgagcactgcatgctggactttgcacacattatttcagtgactctccacaattacccttgaagtaagcatcatcatctccaccttacaaataagtgaactgaggcccagagaacttgtctaacagcaacaggcagcatggggctgagctggattcaaaccgggggcaccttccaagagaccctgccctgccacggctcctcttctccccataaggaacggtgttgatgagcaggacaatgttcaggggtggtgatcagaagcctccctcctcttcaccctgggttactcccaacaatccccctacctgatcttcctgaaactcttagacaaaggtaagtggtgcccatttctgctatccctctccctcctcccttcaactttccagagtcttcagcaaattgatctaataaaaattcaacagctcactggctctaaatctcaggtctggttttttaactgcctaaagggctcacagggttgctaactcggcccttgaataaaatctaaaacttacacacttgtgcattcattcattcaacaaaaacttaccaagtgcccaccaaatgccaagcccagcatgacagcacctaggtaatactgaagaggtttacacaggtaaggctgggcaccacacatttacagaggccacattttttaggtctgagggacttttctctagcagtatctagccacctgataaaagggaagaaaagagaaagagctgtgtttgtccaggtgttaaggttgagatagagatctaaggaaagggtactgggattccaaaaaagagaatggtggatatgatatctatggaatccaagctgatctgggaagcaagtagacacagaaagaggcagacagacagcagaatcaaccaagggaccttgcttgatgtgggcacttccatcaaaaatggccattcaactggagcaaacaagaccagaccaggatggtgtctagagttcacataagcagcaatcccacctaacgcatgagtgccttctatagggtcacaaggtgctgctacatctggtaacaggaaactctccaccttccaaggaacccattgccaagtgagcatctgcctgctgggacttttgggttctggttcttccatccacagctacatagagcaagggtccaggatggggcaccatacttccagtgcaaccaggctgccctcggcccttctcaatgcacagatatccatccacttccacgattcagtgatcaactttgtgccaatggctccaaggtctaaaatttcagcctctatccaagcttcagactcaaatactcaactgctcaccagacaccctgaccacaacatccctgagcactcacactctgaatgcatgcaaacctgagctcgtggccttgtccccatatacccaaacactgcattggaggatggatcctacccaattcccaactgggcaccatccttgatctctcttcccaaaacacacaaataatcaccttcctattcattcttcctcctaacaggttctcagatacagccacctaatcccttctatccccactgcaatgactcccaacaaggtcaccaacatctctctcctggcattattatctttctcagggaagttttcctaactagtcttacttctaccaccttacccactctatccattttcctggcatggaatcaaaagtgatgtatgagtcaatttttatgaaatgtccagaataggcaaatccatagcgacagaaaggaggttaacggttgcctggggctggaggtagggtgatacagggaatgatgctaatgggtacctggtttcttttgggggtggtgaaaacgttctaaaatggattgtgatgatgattgcacaactctgaatatactaaaaaccgttgaattaaaaaaaaaagtgatgttttcaaaaagaaaagttggtcacaacacatcactgcttaaaatttataagcagcttccactgctctgggaatgcagtcatcagttacccccaggatctgcaggatctgaccattcaccccactggcctcacctctgatgctacagcatacctgtcaactctgtgctccagccacattgggcattttgttcccacaacatgccatgctggctcacctctgagccacagcaaaggctgttccctctgcctcacccctaccctctgcttctaatgaaacactagacttctcctctcatggtatctcctgctgttttgtaattttctgcccatttatctgtctccttccaaaatgtctgatcaacaaggaaacatgtctatgttgttcaccaatgtctccctagtcctgacacataggaagccctcaataatctactttatttatgtatttatttacttatttctttatttattgactagaataaagtagattattgaaggtttcctatatgtgtaatcctttcatctactccaagcttgttgaaagaaagcaagaatttccaactatcaatcaccttcactgatctgtttcctatatctctattaatgcagccccaaatggcataggcttcttaagttgccacaattcacttcagatgcacacataatttccccttgactgaagaactcaaggatttttctattacatactgttaaaccatctcatacccaagcaattctccaatttaaatacttgctgcaggagtttcttatcaagacagaaagaaggaaagcccattttcaggatgaaaaagagaatgtgaacactttcagcttccatttttatctggttcagccctggctcacagattaatttctggcaccaggatctgggaccagataacagagaatcacacagaagagccttctccagctctccaaagccagcaagaatcactcttttcacaatcgtccattttacaatgtgtctaattataactgaataaattacttctgccattctgcagaaatacttaaaataaatagctctctttccttgaattaaaatcatagtcttttgttcactgttttctgttccataaagcaacagagtctgttgattaaagatcatttataggacttcgttttcaatcttttttatgatatcactttaaaatacccccaaatattcagctgcaaggagggataagaactactggaaattggctctttgagagtttttgatgagaaatgaagtcgtggatgtaactctcagcgaatgagcatatattagaaaagtcgattttaataactacttggttcttcttcttggactttttttctctacccaacttcctacatttttcttgagattacaacataatccccactgacacactaaatattacctctctgtattgaatggatgacgctgagacaataaatcactttgagctaacacaatatgccaaccagtcccagctaagccaaatatttgacgaaagacatacaaactgaaatttagcaaggcaggaatgctttggggattatgtcctgaatatcaaccatctctagaccctatgtagtgaaaaaaatagatgttcaaggaggccatatgtgaatgcataagatgattctgtgttcagaataaccacagttagccaattccaggagatatcttgggatgagattgtgattaggccactctccaaacactagtggatgtcacgacaaaataaagactcttcacttctgaaccaaaaaaaaaaaaaatcaccccaaaacacataaactattgttcttctgcagtggtgtagaaacaaacatgatgttgatgaaaaagactgtctgggggtactgagcatgccactagggaagctgacacctcgggtcctctcacttgcatgggcccctttcaaagcccggtgctaatttggtatctgaaatgctgtcttctttttcttaaagtgggcccctgaattgtgcacacttccacaaaaccttccagagctgcccctgtggaccctactttagaaggattgaaatgggactccagagatgccctcagctgtcaatacgatggaactatattcacaggtcatcctaagtcccctaaaaggaagacagagcatctctggccagcagccaaggccttcccagggcagctccagtgaacttctctgactcccatctcactcgcccaacctgccttccactgaagcatcagtgatcactaaccagcttcatccactgtcatgtttcactagagctgggacctcagccaagcatgttctacctcatgtcttctctccaggtacctctgctcctccttcagaacctactcgaggggcatcagctctaagaaacctgtcttggtgcccccttcccccaagatgaaactgtgtcctcctatgtgccctgcagcttggagcttagtaccttccctgggtctgaaatgtggctccctcacttactagaaacctcccatgcctcagtttcctcatcagcaaaatggaaagcaacagtactcccctcataaaatggacacgaggataatccttgttgcacagtagaaactcaataaacgccaaccatcatcatcatcatcctacacatcgcttcgtcagaaatccctcaacaactcattctacctcccccatcagaccagggacttctcaatagcagagatggaagcccctgtgcccagagcctggtgctccataaatgtttgctgagcacatgaaggaattaagtaatatttatattatgaccaacagaggtaaaattcaataacacatcccacagcctcttgtttgctaacatttcaagtctatattggagaatttgatgaaaagcataagaagacagaacagggagcaaaacagctctgcatcatgtttctctgtctattcccaagagcatcccttcttcatcatgggccaacagagcccagagctgctagctgtctacaaaacccatctcccaagggcagcttcattcatcgacctctctttgcagacagacttccaaggtgccttcggctgaaaaattctttcatctactccaagccaaagcaggatcacagaacctggcactctcacccagaaatcaccacacacaccatttgacccatctagattcttcctatcaggttagaaaacatgaataactctatagccatgatgagactttaaatctacccaagacctcttcaagcaaagcaagggctctgtctgtggaagctgcaataggtgtcatggaagtgtacacgtgcaatctacacagagcattgacatttccataccctgggctggttgggtggggggatctgcctccatgtttaacctcatcttggccacaccctcacacctgcccttcactcccaactccacaaaatcaatctgcatatcctcatattaaatatatgcttcaattgttcacatgtcactgtcctagcacatttgtcactctgcctggaacggttctcaccaaccctccatcgcatccctggggcaagaagtatccatctcaataatgtctccctactcctttcaaccccatccccaacttttgaggcctcctggacccctcttcttcagactcccctagttcttgccccatgattctctcagcactgttgttgtatgtctctcatccaccatatgttatctctgcaaccccagcacccagcacagcaatggatgcacacagcatgtgctctgtgaatacctgatgaatgaatgattccacgagaaatctcccctgagatcacagacttaaattatgctccacataattcctgagtttcttaaaagaagaggtgttcccatccagtgggtcattgctcattaaccccaaaaccatcccagctatttttatagagggagtaaagaatatgtgggttgatttttcaggaagaaatttcccatagcagaaccactctgaaggctgaggtgtagcactggtatagggttcatatgcctcaaaaatgtactgtctgctaccttttttcataggcaagaaaaataaagccgcagaagtgaagaaataagatgggctttactctcacctccaagattgcaaaacatcagtagtatctgctcaagaaatctttaacgtgcttgaggtaggtcagagatgttgttttttaaaatgtctgtgtgatcctcttacttctgcaagacaaattaatgctgcagaataactgggggaaagaaaaaaatctagatccatgttctgttggaatgcagcttgctctaattgttttctcatgtaattacatatattaccaatataattacaaataatacacatatttgatttgtgcaattatagaatagtatataatttttaaatgtggtatgtttctttctacccaagatccctttgtgaagaaaatgatttatcatttctaaaaatatgcccctgtgcattatgttttaataaagcaaaaattagtaaatatttgcctttcttttatatttcaacaaaataaactttgtcatgaaaattcaagttttaaaaggctcattatatgctttgaaaaactgcttgcactaggttaattctattcactggagaaaagccaaccaaatactatgattctcaagaaaggtaattataacagacaatgtataaggcacagtcaagggaggtatttgagaaggcctgggataggaggaaataacacctcaatgaatgggtgaggaacagcctatttaagagtgaaagagacaagtgagaaaactgggctgtgtcccttatcagttgtgtgtctttgagcaagcaactgaacctctcagaactttcatgaagtggaggtaatttaccacctcactcattgtacagttgtgaaaattaaatgaggtaacatgtgtgaaaggccctagcactttctcacttagcaaccatgcatgtcacgtggtagatggttcctgccgtaacagcataaatcataaccctcatctaccattactgtatttctctttgcaagatgacagttcaccagatctgctgcacagcatctggaacaccgtggtctctaagtctccctttttggaaggtaaaatggcaacagcctgcattcattcaaagaggagacttgtgaagggtccagggaagaaacgtgtgaacatccgtgagatgtgaagggaaatgcagaatattaaactgtaaagaccagaaaagaatttccagataatcctcatctgactagtgactcacactgaggttctattggatccacgcaatagaatctttgtttaaaaacttagccaacatttaaaattaggagatttcccataaaaccttggaagtacacattctcattctgcaatgagaagcctgggtaaggctgggcccaagatcctctatggcagcaaccggctggagccaaggagtttgctccctaggtagccacactcgaaaggctgccctctccagtgttcattatttgcataagctatggcaccctgagacaaaaaataaataacactctcaagtcgatcaacagacaactcagaactgaccagtaaaggataacggtctccatccccacctaatactcagccagctgctgaagcctcctgtttctggggccaactttgctttcccagcagctataatcacaacggttgtcacgacttccacagggtcttttctttttcttttttttggagattgagtctcgctctgtcgcccaggctggagtacagtggcaccatttcagctcactgcaacctccacctcccaggttcaagtgattctcgtgcttcagcctcccagatagctgggacaacaggcacgtgtcaccatgcccagctaatttttgtatttttggtagaaatggggtttcaccatgttggccaggctggtcttgaactcttggcctcaagcaatctgccctcctcggcttcccaaagtgctgggattacaggcatgagccactgtgtccggccttccacagggtcttcaaatgcccaaagctcactccgcactggggagaaaggtgaccctaggagaaaactgttacagagttggtacaatggagtgtcctgcctacctagagatgaaggcagatgtgatctgccttcatgctgaacctcacatttaagaagagaataaatggatcacagtgcatctgagatgtcctgaagactccatctaaatattcaagaatatgtatctaatcttagcacttcagtgtggtaaaaaatggcatagactggtcgggtgtggtggctcacgcctgtaatcccagcactttgggaggcctaggagggcagatcacctgaggtcaggagttcaagaccagcctaaccaacatggagaaaccccatctctactaaaaatacaaaattagccaggcatggtggcttgtgcctgtaatcccagctactagggaggctgaggcaggagaattgcttgaacccgggaggcggaggttgcggtgagctgagatcgtgccattgcacattgcactccaacctgggcaacaggagcaaaactccgtctcaaacaaaaaaaaaaaaaaaaaaggcatggactccatggcataggaacagaaagcttctaataaagagagttaataaagaggtgggggtgggggaataccaactttcctggcaagaaaactgagtcttggaaagttttagtaattcatctgagaactagaaactgaatccaggaactgactccagatatgaataaacaaaccatgtagccttacttttctagttacttccctccataggtacatcaaaattaagaaaccaagaacttggccaggtgtggtggctcacatctgcaatcccagcacttcagaaggctgaggcaggaggatcacctgaggtcaggagtttgagaccagcctgaccaacatggagaaaccccgtctctactaaacatacaaaaaattagccaggcatggtggcacatatctgtaatcccagctactcaggaggctgaggtaggagtatcacttgaacccgggaggcagaggttgcagtgagccaagattgtgccattgcactccagcccaggcaacaagagcgaaactccgtctcaaaaaaaaaaaaagaaaccaagaacttgaagactaatgagactgatgagatacaactctcaactctcctgaagatggagaagaaggctgagctcaggaagccctcctgataaagccatctatatttttgagccagcaatagtataaagaatttggagcttctttttactgcaacatctggatgaagctttttaaatatttcattcgggattcattcctcgtcatggaaacaactatttcatcaaataccagaactgctcagaaaaagcctctgtctcatattcaagttgaaccacaggctcaaagactaagtaaataagtgtacaactaccttgaaaagttagccaagaaaaaaaaaatggaaggaaatatgccagaatattaaagtggttaactgtgtagtaggaacacaaacagatatcatttttgcttctgtctttttcccctagtatctttgttttctcaaatgggcttgtattacttgtttaaaataatctataactagacaagaaaaaaatacatatgaattcattgcacacaagtgatggagctgagtcaggcgtcttgtcctgatctggacccacagatctatctcagtgtagcttagcccatttttgccttctctgccccctgctagactacgtgaggtctccccaatgccttgccatccccactgtgtgccccaatctgagcagcaaggtcctcagcacatagtagctacctaataaacatttataaagtgaataaattcatagcatcttgtatttcctttcacacattcttcctctggacctgtcaatgtagaggatgatactcaggtgaatgatatttcctggaagatactatacaattaattacccttgtaacctcaaaaatcatatttgaaatcaaatctgcacaagtgacaagtaaaggatataaaacatggcattctccttagcctcttaattacatactatatatcaagcttctcccaagctctgaaaatgtcccatttaacattctacacttggcattcaattgcaaaacctgaaatggagattgtattacttaaatacttcccaattttttttttacctacttgttctacatttttacccttcaaccaggttttatctactccctgtttccctcttatgctgttgtatgctagccaagaaaatttagggtaacactcaattgtttaaatccagatacttccattgtcctaagaccaaggggcatttacctagtgcaaaacacatgagtgagtgggcaaaggcatgttgaaggcacacaacagaatcatccctctgaccatcctctccatgaagctaatatcttgagatacatagtggacaccaatatatatagtatgaatgaaactttgtttaaaaagtatgcatgtgtacaaacacagatatgttaatatatccataggaaaaagtcagaaaggatacacacagaatagcaaataataattagctttgcatgaggtgaagtggaaaagccagtgggctaaggaggtagaaatttttacttattttccataatctagataaataaggcaaaggaactataaatgaattgttcttatgtttacccttttattccaaataaaaaagtactaaaatggtatgtaagtgagtgtgttatctgtataaaggttagttccctgccttcaggagaaaaacacagtataaaataattccagaactcacattatacattattacaaccacagagacaaagaggactctccggatacataaatatatacccatcctatctcctcaaacaaatggaaatcagattcagacaacatggcctcaagaaagtctcaataaaggtcgcatgctaccatgccactatttgggtatttggttctgtttatgggaggagttctgtaaaaagattagcgcaatcggtcaatgtaactgcagtgggattgaatttccacagaggctggcaacaagctcagcacagagaaggcaagaggatgaataaattatagcaagaacatgaggttcataaccaggaaagaggagcgaatgaagccagcctctcagaatcaggtggcttgtagagaaacctctagagatggctccatccctctccccaaaaaaagaactgctgcaagttccttgcaggtgagaagatactccaattctatatcttcacgtcttggggaaggaaacacccaagtagtaaatccattaatactgtccttacaggtgaggtattcctgaaaactgcttaattccccataaaagcataaaattgttttcttctaatcatttcatcattttgggacttatatttaagtctttaatccattttcagttgatttttgtacacggtgagagataaggatctaatttcattcttctgcatatggatatccactttcccgaataccatttactggcaagactgtcctttccccattgtgtgctcttggcacttttgttgaaaatccattggctgtaaatgcatggatttatttatgggttctctattctcttccattggtttatgtgtctatttaatgccagtaccatgctgctttagttactacagctatgtacagtattttgaagtcaggtagtgtgatgcctccagctttgttatttttgttcaagattgctttggctattcagggacttttgtgattccaaacaaattttaggagtgttttttctatttctgtgaagatcatcattggtattttcatagggattacactgaatctttagattgctttgggtagtataaaactactagaagaaaacataggagaaaagctccatgacattggtctgggcagtgatttttttggatatgacctcaaaagcaaatggaattgcatcgaactaaaaagcttctgcatggcaaaggaaacaatcaacagactgaagagacaactcacagaataagagaaaatatctgcaaactgtacatctgataaggggttaatattcaaactatataagaagttcaagcaattatatagcaaggaaataacctgattttaaaatgagcaaaagactcgaatagacattgatccaaaaaaaaagacatacaaatggccaacgggtatatgaaaaaatgctcagcatcactaatcatcagggaaatgcaaattacaactacaacgagatatcatctcactccgttagaatggctttcatcaaaatgacgaaagagaagtgttagagaggatgtggagaagatagaacccttatacactgttggtggaaatgtaaattagtacagacattatgaaaaacagtatggaggttcctcaaaatattaaaaatagaactgccatatgatccagcaatctcacttctgggtatatatccaaaggaaataaaatcaatatgttgaagagatatctgcattcccatgttagccaagatacaaaatcaatctaaatgtccatcagtggatgaatggataaagaaaatgtggtaaatatacacaatggaataccattcagccatatcaaggatgaagccctgtcacttgcaacaatgtggataaacctggaggacattatgtcaagcaaaataagccaggcacagaaagacaaacactgcatgatctcactcatatgtggaatctaaaaaaaagttgatctcatagaagtagacagtagaatgatggtacgattggctgggatggttagcagggagaggatgggggatggtggccaaaagatacatcattacagttaggagagaaataacttcaagagatctattgcacagcatggtgactctagttaatgatgataaattgtattcttgaaaaatgcaaacagggtggatgttgtgctctcaccacaaaaatgataactttgtgaagtaatgcatttgttaattagctagatttaaccattctgcaatgtctatatatgtcaaaacatcatgttgtacatgataaaaacatacaattttttctgtcgatttaaaaaaagaaataaaacattaaaataaatttttttaatgtaaattggtttctcactcttcagaaattagcagcctgagccctcaccacaagacttccacatatgtgaagggagccaagtcgcttgttcagttcctctctttttaaaaataatccctgttctcagtattcctccctgggagcactttgaaatctgtccatcattttatctgggcatttttacacactattcacgacacctccaagcaacattgaacttccctgaaattgagaaaggcatggggagtgctgggtgggtccttgtgctgggaggaaccttgtttgggggcttctctctttgctcctggtgttggaaagatgaaaggccttatttcctgatcagcactggggacaggaaccacagatcaagtggacaagctccacctgcatcaggcatggaggcttgtccataacagaacctcagaattaggagctacagcatcagaggggccttagcaacatccattttacagatgagaaaactgagacccaaaaaagggagcgggtgcctgtggtttcctgggaagttaatgacagaaggagactggaatctagggctctgagctcaaagagctaaaatgactgatgaatggagagatggacagatgcctggatggcacagagacagacagactcaggggatgactaattggcatcttggtataaaatgatgaatgaggagaaagtcttctcccaaggctgtgttggcccatggttccaaaacctgtcctgagaccccaccccaccatcttaaaatttcctgccatggtttacaatggacaaagagagtgaatggttggatcaaacccaatgctgacttggatggaggagggaggattaaagcctacatactctttatacagcaagagtgccaggatctcatcagttcctcttcagtcattgatcatccaatggaaaaatttgctacagctacactggagtgtctgagatcattgagagacaccagccacaagggcttccctgcctggcttgcagtgagagctctttgttgaacattttgagattcaaggaggggtacacccacattaatcagctccttggtcagggttcaggcagagatggtagctggatgtgatgcatcagttgtcagaagccttctgccccttcatccatgcattcaacacctacttgctgaatccctatcacatgccactgttttaagccattgggacacagcaattaaaaaaaaagacacaggctgggcacggtggctcactcctatcatcccagcactttgggaggccaaggcgggaggatcgcttgagcccaggagtttgagaccaggctgggcaacatggcaaaacactgtctctctactaaaaatacaaaaaaaaaaaatagccaggcatggtggtacacacctgtagtcccagctacttggggagggggtggaggcaggaggatcacttgagcctgagaggtcaaggctgtggtgagtcctgatgatgccactgcactctagcctgggtggcagagtgagaccgtgtctcaaacaaacaaaagatacaaatccctgccctcttggatttacatcttactggggatgggaagcagaaacagacaattacgagaaatataataaagtacactgtaaaggtagaaccttaactgactccctctgcaagccaacccatagctgattatggtgggagggagtgggcactttgcagtattaaactaagtagttggtgggggaaggagactcactaattttcccaggacagtcactcctggcttattccagttgtagaccaattaatgtcaattagtttcttttagtgctacctttgtatctcaaaagtgtcctggtttggatggcaagttatatatcggtcatcttattgagaagtatgctttcagactccaaggaggcaagggagttagccaagcaggtatcctagggaagaacaagtagagcaaagactccaaggtgggagtgtgcctgatgtgttcaaggaaaagcaactgggcccagaggctggagcatgcatgggttacagggactaaatagtcatgggcccttccaagttttccaacaaaaactgtggttttgctgagtgagatggaggaatttgggtgagttctgagcagaggagggacatgatccaattctgatttgcagtgagcctttctggctgccatcttgagagtagattctgtcaagacaaggcagaagaaggaagactgattaggaagcccttctaataatcccaggggaaaagagggtggcttggccaggtggctcgcaagtggaggtggcgagagtggggggactctggatgtagtttgaagacaacacattggacttgctgatggattcgatgttggtatgggacatagagaggaatcaagaaagactagggcaacttggccagggcaagtggacgtgtgcagttgccattgactgacatgaggaagtctgagggtggagctggtttggagaattaggagttcaattctggacaagttccatgtgagatgaatgttagacatataagtggaaatgccacgcagttaaatattggaggcaagagctctggagagggttctgtactggagatacaaattcgggagtcattagcatggagaaggtctttaatgcaatatttaccaacaaagaacatctggcctttagtccaattcaaagcagcacaaattatatggtagttgcctatcatttcatctcccccattctgttcgtgctcccatcaaaacttcctatgaccccaaactacacagccagacctcactccagggcctgagcagtcagagctgcaaggcaccccaaggggtacaagcacttcctgaaacaattctactctataacaatactggtactcaccaaggacaccttgtgtaaaataggaagccagttgtggggagcagtgaacatggagtcagaaaatctagaagaagaatcttggctctaccaatggtttgactctagctgtgtgaccttgggcaagtcactcaaactctctgtgctcagctctctcacatggtttatattgtgcagtaagtgacaaaatccatctcaacagcttagcacagcacctgggacatagtaaccgctcagtaaaaatcagcaaaatgactgttttgttgccattattattagcatttgacttaagatgaggataagggaacaaatcatttatttggaaggtaatcctagggggcactggttaaggagaggccaagtgataaagagaaagaaagaagccagtgaagggtgtgttctcaagccagttatcgctgtcagcaaatagagctgaactccaccagggcaccctgacatccagtgtagagtacacaccccagagttctcccacctgaggggtgagggagctgaggtatttatacaccaactcccaccaaccatgccatgagagctgggggtggatactactttctagctttggagaaagagatgcaattggaagtcggctggtgcatactgcagtggtaaggcccaaaggatgtggacagggcacacactggcacctgctgcagagtcatcattgcctatctggggcaattcacccagcttctctgagcctcagttttccatctataaaatggcaggcatcatatctgcttctcagagttggcatgaggatttcagaaaataatgtttgtcaaagcacctggcgtgatgcctgccacatggaatttcaatttcctttctccctttctcttctcctcattacgccctttccacatgaagggaaaacttacttgctcacaagccacacagaaaatgcctttcagaagggcactttgtgttttacaacattgttctctggctgcagagcactccttccatataatatactctcagatgtccataatgatcttgctaagtattcctttctggaaggaggaagtagaggtgctttgatagtgaggacggaggtttgtgcccccaaggtatgcttcatgtctgtggtcgctgtttttcgccccgaccatgtcaaggccccctatctccaaacaaattggtcaagatggagtcattcctaatctgatgacatccagcactgccatgtggtgtaagctgctgagctgctaacagagacactggtaagttgacccagaaaggagtcaatcccttcttacttccccctgcaaaaaaaaaaaaaagaaagaaaaagaaaaagaccaactcaaaaggcccctgcaggaaacaggcctgcccggtgcaacccaccagcccatacagcagaacagacgtgggcccaggagacaagtgcttatgtgtgagcaagaagccaccagaataccaacgagcagggaggtctccatgccaggaaacccccacaacggctatttgtttggtgtcctgggaaaactgagcaccaactgaggcctcacggaggcatccaacagccggaataaatctgaaagaagttgaccacgctgagacggaccaggcttggttactgacacacaaataagtccagttgattaataactactctctgtttagagttagcaacggtcccaaagactggcatcttgctgcatccaaagaggtgcttgctggcatggataaggcaataagaataaataaaattaagtggtttctttacacaggactttgctaagaatctcacatatggcatcttgttgatttttcttggcagccccaacacaaacatgatcatctccattttactggtaaaagaagcctgaagctcaaagggcttatcaataatttgatcatggtgatataaagccagtcaacaggtaagcctacacttacccacccatgaagtcagccttgaaagaatattttttttttaatctacagtgttttcatatacaagatctaatggaaaacaaagtgtatttattatgtttagaagccagaatagtggttaacattgaggtgaaatgaggggtaacacccaggaaggtgccagtataagggactttaagatattggccctgtactgcttcctggccttggtggtggtttcacgaaactcaccttgtgatagcaattcaccaaggtggacacttagtaaccagtgaattttctttaaaaaaaaaaaaaacgtagagacaaggtctggctatcttgcccaggttggtctcaaactcctggcctcaagtgatccttccacctcagccttccgaagtgctgggattacagccatgagccactgtgtccagccaactagtgaattttctatacttacattatactaatggaaggatgagaaaatcacggccagagggggccagctgtctgtttttgtaaataaagttttcctggagcagagccatttctgtgtcgatgtattgcctgtgattaataatccgatcctctgcagaaaaattttgctgatttctgtgtacactgttcagaacttggtttgagcacacattatatctagctttctgcttgcgtttttcgtaggcaaacatgtaaatgagtttgcagacttgaagaacacaacaaatgacatgaaggagaaagagctctatgttaccctgacacattcattaaagaagttatacggtcattaataaaaacacagatgatccaatgagaatgtaaataaggaaattaggataaactgaagaaaattaagagcaaagagaaagacaggtataacagaaatcatcttacttaaaattactaagatttggctgcaactttgactcagagtttcatggatacccaagcaaaattggtaagacactcaacccagacgctccaaatgccaaggaaccaagcagagcttcaaacttcctctccagaatccacagagcatccaagcctgtgcacacaactgaaagctggctgttcctgatttttttttaaaagcaccttttccccatttttcctgcaaaaaagcaactcattttttgctctgatgggcaaaaaaaccctcaggagcctaacttttgccaactgccatgtggcactgcccattcccatctgggctggctggcacagaccacagcgagcagaacagagggcccaggagggtcctcagatcgtggctacatcacaatgacctacttgggattagaacaacattttagagcataacagcgttttatgggtcataaatattgcacagatgttccttatttacacagactcgatagattattattgcaacattaccatgctaatatggtgattcctgttttcgaaactggcgggcaagaagcagggaaatgtaattaaacaagtatggtgcacattttaggaggttgttcagtaaaacaaaataaaaacacacactaaaactgctacctcttattcaattttattccacaactgactctcgatggcaagagttaaacttttcacaaaatagcattagctgggattggagaataataacttaaataacagcaatggcagtaacaaacagctagcattgaatgtgtgcttactacgtgttttatacatgcattaactcacttaatgctcagaacaaccttataacgcggatcttataactatgcccctttgacaaataaggaaactgaggcagaggtggccaagcaatttcccagagtcagaaatcttttctcagtggaaccagcatctgacttcaaagtccatgttctggtaataaccacacaacaagcaaagacttactgacagctttctgcaaaagcaaaggctactccgtgcggtcccatcctgggccactaaagcacacaacgatcaatgccccaacacataacatcacctctttgaagacaaagaatggaaggtcggtctccatggtccatcactctggaggcagcaaggagtcaagcttccaggatctggtctggggctgcctggctccccttcccttcagccacaccagtcagtcacccatggttccaaccacaccaaagggtttggcttttcatgatgacccgctggacagcagcttggctcaggctgctcttctgtctgctccccatctcactactcatagccaagcatcatttcctgccagaaaccatccctggctccagccaagtgaggctgctccttgcagcagcgtcttacacctaccatctccgtatggtgatagccaacatgcccatctgtctccccaaaccagacggtgagctccttgaggacagaaatgatctttcaggtatcccttgctggtgaatccacagtgaccaacccagagaaggaactcagcaaaatggtgaaccagaagaactggctaggaagagagcggagatagctgcaaggatgccctgctaggaactgtggcaatccttacaaaagtttgccctgaaacaatcagcatcctcttagcaatttttgagtctccaaaataaacatctgtggtcaacaatgaaatgcacagagtgctcactttttgacagtccgttctataacacaaatcttgcttggaggccagccacattcacccttaatcctaggtgtgatcacatgaaagtgttcacgtggtccacgcagtacaactgggaagtaaagaacaggctgggccaggcgcggtggctcgtgactgtaatcccagcactttgggaggccgaggggggcaaatcacgaggtcacgagatcaagaccatcctggctaacatggtgaaaccccgtctctactaaaaatataaaaaattagccaggcgtggtggtgggcgcctatagtcccagctactcaggaggctgtggcaggagaatggcgtgaacccaggaggcagagcttgcagtgagccgagatcatgccactgcactccagcctgggctacagagcgagactccttctcaaaaacaaaacaaaacaaaaaaaaaaacaggctgtatgtggaaggctgtggctcattcatacacattatttggatagttccgtggctcctgcactggactggttccctcaggggaaaaattatccaaagatatatacaccgacagcacatctatctcatgtgtgtgtctttgtgtgcatagaaagaagtggagaggagagggagatatgaacacatccgttcctcaacctctcctttacgaaatgtgttcctaaaaatgagttgcaaattgaatgtttaaaatttggactatacagatccttgcgtgctataagggtagagcagaagagggtatacatgggaggacgacttctaaaaaccatgaaattttacctttggtatatatgtttcattttcttaccccctgagtgtcatgcaatgtactgatgattatttgggattatttaaaatattaagaaataaattaagttacaaatgataaacttaattttggaaagtcctaccttaaattccaattatctcagcttactgaaaatacaattcatgcaaaggagaaaacgagtttgctgttagggacaaggatgtgctggcacagatatagcagaggattcggcactggcttccactccttcatgcagtctttcaacatttgtagagcacccagtacatgccaggtgctttctaggtagcaagcaagagagaattgcttctttaagtgctttctccccattacattcaaatgggagaagcaaactaagtaaataaccaaataaataaatacttggagatagctgataccattaacctattaacacacccaagcttatgtggacagaaagtgaaggaaagatatttgagctgagttggaaagaaggcacgtcccaagtagagggaacaactagagccaaggtcttgagggagacagaggtgttgactatacgagaagagaaaaaaaggccaaggtaactaacacagtgcccacaaaccttttctgtagagggctaaatagtagagactttagcctttgcagggcatacggtttctgttgcaactaccaaactgcaccattgcatgaaagcaaccataaataatatggaaatgaatgggcagggctctgctccaatataacatttttatgaatgttgaaatttgaatttcatagaatctttgagtactacaaaataccctccttttgattcactatctaccatttaaagatgtaaaaacctttcttagttcacaggccatacaaaaacaggcagcaggccagatctggcccatgggacacagttttctggctcctaggctaaactcagtcaagtaagctgatatggtttggctgtgtccccacacaaatctcatcttgaattgtagctctcataatccccatgtgtcatgggagggacccagtgggaggtaactgagtcatgggggtgggtttttcccgtgctgttctcatgatagtgaataagtctcacaagatctgatggttttagagaggccagttcatctgcacatacttttttttttttttttttgagactgagttttgctcttgtcacccaggctggagtgcaatggcgcaatgtcggctcactgcaacctccacctcctgggttcaagtgattctcctgcctcagcctcccaagtagctgggattacaggcgcctgccacaatcatgtctggctaattttttgtatttctaatagagatggggtttcaccatgttggtcaggctggtcttgaactcctgacctcaggtgatccacccgactcggcctcccaaagtgctgggattacaggcgtgagccaccacacccacccctgctaaacacactctcttgcctactgccatgtaagatgtgcctttgatccctttcaccttctgccatgattgtgaggcctcccagccatgtgagtccattaaacctctttttctttacaaattacctagtctcaggtattgcttcacagcagtatgagaacagactaacacataagtgaatggcagaagaggggataaaagacagtatcaggagctagaagcaacagtttcggcttggggctttattctacgtgcaagtggagcaatttaaaatgggagagatatggtctgacttacgtttttaaaaaattactttggcagttgagtggcaattctgatgatgtcatcaacttccttgaaaaaaatgtgtcaacagggaatggaacactatcctcttgatcaagcagtctggagcaaaccatcttcccctcaaaagctctacggggcaaggcatggtggctcacacctgtaatcccagctctttgggaggccgaggcaggcagatcacctgaggtcgggagttgaagaccagcctggctaacatggagaaacgtcatctctactaaaaatacaaaaattagctgggcatggtggcacgcacctgtaatcccagcactttgggaggccaaggcaggcagatcacctgaggtcaggagttcgagaccatcgtggccaacatggagaaaccctatctctaataaaaatacaaaaattagctgggtatggggtggtgcacacctgtaatcccagctactcgggaggctgaggcaggagaatcacttgaacccaggaggcagaagttgcagtgagtcgagattgtgccactgcactccaaccccgggcgacagagcaagactctgtctaaaaaaaaaaaaaaaaccctctatggatctgtagatttctctctgtatttgaatcactgaaggctttatttttctttaatgctgattgtctgtccacaattttaaagatttcctcattttcttccatcactaaacatggccttggagacacgatgtcttaggttacattttcaggatttcatgtgtgttctttcattttattttcctttcacaagtgaagtcatctgaccagtaaccaattgaagttaaatagtcaatactgtctgtacatctgacagactctatccttgcctcaaatgtattaccatgagtaccggcattttcacatttccattttctactcatttttataatgtaagaaaaaactggagaaaaattcaatcacagctgtacagataaggggggtaagagagaaaaactggcctcatggctggcagacatcagagtacaatggcttcaaatggttttgtaaagtccaaattcaacaccggggttataaatgaataataataaagaaaagtgtggtttctcccttcccatcaattctgccctatatgagaggaaaggctgtcagggacttggtccttttaggcttccctgtgtttctctgactacccctcctgaatcccagtttccagtgtcctgtcaagagcctgacttgacctgtttattggttcatagactgtgcctggcatcttgacattcaacttagtctagcagcctagctccagctaaccatgccccagcagagagggagtgccgtcatgttagtcaagtcagaaaagcctttactcttgacaggtttggacctcttaaaaatccaaaggcattcaacccttgttagcctggacaagatacaactctggctccctcaactgtcataagaaatagataatgacaacttcttagacatacagcaacaaagaaaggaagtcatgcatttcaaactctcttcaagacacttaataaattaaccaaggtaaataagtaaccagatcaaatctatcagaatttttcatctcccaatttcagtctcttagttaaatttcaacccatcctatgtccatagaagtgaagccttctgtaacaaggctctgaataatgcaaaaaaaaagaggtggggtgggagttaagatgtgattctgtgacagctatagtctaaaatggccccaatgatcttcacctcccagtactcacatccttatataatcccttccccttgaatgtggctagactagtgactagcttctaagcaacagagcatggtaaaggtgacgggatatcatttatgtgattaggctacataagatgatgacttctgtcctgctacagaagtagcaagaatatagcagattgtctcccttgctcaggaaatggggcaagcccacatatgttagaaaggtccatgtggcaagaaactgagggtggcttctggccaacagccccctcaaggagctaaaatgcttagtccagcagcctgcaagaaactcaatgctgccaacaactatatgaggttggaaacagatccttccctatggagccttcatatgagatcacacccctggccaacaccttgactacagccttatgacagatgttaaaagcaaagaactcagttaagctgtgctcagagactactgacccacagaaactgtgagacaataaatgtgtgttaagtggctaactttgtggtaattggtcacgcagcaacagttaactagtacagggtccaacttgtcgtttcagtttgaattgctcaagtcatcctaatccaggagtcacatgttgtcaagtctctgcacacctctcgctgcattatcataagctttcatgaatttaaaagaacagattagaggttgatttcttctaaagaaccactacagtaaaccagtctcaatccctttcttccagcaaagggacatcatcaattgccacatcttcccctttgatgcaaatgacaaagaggaaaatcaaaccatgtcattgccatctctgagtccaggagaaagagataatgacagcacctggcctgtcttgcctcacatcaggaatgcagtgagatggttctgagccatggactttcccagaccatttgaatgagactgacatcatgaggaagggggtatcctctggttgggaatcctctagtggctgtatcattattttctattaaagcccctattgcataggaattttttcccatgctgatatgaatctctcatggaaaataaaagttatttttaactatgagcctcaggctataaattcattctccctaaagagttaggatcaagcaaaatcaaagaagttagaggaaggagagaagaacacatcctggagtgacttggccacacctgcaaaccatgtgccctgccccacaactgtcctctgaatgctcttctgggacctcttccctctcccttttacctgtgcccctttttatgtatttcctcctacatgctcatcccaccgtgccttcattcaacctgctcctaagaaaacttgactttaagacagtaagagctttccaactagctaaggttgattcttcaattcaatgtactactccaaatacttcaatccagagttcattaggttgaaggcatcatgctaacccccacagcagacatgtgaacagctgtgtctgcaaagcctttaaaaatgatccacaaacttccctgccttcttccattatagaatggggccagagtgcgcaccccaggttcaaaacctaaaaagcaggtttcaggccttgccccaaccctcagttcttgtgcagccttgggttggtcctctaaaccatctaagatccagcttcctatctgcaaaagcatcagaagacttgttgaaagcaaggattaaaatggaatggtatgcctgaaaatactctaaaaagagtcactgcgattagggcaaacaatttcaccttttcttataactcaaagttatccataaaataatcggttatcgtactgggagcccacatctattttttctcctcctgacattatcattgtcatgactgccactacatcttcagtaaagcaataaggtgggacctttggggtcttccaaggagaaaagcatgcttggccctcatacctagcagctgcaactactgagttgattgagctttcatcactgctttttacatttatacctcctaattcaacactgggggttataaatgtagcaacagttaactaacacagggtccaaactgtcatttcaattcgaatttctcaagtcatcctaatccaagagtcacatgctgtcaactctctgcacaattctcactgtattatcataagctttcataaatttaaaaggataggttacaggttgatttcttctaaagaaccactaccgtaaaccaatatccctcctcttctctagtaatgaggtcatcaccatctttatttatcagcactgcaagcatgcctccctgaagcagccttctccctccttctaaaccttctgagcttagaaatcaaataaaaacttgctagaattgtaggtaaagtaagagctgctggccactgaaggagagactaagggctctcctctggaggaaaaaacaagagctttgtgtgtttaatatctctttggtggctcagaggctctttagcttctttctaggttccacgcagtgcattagaaggcaagtcttctatttacacaatgtctggtatatagttaccatttcctatttctatctaggatctcacctggtgcccacccaccggtgttgatgtgtatctgcatgtctaatacacaacagcaatgagaccatgggcattccactcttaaattaggaatttcccccgtatatatactcgatatatatacgggggaaattccttatttgatatacagaggaaattcctatttaagcatgatcatcatttccacactatttattcaccattttatatatgttacttcatgttatgctcacaaccatctaatgagataggcactattattcccatttgctaggcactattaatttccataaagaaatttaaagctcagagaggttaactgattttcccaaggatatagagagagtaagcatgatgattaagaatcccaacaagtctggcttcagagcccatccagatggcgatgaaaagatctccaacaatggctataagttcaagtcacattacaaatttttcctaatgaacagaagtgaactctaaaatccacccatcaaattgaaatttatcacgacacatgcgtgagttaacaattctccaaaaggtaataatattataaccaccactgctactatccctcaccaggtatttgacatgcatcctctgaaatcttcataaccccctgccagactggtagaattattcccattgacagcggggaatctgggctcaaaacatcacagtaatttgcccaaggatgcagactcagtaagtggcaagagctgggattttaattcagctctctctgactccaatgcctcttctctttccaacatgttgagtgacccaagatgagatatatttaagggcaaactagtcttcaacaatatagtcaatcttcacaattcagaagattcttgtgaatctttcgcagcttcgaaactgagacaatgctggtctggaaatgaacatagctgggtggaaaccaggtttgtccagttaacagctgcgtgactgagtatgtgcataacctcactaagactgcatttctttatagtaatgcaatttcacagggtcttgacgtggattaaatgggataatgtgtgacatatgtgcaggtatcaaggtctgtggcacacagagggtactttaagtattctttctttaattattatctttctttagaaaatataaatatgaattgagatttctgaatgacagatttaagataaaacagctactattatacaagacagaacacagaatcttcgattcaagattaaaattgctgaaagtatcctagaaatcactgaatattcatttattcaccaacattaagtgagccccgactatgtgtaggaattgcgctaggcatgggggatcagcagggaaaagaacaaaatacggatgattatggagcacaaattccagtagaaaaaagtcagaataaaatagaaaagagtctaaaataaaacacaaagataaacaagaagaccatttcagagagttaagtgttatggttggagacagcaaagctccctcttatttggctgagaggaaaactgatctccaaaccagagaagggatttgattggccaaagaccccacccaggattaatggtgtgtctttgttctctagaccagcgattctcaaattttcacatctatcagaatcacctgaaagggtttaaaaacacaaatttctgggtcccacgccagagttttttattcagtggatctgctatggagcccaaaactttgcatttctgaaaagttcccaggtgatgctgacactgctggtccaggggccacactttgaaaaccactgccattgaggaacacaaccataccagaaagtagtgaggcagaaagagcagaggacaagtaccctaacccctctcctcctgccataccatctcctaccagtgccaaactccatcactaaactcagtcaggaatcagaatgcaaaagagtcgaggtcatgtagcctcctggaacccagcgcagtacagagaagggctccattaacacaattccctccccttgccccttttcacattaaagggttcaaaacctcactgaggcttcccactagtcctagtctccaagtgcctcggcatcccttgtgagttctcttaacctcaaccccgccacatgaatagtccctttgttaaagcctcttgacacacaggagttgaattctgttttctgttaagatccggagagatacaccaccagatcccagacagttccactagtgggataatttccaaaactgacaaacagctcttctatttcttcctaaagtaacagctataaaatgcaggtcaaatatcagataatcttttttgctacacaaatacaaatcgtatatgcaattcgcaagcccttgcacaggctgtgcagcaagatcactctaaatacagcttgtgggcctgggatgagcattagagtgaccgactcatcctgatttgtctcaaacattcctgcgttttcaatgagcactgaaggtcctatgtcctaggaaccatctccatcctgggcaaacgaggacaattggtcaccccagccacgcactcttatgttttcttgcatttatgatgcctccactgaactcccagcaatagcactataaccaaggatggctagtatttatggagcactttccatgagcctggctccttgctaagcatttgacatacctcacctcattaatttctcacaaccatcctacaagcaagttactacaatttgcctcatttcacagatgataaaatcgaggctcaaagggtttaagtagcttgttcaggtcacacatacagcttataaattagcacaggcttaacttgagcccacagtctgagatcagagtctgcagtcttttttttttttttttttttgagatggagtttcactcttgttgcccaggctggagtgcaatggcacaatctctgctcaccacaacctccacctcccgggttcaagggattctcctgcctcaacctcctgagtagctgggattacaggcatgcgccaccagacacggctaattttgtatttttagtagagacgggggtttctccatgttggtcacggctggtctcgaactcccgacctcaggtgatccgccggagagcctgcactcttcaccaccacatggttcatgacagagcagatggactcacctgccccagatctgattccataaggaaggaagattcagccaagaactaccaaaagggcatgttagaaaccaagcattaacactgcagtcacagagcggaaacttagaggggatctacatgttcttcattttaaggcacacaatgaaaaagtcaaccgcaaggtgtttggtgcctttggaaaatcagagataaaattatgcaggcccttatatctcagaatcagagattcttgcagcaaaatctgtggcattcaacacctgatgcatcctacaaatgcaaaagcagtcccatctgatgccttggcttcgaactcttatttgtaaaactggaataatgatcacctgtcttaaatccacaaggtggttgtcctgtggagaaagtaaactcaactaactctgtccagccagaagtgttttcctaaactgctgtgcttgcgggagccccagaggtccaaagtccacagtgtggggtgatccctggggtttggtatacggcaccttcaggtgctgggtccccagtgtgaaatcaggggcagctatatctaggggctcaacctctgttccaggacaggtgagggtccttccctcagaattacctgcttgtatgactgggatagttgagactcacttgttggggagatggagcttccttctgggaaagacagtctctctctcctgtacttcttattcccataaaaatcttctaacattcgacatcacatggtgattaagaacctggactctgaatgagacgaccacagtgtgattgtgaccaagcccttgaacctccataaaaccaattatcttatctgatacatgggattgctgtgtctgcctcatgggatcattatgagaattaaatgcagtcttagaatttccccaaagacatgctcattgaaaattctgaacaaaggctttccacccagtaatttcaaacaggacctaattttctccataagtatgaattttgcacagcacatggcacaaagtaagccagacagagagaacataaagtaatgcccaagaacacagaatctagccttgaattcctctggctcaagtcaagttcccacactgactagctgtgtgacctagggcttgctacttaaccactctgttcctcagttttgatgatcattatacctacatcataacagtgttatgaaaactcaaggagtgataattagtaaaacccttgaaaagtatctggcccattacaagtatttaaagcatgtaataatgttagtgcttcctatttggtagtcatttcatctcctgcatttattcctccgattttcagtttagatccttcatattcagcagaccctgctgcacctgtgattttcataactcttgaatctagtccctgttattatcgcccatcatccatcatttcaccatatgatttttccccttcttgcattttctgcttttcattccaacttgagccaaatgctcttctcctctgtatactcttttgggtttagaaaccttcctcccaggaaagtgaaaatccctgctgtcatattcgaatgtggacagttctaatggagtcactgtttgaaatgaacaatcctggaaacaggttgctttatctcctggacctggggatttcaaaacttattccttttgaacaaccaaaccatgagtagtgtcaaataacaaaactgatccattgggaaaatatattttaatatatttaatctttatcaaagatatccaatgatttggttttcagaacataaaataaaaatcctaaagtcagaggcctagaagtttagtctttaagaaacatagaaatcatctggacatttcacagatgggaaagtgatgcccaagttcacagcatctctaaacattgaaaagactgcgcaacattattctttgagtcaaatgtgcctttctgacgcctcaggcaaacctaaggccaaaggctgtcctatgaaagaatctctgctatttctctgggatgcgaggaagtctcctccatggagatgccaggaaagagaaagagacggaggtgtgacaagggaatagaactgatggctaagaaggtcccctccacgggccccatgcactcctgttcaaatgtctccctgtgtctgtgataaagttctctatttcccttcttctgcatgatgcaggggtgttaggattcccaagagaaatcctttacaaactcggaaataaggccttccatatagaaaataaaacctaaatttgtcttgaaaagatgacagaagcaaactgtacatatatttaaaattcctattatctgtaccttattaataaatcttaaatttcaagaacatctcttggagctgtgactgtgccactgcactccagccgggcaacagaacaagactccgggctctgactgtgccactgcactccagcctggcaacagagcgagaccccgggctctgactgtgccactgcactccaacctggcaacagagcgagactccgggctctgactgtgccactgcactccaacctggcaacagagcgagaccccgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagagagaccctgggctctgactgtgccactgcactccagcctggcaacagagcgagaccctgggctctgactgtgccactgcactccagcctggcaacagagcgagaccctgggctctgactgtgccactgcactccagcctggcaacagagagagaccctgggctctgactgtgccactgcactccagcctggcaacagagtgagaccctgggctctgactgtgccactgcactctagcctggcaacagagcgagaccctgggctctgactgtgccactgcactccagcctggcaacagagcgagaccctgggctctgactgtgccactgtactctagcctggcaacagatcaagaccctgagatatgattgcacagcagcacaatcatagctcactgcagccgcaaacagacatcactttttaaaggaataactgaaatgcagaaatattacaaagagaagtgcaattaacacctaggttcttctccaccaagaattatcaaccaattttaacaaattttcttaaagtatgttctccttttcaaaagcaacagaatatcacggacaaaggcaaaatgccctttatccaccatcctagttccatttttcccatacctcttctaaagagtgtagccttccattctgctttcaatgctgacataaacttacatagtttgattattaatacatatttgattgatgtatccattaaattacccctgttttctttccacagaagaacatgtggatttgcagatgctgactttggttcatgtaccagaaaatcctgatatttgtaaatagtccttaaatagatgcccagattattagtatgaggtcatccaacatgctgatatagaagggaagctgcatagcaaaaattgggatgcttctatgtacaagcaggattctgctagtttgaagaggtcactagacctcattagtaaaccatgaggccagaaaaagccagcccaagatatactacatctgcttcagctctgtgtagtcaccgcactcccataatatcctgtatttttggctaaataaataaaaaatgtataagtttgggagcacatacaaggtccttgccagataatctgtaacccatctgcaatgacgccattggtgtcagaagtgggacagacatgaagagcccaccacaatggccacattttggatagggatcagaatatcaaagtaggacacaatgagtaaaacatgcctaaaacatgagaatttgcggggagctgagtctagtggaatttatccatggttcttctcccttcatccatttggacctgacatatagtgaaagatggctgggacaaaggtagttagcacaaggcaaaattcctggaaccttttgtgtgagccaaagcagtggttagaactaaggatctccagaaaagatgaaaccccagaaggaggaaatatctgaagtttgagccaaaaatctatggatcacaaaaggatgctctcaaattagacatctgaaaaggaaacctggaatgggaaagataccaaagacccctagaatcccaggtggaacaggtggtcagcagctttccagggacaaatgataactgctgaggctttggaagtatgaggaaatgggaatggaataaagaaatgcttcaatgctcatcaagccaactctcaggcagaacaattgcaatacagagagatttacacaaagacatttaaatatatgttaaatatttcgtatgtgggaagaggaaaagataataaggataagaagtctgacttcatcaagtcaaccttcaataaaaaagtgacccatcaggaacctggccccgttacagttttaaactaaaaaattctgttttaaaatatgtgtatactttctaaaggcagcagtaactttgaaatttgttcaaattaattgcacttttccaacaaaaatggtgttcagagcatcaagtcccagaaatattttcctacttggaacagggatcttccaagaggaaaacttaaagaacttcattgagatggaaaattcaccttgggaagtatacccagaaaaagtttataaaacttctgctgaagcaagggtgttgtagtatctggatttggttgggtgtttgcgtgattaagctgggcatctcacaagttgaaaaccatacatttcctcttttccagtaggttccactgctccttagtaaacctaataaaaatgatctcaaaactgcaactgaagtgttagacagctggcctctacttcatcccagacaattttgtttaggggaagataaacaccctgaactggagccagctgagacacagggaggaagctggctttgtgcctggcttctttaaggctagaagctctgggaaaataactaatcattcctgacacccaccccgcaaccctgatttgagactgtttagaatcttggctcaaagttgtgatttctgagctgaaagccactcccccattccaatacacacactttctatttaaaaaggtgaaaaaataatgcaaaggttaagagatggtaaatggacaatcttaggcagaggaaagattcactgacaaagaaaaatgtaacagtcaaaacatccaaagctctggatctgaaaagagaagaaagactggacactgaaatggctttgagctcaaagctgcaacagcagagcagaacaagttccttgacccaggcctgttaagtgcatttgtgcaggttccacacaacaacaggcagcagccctgacctagacacctagaacatggtacccccacctccctcacacccaaccttgcactgccagatgtagcaagactgaaggggacaggtaataaatgagaaactgctcaaaaacccaagcccctgaaagtggaggccaaacacttccccaaggcagatgaagggtgaactcaaggtgtcttagagcactcgttcccagggtcaccttgtagaaatgactcaaaaggacttagggttggaaccatcatacattggtgcctcttctaccaaaatacagatactgcctagacaagaacaatggggatctttggaatcaccaccacccccgaatgaaacaattaaactgtaaaaaccagtaaattcttgaagcacatctccaccagaagtccaatgtctggtcagcccatttagattctgacaaaacatccttccttcactgcaggatctcctggggccctaaacacagttaccttgaaaagaatattgtgacagtttcttctgtgatgactgtactactgccacaacaaccaaaaccaagagttcaggcatgacgtgtttcaatccatataataacttacgtgtttacatcagactttttaattgctataacttatcatattctctatgttagttttatggagcccatttttaaacctctggaaatgggttagaaaggtctaaaataagcgccaattttaaaaactgggatatgtacatgtaataaaaatattaagtttcagctaaattatatcatagccctaatctattggtgttttttataaattggtttttgtggaacttagataccagtgtaaaaattgtagtcttacaaaaacacagtcgtacttcaattttgggggtaaaggttgaaaagttttctgatggatcttcatattaattcacttctactttctgacatgcctaattaacttctacaaaacttaaactaaatcccttctgagacactaaatctctctattctaaggcctttaaagagtgaaagcctgacactgaactggcattagtgcccccaaaataaaaagaattaaaagatctgaacacacttcaaaggttatatttgtatttttctccaagaaacaaggtttcccacacttgtgtgtgacttcaggttcctgtggtgggcagctcctgaaatggttcccaatgacccccacttcctggcattcatgcctgtgatggttaatcctatgtgtcaactcggctgggctaacagatgcccagctagctggtaagatgttatttctgggtgtgtgtgtgagggtgtttctggaagagatcagcatttgcactggtcaactgagtaaagcagatggccctccccaatgtgggtgggcatcctccaatccactgggggcccgaacagaacaaaaaggtagagaagggcgattctgctctcttggcttgagctgggacatccatcctctccttcccttgggcatcagtgctcctggttcttgggtgttcagactcaagtcagagcctacaccatcaacccccaaattctcaggccttcggacttacatcatcaactttcctgggactccagcttgcagactgtgggacttctcggcctctaaacctgcatgagccaattcctataagaaatgaatcaatctctctctctctctctctctctctctctctgcccccacctccctcccttcctctctctccctgtcatatatatatagaaagagagggagagagagggagagagggatatatatatatatacacccacattttttttttcaaacagagtttcactcttgtctcccgggcaggagtgcaatggcatagcctcagctcactgcaacctccacctcccaggttcaaacgattctcctgcctcagtctcccaagtagctgggactacaggcacacaccatcatgcccagctaattctgcatttttagtaaagacaaggtttcaccatgttggccaggttggtctcgaactactaacctcaggtgatccgcccacctcggcttcccaaagtgttggaattacaagcgtgagccaccacccccagccaatatataatatacatttaaaatgtgatatataatatatatgccctattatatattctaatatatatagcctattggttctgtttctctgcagaactctaagacaacttccttgtgcaattccttccccttgagtgtgagctgaacctagtgacttgcttctgacagaatatgacaaagtgatgtgatgtcccttcccaaattaggttacaaaggactgtgacttccatcttgctcacactctctccggctctctcacttgctcactctgacaaagccagctgccacactgtgagctgtctgatgaagtggcctgtgtggcaaggaactgagcgtggcctctagcaaacagctcatgagagacggaggtcctcaagccaagagcccgtgagtaagtgaatcccgccaacagccacggaagtgaacctggaagcagacccttccccattcaagctgaactgactgcagcctgtgaggggccctgagccacacgacccagctatgccacacagattcctgagccaaagaaatagtgagacgataaagccactgcattgggggagtgacttgttattaacagacaattaatatagctcctttagaacaggagttgggcctacttttccttttcagaaagttggtgcccaagaaagaaacatggacagccgggacctgactctggacctgacactgggcccaggcacttggaggccaattccaagatgctaaagaaaaaaagacacggtgacctcagcttctcagtaatactcactgaaacacataatatggcaatgtggcaaaattctttttaattagattaatgagttatcctattcaaactaactttacaaaatcaaagagataaacaatcataaatgcatgctgtttaaaacctctttcttttctatccctaatgccaccagctgttcccattttaccctgctgtatgccagtgttcaaacaaaacaccaaaaatatgcacccagattccgatgttcccacaacaaagggactagggctctttaaataataactactattataataatataataaataataacaaaccaagacgtgggcctgaaaatccttgttgtcactggaaaataaggactctctcaaggaggtctggaggtggtaaataagaacctggtttgaaggagcttccaatagccaaactgatcacttaagggggacacgcacaaaagcataattacagtcaatcagaggaagtcaagatcacccaaggccactagtacctgtgatgatccaacatgaagcactgttttttaaaagtcctgcttgctgatgtgaacccattcattcatgctcagttacaaagagacaaatgcgtgatccctaagggatgactacataaccacccaccaggaggtcagggaggaccaagagaaatgggtttgtggtcttgtgtctgctcctagaaccaacaggataaaagggggagtaaagcaaaatgaggggtggtctgagaagaaacaggtttccaaggtcctgggaagcaggagctggaacataactgtggaacatgtagtcggcagcactgcattcttccacagaaaaggataagctccacgacgctaagaaagttagaagtttgcaaacatcttccttcttttttttttttccgagacacagtcttgttctttcacccaggcagaagtacagtggcatgatctcagttccctgcaacctccaccacctgggttcaagcgattctcatccctcagccacccaagtagctgggattacaggcacatgctaccacacccggctaatttttgtatttatagtagagctggcatttcgtcatgttgaccaggctggtcttgaactcctggcctcaagtgatccatccacctcggcctcccaaagtgctaggattacaggcgtgagccaccactcgcccggccgtggtttgcaaacatcttttaagagcagcgcttgaactattagcgtgaagttcctcctgggtgttgatggaagccccctacaaaggcagagacaaagctggtgctgagctgttttctcctctgttcatcaaaccaaaggcgcaaaaaaaacaaaacaaaacaaaacaaaaaacgttgcatctgctcctgatccaaggcacttctactcttctgttaaatctctacatccttagcttaatgagaaaagaaatgaatgaatgatctattctctcccccacaaatccataccctaccaaaatattcagggtaaaagttattcgtgtctttaattttaatagacattgccaaattagcactcagaaaggctgtttcaattttcactactcaaaaatgaacaaagctacctaattgctcagatccttgtcaagacttgatagtcttaaacttttgcatttttgccaaattgatgaggggaaaaaatgctacttcatagatttaattcacagtctaaagagcctttcaaagagcgagagataatgctttgcaaattgctaatacaacaaactattttggaaactagcaagagataagtcatagtaacgccatttccttggtgcctgttttctgccggggaccaggcttgacaatttacaggtattatctccagctcttgcagcaatgaggcatcagtagccccattttacagatgcagaaaaaaagatgcagagcactgaagtaacttatcaaggccacatcacaagtgcattagggagctgagatttacacataagtctaacttcacaaaggcccgtggtcaaataaaagttttaacagctttagtccataaaatttcatccatcatcagggtactattctataccttttaggaaatgcagagttacacgaccatcaccaccttccagtttccaagtcaagaaagttagaggtttgcaaacatctcttgagagcagcatataaactgttctctcaggctcgcttcctataaacccctgctccatgcccaaccctaggcaacaactggtctgctgtctgtctccatagatctgccttatctgtgcatctcataaaatatacagtctcttacatccagcttcttttgtttagcataatgttctcgaggcccatccatggcgtagcctgtatcagcagttcattcctttttattcctagtcatattcccttggagggatgatggacatctggattgttttcaggttttggcttctgtgaataatgctgctacaaacattcatgctcgtgtctttctgtggacatatgttttcatttctgttgggtagattcctagaagtggaattgctggattttatggggagtgtctgtttaactttttaaagaaactgccaaactgtttaccaaagtgactccaccattttttattccctccagcatcaaacaaaaattgtcaactgaatattcaagaaatgtgagactttgcatctcttccacttatgctccaggggacgtgtttgtgtgtcacacgcactttagcagcctggcttcagtgtgagaaaaaattaagtctgccacactgggggactgcttcaatttccaggtgacttaccagtctgaaggtgcatctgatggggtttctgcacagcccttccgtgtggatatacctaggaaggactaactgaaataatgctcacatttgaagataaaataggccctaatgggccgggtgcggtggctcacacctggaatcccagcactttgggaggtcgaggcgggaggatcacaagatcgagggattgagaccatcctggctaacacggtgaaactctgtctctactaaaaatacaaaaattacctgggcatggtggcgtgcacctatggtcccagctattcgggaggctgagggaggagaattgcttgaacccaagaaatggaggttgcagtgagctgagatcacgccaccgtgctccagcccggcgacagagcagtgagactctgtctaaaaaaaaaaacaggccctaatgatcaccatgcctcactgacacctctttccctgtcccgctgtattgacacatcgattcccatttttcatggttgacttctgttacgtccctttggaatgtatatctagaatcctcactgggtccctctgtatcctctttagcacctgcaactcttaccaatagataataaataaatgccattatcctgctcatttctgcctctactggcaaataaaagtgtccagcaggaccatatgaaatgctgaaacccatgatcctaaccggtcaccctaacccacctggacacacacactattgatgaacccctgtccctgtggctgtatctgatttttgttaacccattgaaaatatgtggctttcttcctctccatactaatctgaatccattctgtaagatttcatgagacacgctaactgctttctaatatctatgtggtattgcctcctggacccaattctgtaaggtgtttgcaaatgctattatacttgtccgacatggtttgttctcaataatctcagagctttttaatttatttattggaatgccatggcccttgtttgttttcttattctttgcttgtttatcaagtgcacaaagtatctttttcccccacagccccagagtgctgtgcagttgatctccaggttagggaagagcagaggacagagccgaaaagcaaggaaggctgcacacgggagagtgtaggaagggaaacagaatgcatccaaatgttgtgtcctgacgcaatatgtagccatttgtggtttatcaacacttctaagtcagagagtaaaatatgcctaaaagtcaacattccctatttaaacccttgaatggccagatttactagtgtcatctgttggcaaatttcattggcaatctctttgtaaaagcagttgcagggaatcaagcccctgaaaagaggaaaaggaggaaaactgggtgggcatggtggctcacacctgcaatcccagcactttgggaggccgaggtaggcacatcacctgaggtcaggagttcaagaccagctggccaacatggtgaaaccccgtctctataaaaatacaaaaattagtcaggtatggtggcacacactcataatcccagctacttgggaggcggaggcaggagaattgcttgaacccaggaggcagaggttgcggtgagccaagactgcaccactgcactccagcctgggcaacagagtaagactgatctcaaaaaaaaaaaaggaaactaaaaatcatcaccaaacccagccatctcatggccagttcactatttagcataagactgatgccccacccgccttggcctgtgcacatacacctgtgctgaggtcagtaacagacaaggctcctcttgggacaaagtgcctattatgtaccaggcactcttccattcactctgcatattgcatcttatttggttaccacaaagtccagcgagacagctataattatcctcactttacaaatgagaagctggggagctgagaaggtaaatgacttgcccaagccggcataggtagaaagaagcagaggcgggatttaaactgaggacttcagatgccaaagctcatactcttttctccaaaccaggctgcctcctgagttaaattcccctgcgcccaccctcgcccccccattatagctgccgtgagactctaccatctcttcaccatcatcagtaaatatttatcaaggaccaccgcctacacagcattgctcttgtttccacagcaacacactgtcacggagtcaggggagtatcctgtgcttgaaagagtgatgctgtcatgtcctctgatcgtggctgtgaaaggtgacagctatacgactacatggaataccatctcagctggcagcctgacaccttcaagagctgtgctgagtacaagcaagaagaaattaagttgagtagaaagagagtcggttgtaacccaagaatatggtctgcttttactatgtgtttgcgattgttgctggaacagaatttaagccacgtttgcacattaattgttcttttattaggaaacaaatcaagcaatccatgacagaaagtaaaattcgactgtactgctaacagttccccagaggtatccaacggtgattattgagttaaatgactacattgctaacaattgcaattgcaagtcagtcccctataagatacatttttgctctcaatatgtggattctgaaacccactagtaaatgaattcattatccccttattcatttaactgtctctctcttcccccatcccaaatcatgttttgccacattgttaagaggctgtttctaaaggttttttgtttgtttgatttttactatcattccttccaaaaaccgtcgtggctcaagaaatatgtcttagagtaaggaaaaaggaaattgccttttgatgacaagcttccgccccgacttttggacactgagaccaacatgttacagcaaaacatattagcccaactatgttatggatgtaaccttataaattgaaattgctttcaagattgggaattttcagatcaaaagaacatggaaaacacactacttagttttaaaatgtatttgtccaaacttgccaaaagttttaaataaaatactttaaaggaaatcaagttattgtcatatttatactagatttgaaatactaacaatttctgaatttaggaataaaataagataagtccatttttaagtcaacatttacagtattcttgttttgacaaatacagatgttcatgaggaaccctggggaaaaaaaatctaatttagatggtctagttgccgttaaactggaaaggagaggacagatatatacagaaaatccccatttctacaaatgtgtgaggcttagaatgcaccagttctccaatacaagctaatcccattcgtttaaggagcccctggcacaaaggcacccacttgctaaatatatgctatatcgcaggtttgcagaaaccaccctgcccaggtagacccaaaagaaccacagatttcttcccaaaccatattccaggatttcttttctttctcctgcattctaaagagcaaacaaagaaaaggtgctcgctcctcacacttctctaaatgttttaacaaaaggctgctgaataaacacattactcatttaaaaattgaaaagaagttctattcctgatatgaaagcaaccagatttgcattttaatagttgtgggcgagcgccacctggcgggagcatccggaacgggcggcgttcagcactggacagcttcccgagccggtacgggttttaccgcttgctacccaagaacgattcgagacccgtgatggaatatttttgatcctgtttctgccgcgggaacgtgagtggtattaatgtgtggttggccggtcatgccttagaggatataaaatctgagtcacgaatcatgcctggatccccaggactgccccgggcatcctccctagtacccctccctcccctagcacacctaacacaccccccaaaatgaggaaaacaagaattgtgcaccatctttagaatggtgctgtagctgtccctcttctctcacttgctaatccaacctttcagcttcacacacctcaaaaggagtgtcttcgtcacccaacttcccagccagggaaacaggctgtcccttcacagaagtcgcctattccgcttccattttagtaccaagcaaggaaggctctaaagcatttccaacggaatgtccttccagcggcccttaacctcagacgcagcttgtgcaaagacgctgtacctccccacaggttcgttcttttgctctttctttcttcctttccttctttcggtgaaataataaatgggcacagctgttgcttagcgatccgaaaccagcctgttcctgcgtcccacgggctgatctcagcctgtccccgcaatcccagccacctcaggccggcgtggttacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccgggcgtcggtgccgctcctcgtctcgccgccccaaacactcaagtggcagattccgacaagtgggaggcagcaagtggaaatattcgcaacaaccgcggaaagttactccagcccggggggccggcaggaaactgaagcggggaacttcgccaaacgcgggctgccgagggacgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggagg

SEQ ID NO: 220 - DNA, 1117166 bp, Homo sapiens; identical to SEQ ID NO: 219

SEQ ID NO: 221 - DNA, 22818 bp, Homo sapiens
gcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggtgagtgcggcgcggggtccgaccggggcccccgggggcccaaactcgaagcccctctctggctgctgcgacgacggcggcccagtgggtgggccccgtggggtagcggcgcgctgcctctttcgctccgcgcggccgccggcggcgaggccagacctcgcagcggcccctccctgtttccggggccgggccctttacctcttggagaggctcgggccgcctgaggtcctgccggccgggcggggtgcaactccgtactgtgccgtaagggacagcggagccggggatcccggaccctccctcactatctgcttcgggccccacgcgacccctccctgcgtcttggtcggcaagaacgtccccttcagccctgtcacctctgctccgtgctttctggtttccagaaattaaaatttaatcaaacgcggatgagttttctagccccagtccccgtgtttggctcctcctggatgagtaaggggtttaaccttgggagacagcagtgggggaaccccctcccattttgcagtaaaaccatttcatcatccttcactggttatggagcctggcaggacccaagattccctaggaagggaattgggtttgaatcaagaaaatctgtttgttggagccggttactgagtcaggccggatccccaggaaaaaatatcagggggtgagaatcggagtattttctcacagtatttaccgtcatttaatgccagattcttttgtgtctttaccccaaattcccccatattgtgtgttagcacgtttttcggtctgaaatttgcccggtggcttcctggtcggggggtggggagcggagggaagaagaggtgggaaggtgagtgcatctttgccgcaaatggagaactcccatataatggggttttcagaggtggcagccttggtaagcaatttgccaacctttctgtaaaatacatgtttcttgtcgttgccttcattgcatttctctttggtaaggctagatagcatcaggtcctgattttgcttgccctgtgtgggagatggaatttggcaagatgatgctatgaacataaaatcagcctcgggaaccaaaagagaaaggtgaagcacttataagaatatgaaaattgtctgcatttctcattctgtcagttcatgtgaagccagacacagatgcagtttgtagacctggacactgcagcttttgcattttcatttggaaatgtgtataagtatttgttcttggtgaatttcttcttgactgcttccagtgtaccctatttcttacttagggatatctcatttgtttgagccctcatttttcttggatccctgtccttggcaacacacggtgtgtgagtgtaaaacctgtcaatcttattggacctaagttagaaatttaagtgtggctttcaaaatggaaggctaataatcctgtagcaactgcagaattattttcctggcctgtccttccaatgagataagaaaccattcacctatcttgcagatgaagtctttatgagaaatgaggtgatttggcctagactatacacctagtttttttcaaactgaatatcctcattcatcagtagcaaatatttatggattgccagcccctggagtatgacgcctaccctgtaatcttttgtacatttcacatcttgcagtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcaggtaaatttggttgaaatcttgcctgcaatattttctagctttctgaatcttcagcatgttaatctctggttcttggttttcttatttccagggttatcattaagccttttttataaactgtaaattgttaaatataagcttttggtttgttttttaatcagagttcactattaatggctttttctctccagttaacatctgatgacactaaaccctgctttgtacacatgttgctttcaaaaaatggtatattattataggactttattttgcatataggcaaatccagtctttctgaatcattttctcgtctatatagcacaaatggtaatgcagcttttgatatatttttgttgcgacaagctcaataatgaaaataagcatctgggatatagttggggttcaatagatgttattgaccatctgcatgaatatacacgtgtatagattagacatagcatatatgctattcatggacatttatatagaatccatccatttgtgatttattcaccaactgatgaggtggtatcagacaattagtctataataatagttaccacttacagtacttactgtgtgctaagctttcttttaagcactttaagcatattagctcagtcttcataacaaccaatgaaaggtaagactgttagccccattttacagatggggaaactaaggcactgagaaggataattttcccgaggtctcacacacagcgcaaggtaagtgccagaaccaggaatgaaaccaggtgatctggttctgaggaatgatattatagatttctgcatgtggtagagacagcacatgtatatgttttatgtgaacaccatttagtccttaatttttctttacaccaatcctaataaagtaaacgtttgaatgggaatattagctatttttgaagatagatacaggacaatttattgtggagcatatacccattctggcctgtagggatgataattgctagcatgcatcaggaagcaagcttgtgaacaatccagtttttctagtacttgcttcatactagggagaaagtcatcagttactttggcatagaattttaggttcttcatctaatagaatttgattgtgaccattaatttttgtttatcttacgacttcatcagtagatgttcagatttttctcattttgttggcagggaggaaatgaggaaatatatctacgtaaatagagagaaacttctaaattaaaacatcctgttgtgctacctgctctttcggtgtcaacaaactgagttttcctttaaatgctggtaccttagagaatgaactaaaatttccttgtagagatacttttaagttccttgtttctacatttttctagggaaagatgacaattcactagttaaggggcaagaaattatggttacataatagcaacctttaagctttagaatccttttgatctctatgtgaatatgatcttagcagtcatctgtattgcatgatggagaaactaacggttggagctggattctgagggaatttttctaaggggaatacttgaggaaacagactaaaagtgctttctgtctcatgatatgtgtgctgaaggccaatcatcttactgctttctcaactaaaagattttctaatagaggtgtggttatatgtatctgatacttgtaatgagatgtaaatgatcagtggcctcaagtcattcctagcagattgtaggttagttaactttttttttttttttaaattctggccagttctttattatgtaagtttttcccgtactggttagtttattttattgttttccctaaaagaaccaacaggaggttatttctgaatggccttgaccaggacaagaagattgaaggctacaataaagtagatatgagtcctgtctattattattatttgccctcagctaagagctttcctttaaaatttgtttgacattttggtaagtctttggcatgtttttatgctgtttttaactccttgattttgtttttatttttaaagctagataacattagcttaataggccagttttaaaatttcactgtaacaaccttgtatagttcttttaaaagttgacaattctctcttttccttaagtgagcattggagttcataattgatctttaggagatagggttacataaaggaaagagcattaattttaaaattaatgttggtttagatcccagatctgccatatatagctgtgtgaccctgaatgagttaactctttgcatttataaaacgggacaatgtcacctgcctcataggatacttaggatcaaatgcgtttctaggaatccctgagtgctttgcaggccataaatgatggatggatatttttgttatttactaaacgagttagctggtttgggtttctgtatagtgaactttttgtatagcgaactgattggacttctgaatggaggagatggacagaaagtaatccaaaggcttgttgaaagtcagtttgaatctataaatacaatgattggtagctgaaaaatattagtcaaaatgtatagtgttgctcctgatgagagctggctggcttttttcaaaaagtagtctaagacaataaaaacagtctgtattttataggtcagatgtgtgctaccttcctctgtccacgtaggaaataattgctttttcactttttaagaatgcatcagttgatcaagcagtcactcagtgtgctaggccttgtactccacattgggtgtccaaagatacaagtctggattcctacttttttttttttttttttttttttttgtgagatggagtctcactctgtcacccaggctggagtgcagtggcacgatcttggctcactgcaacctctgaagcccgggttcaagcaattctcctgcctcagcctcctgagtagctgggattacaggcgcctgccactgcgcccagctaatttttgtatttttagtagagacagggtttcgccatcttggccaggctggtcttgaactcctgaccttgcgatccacctgcctcggcctcccaaagtgctgggattacaggcgtgagccaccacgcctggctggattcctactttaagctcacaatccggtgtgggagccagcagagacacttgcattgcagtaaactgtgataagggccattttagaaataagcatagggaaattgttatgtgcctttcttttaaaagtctttaaagaaagcagagtacgtgtaaaataaatgaggtacatagtaagtttcccttcactggctgaccattggttttttaagttttgtgtggaatgtactgtggttgccatttatttgagtgcttactgttttatatcataaacaggtttactccttacaggaaccctagtaagtagatttgcctatgtttttttttttcttcacagagtcttgctctgtcgcctaggctggagtgcagtggcgtgatctcagctcactgcagcctctgccttcaggctgcctcagcctcccaattagctgggattacaggcgcctgccactatacccggctaatttttttatatatttagtagagacggggtttcaccatgttggccaggctggtcttgaactcctgacctcaagtgatcaccctcctcggcctcccagagtgctgggattacaggcgtgagccaccacgcccagcccagatttgcctgtattatggatgagaaaacaaattcacagaggtcacatagcctgtggacttggtgtgcggtactggtaaatcagactgataggcttcattatgtcagtgggccccaaactgtagaaattattcataaggtcaaccaattgggctgtctttatggatcagaattaacatagtgtcttttggattgattacttaagccaagaagtcaatttattgtcatatctaccattaagtcacatgtgtaaccttgcgcctgtcacttaacaccctcagtaagtttaatcatggctaattggacataattagcaatgatatgcaacagctgatgtgaaagagggaagggattttgaaataatagaaatgcagtttctctccaaattcagtgttcactggacttagtgctaatgactttgtattacagatatgctgtgttttgtttcctaacaaagaacctgcaaatgtttgaatggaattaaatttattacaggactctaaattttatatgtagaatggcacacagacagttttatagtgggtgttttttagtgagtagttttctctgagagccaggagtgtttaactttttctgggtaacacccactaaccacctggtcccactgactttctcagtcccttctgcagtagcttggcatctgatttttcttcagcagagagactccagaactaaaacttctgctgtacagtgctgtggatgctctatctggaatggtacatctgtgaatgctgttcagaatatgtgatcagttccttaccccattgaaacattcgagcctagatttttcagattttcttgtcagttttcttccttattctcatttctttatctgctttggcctttgatttttatctcatctagaaaaacatacatgcactttattaataacatctctttttaagtcacgacctagctacctttaaacctatttcctctagttctgtctggttggctttctaaggagaggcattgtaacccttaaacgtgtgctgtttttttttttaattgatgtgtaatagatatacatgtgctcttttcttgtgtttctaccactagagtttaagctctctgaggggaggactacactgctttcttttaaattcctctcaatgaataatccaaagagttcttagaaatttggtagtttttcattttgttagttatttcaacacacattggattatatgtgttacatttttgtgaggtagcttaagaataaaaaataagaatggcttatgagcctttactctaaccagcactatatgggcattttatgttcattatcttatttgatagctattaatgtctctttttaacactgagaaaacagattcaggtaagttataatgtggaaatgtagaaaaatcacctactttctctttagaagctcagatgtgtatgtaaggcttgctaaaagcagaccccaccgtatattttatatgtatagagcttgggtaattcctgacatataataatggagtcttcatctgaaatttctaacaaattattaaattcaaagcttattattttcgaatcgagcatgttctttgccttgaaaacaaaacatagctgaaagccagtgcttctaaaggccacagctgtcattttcaaccctttctgtctttgcactgcctttatttaaaaaaaaatggattagcagtaggtagtcttctttttcttttctttctttcttttttgattcttctcctaggatatctgctctagccactgggaaataacttctcagtattttgaccctgactagaaagatgtcccttggggaaggaattgggatagaggggctaggctgtttcctagatcctctattttcagcatttattatctgatttaggattttgtttctttgaagaaaatcctattttgtgagtacctttagaattatttttcatagctgtttatctgcactagtggtttctctttaaacagaaaaacactttttttcttaaaaaaagaaatagtacccaatttttaaaaaagtaatacatacttgaagaaaatttaaaaagataggaaaatgaggatataataatgttattacccagagacagaaccagtgttaaccatttggtgtaacctttctgttcgggtttgtttgttctttaggggatattttacagaaataaaatattgtgcagcctcgtccctccagcccccattgctcttaaataaatcttttcatgacattaaatctcttcttttgatggccacgtaatcttgtaccatctatctccttccctcccctgcctttttttttttttttttttttgagacggagtttcgctcttgtcgcccaggctggagtgtagtggcgcagtttcggctcactgcaacctccacctcctgggttcaagtgattatcctgcctcagcctcccgagtagctgggattacagtcatacaccaccccggctaatttttttgtatttttagtagaaacggggtttcaccacattggccacgctggtctcgaactcctgacttcaggtgatctgcctgccttggcctcccaaagtgctgggattacacacgtaagccagtgcacctggccagtctccttattttttaaaccattcccatattgttggatatttagatttgcttccattttttcactaagcaatctctgcgtttatcaacaaatgcttcccagtcctgacttgctgcatccagtggcttagaacagattgacagccatcatcatcatataggtgtgctggagagctcctgttctcaagcacgtcagtctcttcctgaaatatgcccagcacaaggaaaatctcttggcttactgcagggttgggccttttgtggcctctaatgagtttgcctgcgccagtatcttgatgcttctgcagtggtgccaggcctgacgatgagactatagtctttcaaaaactttttaggagacaaataaagagtatcttgctgactttttttttagtgggaacctcattcaaagtcttggaacaacagtaggtcttgattaaaaaccatcatggcatatcactagaaaattcaattagaaactaatggataaacttcagttacatttaacatatatgtccattttaacataacatactaactatctgtacaagattaatctagacttttgcttttccttctcacaaaattgtatatttaaaaagaaaattcaagcttatggttttatgggctgctacagtgtaatagtcgtggagaagaataatagtacttcagtttgattttgcactatgcatttttcaaggaagatttccacatttagtattctttaattccctgcgcctcatcttcacagcaactctactgaggtagatgccatcttcattttatggattggaaggctgagatttaacatgctcacatggctgtatagtggcacattgcgctgtgacacacagtcctgctgccttccgactatactacatataggtactctgtgttccttgtgctctcccaataatgatttgtagaaaaacttgatattcatttgcatatgagttttgtgcttagcacagttataagcattaaatgtgaaacaaacatgaagctttcctttgagggcacacacgtgaagctgtaagtggtacagtactcatctgtatcacagaatggcataaagaagtcctagaccatgtaataggctataagtatattcagagtcataggcaaggtaaatcagtgagggctagggcagtcagggaagggtttgtagccctagaagaatgggtggagttcagataggcaggcagtaaataggagagcactctagatgaagggaactacaaaagcagtttcagacacgtttgagcattgtgtttatagggcatgtggtgctggccagcctgagagaaaggtacatgttggagaacagtggatgagaaagccaaacaagtaaagaggagacaatttatcaggaatttgaaagccaggtagagcttaaatttgatggagtagccaaaagggagtcattggaagttactgagtaaggacaaaggcaagactagaggtaatttaggaagagtaattttttgtttgttttgagacagggtgtctgtcacccaggctggagtgcagtgatgcagtcatggctcagtgcatccctggcctcctagcctcaagcgattctcccatctcagcctcccaagtagctgggaccacaggcatgagccaccacacctggctaatattttattttttgtagagacaaggtcttactatgttgcccaggctggtcttgaactcctggtctcaagcgatgctccagctttggcctccaaaagcactgggattatagattgatctgccatgcctgactggaagagtgaattactctttgaatttcagagggcacagaaattcaagaaactaggtacaaatgtaatgaagatttaatatgcttgtgaggctaataggtgctttgaattatttgagaaaagggagaactctaccaactctgcagttttatgcttacatttcaggatcagtttgttcattcagcagatatttgttcctaccaattatgtacaggatgctgtgggagatatgtccaaaggagcttatggtgtaggaagggaaataggagacactatgtaagtaattttagtactgaagaaacgtggtaagacattgacaggtatcagcgaaatgctttgtgagaatatattcattagagcaatgccgtcccataggaatagaatataagccacatgtaatttaaatttttctggtagctgcatttaaaaatttttttaaagtgaaattgattctatctgtttttacttaacccattatgaacaaaatatgatttcaatatgtggcactagccacattttaagtgaatagccacatgtagctatggctatggcttaaacagcttaagaaaggcttcatggaagggatggtatctgagccacactgtgaagaatcttgtatgcagagtaaatttgggaaaagccattccaggtagagggagtggcttggtgagcaaagatagaaaagcatactttgtatgtaagaaaaccattttggcagaagcacatatgatgtggaaggcatgatgtgggggtctggaagataggttggcaagctttcactgataggggaggaaatctgactctgcttttggcatcagggaactttaaagaattttgagcgggaagtgacttgagcagagttataggaaaatgggtcttacagcaaaggcatggagggggctgtagataatgagtgactgaaagcattgccactagggcaagattttggatgggagatttattgtagatgtagaaataggaacaatttcatttctcctttgctgccttcctccaaactgctgggtgttgtgtaacccatttcctgttgaaattggtctagttgcttcaaaatccatgttatataagtcaaaagttatgtaagcagtagccatcaggacctttagctatggattttgtttgttgtaagttgtttctgtatgtgtataattaaaaatatttgaaacagataaatggatacagattttaaaaaggtgtgcattcagtccttatcttgccatgatggttctcaatctctaagaaatcttgcagtaatctcggagaagcttaaaatagctgaccccaaacagaaagggtgcattttattttgggaaatagggaaggcatatttgggaggtcccactgaatagtccagattctttggagtagtatgatttaacttttaatccttgagaaggagagaagtaaaagggggatagcttaattttggggcctagtagagctgaagaggttgatggcattatttagcaacggcaatcctttattactccattatgataccacatgggatggcttagctctgaattggcttttggccagtactttatgatttggagtaatccacaggtagagttgcataggtactgttctatgaactttgaagtgggcctctaagtgacttctaactttgagttagtctacagactggaaattttctgaaggttgttgggtcattgaaagttggcttctttctggtgtacctggcacttttagaaaccatgaagtagggttatttaatgatgaagatatttattgtcctgatctcaaagaccttatggtcaagaaagttagatatatgaagacagtggtcatcctttggtatccagggggtgtaggttccaggacacctggggataccaaaatctgaagatacttgtttattttgtgtttttttccttctttattttccaccacggttggttgaatctgtgtatctggaacctgcagatatggagggccaactatatatacttttaagatggtagagtatttttgatgtacttgtattagagtagaacaggttgtcttgtggtaaccaacagctccagcatctcaatgttttaacccagcaaaagtttcttttgttttcaccctgcgtgtccaatgcaggtctgcaggagtcttgcactatacagtcacccggggactcaggctgacaaaaactctacagttgcatgactgtaccacctagaatacatggccttctcagtggctgctgtgagggaaaagagcctggggaggcacacgtaggatattcacagtgttagcctggaagtagcgtcatttctacttatctttcattggacagaactaccatgtggcctcttctgactgctgtgggggttctgggaaatagaagggaacaaatggaatgtttcttgaggattactctctctgccttagttttattctagtgttgtgagtgaagatgtcagatggatcaaagtgagacttgcctcactgagtgtaagcttacaattagtgagccttatataagacacagctctgcatgtgatttagataataagcagtaggaagaaaaattatagttatgaactggagaatcaattctttctgaatcacctagattttgagtgtatcttattgtgctccctaaaacatttttaggtgataaggccctgtgtgtagaatttctctcttgaaaatacagaaatgacttttgaggcaaaatcattttgtgagtggaggtcatactttcttgttttttttttccttttttttttgagatggaatcttgctctgttgcccaggccagagtgcagtggcgcgatctctgctcactgcaacctccgtcttccgggttcaagcgattctcttgctcagcctccccagtagctgggactataggcacgtgcactgtgcccagctaattttttgtttttttagtagagacggggtttcaccgtgttagccaggatggtctcgatctcctgacctcgtgattcacctgcctcggcctcccaaagtgctgggattacaggcatgagccactgcgcccagcagaaaatggttaatttaaaaatagcaaagaggccaagtgcggtggctcacacctgtaattccagcactttgggaggccgaggcaggcagatcacctgaggtcaggcgttcaagaccagcctgagcaatgtagtgaaaccccacctctactaaaaatacaaaatcagccgagtgtggtggtgcatgccagcagtcccagctactcgggtggctgaggagaatcgcttgaacccaggaggcagaggttgcagtgagccgaggttgcgtcactgaactccagcctgggtgacagaatgagactccgtctccaaacaaataatcattttcagagccttaaattgtgataccatgtatgtagtaatgaaagaatttgttttgaaaatactggcattggctaggtgcagtgggtcacgcctgtaagtcccagcactttgggaggccaaggcgggcagatcacctgagtttaggagttcaagaccagcctggccaaaaatggcaaaatcccatctctactaaaaatacaaaagttagctgtgcatggtggcacgtgcctgtaatcccagctacctgggaggctaaggcaggagaatcacttgaaccctggaggtggaggttgcagtgaaccgagatcccaccactgtacttcagcctgggtgacagagtgagactctgtctcaaacaaacagacaaagcacacaaaaaaacctgacattactactactgtttaaagtagcatttcatgtttttatagctcaggatattagtgtatttttatactgtgtggcacagattgatatatcaatatttaaaccaacagtacataaaattaactcttcttgtttagtaaataacttttcaattattttatccaaaaattacttattaaaattaccgcactctgtaaatggtgattattgcagtggggaactgactgtggtgagttgataagagatattcactgattggcatatggatttgataaattgataaactgaagtcactaggatttttgtctatttcagaaaaactttaaatgaactcagttatggttcagatgaattcagttatggtttcaagttatgttgctgtacatcttgttatacacccctttctcttgcaacctataccatatacaaaattagtgcctgatatttttatataatgctttatactttttaaggtgccttcacatgtatcaggtcttttgttcctcataacaggcccactaaaagagttggtagtgttctttctttttttttttagagacaggggtctcagttggttgcccaggctggaatgtaatggcacagtcacggctcactgcatcctggaactctgggctcaagtgatcctcccacctcagcctcctgagtagctgggactacaggtgcacaccaccacacccagccaattttttcttcttttgtagagatgaagtcttactatgttagagactgatttgccaggataatcttgaactcttgggatcctaggcgtgagtcaccacatccagccctgggtagtgttcttattgcccagtagagaccgaagctctcaggttaagtgatttaaccaaggtcatgccacttgtaagtaagtagcagagctagtgctagatagagcccaagtctgactgcccttagtttatgttcttcctgtgcagtgtgtcctagtaacaaagttagcagattacagaagatgtgatataatctttcccatccttcagttatctactgcttgatgggtgcagccaaatagatcatttaaaatcatatcttttgcttcaggattggttgaaacaaacatcatacttactctttcctgtactatggaaaaaacaggtttagtcaaaaccagagttgcttacaggacagtgaagagaggacttcctgtattacaggatacagttggattaaggtcattaaaacaaaccagacaattactgagagaagtcaaggacatatatatagtaagcataaactttttttttgagatggagtctcactctgttgcccacgctggagtccagtggcgtgatctcggcccactgcaacctctgccttttggtttcaagcgatcctcctgcctcagcctccccagtagctgggattacaaatgcctgccaccacgcctggctaatttttgtatttttagtagagatggggtttcactgtgttggtcaggctggtctcgaactcctgacctcgtgaattgccctcctcggcctcccagagtgctgggattacaggtgtgagccactgcacccggctagtaagcataaacttctaaagaaatagttattaagcagtctgtatgtgccaggcaggtgaattaggctaatggaagaaaacaaaagctctagagccagatagatgtgagctggagttctggctctccaccatctatttgcatgttgctctgggcatatcacttgccttccctgaccctccatttcttcacccataagaaggggaaagttgttgttatgaacatacctactctgggactgttgggaagattactggaccaaaataatataaaggccttagcaaagtacttaaccctagaggtgtttgatatatcatcaatattgttgatggcatttggaatgagatgtttcacatttagtatgctgctttccagatgggttggaagaagattcacacacgtttcctaggccccgaaacctgacatttgctctttctttttctcttgctcttgttctagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtaagaggccagtgcttctgttttgaacagtggtttctaaatagtattaatttaatgtataaatgcagactctcaaaacagcttatgagagagaggtgtctgaatatactggaaagctgccaggtatttacaactaatttttaagcatatgatataatttgtgtcacctattgcctgatcagaggttgtacatcacttctgagatactttcctctcctatcaaaaagacctgtgaaaaacagtgacattttttcagcctccctccatcttttaaaattgaggccagatagacaggattttaatagatacagctacagataggctattgtgtatattagtcagagtagtgatgtcatcgccagtaggggagggagatgaaaaagctgagctgcctttcagcctctccccagtcatgccttcacactgtaaagtcctgctttggtctgaaagttaggcacatccatcaagttcggcatgcattccagagccaaattcaaagtgttttgggcattctcctctcctgtattttacataaacccttagtcagatgattgattccctctggccgccacttgggattgaatgggaggggtacgtactccaaaacaaatcataatcatattgtctttcccgcacatcctgagccattgggaactttctttttcttccaggtgaaatcaggtaaaaatgaactcagcgagggctgctttgaagggaaaaggaattcacacttggggacctaccaccttccctgctggctgcctttctaaattactgcccatgactcctttcttttgaaaaccagtataaagcttgtcagccatcaggcagcaccccttatccctaacctattaggagttacacactgtctgtctacaaagaatattaaaacgactgccgccccctgcatcttctcactttggttgattaaatccccttataactaagctttgcattgagcttctctttttattagactcatggcgtaagagtgtcatgactaaatttgttgcctgttggtaatttgggggtttgttaatggtgcactaattcctgaatgttaggtacatctggtattcagatgaagtatgtcatgcattccaagggcaagaaagttccataattcatgaaatgtagaccaacttttaagagcatctgaaagaatgtgaagaagagcttggtacttactgcctcttaaccagtttttcaggatgccacattctaaaacaactcttcgaaaatattgctctgtatacgaagcttggactccttcagaactacttttgttgtaagcataaatgtttaaaggaatttattattaatagtattagctactctttgagtgcttactacgtgccaggcaacgtgttaagcgctttatgtatgtcaacttatttatcattataactaccctagaagatggctataccctagaagatgacccttcgtatagctgaggaaagtgaggctcaaagtgattaggtaatttgtccagagtcatacagataataagtggcagaagagggatttctacccaggtcagattgactttaaacttagttcttggcagttttgctctattatcacctttttcctcctaaggaaagatattttttcccctttaattatagaagtaataccagtttgtgggtttaaaaatggtggggggaacaagtcagaagaatataaataagaaagtaaaaatcacttctaatcttaccacccagagaaccattattaacatactccttccaggcttttcccttatatatttgtgagcatgtacacaaatgtatcttaatgttaaaataggattcttgtggtatttataatctgctttttttccactcagatttcttttgagagcctttccattatctgtttagctctgcatcattttaaaggcctacaaaacatttcattatatggctatactttaattatcccctatggatggtcaaagtgatttttaacagaagaatacaggcatctgctgttatgacctgggctaaacaacatttagtagcttggatgaaaaattggtgtttttttaatcttccaaaaaattatttagaagcagtagtgtatatcttgaatctcaaacatagttttaacatctcgtgaataattctaaattcttaacaatgttcattttttaggagctgttggacaaatatcttattcccaatgctacacaaccagaaagtaaggtgttctacttgaaaatgaaaggagattattttaggtatctttctgaagtggcatctggagacaacaaacaaagtaagtaatatctttaaaaagaaattcgaccagtaatggagccagtcttctttcacagggactttttaacgatttttgctttgttcgccatagacaccaatgtcacagtactaagaatttaaaagaccacagcattgtgacgaacggggtcatgggcgggcaaataaaaatttatctgacagggaagtatggagggcattacaaacctggtgcgcagtgtatttaaaaagatcttatcttgagtattatttgttagctctctttttagcagtgaactttttatacttggtggtacgaaactaccctagtgatgcattgcatttatcacatgtattaccgtgatggtggtaatcttaaccacactttattaagtgcttctgtgccaagtacttccgagtctcacttactcttcacacagccttacgagttaggtggcaggctgcccatttttcatataaactgaggtttatggaggtttctacttgccccaagccacagacctagggagtaagagttgggaattaaagtttggatctatcgactctaaagcctgtgatgtttgcactagaatgtatggtttttcacattctatattgttaaaggttatagctgtatttaactgctttagtagactttgtcataattgttttcccccaaagcatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctttgggccttggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtgccttaaagttccgtcacttaaatcagatttagtgatgtgagtttccagacattttgagttttagtttaaataaataaataattttaaatagaagattgctagaaaagtctttggtaattaaaaaatcacacgcgtttgcccagaatgactgtgctagggttagcagtaatactgcttagttattaggtacagcaaagttcttaccttggagtttctgtcattgttggttggtgctttgtaaatatgccttatacttctgctggaaacagctaacagacagggtaataatagcctaggttcccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagtta

SEQ ID NO: 222 - DNA, 22818 bp, Homo sapiens; identical to SEQ ID NO: 221

SEQ ID NO: 223 - DNA, 29260 bp, Homo sapiens
ggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacggtgagccccggggatggggcgggaggggaaggaccgacggacaagcaggcggacagacagaagccggaactgggccgcttgcgctttcatcttacactttgcagccggggaaactgaggctcaaagataacagggcgttggcagaggcctggcccctgagacgggaattggtaattagtgtggtttactgctattcctctacagaggagagagattagggtcgagtgaaaacagatacaggctttgtgggggtgggggtgggggtcaggcggaccagggatagaagcccagcagccgtgtgactctgggcaagttactcgaccattctgagcttcagatgcgtgtctggaaaatgggggtcctagctgccttatagagtgcttgtgaggatgagagattcaaagcacctggtgaggaagatgcccaaggcaacacagctggtgagcaggggaggcaggagaacccagccttgggctcaggcctttcccagcgcgacgtgagatccacactgggcgcctctacctgcacgggctctgaaaaaccgctgcctccaggccgcaaggccgctttctcagagctgatagcattgattagagcttgtccgatgagtttgcctgcacttctgttgagagtggagaggatgagtgagcttgggcaagccttcacgctctgcaccttttcatctgcaaaatggggctaaggcgtattctccaataacataaagaatggagaactgctgtctatgcataaagaatggtaactgcttgttacctcgtaaacgctcttaagtggtaacctaaaataaataaataaataaataaataaataaataaataaataaataaggccaggcgcagtggctcacgcctgtaatcccagcatcttaggaggccgaggtgggcagatcacttgaggtcaggagttcgagaccagcctggccaacatagcgaaaccctttctctactaaaaatacaaaaaatagctgggcatgatggcggacgcctgtaatcccaactgctggggaggctgaggcacgagaatcgcttgaatccgggaggcagaggttgcagtgagccgagactgcgccattgcactccagcccgggcaacagagcgagactccatctcaacacaaaacaaaacaacaaacaaaaaagaaacaacaacgaaaatagtggctttaacattctgatgtaagactccagaaactcacccaaaaaatggccggcgtccactagagggatcccttgcgccaggtcgcctgggtgaacctggtggttgcctgagtgggtggtttgctagggaaggggttgttccgccgggcctgttccccgccccttactgggctggattcctgggcacttttctgtttgttctgctttgctccacctcctgcctcttcccatcttcctccaagccctgtgaatgaagtgggactcggcctggaaaccgtgctgcagagagaagggttttgccccaggtatttatgataagactaggtggagaatccgggcttcctgaaacttgctccactgtgttccccacagcccccttccatgtctctgcactagcagactccctgaaacaggtcacgtgtatcacccaggagagacacaggctgcagcagtggccggaggctgggcatcggctgctgttttgagacattattttgtgtcaggcacaaagttacaaacaaggcacttttacataccttctttatttttcagtccctccaacaacctggtagttggtagtatctccctttgttaggtgtggaaaagtaggtaatattaccatcattccccctttacaggtgaggaacaggctcagagaggtaatgtccactttccccagagccggactgcttgagatctaacctcagctctgccctgcagcacctctgagttttaatttcctcaaagtgctgccaccccttgtcatatggacattgttatccactcagtgtactttagaatccagaatagacctgacgctgccacagacctttcatgtttcttattctcagttttcccatctgtaaaatgaggggcaggaatccatgctcatgtggctgcagggagttggttgaatgagatcataactggaaggttgggggagcaccatacacactaattctcagcttatccttcctgagcctttgggctcttatctcagttatttgggctcttatcttggcttattgtctgggacccagacaatgactttctctttattggctcccagttaagcacctcgaggggtgggtgatcaaggtaagaaaattccctaaacttgctaatttctctcctcttccttctgtccagcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtagaggatgaagggtgtacgtctttgggtagatcggtgtcaactacctgcctggtagaggggtgacaagcaacacctcactttacagtttacaaggtcctttcagtcaagtttcaggtacagcaagcacctgaatgacagccgttctttcagtttcatcttccgtgaatgaccagacattacctgtgtatcagtcagctctcgctgtgtaaccaccttcaaatttagtggccgtcaacaacaatcatttatttagctaataattccacagttggcaatgggcaaagttcagctgggcagttcttctggtcttggctgggttccctcctatgcccactgaaagctgagtgggagctctcgctgggtatatgagggagcgactggctgtcagctggaacatcttggctttcctccctatggccttttgtcctccagtaggctagtccaggctattctcatggtattctcatggcaatggcaggggctcagaagacaagagtggaagcacaccaggcctcttgagaactaaatgcagaactggaaccatcacttccactacgttttttttttttaattgagatgcagtcttactctgttgcctaggctggagtacagtggcatgatctcagcttactgcaacttcctgggttcaagcctcctgagttcaaacgattctcctgcctcagcctcccgagtagctggaattacaggtgcgagccaccatgcctggataatttttgtatgtttagtggagacagggtgggtttcactgtgttggccaggctggtctcgaactcctgacctcccaaaatgctgggattacagccatgagccaccgcacctggcctctttcactacattctattgaccaaagcaagtcacaagaccagcccacattcagagtgagaggggagtagaaattataggatgaagggtgtggctacaggaaggccattaattggggccatcaaggcaattaagttattgaatcttgtttttaagattgtcttacattagatgtaagttccatcagtgatcttgttcttagtcattattgtatcccaatacttagaataagatgtgaaacatattaggtgctcaataaatatatgttgagccagtggaggtatgtcatttgagaaggattctgattatttctctgactttttatatgaggatgttgaggatcagcggccatatagcaggtcagtatgtctggaacagagggcttaaacctgggtgttctgtctctagattttataaggatagttgatcagttaccccgtagcctttggagtgtctgctattctagggaggatggggacagtttttgtagcctatgtgtcagaacttttttttttttttttttttgagacggagtctcactctgttgcccaggctggagtgcagtggcgcgatctcagctcactgcaacctcctcctcccaggttcacgccattctcctgcctcagcctcctgagtagctgggactacaggtgcccgccaccacgcccagctaattttttttgtatttttagtagagacggggtttcaccgtgttagccaggatggtctcgatctcctgaccttgtgatccgcccgcctcagtctcccaaagtgctgggattacaggcgtgagccactgcacctggcatgtcagaacttttatcaagtgctactgtgtgccaagcataatccttaagttctcaacgagggctctcaaattcccagtcaataagaggctatccctgtggctcagaggagcaggtagacttgaggagatgtagtaatgcactaagggttatctgtgacagagagacggggctgtttcctgtctttgaggatcaaaggaagaaagactcttaactgtgtattaagttcttcacaataataatggcagatttatcatgtactttctgtgtgttaggttttctgcatacatgtatactccttaaaagggtacctggcatactgttaagcttctaagtgataactgtaacaatcaaagaattacttctgttggctgaccttggacaagtcatttattctcattttccctctggggctcagaggttaagaaatgactgaaaggattctcttatgactggcatagataacaagggaagtatgtaatgcccttagcaggttcttgacccacagtggggacccagtcaacgtggttaaatccaagctgaggcttgagttgaaagtggaaggcccctgtttcaggatgagaggtggaggggtatgtgcaaggcatgggtttggaagcaagatctgttgtgcaacacccactggggagcctcaaatgccaagttgatatagttctgtggatagaagctactagagattgaagggatgtggtcagaattacattttagaaagagcatcacagtggtagtgtgcaagctaggctgggaggcagtgcttgtcatccaggcagaaaatgccactagctgagctgagcctgtagccacagggatgagtggagccacagtcaccttgaagtggggggttagtggtctttctgcgagttcaacaagagggatgggggctatgtgaactagaaggtctttccttgttctcaagttctgtcctgctggcctgagtcaggagggttacagaatgggaataggatattgtgcatctttaaaaaaattgaggcggggtgcagtggctcatgctcctaatcccagcactttgggaggcccaggtgggtggatcacctgaggtcaggagtccaggaccagcctagccaacatggtgaaactccatctctactaaaaatacaaaaaactagccaggcatggtggcatgcacctgtaatctcagctactcgggagtctgaggcaggagaatcgcttgaacctgggaggcgggggttgcagggagccaagattgtgccattgcactccagcctgggcaacaagagtgaaactctatctcaaaaaaaaaaaaaaaaaaaattgaaatgagtctgttgttgcagtaattcatgtattggcaaagtttaaacaatgtggaagggaagaaagtgaaaaacaagactccatttctttcagccctagtccccaaaagtaatatgaatacattttatgtgtctttttcaaaatttccaatgtgtagatgcctactttagcctgaatggattttttttttcacttaacaagactgtcaggccatgtaacctaccacattctcttcaactgtgcacatacagtagactggtgtacaattgaggctcccccttgatgaataccccggttgtttctagtttgctgatagaaacaaggatgcagatatgggggtttgaatctaacccttttgcccattgccttaggaagacaattaaaagccagtatgcagtatagatgaaacctgtgttcatttcgttctccctcttaaatctgttttttcttttctgtttttatttttttgacacagagtctcactctgtcacccaggatggagttcagtggtgcaatatcagctcaccgcaacctccgcctcctcggttcaagcaattcccctgcctcagcctcctgagtagctgggattacaggcacccaccaccacatctggctaattttttgtatttttaatagagacagggttgcaccatgttgtccaggctggtctcgaactcctgacctcaagtgatatgcccacctcggcctcccaaagtgctgggattacaggcatgagccactgcacccagccttccttaatccgttaacttgagtggtgacactctttgagcttccataccccatccctaacatgcaggattgccttttccaggcacagcaggcatgcagagactggtcgtgatcacctttgccattcctttctacctgaaccctctgtcagtactcttcctgtccttcctccctgtggcccaggtggcgtgtgacgagcatggctcccggggtttcggctttgtccattttgagacccatgaggccgcacagcaggccatcaacaccatgaatgggatgctgctgaatgaccgcaaagtgtgagtggctgggcccgagggaggggcggaggctgcagggacagaagcatggcaccaccgactaggaatcgatgctaccctcaagctgctaatgggcaccaggcacttgagcggcaggcagccctcctagaagtgtgagcccggagcagctgctcaacctctcagggactctttcctcacataaagatggagctgatgatctgcattagagtatggtaaaggaagtggtgattttaaaactctagagggactggctaatggtcatatcatcaatggactcagtgttttcatctgttttccagccttctcagtatggggtgtatgtgtgtgtgacagggtcttgctatgtagcccaggctggagtgcagtggcatgaacacagctcactgcagccttgacctccttggctcaagtaatcctcctgtctcagcctcctttgtagctgggaccacaggtgaccacatgccaccatacctggctaattttttgatttttttttttttttttgtagagatggggtctcactttgttgcccaggctggtcttgaactcttgggttcaagtgatcctcctgcctcagcctcctaaagtgttaaaatgctgggattacaggcatgagctactgcgcctgactttttctttaaaccttttgtgtttcatgagattttggcagaaagaaaagtaggcatatgctaagcctgccctcatcatactgttaacttcgatatcatccccactacacagatgggaaaactgagaggcagataatagagagaatctgcctctggctgttccctgcccagaattttgattttgttcatctgagaggccagctcacatggtcagggccatggagagaaggtggctttgagctgggggatgcactgagagtcattttgtccagggttactcagaggagggtccagtcaacctgtcaaacaaatcttggtgggcttttcccagttctcagaagaatgctcttcgttagctccaatttactcaagttcacctttgccactcagttttcttcaaattttggtgcctggtacaactttgtttgtgctaaacgtgctatagataccatcagaatttattattatttttttaatctgggatgctttcctagatgtgtttacatgaacttggaaatgaacttttaaaattaatcttgtgactgggtgtggtggctcacacctgtaaccccagcactttgtgaggcagaggtgggtgaatcatctgaggtcaggagtttgagactagcctggccaacatggtgaaactccatctctaccaaaaatacaagaattagccatgcgtggtggcacatacctgtaatcccagctacttggaaggctgagtgaagcaggagaatcgcttgaacccaggaggtggagcttgcagtgagctgagatggcaccactgtactccagcctgggcgatagagcgaaactcagtgtcaaaaacataataaataaaaataaaattaatcttgtatttaagtgattttagtcaatgccccccatagcaacactagcattgactgcgtctaattcacttacccctgcttccccagtgcacccaatacatgttaataagcaaagccccatgatgagaatttgagtcccaattttacagcaatgaactctgaggctcagagaggttaagtagcttgcccagggtcacacagctaggcaactgcagagcgaggattcaagcccttgtctgtctgactctcaggctcattcttctgtgctctcagctgcctggtatataatagtaattatgtgtgcatttgtcgcaagaatgaaatcttcttaaccttctgctggggacaagctctggaacataatataatatcttggctattggaggtagccgggccttggggatgttctaaggagtattgtcctgcccagtttcctgatgagggatatgtaagcctggagaagggcagcagttgagcaggagttggcatgggggtggctgatggctggtagctgtccacagccatgagccagtgtgtcatgtccacagctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttggtgggtgtgtccccaagggagcggggggatcactgtttttcctcttcccttccaaagtctggtagggaggaggggctctcctggggtttcctgaggacttcccagactcccctttgagccaggttggtcctttgcagggaaaatgctgagtgtgaaggtgatgagggacaacagcggccactcgcggtgctttggctttgtcaactttgagaagcatgaggaagcccagaaggtaggagcctccccatggctctgttctgcagcagggggaccgagctgggactaagaagagggtcccagctgcctgtggaggggaagaaagtccctccccggcctaagccaagagggtgggagagtcctgtgtgcaggcaaagcccttccttctgtggtcaaaggccaagggcttcattctttggtcacttctaagccctgatgtccgcagagctgaatatttaggtagggatgcagaagtcattattatataaaaatatttactcatgaactgaccacttaaatcagtttccaccgggtgtggtggtgtgcacctgtagtctcagcctacgtgataggctgaggcaggaggaccccttgagcccagtggtttgagtccagcctgggcaacatagcaagaccctgtctctaattttttaaaaactctccagatgtgatggctcatgcttgtaatcccagcacttggggaggctgggtgggaagactgcttgagttcagttcgagaccagctggacaaaacggcaagatgccatcttcacacacaaaaaggctctcacagttagcaaagaggattattttgtgccttgaaatccaactcaaagtaaggatgttgatgatgctgtcatgccattatgagagaattatgcttgctactttgttcaaattatccatgtgtagttgcagttagaacctaaatttttttaagttctttaagttcttttttcagtgtagttttaagttcagagcaacgtttagtggaagttatggaggttttctgtataccccattcccccaacacatgaacagcctctgccattatcaatgtcctgctcccaagggttacgtctgttacaagtgattcacttactttgacacatcattaacacacacagtcccaagtttacattaggatttacttttggtgtagagtctaggggtttggacaaatgcataatgacatgtatccactattatggtatcatgcagactactttcagtgccctaaacatcccctgtgctccatctgttcattcctccatgccccttaacccctggcaaccaatgatctttttgcttgctccatagttttgccttttctgggacagagactatgtcacctagactggcttctttcacttagtaatacgcatttaaaatatgggaatatataaatatttacattttattttatttttatttatttatttttgagacagagtctcactctgtcacccaggatggaatgcagtgacgtgatctcggctcattgcaacctccgcctcctgggttcaagtaattctcctgcctcaacctcccgagtagctgggactacaggcgcccgccaccatgcccggctaatttttgtgtttttagtagagaaggggtttcaccatgttggccaggctggtatcgaactcgtgacctcaagtgatccacccgccttggcctcccaaagtgctaggattacaggcgtgagccaccatgcccggccatatttacattgtaaatatgggaaaatttgcaaatctcaattttatttttatgtttattttattaagatggagtctgtctgtcgtccaggctgtagtgcagtggcgtgatctcagctcactgcaacctccacctcccagtttcaagggattctcccacctcagcctcctaagtagctgggattacaggcacctgccaccatgcctggctaatttttgtatttttagtagagatggggtttcaccaagttggccaggctggtttcgaactcctgacctcaagtgatccaaccgccttggcctcccaaagtgctgtaattaccaggtgtgagccactgtgcctggccatcaattttgtttcttaaaatacagccccagtccgaattttttttttttttttgagatggagtttcactcttgttgcccaggctggagtgcaatggcgtgatctcagctcaccgcaacctccacctcccaggttcaacgattctcctgcctcagcctcccgagtagctgggattacaggcatgtgcttccatgcctggctaattttgtatttttagtagagacggggtttctccatgttggtcaggctggtctcgaattcctgacctcagatgatccgtccccctcggccacccaaagtgctgggattacaggcatgagccaaagtgggtatacttaaatggcctttgtcctggtactgattattctcagctagtgtggccagcctggtttgcaggtggcccctctagatccagaagatgagcctgggccagggccacatctgagtggttaccaagcatgttccctcctcctttccccaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccaggtgaggtcaggcttcctggtggcagccacttctgtgtgagagcagctgtgtgtcgggggccctgagtggtgactgtttcttctagtgatcctacttctgggcacttggctcaaggcgggaattgaatgagcatgggatggcccccactgcctaatgtataacagtgagaaactgcgcacaacccaactgtccaaccatcataggggttagtaggggtgctggggaccttttggttagaataatccttcacgtgggactggttagcatcccacccagcccactcaatcccagttgcatcctctagtctcagacaaccaaagtaccccgcatattgccagatgcccctagaggaaatcctactcctggctgagaataatcaggccaaatatgttacatccaaaagttggaatgttggacagcctttgaattatgtggagttaataattaaagtgaatattgtggatcagtgcaatttaaaacttcattgggaagtgaacccctctaagattttatttatttacttattttttgagacagagtattgctcttgtcacccaggctggagtgcagtggcatgatcttggttcactgcaacctctcactcctgggttcaagaaagtctcagcctcccaagtagctgggattacaggtgcgtgccaccatgcccggcaaatttttgtatttttagtagagacagggtttcaccatgttgcccaggctggtcttgaactcctgaccttgtgatctgcccgcctcagcctcccaaagtgctgggattacaggtgtgagccactgcgcctggcctcatttttgtatttttaatagagatggagttcatcatattggtcaggctggtctcgaactcctgaccttagttgatctgcccgctttggcctcccaaagttatgggattacaggcatgagccaccacgcctggccccctctaagatttttcataaaagttctagatccttcatggagaggggcatataaatatacatatccacacaaaacacgcacacatactcagtagttctcagtgaggagcagttttgcctcctgggggacatttggcaatgtctagaattttcattgtcgtgtgggtggtggggtgctactgtcatccacagggtagaggccagggatgctggcaggcatcctacagtgcccaggacaatgccacagcaaggaactgtctggcacaaaatgtcactagatctgaggctgagaaacacatacatcctcttgtgtacatacagcgtgtccaggggctttcatacctgcagaacaaaatactcatcacataatctgcaagagcaggatgctatgctgtacaattgtgcggtctctgttctcttgtacattcatacactgttgtgtttgggaggtctggaaggagaaaagtcaaggtgctagaggcagctgtcactcaacagtgagatgcacagactctgaagttagtctgcctgggttgtcctgtctctgccacttagctactgtatgatctggggcaacttatttagcctctttgtgtttcagttttgtctgtaaaacaaggataaaagttttcttcacgcagggttgttgtgaggattaaaaatcaaaacgtggcctgtcgtggtggctcgtgcctgtaatcccagcactttgggaggccaaggtgggcagatcacctgaggtcaggagttcaagactggcctgaccaacatggagaaaggagaaacccgtctctactaaaaaatacaaagttagctgggtctggttgcacgtacctgtaatcccagctacttgggaggctgaggcaggagaatcacttgaacccgcgaggcagaggttgcactgagccgagattgcaccattgcactccagcctaggcaacaagagcaaaaatccatctcaaaaaaaaaaagtcttaaaaaaaaaatcaaaatgtatgggaaagcttagagtggcacctggcaccaacatgagtaagtgcccgaggttcctgggctggcaggggatggaggggcagctcacctgtgttagggttctggtcatgggccagccagggaggagctctgactcctgctgcccgacatccaccatctggagagcttggcttgggcatgctctgcacctcagcctgccacgggacctgggacatcctcgtgggccccatctgtgaaatggggaatagctgtggtgaggctgggaccagtgcagatgtgtgagaactgcaggggaatttgggatgtgggggctacagcttgcatgtgatgggcacgctgagggatgggggtacctgggtgctgagggagacggggagcaggaggctgggctggtggggctccccatgccccttgtacctgcgtcagttccctgatctccccaaggcagttggggcttggaggagaaggggacatccagcagtttcccttccatcccagggtgtgaacttgtatgtgaagaatctggacgactccattgatgacgacaaactgaggaaagagttctctccctatggagtaattaccagtgcgaaggtgaggactgggggcacctccgggggacagcgttcccctccatcctctcaccaccatccccccacaaccccacccctccaccctctcgcccagcagccttcagggggttggtgccggctaccccttctggggctctgctgaccccgttggagcttgtagccatctgcagccttgtctgggctggaggggaagagggtagaaatatagtcccagtcacacagctggacttggggctcactgtcaccttggcatttattgagtgcctactgtatgccagattccagaaattcatatcttagtatttccattgacttttgttgtctggcctctgccagtgacattaccctcctgggcctccgttttcccatctggaaagtgagagggctggacttcgtcattcttcatttgttcttccctatttctggagcaccaattgtgtgcccaaccctgttaggcccctgagatgtggcaactggcccatcagcagctctatgagctttagcagatgttgtcttatagataaggacactgggctcactggatggctttccgaccctggcttctcattacaaccccctgggcaattcttaaatacacacacctcagtcaggcatagaatgtggatccccggggtagggcctgggctttttattttttttttttaaagctcccagaggctgggcaatatggctcacgcctgtaatcccagcactttgggaggctgaggcaggcagatcatgaggtcaggagatcgagaccatcctcgctaacacggtgaaaccccatctctactaaaaatacaaaaaattagccgggcatgatggcacgtgcctatagtcccaggtattccggaggctgaggcaggagaatggcatgaacccaggaggcggagcttgcagtgagccaagatcgtgccactgcactccagcctgggcaacagcgagactctgtctcaaaaaaaaaaaaaaaaaaaagcgcccagatggtttttaagatgatgatccagtgtttcttcattctatacttaaatacctgctgttttaccaggctctgtgggaaacaggagcaaatcagatgtgatccttgctttcaagtagcttatagtctagtgaggaagtcagcccgtcactaactcaaatggattataagatgggggacagtatgggaggcaaagctacaggagttcagtggaacagaagggaaggctgcctggaagaagtggcagtagcagcagtgtttgacttggctgtgaggaggtagggagctggagtgggaatgaggaattttccaaagagatcagtgtgagtgacaggatggggggacccgcctgaatgatgtgatgttgggttctgaggaagtggtctagaagttctcttttggctactgagtccagttgtaaacatccttcagggagccttgtgtttggaggaaaaaaggttgtcttttaggttaagatccttttgaaaaatgcgagagaaggctgtggcacatgtaaattaggcatcagtaaatttgattacacatcataaaaagctataggtcctctttccaagcaaatgcatatacatttgatgtagaaacatggttgaaagctggaattttaaagttaatcaggtttaaatgtaaaccccagtcctaccattacctagctgtagaaactgaggcaagtggctttgcttttcggaccttgtttactcacctataaagtgggagcaacatttctcacctctccaggtgtcctaagaactactaaagaggctgcatgtacagcatctgcattcaataagtagtgaaatagtgattgtcgtaatgattcatcatacaccttgcatacagcttcaggagatggaccttcttgaggactccccgaacaaaggaaatgtgtaaatttggattgcttagagttaaggcacacctggggtgaccatctttttaacaggacaaacggtataaaatggggattataaatatatctattttttgtgtgtgtgatggagtctagctctgttgcccaggctagagtgcagtggcgccatctcggctcactacaacctccgcctcccgggttcaagtgattcttctccctcagcctcctgagtagctgggattacaggcacctgccaccatgcccagctaatttttgtatttttagtagagacggggtttcactgtgttggccgggctggtctcaaactcctgacctagtaatccgcccgcctcagcctcccaaagtgctgcaattacaagaatgagccaccacgcccagcctacatatatatatatattatacaattatttatttattttgagatagagtttccttcttgtcgcccaggctggagtgcaatggcgcgatcttggctcactacaacttctgcctcccaggttcaagcaattctcctgcctcagccttctgagtagctgggattacaggcgcccgccaccaagccctactaatgtttgtatttttagtaaagatgaggtttcaccatgttagccaggatggtcctgaactcttgacctcaggtgatctgcccgccttggcctcccaaagtgctgagattataggcgtgaaccactgtgcctggcctatgttatgcgattttatatattttggtttattattattttttattagatgcaggttcttattctgttgcccaggctggagggccatgatgtgatcatggcacgccacaacctcaacctcctgggctcaagtgatcctcccacctgagcctcctaagtagctgggaccacaggcatgtgccaccatgcccagctgatttaaaaaaaaatttttttttggtagaaattgggagtcttgctgtgttgtccaggcttgtcttgaactcctgggctcaagcagtcctcctacctcagcctcccaaagtgctgggattataggcatgagccactgcatctggcctgtattttgttttatataaaaataattatgaaaattaaaggaattaatggatataaatacttataccactatcaagttcatggtaagctctgcataagtgttagctttgctaaattttatcattattaactaccgactgccagaagttcttaacaatatatatatatttttttttttttgagatggagttttgctcttgttgcccaggctagagtgcaatggtgcaatcttagctcactgtaacctttgcctcctgggttcaagtgattctcctgcttcagcctcctgagtagctgggattacaggcgcctctcaccatgcccagctaattttttgtatttttagtagagatggggtgtcactattttggccaggctggtctcgaacttctgacctcaggtgatccacctgcctcagcctcccaaagtgctaggattacaggcgtgagccactgtgcccggccctttggctatctgatgaagcctgtggaacccttctaagaatattttttaaaaacttttttgagacagagtctcgctctatcacccaggctggaatgcagtggtgccatcacagctcactgcagcctccaactcctggcctcaagtgatctcctgtctcagcctcccaagtagctgagactataggagcaccactatgcctggataattattttttatattacccaggctggtctcaaacccctgggctcaagcaattcttccgcctctgcttcccaaaaataggcatgagccaccaaacctggccctaagaatatttttaaatgcataaaataagattcttaggtgtacaaaaaaatcatactgaaaaaatataatggtcaaaatactaaagtgaaagcagtatgtgcttcttttattatttttatttttatttttttgagacgaagtcccactctgtcgcccagactggagcgcagtggcatgatcttggctcactacaacctctgcctcccaggttcaagaacctgggttctgcctcaacctcctgggaagctgagattacaggcacccgccaccataaccagctaatttttgtatatttttagtagagatggggtttcaccatgttggccaggctggtctcgaactcctgacctcaggtgatctgcccaccttggcctcccaaagtgctgggattacaggcataagccattgcgctcggctgagattagcaataattaatgtgatatgaaaatattttctttttcttcatgacaaattcatggctaatactgccaggatttttttgttgttgcccatattcataatagaaggaaatgctaatatgaaaataaagatgtcactttttccccaatccatgcaatttccccctaaattgtatccatgacctacctgagggggatccatggactctcaggttaagacccctctactgaagggtagcagagtacagtttcaaaattactgattaagagcgtgggctcaccaggagttcaagcccagccggggcaacaggatgagacctcatctttacaaaaaatgaacaaaattaggcatggtggtgcttgtctgcagtcccagctacttgggagactgagttgagaggatcacttgaggctgagaggttgagggtgcagttgagctgagattgcaccactgcactccagcctgagtgacagagtgagatcctgactcaaaaaaaaaaaaaaaaaaaaagaaaaaaaaaaaggaaaaaaagaagattttaaaaataactctagtccttatgggctgtatgagccaggccggtgtcttcaccctaaaaaaaggttaaaaacccagggccaggtgtggtggctcctgcctgtaatccctgcaccttgggagacctaggtaggaggatctcttgagaccagcctgggcaacatagtgattgctgatctctacaaacttaaaaaaaaaaattagctgggtgtggtggcatgtacctatagccctaactacttgagaggctgaggcaggaggatccctggagcccgggagtttgaggctgcagtgagctatgatcataccactgcactccagcctggatgacagagtgagaccccatctctttaaaaaacaaacaaataaacaaaaagacaaaccctaaatgccatgtgggttggatcctggaagagaaaaagaatattaggggaaaaaagagtgaaattccagtgaagtctggagttcagttaatagcattgtagttaataggagctaatggtataaaatagttaatagcattgcaccagtgttaattttgtagttttgaaaaatgtaccatgttcacattgggggaaactgggtgaaagatatacagcaggccaggcatggtggctcacgcctgtaatcccagcactttgggaggctgaggcaggcagatcacttgaggtcaggagtttgagaccagcctggccaacatggtgaaaccctctctctactgaaaatacaaaaattagccaggtgtggtggcacacgcctgtagtcccatctacccaggaggctaaggcaggagaattgcttgaacccgggaggctgaggttgcagttagccgagatcgtgccactccactctagcctgagtgacagagtgaaactatgtctcaaaaaaaaaaaaaaagatatatagcaaccctctgtactgtttttgtaactttttctgtaaatctaaagttactccaaagtaaaaaggttattttaacaaaaaggctaagaacctcttccccaaattcctaaagaacttggcttggtacttagcagaggcgatagaagcttaccagaacaatgtgttgggttgagtcctggctaacgtatgaaccacaggctgagtgaccccagacaagtcactctttcgagtctctcttatcccggctgtaaagtgggagccgcgatgcctcccgcatcgggaggttgtacatgtgaggtgtgaagacatgtaaagtatctggcatgcagcaggcctcatagatgggggtgcgtgctgcatccctcaaacagctcagtaaacagggtgcacgctacatccctccatcactcctcagtaaatgggggtgcacgctacatccctccatcacagcttgctaaacgggggtgcacactacatccctcgaacacagcttagtaaacaggggtgcacgctacatccctccatcacagctttctcgcgggcctgcccagtgctgggcttagcccatggggaggagggaggcagcgcagccccaggagccttccttccccaccccagcagctcttgtcttgtcttgcttttaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttcctcccttccttcccttccctcccttccctcccttccctcccttcccttcccttcccttccctccctccctccctccctccctcccttccttccttccttccttcgtggggtctccatgtcacccaggctggtgagcaatggcgtgatcatggctccttccttcttccctcccttcctcccttcctcccttccttcacggggtctccatgtcacccaggctggagagcaatggcatgatcatggctcactgcagccttgaattcctgggcttgagtgatcctcccactgtagcctcctgagtaggtgggactacaggtgtgtgccaccatgcccagctaatttttttgtttattttaaagaaggggtctcgccatgttgcccaggctggtctcaaactcctgggctcaagcaattctcctgccttggcctcccaaagtgctggcattacaggagtaagccaccgtcccccgccctacatttttttaaaaattaaatttttatttttttggagacagagtcttgctctgttgcccagaatggagtgcagtgacaccatcttggctcgctgcaaactcttcctcctgggttcaagtgattcttgtgcctcagcctcccgggtagctgggattacaggtgcgtgccaccacactcagctaattttttgtatttttagtagagacggggtttcaccatgttggccaggctggtcttgaactcctgacctcaagtgatgtgccctccttgacctcctaaagtgctgggattacaggcatgagccaccatgatcggccctaaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtaggtgagtgtgggtagggccaaggggaatgggggtggggcaaagttggcactaggagtcaggaccagcctccatggtgaccttgccatatgccctctcggtgagcaaagctgactttggagactgtagcgtggtagttagcttggcctccagttcctgggaccaactgactatgaggcccttgctgactactatatctgtcacctaatctttaaaatggggacaaaaatagtacccccattttattgtagagaatttaaatgtttttttttttctttttgaggcagaatttcattcttgttgcccaggctggagtgcaatggcatgatctctgctcactgcaacctccgcctcccaggttcaagcgattgtcctgcctcagcttcccaagtagctgggattgtaggcatgcgccaccatgcctgggtaattttgtgtttttagtagagacggggtttctccatgttggtcaggttggtcttgaactcctgatctcaggtgatccgcccacctcagcctcccaaagtgctgagattacaggcatgagccactgtgcccagccttaattttttttttttttttttttgagatcgagtcttgctctgtcgcccaggctggagagtaatggtgtgatctcggctcactgcaacctctgcctccggggttctaagcgattctcctgcctcagcctcctgagtagctgggattacaggcatgcgccaccatacttggctaatttttgtatttttagtagggacagggtttcaccatgttggccaggctggtctcgaactcctgaccttaggtgatccaccagcctcggcctcccaaagtgctgggattacaggcatgagccaccatgcccggcttgttgttgaggatcaatgagatcatgcatgaaagggcttagcactgggcctaaagcctggtaagtattgcagtgactataaacaagggtgtaggttttggctgtacagcaagcacatctgttctttcattctgcaaatgttctcacatccacagtgtgctggggccccaagctcagcactggaggttctgcgtgaacgaggtatactcagtctctggccttaggttgctgccaggccctgacacccctgcttattcctttttattgtggtaaaatacacataacaaaatttaccacttaactatttttcagtgtacagatcaatggcattaagtatattcacactgttgtgcactgtcaccaccatccactctccagaactctgttcagcttgtagagccgaaattctgtacccatcaaaccataacttctcgttcctcctcccgctagcccttggcaactgccattctactttgtctctgtgaatttgactgttcttgcttggtacctcatgtaagtagaatcatagagtatttgtctttttgtggctagtttttttactttacatgtctcaggatgtatctatgttgtggcgtgtgtcagaatctccttattaaggctaaataatattccattgtatgtatagacctcatttttacttattcattcatctatcaatggacacttttctaccctttgggtattgtgaataatgctgctgtgaaaatggttgtgcaggctgggcgtgatggcttacgcctgtaatcccagcactttgggaggctgaggcaggtggatcatgaggtcaggagttcgaaaccagcctgaccaacatggtgaaaccctgtctctactaaaaatacaaaaattagccggacgtggtggcatgtgcttgtaatcccagctacttggtaggctgagacaagagaattgattgaacccaggagggggaggttgcagtgagccgagataacaccactgcactatagcctgggtgacagagcaagactctgtctcaggaaaaaaaaaaaaaagaaagaaaatgtttgtacaaatagctctttgaaaccctgctttcaattcttttgggtatatacccagaggtaaaattgatggatgatatggtaattctgtttaactgtttgagaaagccctatactgtttttctgtagtggctacatcattttacattcctaccaacagtgcacagtcttctaatttctttacattcttgtcaacgcttgttattttctgttttggtgttgttttgttttgttttgtttttggatagcagctatttgaactctgctttttttgttttgttttgttttgttttgcagccaacattggtactcagaccacaggacccagtggggtaggatgctgtacaccaggccggccgctcctgccgtgcaaatgttcctcagcagcacatagcacctatcgggtaaggccagcccagctgcctgctcttagcctgggctcctggccgcctggctcagaaccttagctaaggtgttgggccttggctttttttcttttcttggcttgtaaagtttcgtttattaatgtgtacaatcaataagagatcacccttactgcgagaaggggaaagagggccagcattacgttttatttacaatttgttttgcttcggttattaccaaaattaatttggatatccttagtatttgtgatgaacaccaaggaaaggtattctaagaatatgctgattattgaagggatgtacttaatcttcaaaacagaaaatacttactgtaatcaaagactgtgtatttatctccctcccctaaaaaaggcctaaaattcagcattatcatatcctgtgtagaatttcaatgtgtctcttttgaactatttcctgcaaaatgaatgagaacagtctttaaacagcaaaaatgtctatttttttttttggacagggtcttttttttgacagcacccaggttagagtgcagtggtgtgatcatagctcactgcagccttgaactcctaggctcaagtgatcctcccacctcagcctccaagtacaggcatgtgacaccatgcctggttaattttgtgtatttttttgtagtgacaggggtctcattatgttgccaaggctgatctcaaactcctggcctcaagcgatcctcccactttggccttccaaagttctaggattataggtgtgagccaccacacctggccaaaatgttttaaaattaccaagatgtgaaagggtgagaggtgtgccggggacatgtccataaatctacttgataaaaagtgctttatttggcacaaagttattggtaacacagggctttcctttatcaacgttcatcagggacctttataagttcgtagcactacaggaaacgtctaagctagaggcatgactttgtcttctaatccactttgcccttgttggggactctccaccccacctgatcatccagaccttgccctctgttcccctcctccagtgcctccctggccttctgctcacttgccagggtaagtattttgaggacatgcctgtccatggtgattaagggatgtgtccccggcaccatgcaggtccaggagccggctgtgcacatcccaggacaggagcccctgaccgcgtccatgctggctgcggcgcccctgcatgagcaaaagcagatgattggtgagtggctggttctcctactgtggagcaagaagaggagggctgcgagctggctagcctgctgggaaacacctcacctggtggtccaacgtgaggtcaaattccagctttgtcaccgacccccctactgggtgaccgtggccaagctggctctattctctaggcacctgttatcttgtcttaaaacgctggtcagactggatggtcctgagctttcttccactgctgctgtcctgtgactttgaggttgggagacagtccagatgtggggagatcaggggacaaagggaggagtaggggtatggtcttgggtttctgctgagaaatggcttgtaggtggggggttaaagttcctcacacctctcctgaacgggaggaagctgctgttcaccagtttccagtgctcaatgcgggcaggtggggcatctgtgcgtttggtaaatacatgatgtttcccatagattctggattccttgtgcaattcatcttcacccctagtgtccatggcaggccctgataaaaatgccactaagtgaacacaagcttgttcctggttggcaggttctttactgcatggcccccgagacctccagaccctttactgaaggcccccattaccactgccccattgtttcctcagcttacttagggttttgccacattaccccttcccctcaccccgaaatttttttttttttccctgagatggagtcttgctctgctgccccggctggagtgcagtggcacgattttggctcactgcaacctccacctcccgggttcaagtgattctcctgcctcagccttctgagtagctgggcttacaggcacatgccaccatgaccagctaagttttgtatttttattagagatggggtttcaccatgttggccaggctggtttcaaactcctgatctcaggtgatccacccacctcagcctcccaaagtactgtgattacaggtgtgagccaccatgcctggcctcacccagaaacattttgaatgagcttaatggaagtagaagtctttgttagtagttctctgtaaacattttcactttcttcatgggacgatcctttccgcccccacttaaggcacccagtcctggctgggccctggacacattgctgagatgggctgaccaccaataccaggcccagtcattaaaagtacctgatgttagaagatcaagtgttaaatgtcatagcctagaaggagcagttctgggagaagaacccagatgtcctcagtgctccactccatacgagccctgggatgctggggtgtgagctaggccgtgcacaagccattagaaggtgttccacacaggggagcgtctctacccccttatccatgatgtccacacccagctggctggcaagatcacgggcatgctgctggagattgacaactcagagctgttgctcatgctggagtctccagaatccctccatgccaaggtaagcaggagcctgggcagcagggagcccgagggggcaggaggagagctaacgacaagggctctcctagtggagccagtggatagctgtttggccagataaagtgtttcttcttgctaatacctgaaggcctgctgaatcttaagagtggaaggggccttaggtaagggtttgctacttcagcccttccgtagactaattctgtgttgttctgtaggtaggtcttttggtacaaggaagtgtgttgtgactcagtgtaagggttaagatttttccagctgtccagcaatgtacctctgtgtcaaaggtgacagacagggccatgggatcttgcaagcagtggtggatgggagggttccacagaaaccctgtggatggaggaggatcctgtatccaggatggtgagcgagggggagatcaaggctcttctgtgacctgctaagatagctgcactaagcccccccgccactcatgtctcacagatagacgaggcagtggccgtgctgcaggcacaccaggctatggagcagccgaaggcgtacatgcactgaaaccaggtgggtggaatggtgacagaagcagctgagcccgggagaagctgtaaggaaataggcagggactgactttcacaaacactgagaattgcgccgtgttcctggctttctctgaagcaccaaagagtttggaggaagttgtgagaatcagaggagatgattaactgtgatcggaatggggggtggtggagggtgaaggaggtgccctcttgccagctgccctgcctggcttcatgcagaatagtttgggctttcccagggccctgcctggctccattctgcctgcctgaaggcctggccaggatgtaaccaccttctttattgaagactgggtgtctgccatactttaaaaacacttatttttacctttttgtcctcagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgccttg

SEQ ID NO: 224 - DNA, 18344 bp, Homo sapiens
tgaatgcccaataagcaataacttttattattactacagagttccaggtgcaaagctgaaaaggcataaatgaaagcacagcagatattgatgtagaagaaagctttttaatgcaacagcttaaacacacagttcaacaaaatcagtcaattcaaattaacttcaacatattacaaagaactatgaagcccggagaaggccactgttggaacaaaaaaccaagtccctgcccagaaagcatggacactgaccaaggaggcctcttgccccctcccacctctaggaggagcagccacaatcactgggctctttaaacagcttaggtgcctctctgcagaaggcagcagcacagagtcaaggacaaccattcaagggtcagggctctgccttcccaccaaaggagggcccgaacagaaggcactggggctcagacataggagactgtgcaaggacaggacagggcagggacagcagctgtacacctggagagactgcagccctggagaaccagctcaacaggctgctttggatcagggccttaggtttatccccctccttccaccccggcccaggagctcaggttgttcagatgaactgcagtgagttggggtctggggaagctacaagggcagcactcagtctgcagcccacttgggcaggacaaagccaaatgctttgctgatgaggatctgttggtgtgatcagctagctgggctgggggaatagggacagagcttcagcttcacgcttagctctagtggggacctttctggtgcaacaaccatgtctgtgtttgactacactgagtttaatttgaacaagcaaagcctcttacagggtgggaggccatcaagggattgaggagggggcttcagagctcacttggggcatgctgggtttcaggagcgggcacagagcaggtggcccatggcttctctgggtaaggtcaggcaggggttccagttgccctgttgggtttttagtgtaggttctgcttcacttcctgccgcaacttctgtgcaggaccattcctaggctcaatctgtaggaggttgctgatgtctgcaaagctggatttatagtcctaatagaagaaaagacaggagtgtgggggaaggttcccggactggggtggggatagctgctgaggcagcaaagtgttttcaaaccccagcccacaggcctgctctgagttatcctgggcccaggatgagaaggaaaagctgcagatattgtctcagcttggctacaccctgtaaatggtgacactggcataaatctctgtagctatgttgggaccttttggccaggatttttttttaccttgagtgctttgtgggcttgagcccgtctgtagaatgccttcacgttctttccatccagcttgagggcttctgtgcagtccttcactgcttctgtgtactgcttcaggaccaaatagcagagtgctctgaagggaaagaccatttcagaggtttcagtcacgtcttatgggccacccacatgccacgcagtagtttgagaagtgatctccaatttgctgaacacctactctgtgctggttactttatgtcttcttaaatcctcacaacaatcctagcccttttcatggatgaaacatgctggctcagaagggtaaaggaacttgggccaggtaccgccagtattaaggggcagacccaggattcaaataggcgggcgttcgttcatgggactccagatcctgatctcatctagttctatcatgctgtactgcgctctcctatactgagctctttcaagcaaagaaaaggtttcctgaaacttttcccttgacagattaaaaaattatctactttaagggggaaaaaaaaacccaacaactactgaactctaatgatataatgctgacatggggtgaaatgtaaagacgtttgcaatttacttttaagtgcatcaaacacaataatacagaccaacagatggctaaatagtgataaggcaatgtaataatactaattgtagaatttagatggtaggtctatgggtgttcaatgtacaaatctttcaactttcctatattttgaacattttcataataaaatgttggaaaaaagttatgtgcatccatacaatatattctgcatctgtgggttcaaaaaagtgcatgtgtgtatatatcttcctcattcagatctagtccttctctccaaagacagtcactaaaaacaaaacagtcagatgtctgggcgctcattacataagttcatctgttccacctcactgttttcagtgggtgcagggtattcactaagttggatgtagcataatttattttaccaatttcctatcaagaggtatttttcattgtttccagtttgtaaataagtgatgccatgatgaacatccttgtgcaagggactgctgtatccaaagatacatgcattttaaaacctgactggccaggtgcagtggctcatgcttataatcccagcactttgggaggccaaggtgggaaggtcacttgagcccaggagtttgagaccagcctgggcaacatagggagaccccatctcttaaacaaaacaaaacaaaaaaagaaataaaatctgattgttactgccaaaatgctttccaaaaaagctgaatagttattgacagagcctattttcctacaactgtaccaactttgggtcttaaattttcatgtatgccaatatggaataaaacactatctcactgccttagctgcttagttgtgggtaaagctgaacatctttaataagggtttttaatcttttgaaatcaaacttctctaacttttcctttaacgacttctgtaacatttttttcccttcacataagaataccttccccactgcaagatagttaatccatgtgttcttctagaacttaatggtttcgctttttacattccaaactgtgatccactcagaacttactttaaaataagaagcaaggtaggattcaagtttaactctaacctggccaacccaacacctcttattaaataatctctctttgccccagactttattatacaccagattctctcatgtcgttgttctcatttttttctgacttatcatgaatttaaagaagaaaattctactagtcctttgtgattgcatggaattcataaattaacggagagaaaaatcttcttgtaacaacttaaaagacaggcacaaattctttggcaatcctccactgagaggcggaggtgtatctgctctctctctttgaattcgggcaggctctgtgactgctctgaccaacagaggacagaggaagggacacgatgtgacttccaaggttaggtcataataggccttgcagcttccaccttggtctctggaaacactcgctcttggagccttgaactgacagggaagaagccaactactctgaggccaccacgctctcaggaagctcacagcagcacacatgaaaaggctgctaagaaagtggaaagaggtgccagcttgctctagcagttccatcacccagccatttgagtcaggcagcccagctgccagacattcgaggaagaaggctttagaggattccagccccagctaccatcttgctgaccctgcatgagagaccccaaatgagaactgcccttccctaattcctgactccacaaattacaagcaaaataaaatggttgttgtaaatcaccaagttttagaatagtagcccgttttaaactttgaacacagaagaattcctttttttttttggagacagggtctcactctgtcacccaggctggagtgcagtggcatgataacagctcactgcaacctccgcctcctgggttcaagcgattctcctacttcagcctcccgagtagctgggattacaggtgcatgccaccatgcccagctaacttttgtattttttggtagagatggggtttcaccatgttggccagcctggtctcaaactcctaacctcaagcaatctgcccacctcagcctcccaaagtgctgggattacaggcatgagccacctctaaacatagaggaattctaaggaaattaaagtttcctcccaatgggcttggcaatttaaagaaatagccaagtgtctgggaagcagaggaaccaccgtgtatcgtgacttcagaatagaaatgtgattaatagggtcatgtgagacttctaaagactatatttaagatgaacaaaatgcataacttcaggcaataaaataaacccccttgacttttggtaaatgaagtaactgtatccagtcagaagggttttaattacaaaggggttgggaaataacacaagtgagtgaaagggaaataagctttggagtcacaaagatctggcttaaatctcagccaccatgtactagttgtttaactttgtggtcactaattcatctttctgagcctgattaggtaacacaggacaatgatctaagctgaagaactgttgtgagtacaagtgagattcttatgacagctgtttcagggctggcaagttgtaggtgctatgcactcagatgtcacctgcacaaagggagccaaagtaagccaaagcctgggcattgtgtcattcagatgggcgtacatgaggtggagcattagactatgtccaagacgttccaggacatgataaaatgttagccacaatggctgaaagttgttttgtcattagtcctctagattaaattataaatccaatgcaatcacaaccaaaagctgtccaacaagacattttttggaatttgccaaaatgatccgaagctttagctagaagaacaaacatgggaaaatactaggaatgctctgattaagaagaatgaagaaaagaccagccctataagatattataaagcaaaagcaattaaaacagtgtggcacagacacctgcatgaagaacagtatctaaacaagacaaaacacagctccaaatatggtaatgatccagaaaaatgagttaatggaggtgtccagcagcataaggtaagcaatgtgaaagagggtccagagatagaggagttagaagatgccacacaaatatggaacaaataggctgcaggcttctttttcaaattagcctggcaaattgtggcccctctggtccaatcagcaataaaaccacataaaaccacaggtgcaaaattccaaaatataagctttaaaactacaagttctctttccaactcattgggcagcaaaacctgatctgaactgacatgaagctatttagtttctctattccaccccatgtgaacatggaattttcaagtttcactggcagaaatactaataattaacttctgcaagctgccccagacactgctggggtgttacataattcagaccatattacctcactaaaatggaaaacacttcttttttttttgtgacagagtctcgctctgtcacccaggctggagtgcagtggcacaatcttggctcactgtaacctctgcctcctgggttcaagtgattctcctgcctcagcctcctgagtagctgagatcacaggcatgtgccacagcgcccagctgattttttgtatttttagtagagatggggttttgccgtgttggccaggctggtctcaaactcctgacctcaagtgatcctcccggagcctcagcctcccaaagtgttgggattacaggcattgagccaccgtggctggaaaacacattttatctcaagagtttggaataaggaacaatgtgtctatattagatccaagatttttgaactagagagtgatatgtgtatgctggtagggaaggataaacagatttctaacattttataatgttttatactaagcatttggttttgatatggtctcttgctgaatgtttcaagcttctgagagtaaaagtaacaggaagatcttgttgaagtcagattccaattcttgtgccaacatttactggctggctgagtttaaagcaaaacccttccttctctgagcctcaattttctaaacactaaaacagaaagaccacctatacgagcattgttggagaacaatcactcctacacagtgaagggaccgcaccctggctcccaggttctcagtcagtggtcactgacggcagctcctggtgcaggactttctacaggcccacaagtctaacctttcaggctagactgtacccatccttcctgctctcatgccaggcaatggttacttcacattttggcttctgggccagtactctcagacagaaatggtgccagaatttctaacaggagggtcttggagaagggtagggagcagcgtagcgtggtggggtggacaggctaagagacttgtgttagggttgtgtttgcagagcaggcacactgcttttagttacattgcatgcttatgaaaattctggggacaggggccaacaaagcccaggctaccatttggcatccctcagtttctacccttttgagagaatgaatgccactggtcatggctagctcacaacgtggatgcatgttttcagccataacatacttgactaaatgctagggatgaagggcccattgcagtccaagagaagactatggaacaaatgtcctgaaatgccccaggccagcagctgtataggagatacctgttgctgtacgtggcagattccaggttactacacaagaggctttcactgtacttctcaatagctttcttatggtttcccttctttacaagctcattgccttcttccttcagaactctggctttctccacatccccagcagaaggcactagatacaaattcagaagaggaaaaaaaccatggagcagcacccaactgagatcagtgaggtctcttcagcatcgtcccttccaaactgactacaatcctctctcccagagatttcctcccctgctgtaaatcatccttcctgattaatgacttcccccaattaatagcttctgggcaattcaacagtttttcatcaagaagttggggaatcctgatataaaaacatttttgcatgcacataaaaatatataaatgataaaaagcaacccaggttctagccttggcactgcctcttggtagctggaagatcttgtgtgacctacctaacttttggacctcaatttcctcaccaataaaatagggcaatactaattccacagatggctattttcagggtcaaatctgagagtatgtaagaaagtacggaacacactataaacttaaagcaggacaataagtaaataaatactaataaacaaatatctggtaaagaaaaggtatagcttctgggctatgagaaaaggggagaagagcctgctattcctcatttctggtttgggctgagcctgtgagtatcctccctcatctaacacatgcagctctgctccagccttcaaggagaggaagcagagggaacatggtgaaatccaagctgctcaacttggtgttcaggcccttcactgcttggccccaattaattattccagcctcagctccatatcatctgcttttcaaaaatttttaaaactatctttataaaatactaaatatttatgaccagggtaagattataggtttacaccctgaattcattgcctggtttaagaaaaagaacataactaggacctttgaagtcctgggggaccttcctcaattcaatccactgctggaggaaactattatccccaattctgtgcttcttccccacctttttaaacagtataactatatacaacagtacccacagatcatttgctgtttactttgtttttgaacttcatacagaagaataagtctgtgtattcttttatgacttggtttttctttttccccttaatgttatatttctgagattcatctgtgttgatgcacagacctgcagctccttcattttcattgctgcaataccaaagctgaattgtccattctcccatttatggagatctgggttatctccagttgttttttgctattacagtcttctacgaacatttgtgggtacatctccctgtgcacatgcacacaggtttctcttgaagtagggcttcagcttcactggcaccctgcaacacaccactctgcagtcatccttattcctactgttccccccatgcactttcattctccaactctctccactgtctctgccaaggattctccttccttcccacctgatgaccttcttcaaggtccagctcaaggctccacctccattgccaccccttctgagtctttccccgactccctcatgcacttaagtcagtttctatcctgaagtcctcaaacactaagactctaaagcacatgttcctcctccttgtgttttaagacactgtttacatgtctcagtccctcaactgagggagagttccctgagggccaagactgtcctctgtgtcacactgcttagcatacacatggcttggaacacatggctcagtgaccctgaaagaatgaaatcaatggtaggtgcactgatttaaagaatgaaatcaatggtaggtgcactgattgaaagaatgaaatcaatggcactgatgccatcaggttcattagcaccgcacattttcatcctagagaagagtggggaacacttaccaggctcccacaaaccagagtgaatgctacccatgaccagagaggcattctcctgtagaaggtgagtaactcttgtcctcccctaacacctataggtcacttacacatggcagggctccatctctgatcccttctgcacctctagcctgaatccctagcttgctgggctgggaccattcccctggagcattaaaagagcttcctagtgcctgacaaatggcctcttcatttcatacagttgaggtgaggaatctcctgtttttggctgcttggatctcctttctcttcttcatgcttctccagggattcacacagtgtacatgctcctgggaagcatcaccctctagttctggaggtggggcaggtgcctcagggtgacctaatcacaaaatctcatccgccggttatggtgtgtacttcagggaatggcctgtgaccatgaagaccagaatagattgagaaaatgattgagaaaatatgtgagctagagttttttgggggaaaaaaatcctatcttttcctagtgagctatcagagaaagactttctttctctgggtcatgaggcatggggtatggatgtgaggccgggaactgctatagctattttgctactaggagggaagcttgccaaagacaaagctgacgcacaacagaaaataaagctgtgataagtacagaaaaatggagttagtctgttaatatactgagctgctggagcaaaccttgcctgaattctctcggatttttcagttttatgagccaataaattccctatactatgtttaccatgttgagctttctgtttttgcaaccaaaaacatcctaagtactacatcccaagtgctaccagaggaaagagaagggaactcacactgcatgcctatgtgccaggctgggagttttacatgtcttatgtcattcagtcctcatggttgtgaggaagactttatcatcaccctcactatacagctgagaaaacagtctctaagaggtgaagacttgtattttgttttatactttgttcctaagattatttttataactcagctaaacaatgccaatttttgcaggactactctaaagaaaatggatagtgggagattgcaagactctgggcagggagtcacagctcacctctgttctttgtagctgtggtttctttggatttgcttttagccatctctttgtggttctccgaaggcaaggaattccacctcttctgagctgaaacaggcaccaaggggattgagggcagcttcaggcgccactcaggcccaagcgagtccatgagagctctggtcattctggaaaagaaggcaggattgcagggaggtttccagctgggtcaagaagatatttctcctttcacacacccatgggaggtaggccttttcagaagagccagagctgccaccctccccctggtcggaaccacctctttagctcctccaacacgtgcaatacaggaacccataaacaccatctcagatcagtccccatgacattccttgagcttggtcaaactatgttacctttaaagtggtgatctgttgcttgttaaggatacttaaaccatgatccaaaaagactatagtttctccaagaaagaatcatacattttgtttcatattttatcaatgaatcaagtacacaaccatgcaagcacctgacatttgtttaatgctcaggctttttaaaaaatgcaaagcttatgtcattctcaaatcttacaactcctcaggggttcccaattccctaggctaatgtggcatgtgagatctggtccccaccccttcctgtcccccttcactgtgagccacattctcttctgatccttctgttcaagactttgcacatgctttttcctctacccagaacaaccattttcattttggaaaaagattgccaccttccaggcccggctaactccaacttattctttagatttcagcttaaaatgccacccagagaccaagttcattctgtcaactgatctccagcacctggtatgtcacctagcaaccaccaaggcccaatcagttatgtgttgaatgagtgaataatgctaactgtatactttttctgctcctacaaccatgtttcctatattacaagaataaaaaccacagactgtatcactacaaattccaagatgtctctggctaggctgttttcctggcggccaagctatttcaaacctctgctctcctcaaacctgttccctggcccttccccttttttagagcaaacttcctcataccccaaatacaaacctacctgcctgggtgcccaatccttcctatttctctcctgtcacaacagaagagacaatgggaccaatccacccacctaagctctggatcccatctcctcttgcctctttcagggaccacacccaggcagcacctccctctcccacatcttcatccttcctctctactaactccaaccgtcagcatttaagtccctttaactctttcctcacctaataaaaccatactggacaccccttgccatcacaggtatactccccagcttctcttcaagcctgactttctgaaagcattgccctctggctcctgatcccactgaccagcttccatcagagccaccggtgacttcattgccaaacctttaatgtaagctccttggaacacctgacactaatgatgtctccatctttcttgaaatactccttcccttgggacatcaatgccctgtttcctcccacctctctagctgctgttcctctgtaagtccctcaaatgctggagtttctcaaagctccatcctcttcacactagctgtgatgttctttttctttctcacagccctaatccacctctgcgctgatgaccctcaaatccttatgtctggcctgtattttcttcctttgttccatgtaaatacccaaccgtcctacttagatctctagtcttatgtcccacagtcacctccgactgaatgtcaataatctgagtgtcttcttctattcctcccttctcgataccccgcaaccactaaagcttgttgatatacttcctacatgtcccctgactggtcccattgttttctctccaccctctcccctggattgctgcatgactcctttctattctgttgcccttcatatcatccctcaacatggcagcaaagagcttttctctaaaatacaaatctgctcatgttgctccactgctaaagaccttttcataaaggctgacttgctcaggattaagtccaagccctgaaccctgggtcttgtgtgacttggcctcaccaacctgtcccaagctgagctcctgcctgcagcaccatgtgaaaccgacttcttacaattcctgtgatctgtcacacttgctcacctttgcacacgctgctctgtcttctggctaaccccctaccccatatctctcattcttagctcacctcctctgaaaagctctctctggcctccccctctccctctcagctagctaggtggctcctttctggcctcagagccccctgtgctgcctcctaccatggcgcttatcatgttgtattgtgcttgcctattactgactggtgtcttccttgagaccgggacctctatgacggcaggaagaggtatgtctcagtcatcagcccaggtcctagagcaaagtctgtcacataattggtagattttgtggaatcagataagttaaaaaggaggcaaagagaaaacaaagaatgctggcagacaagtcaagccagaaataaagcactaaatacataccatgaagtccctgttaagggtttgctattagtgcagtgtttggctttctagccgcacacgcagaggggaaacatgatcagttatacaaatgacaatatccatgagataaaagccaataactgctcagagaccagaaaggaattgcacctggggaacctcttggattggtcacagtgcaatatactgaaccatgtccacaaaccatatccttttaggcttgtcatagctgcttgggcttgtgtcttattcttctaattagcgttagcgctttgaaggtaagtggggtctgtatctctttctcattttggtatcccccactgaaccgggcacaacaccttaaacagtgtacaataaatattactgtgtacatagatactgtgaggcacatgtaggcaaatatcaatcaatcaatcttagtaattgactccctgaaaacctgctaaataaaaaagcagattttcctttctcagcttcccctacatgcccatcgggagttttttaagtgtagccaaagggatcccctcagaagacagacaaggcaatggcccgcagccaatcaagaaggacagggagttgccgtggagaccacctgctgggaatggagctcacctgttgatgccttctacggctgacgtcacattatcatcaatctgcagcacagtcttatagtcaacataggccatagggtacttctccagagcctcataagcagatgctcgccgcagcaggggcttaatgctgaagggaaccaaggccagtgctctagaataggaggcaaaaatgtcaactggctggctgctgagccaccagggtttccctacagtttcttccaggcagggttatctggagcactcagcgtacaggaagtaatttctggccgagagacatggctaaaaacgccaaacctcagaacagggatttttcaacgtagactgaagtgaggaggagaaagaaggcagagaaacatgaattttgttaaatgtgtgtgcacatgcatcaattttcatagtttcagttcccccaaaatcaagaacaaaagcctcatggctttcatgctactatgtttttttacagttgtggtctagtgggaataacaaacaagctttggagtcagatggggtggtgtctgaattccacctctgctgctaactatgtgacccaggtaaatcactttactgccccaaccctcagcaaccaagttctggcctgggacacatggtaaccgtaccccacagattggttgtgaacactcaaagagggaaatctggcacaaggcatggcacaaattaattcagcacaggctctgtgagtatgctcacacccctcctgctctcctggctatcaccagggcaggaatctaaagcaatgtcagaggacatcagatctgagaacacatttcaggtaaatgtgagagtttaatgatgataaaagaatattagactggcttgaagaaaaagagatatgaaacattgttcagtgtcctctaaaactggtcattcatgaataccatttttttcctttctccttctgagacaatctattaacctctattcctccttctttccttcgctcccttcccctcacatactcccatcccagaaaagcacctgggcaagccagttactggtctgccactccaccttattcccaggtttcaaattgcacaaagactttacggcctgcttctaactgcccatcccactcctttttcggcagcagagccaagactccaaagatgcaagtcacgggccataaggaccaaataaagactcccattctcagtgacctggtgaaactcagtgacactttcttaatatctgtcccagatgtaattgatgggatccttccaaagaagaaacaagccagattaacccagcctcctcttctgagaccctcaggcatcccaaaattacccttggccacttacgaagtgcaatctttgatgcagtctctgcagtttccatccttcaagtgacatgctgctcggttggagtagagaacactttcttcttctgggtctgaagaacctgcccagatagagtggggaagatgatcagtttggaaaatgggtgcctcagggcattaggatacatttcaaactcagagctctttgggccttgtgttaaggcagtagagataactataacctgttcaggcttgttggtctgctgggctggcgtgtttgtcattcttatgtgacagaaggacactgcgctttttgccattcaaagggaaccaagtatttcctcattcactcattccagcactgaacttgataacagacaaaagataaacaagaaatagctagcttctgcctcaaagaaatccatgctgtaactacttgggtttgggtggataaatggatggataggtgtgtattttattacaaaaagcatttaaatccaagaaagaaagaaaaaaaaaaaaagaaaagaaagggagggagggagggaacaagatgataaacgtatgataaatggattgaccaaaagttgtaggggcacaaaacacccatgaaagacatgagactagttttacctggtcaagccagggaggactttgtcagggaaatgataattgagctgggtgtgatgggagtacagagaacttaatcaggaaaaagtcttaagctaccccatggggagaattattagacattcttctaaggcagtccttaccctcaggaatcgcagaggctcaagtccttcactgtggccaccatgatctttatttacgtatttttttttgagacagagtcctgctctgttgcccagcctggagtgcagtggagcgatctccgctcactgcaactccacctcctgggttcaagcaattctcctgcctcagcctcagcctcctgagtagctgggattacaggcactcgccaccacgcctggtagagacagggtttcactatgttggccaagctggtcttgaactcctgacctcaggcaatccgcctgcctcggcctcccaaagtactgggattacagacgtgagccaccgtgcccaaccaacaatgatctttatttttaaagataattttcaaccacttcatacccactagtgtcggccattattttaaaaagaattgaaaacagggtctctttttgaaaattttgaaacatacagaagaccattatctcagaatccaccactagatttagcacgttatattagttcccaacttttttaatttttagagacagcgtctccctctgttgcccaggctgaagtgtagtagcacaatcatagctcactgcagcctcaaactcttgggctcaagtgatcttcccagctcagcctaccaagcagataggactacaggtgtgtacccccaagcccagttaatttttaaagtttttgtagagacagagtcccactgtgttgcccaggttggtcttgaatgcctagcctcaagtgatcctcccgctttggcctcccaaagtgttgggattataggcatgagctatggcacccaacccttaaaaatttttttgataagctaaaactccagccatccccatccttatccctgtgctccctccccagactcacagaggccagtacaatcctgaagttggtatgtaacattttcaagcatgttctacatttacatatatatgtatatatgtatatgtatatatgtatacatgtacatgtatatatatgtatatgtatatatatgtgtgtgtgtgtgtgtgtgttaacaggaaagataccattttatgtctattaaagcatttcctaagaggcatcatattgcctatccttctgcaacttacttttttcactcagtatcctgttgccatgttgatatttgatatctttcattcaataccaacaataacaagcgttttcccctcttgttttgccaggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaatcgtggctcttccatgtcttcactatgtaaccccgagggagccaatttaactctcttggactcctcctttctaagcattttatccacagggccataataaagatcaaaggagatcgtgtctaaaatgtctagcacatggtaaatcactcaagagatgctagccaagaaaaggaaaaaaaggaaggcggcaaagggaaataggtactgaacggtgactcacagaaaccaggatccaaggctcctttcaaaagtcaaggctttaaccaatgagggtttctgattaagtcaccctggagaaggggctttgggcaaaggtctgcggtatgctgacgaaagctggacgctgggagaactggtaagaatatgctattcttctgtttcaaactctccagtagcttcccatccagcagctttcatgccaagcttccagtttggcatgaaatccgaactccttagcagagtttacaacacctccacaataaataagggtctgccttcctaactgacctcatgtcttcctattccctgccctggctcactatgctttgacccctgaaacacaccatgtttatatcgtcttggagggggggcctttctcattgcagttcacttcaggaccgaaaaccttgtgcgcttggcttctcatcatttagacatcacctcaaatatcacttctttacagatgttgcccttgatctcccactccagtcaactctatcacatcaccctatttgtcttcttcctaaccctgattatcccacaggtctcgtttacttactgactcgcttaagactcacgtcctccccaccgcccccacaagaatgcgctgtccttgagagaagggactttttgtgtcttgttacacaggcggtatataacagctactcaacaaatactaactgaaaaatgaattgctgcgggggaggagggtttagctttcttctcagggctcagaacgaggcctaaataacttaggatgggggccaacagggcagttaacaagcaggtggaaagaaagggccgaggaagtttctggtaggatgccggagtcggaaggggctggaagggtgggagggccgggcaggactgctggccgccgcgcgaggcccgggcggtggttgcgggagttggaggagcaggcccggaggtgagatgggggccggggtcgtaccttgcgcctgcagcacccgcagcgcgcggccgtagagcgcggaggcctcggcgtactggccgttgcggaaactctcattgccggcggcgcggagctcctccacagagtctgggaatttgggggccatcccgtggccaggccggcgagttgggagctccttccttcctcccccgtgtggtgcggcacaccttccgggcgcaagcgccggcggcgaatatctccgcccaacagcgaacccgcggcgagggggcggggcctgcgagacct

SEQ ID NO: 225 - DNA, 2660 bp, Homo sapiens
ttgtaaaatagctttattgagatataactcacatattgaaagtgtacaattcaatgccttttagtatattcagagttgtataaccattactacaaccaattttagaacattttcatcaccccaaaatgaaatctcacaccttttaatcatcccctccaattcacctatgctcccttccaccagggccttagacaaccacaaatccaccacaggatttgcctattctgaacatctccaaacctgccaaagctatgccattaaaaggcactacagcaaagagcatcatgcaacttgcatcacactgggggcctggcacagaagtggcggtggtggcaccaggcagggcctgatccacggggtccagggtgaccatgtgggtcatgcaaatggcattacacaaatatgccatgcttggctaagttttttgtagaaaaggggtttcaccatattgcccaggctggtctcgaactcctgttctgccttggcctccaaaagtgctgggattacaggtgcaagccatcatacccagtcccttgaatactgttatgcaattgttccccattttctgccaggtgttggtttgaggatctattaggatactaaaatgtgagtatactcatgtactatagttgaccctgcagaacctatggaaacgaaaagtcagcccaccctatacacaggtttcacatcccatactgtattttccaaccatgtttcattgtggatgtggaaccctctgatagagagggctgactgtatttattgaaaacaaaacaaaacaaaacaagggttgtattggtggacccatgcagctcaaacccttgttgttcccaggtcaactgtatatccagagcttataggaaaatacctctcccagtaaccctgctcaccatttctctcttaagctattattatgattagccacggtttgctatttaaatttaaatttaaataaaaatgtggcctttcagttatgctagccacatttaaagtgctcaatagccatatgtggctaatggttactatttcggacagcacatatttagaacattcccatcatttcagaaattttcattgggaacactctgcggaaaaagggggccatcataatgtgagtccatcttctggaaaaatcctgggaaggggacaaaggaggtctgtttggcattgtgtaatggtaatttggtatttaattttcaaaaatgtttacccaattcctattcatcagccaggtgtggtggctcttgcctgtaatcccagcactctgggaggccgaggtgggaggactgctgcagcccaggagtttgagaccagcctgggtaataatagggagatcctgtttctacaaaacaccaaaaacaaaacaacaactttgatgttgtggagtcaggacagtcctgggttaaaacctttgctctccttagctgtgtaaaccgtgggtctcagctttcttatctgttaacggtaggtacttcttcctagggctgttttgaggattaagtgaaagtccaagattgtgtctggcacacagtagcttctcagcaaatgttttcctcctatgtcagggaatggctcctttatcccgttttgggcccatgggtggccctgaagggtgggtgctcaggtgttaagttctgtagatggcatatccttgggaaaagcaaggcaattaaaaacagtgagaggttgctctggttaagttttctcctataactttccccatgggtcaattgggtagaatctgccattttcctaatacttactgatggtagtggcattcggaagcacaatagctgaagccggagctctgagtggagagaaaggtctgtttctcaggcccaaaaagaggttacacacccatggctgtccagtttggtggtgcaggccctgaaatcagaccaaactggatttaaatccccaaacctatactctaagctatgtgaccttgggctagatacttcacctctctggccttatgaagtaggaataataataataccgtctaggttgttaggagtattaaatgaggtaaagcactgaaaacgtttagggactgtgttaaatcattaaataaataaaaacggggatgaccttatcggcttgacacaggggattaaatgagataatatatgaagacaagtacacggcaaatgcttaattaatgttgcttatttttatgtctgcaaactgacttaaaggggaggcctttaagaaagacagtggggcaatttgcgcgttgatgcattgtaggagaaaatgtgcagggggcccgttgggaccagagttcaaccaggtaagcggcagaaaaccacaaatacctccaggcgttcctggggcagcgccgcctccccaaaatcacgcaaaacttggtttgctaagaattgtcagctcttctaaaggaggcgcttcacgcatctcagtctgtgaaatgggacccaggacccaggtagaggtgcgttctcggcctggggaccgagtattttgtgcgctccggtaacgcaggaagacagcgccactgacactctagagaccagcgggcaccgcctggaggcgccttcaccacttggcggttccgggtccgcgccccaccgcgccacaagactcacgcccgaaccacgtgatcagggccgtggctccgccccgctcccgcgccgcgcgcc

SEQ ID NO: 226 - DNA, 113474 bp, Homo sapiens
gcggaagtgtgggagggtctgcggggcgggctcaggaggtccgcgggaggatggagcagtgagcgggtctgggcggctgctggcagcgccatggagacggtacagctgaggaacccgccgcgccggtgaggggccactggctaagaggacgggcatggggtcaggggaagaaaaggcgggaactggttgaggggatacacctgtgtgggagtccccggagctaagcgacccagccgatggggcacctgctgagtgaggggggggacgtctggtgggtgagggtccggctgaggggagcatctgctaaggaggttagacttgggaccggttagagggagcactcgctgtggtgagactgtgctgaggaacgtggggacaagttagggagagtacctgctgaggccgggccactcgggggaacgctatccaagcagggactcacggaggtgggggcgaatgctgaagcagggtgagaatctgtgagggatctctttaagggggtggatcgagaactggccaagaggaaggccgggtggactttctaagggtctgaagtcccacttgaggggtgcggtggggggatctgtggaggggaaaagctttgcgcctaaggctgaaagcatgcgaggaaaggttgagggtctagcaagggaggggatggtggagggtagcatttcagaggatgctgttggtggtgtccccactgtaggatggcatcttttattactgatgttcagtgtcttcctaatggtcttcacatcctcctcagctcttcagaacctgacattgggaggtaggtaaggaaataagaggatattttcgagatggggagactgaggtccagagtagttgggaagtgtttccttctttactccgggtcactgaaccctgccagtctgtgcccttttcaggcctcagttgttttgtgaatatcagcaccaaatcctagtggtacctggaattgctttagttcaagatcaggatggtggctgatcctagaaaatctcaactcctggatttcccttgtggacatcccgggtcttttgccactctaccacatctggagaaaagtagggactagagaccgaaggagtcatgcttctctgaggttcagtgtggttacttctatttcacagagacgtctgacttcctgcagcagaatgagctctaaagaaggaagtgttcagggtgtggaagtgcagggcaaccaagaggtgaagagaagggattgactgcctgggcagcactcttaggggttgtttgagcttggggatgtttgaggtgcacaaacattgcagaaggcaaataggtggttgggatgggctttggattcaccctagcgtagtgtgctgagactgtaatagtaatgattattacactcatattgcacttaccgggtgccaggcactgttctaagtgctttccatgtgtcctgctgaagcatatgaaattgctgatatttgaccatttttgaaccataaaaacctcatttgaactcatttgaacctcacaacaatcctgtgtggtagatatccctatatgtctgttttacagatgataaaactgagatacagagggtagtgatttgctgggagaagtcatagcaagtaagagacagagctaggattttaatgtctatggggtctggtccaaagtccatgttctttttttttttttgagacggagtctcactctgtcgcccagtctgaagtgcagtggcgcaatctcggctcactgctacttccgccttctgggttcaagcgattctcctgcctcagcctcctgtgtaactgggaccacaggtgcgtgccaccacgcctggctaattttttgtagttttagtagagacggggtttcaccgtgttagccaggatggtctctatctcctgacctcgtgatccgcccaccttggcttctcaaagtggtgggattacaggcgtgagccaccgggcccggccatgctcttaactgcctcactctgatgcctctctaaaagtacccctgtttcacaggtctctgtgtatgttagcagatatttactatagtaccatagtgatccaattatgaatgcacactagttatgtttctttctgaactatgttcgttcgttcttcttggtttctttctccgaggccttggtttaattgaaaagaggattaggaatctgagttttgtttccccctttgccttgtcttacataatcttgagcaaaggactaaagtttcttggcatgctcattcctgtaccttttggattttaaaaaatgtattaaaagcacaagagaagagcattgcaggactgggttctgaagtggctggtgattcccagctcattgtaactagtagattgcctaatttgaagcagatcaattttattatcacgtgtatcagtttatcaggacaagacaaagtgtcatggagtgggtggtttaagcaacgtaaatttattctctcactgttctgaaggctagagatctgaaatcaaggcattgtcagagttgtttcttttgacgcctttgcttgactcgtagatggccatctccctgtgtctccatgttcttccttctgtacctgtcagtgtcctaatctcctcttataaggacaccagtcatactggattagggcatgcccatatgacctcattttatcttaattacctctttaaaggccttgtctccaaatacagtcacattcttaggtggtgggtattaggacttcagcatatgaattggggtaagctggggacacagttttattatgtaagattttgtccatttatcatgtatagttgttgtaatccatatcaaattctgtgtggaaaaagaaatagttacacataaaatgaactttatgggagttctgaaatgggagaaagctttgagaattagccagacctgtaagtgactacttcatagacaccattacttgtgtttggaaagatacaggtgtcttttcagaaattcagatggcatgtgtttccaataaccccagtgcaggaaatgccctttgtgttcgtgagtttgacatttgtgtgtgtgtgtgattaagtgatgacagattggtgtctcatataggagttaataattttaaaaaatgagttgccattagattaatgttatagtggaaggcgtagagtgcattcctgggatgctggccatccacatggccatctgacttaggagaggagcatccaccagtatttggtccatggatgctctgttgatcaggcttgttcatttatgagcaagtgctgaaaccgtctggaacctggggaagtcccagataagagaactgtattatcagagtcaggctgttttggtaatagtgttttttctgtgaagagtcatggtataaaatattattatgaatcacttatcaaaatatttttatagaaatgttgataattcagtaatacttcttaggtgaaattctgttttattgtgataattcaaagattgctgatgaaattcgtgattcccatcattacatttgtgaatccatttcacaaatatattttgaccacctcttggttatcaggcaccagagatgtaatagcgccttaagttcaagttgtttttaatagccccggatcaaaaacaaacaaaaaagcacttagattgtttcaaagatgtattcgagccgtcatatgctaaatgacgagttaatgggtgcagcacaccagcatggcacatgtatacatatgtaactaacctgcacattgtgcacatgtaccctaaaacttaaagtataataataattaaaaaaaaagaaaaaaaaagtttgtcaaagtattatcagaggtttgcagctgtctatctcaaggcagtggcaatttcctttgttatgctgtggtccctgaagtagttgaaatagtgacttttgcattttgtaaaccacagagagtcaacacttcaaagaaacatacttgatcttcctttgtataagctgtttatacaactttgattatacttgagaagtgaggtattgtccaatgtttatacaattacaattcaggactttaccaaaaaaaccctggcatatgagatgttcgttctgacttctgagtttatagaagtttcagttctgaagtttaagaggagtttcacttcatcccttttcattttgaaggtaggagtttttatgatgtcattggtatttaatttttaggaccttttgattttcaaaggtcactgtgatcattttgttctgttgatatcaagttaaggcagttttgacttggagcagttctccatttctctagtttatagtccttgatattcataaactataagattgtccttctgagatcagtgtttattggtagatacacttgatgtggtcagggtttttgttggtttgttttattttttgtcttctaattttaatctgttttatttaggaaggtacacatttgtgtgtgtgtgtgtgtgtgtgtatgtgtgtgtatttaagtcttttgttgtaataattgatattatccagctagtctaaacctttttttttctacaaagaggtctccagtgtgactacttccatatttcaccgtttcctcagctctctattctttgttgttctttgtagtttcaggaagccattgtgtagactacacacacacacacacacacacacacacacacacacacacacatattccttggcaagttccttctttaagctcattagtaattttcagagatctcagagttttaaaaaaatgttaatttataacctcccatgtttgttatgattgtctagcatagtcagaaatctgaattatctggaaattgtgagcagccaagtacctttgatttttgggactagtcaaaggtatgtatctactcataggaaggtctttgtgagaatatctgaaactcacagctgcctagtgatttttcacttttgatcatatctaaatgtacactttccactttctgtttctgtgatacctacagaatttatgtgttttgacaaacttacaaaaaacttgctaatggaagagcaaaggtttcccgtgtcttccttagtctgcagtccaattcatagttatgtttcaattcatagttaccttacattaaacaccttttctgaagagataattacatcattttaattcatgaaatctcaagatttaaatagattttgaaggatacatcgaatgcttgaatctacagcatttcagccacatgactttttttttttttttttttttttttgagacagtctctctctgtcacccaagcttgagcgtagtggcgcaatttcggttcactgcaaactctgcctcctgggttcacgccattcttatgcttcagcgtcctgagtagctgggattacaggcatgcgttaccacgcccagctaatttttttgtatttttagtggagacggggtttcaccatgttagccaggatggtctcgatctcctgatctcgtgatctgcctgtatcggcctcccaagaaaccttgtttcttaaaacagtcttaactagtgaagtctgtatagagaagttcctgagatgctaattataaaaaaaagatatattttatgttctagttcctagcaaataaaatgtattttgtgtttatatttctttattcacaggcagctgaaaaagttggatgaagatagtttaaccaaacaaccagaagaagtatttgatgtcttagagaaacttggagaagggtgagtgtaaagaaactataggtaggtcattgggtcccagtctttttcctgccccagaagaagcagaaggatatgaacctttcagcattgttctaggtggggtggaaggtaaatttacagcttgtgatgtccttcttcgctttactccaatccctattatagacagatttagtgattcctggtctttttaacacgaagaatatctattgttttctcttttgtaggatctgtatgattttatctacttaacagatagcactaattagattaaaattctataagaaactttttaatttgctgttcataatttctgattggtatgcaataactgtttcaatgaaaatcaatgtaatttagtattttaatatttgcacctttgtgaaatatagtaaataaattaagcactatcaccaccttcacagctacttaggagatccacaatcctgggttgggagccagtggatttcctgaaacacagatttgttaatgcgtttataaaatactgatgaaatgatattagtaatgtgcagtgaccatcattgactttcatgatacaattaagtttacataatttttatacttttatatatcattttaattcaatcctgtgtatttattccttcttctgtaatgaccaggaaattaaaatgttaatgacaccatttcttaagtttttcttgttaatttttgaataggcgatacaatcatatgattcaaaatttaaaaaaatattaagacgcatacaataaaaaaaaaaaaaaactgcctcctacctctctctgtctcttagccacccagaatcaccaagggtagcggcttcttgtgtgtctttcagagacaggctatgtgtgtgcgagcgcacactcgtgtttgtgtgtgtgtgtgtctgtatttttaatcccttgggagtatttctggatcaagggaagacctgacatactaacttgtaaaaacaactactgactgatgactatatgctctttaaaataatttcctttatgtcattagattattttttgggtttagtattttttatgttaggagacagatttacaacgttaaacccaatcctggattacatgaaatggtttttttatgatttacctccttgtaaaaaacatgagtcatcgtctttttgtaagttggaaaaatactctttggaatccagcaagaaatcaagcagagaagggaagtaaaaatgacacaccagctgtgctgtgaaaagacaagtccaagatgaatctgaagactgccagttgactggcatcattaaaggtatggggaaatgacagtccctctacatctgttgcctgccattttcagctttagcttgccatccttgctattttccctaaggcagcaaggctgtgacctttaatctaacaatgctcataagttatacttagaataagttcaagactgataggcataattgactatgtaacttatttctctcatttctaatacagtttgctcttactactacaatgtgaggctgacctgggttaaaatccttgctctactgtttactggtcataatagacaagtgggcttaagcaaattgcttactattttggaggctcacaatcctcatctgtaaagttgggataataatatatcaattcatagagttgtgttattacctgaggtaattggggtaaagtatagtgcttatcacaataataaatgttcagtaagtggcaactattgctattctattttaaatgtatcaactgaagcattttcaagacctcatcatgtcaagtcttaaagtatttttaggtgttgttataggtagctctgagctgattgggtttgtggaatgtcaaaggaagactatagacagagaatatatcagaaatataatgtaaacaaaaaataagctaattatgattttttaaattgtattttatttatttgtttgtttatttatttttgtagagacgaggtctcactgtgttgcccaggctggtcttgaactcttggccttaagtgatcctcctgcctcagcctcccaaagtgctaggattagagacgtgaaccactgcacctggacaaattgcgttttagatctatggatgtcttctgcaaggaatgtggaaatttccctatgaagatatcaccagggagaaaacaaagcttcagatctttcttcccatactatcaccttattgttcttctaaataataccagatttctggtatttcttggatttctgttattctgactgaatgaacctaagcaagcctcatttaactaggaatattttgaaggaagaccttcactgcacttcttttccaaacatgtgacacaatgctattctttttttttgagattaagtcttgctctgtcaccaggctggagtgcaatgtcacaatctcggctcactgcaacctccgcctcccaggttcaagcgattcccctgcctcagcctcctgagtagctgggactataggcacacaccaccacgcccgacttattttttgtattttagtagagatggggtttcaccatattggccaggatggtcttgatctcgtgatcttgtgatctgcctgcctcagcctcccaaattgctggaattacagatgtgagccaccacgcctggccaatgctattcttaaattgttcgggaggatgaatggtttgtgaactctcactgacttgtatcttgtgaaatgagctatggctaaaaaaactgttggattctggaggctgcaatcattctgtgttatgaggatcatatggatctgtggcagagtagagccaaagctccagaccaggatgagtggagagcacttgggaagtgttttcaagtggagcctagcaccttttttcttctacttaaagttgtacacattgactcatttgaatttttatcatagaatgataacaaaagcatcttgcccatggtttcataaaaaatgagtgctattgttaagacttgtatctgattaatttggcctcagatactgtggtatttccatttttctacatagatccttgccttgcatggcttatgtaaaacacctacttctccattctctgctgtcagttgtaattcattgaatcatctcattttgttgtagggaatcaagttttaagggacttgcttgtgagtatgattgctgaaatcttctaaccaccccctatccctgccttcagattactgtagatgcagtatatggaatcaggaatcttaacttcatgtgagctattggagttttccttgctatcaggatgcatagggaggtatgaagagtgttctggtcaagattgctgagtgagtgtatgaagagaactttctaatatataagaataatgagtgaaaattattttaaatataaggatatatagacagctatggacaagggataggaaagaaatctaaataatcagcggagactaaagcatgccttatccttgtcaggagattgcatttgagcttcctgcatgaagttgggggctggaactcggctctccatctgtgaactaaagctgaaataaatttgcctgaccacaaccagaaagtgtcatttgcctgtggcctagggaaaaaatggatatactggttcgataataggaactgagcttggattgtatttaagtatggtatcttgaagggcaaaaaccccaaactctgaatataagacctggtttaagttgtatatcccagactactgtactgagaaaaccatgaaatcatcgacagtgagtgtggtatagaggaaaatcattcaagagaaaatgaaatccatgcaaggaaatctactgccatgagataatcagcagaatgggagaattcacactgaaggaaaaagaaataatgaagcaatctcaaaaacaatttaatataattacaattttcaaaaagatcaaggaggagataacatttttaaaaggacatcagattattgacatgattattaacatatttgcccaaaggcagataaaaagttgggaatcttgacaatgaaaactacaacaattgaagttttaaaagcccaataaattggataaacagtaaactagacaaactgaaaggagaatttgtgaattgaaagatagaaatgagactgatcacaacatgcagaaatacagtgttggaaaccaggaagacaacatagattgaggaggtctaatacagttttggtaggaattctaaaagaagatcctagaagtggtagaggaaataatcacataataatcctgagagtttttcattcttgaggaaagacacgagccctcagattgaagaagtttatgaagtgccagatcaactcctagttacattacagtagaatagtagactgttaaggacaaaggaaaccttaaaaactatggggagattacccatggaaaatgataatctgataaaagctgacttctcagccacagtcgatgttggaacactgcaacaacagtgctgagggaaagctgttgtcaatccggtatccaaccaaactatcattctagagtggaggtgaaataaagacagtttcagacatacaggagctaatttatcaagaatgcctttggatggaagtaacaatacccaacaaacagtggctaaccaataaagacattaagaactaaataatacatctgggggtgtgagattcgagaagccgttaattggcttgacaatggtttgacatctgggtaattctcgtagtctcaaatggctgcattagtttcaagcatcatccctcacatggcagtaaccaaagaaagaagggaagtggcaggtggaaatgggccttcttgtgtgcttgtctcctaccagggaagaaagtctttcccagaaacctttcagcagaattatcttcaaatttcagtggccagaactgggcgacatgtttgccactagttcagtcactggcagaagggaataggaattctgtgagtggcttggactaccatggtatatctcctgggacgaagcacatcaccactgtaacaaattaggaagttattttagcaaggaagaagggacacatgctcaacagttgcctctctctggcaaaaagtatttggtgtaatatttaaggatgattatgctagttttgcaagtatgacagcttctaatggaatggaaatatttttatgtgctctgcatagacttaaaaagttttatgttactttcacattgaaacagttcatgagcatctatttggcagttagagtattgtactttgacatagtaggtggcactgctattttgattttttttttcaccaagacagtgtgaagatacagatgtgttgggaaatatgaaagacagtttactcagtattatttcactgacagctgcccaggattccaatgaaaatgttatctgtataaagtgatgatggtatctcatttgaccatcacaaatgagataccatcacatcttgtaaggtagtttgtattattgtcattttacagatgagaaaattcaggtacaacaaggttaataaggtgtaaatgatagctaaatgtagtgttggtaggactcaaatccagcttctttactttcaaaatctagtggatctgtagcctccaaattgactagatacacaaactttattttgatattaagctgttaagggaagatggagtaggaagcaaagagtgtgtgtgctgtgtttacctgatactaatattaaacaggcttagattttaattagtttccataatattttaagtattattgtaagtaagaggagcaaggacagaaagatcttgtggtactagagtgaatacaataaaacaaagactgccacttccatattgtaccccagtatagatggggagacaacgtaagctttgttttcagacacacccgggttcaaatcctggactgataacacaactggtttcaaatcctggactgataacttatgtgaccttgggcaaatcataaacccctttgaacctttttacatttacctgtaaaatagggatagtcatctcatcttcattttttgtaggaatgaattgagatggtgtacagtctctagcagatagcaggcatgcagtgcatggcagctactatattaccatctcataagaatacattcattacagttttgaatgtgaagctttcaagatgccattttgttgtagttctcttgacagttttttccccaaaagtattttagctatcttagttttgcaagtgtatatgtattaggcacttagggatatatgttagaactatcagttgcttgtgttttaccacttcttatatcttggcttgctttgactttataaatgttcttcttctcccaaatgtataggtcctatggcagcgtatacaaagctattcataaagagaccggccagattgttgctattaagcaagttcctgtggaatcagacctccaggagataatcaaagaaatctctataatgcagcaatgtgacaggtaaaggcatgtgggcttcctttggggagaatgtggttttgaattagctatgattgtgtagagtttgatacctagagacacatttacttagatattttgcagaagggagaattcgatggaatcactgtgcattttcttttcagaaaaaaatatgatgataatggttgtttttgtagctaaacctccgtaatttttatgcatggtgttttgtttttttttttcaatttttctttttttttttttctgagacaaagtctcgctctgtcgcccaggctggggtgcagtggtgcaatctcggctcattgcaacctccacctcccaggttcaagtgattcttgtgcctcagcctcccgagtagctgggactacaggcatgtgccactacgcccagctaatatttttgtatttttagtagagatggaatttcaccatattcgtcaggctgatctcaaattcctgaccataaatgatctgcctgcctcggccaagtcccaaagtactgggattacaggagtgagccaccatacctggcttttttcttttcttcagtgagcccttttagaaactaggaagaagaggcagaaggtggtgcttgcttttttttgtgtgtgtgataatgatcttttttacttcctattgagaaaacatttctgcagagatagccaagaacagataattcaaatgttttttagttctagaaaccttagaatatcaggtaaatctataaaaaaagagtagttatgtatatactactgtttgttccttcacattaaaaaaaattattctagctgagagtacctacgtatttatttttgaggaactaagatttgtcaaatgttgtaagcaggaagtcagaccaaaagacaaccacagaaaaccacgtggtttgctctgaaattccatgacaacatgggttggtcactgatagagcaggcttccccagcactatttagattagagacaaacacaaagttaggggcaatgccagctctagggagctgaagatgggtgagaaattctctcagttgaagctgcattcattcttctgaaggctttttggtcagcagatcaacttagtacctgctgtttgcaaaacttctacattagggtttaggtggggctacctaccaaaaaattagtccagaagcctttcagtctcacagacttgggaatgtagtcctttcttttttctctcccttctttttttttcccttctatttttgtgattactgtctactagataaaatccccatttttcttgattggattgaccagatgaaggtggcagttttccatttgctcctttttcagatacattttggaagttctttccatttggcaaattgggactttgtcactttcgatagactgtgcgggagctgtgttccaaacagagtatggaaatgtctttaattaaagaagagatattttcaagcgtctactctgtgctaagcactgtaaggaatacagtgaaatacagagcagagtccttgtgctttgggagtttatagactaattggacaggctaagtatatatatatgtagaggagaatctagccaacagtgcaagtctatagagaacatattccagtagtaaatacttgatagtaatggcctacagtatttaactcctgtcagtactgtattacagggagagtaaatgtgttgatatttaccttagacacttttttcattaatatttaatgtgtgtgtgtgttttgctgtccttgtcactggcatgtttcctaaggtttgaagaggaaattgtaagagttctgagttaatgaagccaatttggttttaacatcagttgttaggaaacttcatttggccatgataacaatctagccagttaaagctggcagctctcagagggcacattattttattttaataggatatttgatttttctctgaatttcttgtttggtatctctcttccagcttgagacctaaaattccaggtttgatcctgaacattttttctttataatagattgtagtatgtgtatgtttttattacaaagtacatatgacttcttagaaaaattcaaatgaaaagaaaagaaaatcacttttccctttggagaaatcatcattttttcttttttttgagacggagtctcctcactctgttgcccaggctggagtgcagtggcgcgatctcgactcactgcaagctccggctcctgggttcatgccattctcctgcctcagcctcctgagtagttgggactacagggcctgccaccacgccaggctaatttttttgtatttttagtagagacggggtttcaccatgttagccaggatggtctcgatctcctgacctcgggatccgcccacctcggcctcccaaagtgctgggattacagatgtgagccactgcgcctggctgaaatcatcattcttaaacactgcttgatacacatattcttccaaatcactttggagttttacagtaattcctgttttgtagcctgcttttttgtttgtttgtttgtgtaaacacagtatcttctcatgttatcacatagtctataacatttttcatggattcatgatattttattatacggctatagcattctttgttttttttgagatggagtcttgctctgtcgcccaggctggagtgcagtggcgcgatttcggctcgctgcaacctctacctcctgggttcaaacaattttcctgcctcagcctcccgagtagcagggactacaggtgcacactgccacggctggctaattttttgtattttagtagagacagggtttcaccatcttgtccaggctggtcacgaactcctgagctcaggcaatccgcccgcatcggcctcccaaagtgttgggattacaggtgtgagccactgcacctggccctgtatcattatttcttaaataaactccctaatgttggatggacatttagatgatatctaaatttccacttttgtcaatagtgctatgatggtaactgttactttttgaacatttataattcttttttgaggataaattgtagacatagaaatgctggttaaagaactcaccaagttttttatacttttgtgatttattaccctccagaaaagctataccattttgcattcttatcaggaggttgtccattttatccttaactatgaataattgatctttccagatgaggaattaatttgtatatacttgctagcatgaattaagagatatttgaaggccattttattaatttgtattgtctctctctctctagccctcatgtagtcaaatattatggcagttattttaagaacacagacttatggatcgttatggagtactgtggggctggttctgtatctgatatcattcgattacgaaataaaacggtaggtttaccttctagaacatgcaactgagctagtttcttatgccatcttcttttctctgcctctttttcagggcattctcctactagagagacgactgtcagatttccccttttccatggttattttccatctttattcttttatgtctcctaagtgtgacagctttttttttttttttttttcaagagaccagagtcccctgtcacccaggctggagtgtagtggcacagtcatagctcactacagtcatagctctacctcctgggcttcagtgatcctctcacttcaggctcctgagtagctgggactacaggcgtgtaccaccatgcccagctaatgttttgttttgttttttaattttttttttttgtggagatggtgtctcactgtgttgcccaggctggtttcgaactcctggcctcaagcaattttcccacctcggcctcccaaagtgctgggattacaagtatgacccccccatgcctggcaatgtggcagttttgacaccaatttagtccagtgatttttagcatgctttggttatttcttactgggaagaaaatgactgttagatcttagttatagaatgaattttaaatgtttaaatttggatttggatttgggtttctgcttctacctagcgtgttcacaaattaaattcctgtatttcctgttaatcagagaataatccccttatgaaagattatttgctgatactgtggttgcagtataagacctaggagtcatgggttttagttctggttcagttacttaatgtctttatgtattcgttcagtaaatatttcttgaacactgttttaggcctgaaggatctaatagtaaataaaacagatgacaactctgctgtcatggtagtgtacttcggaatagggcaacaaaagcaaattaatagtaactattaatagaaaagatataataatgatatatactatgaggaaaatgaatgaggatgaagtgatggtaaagttgtggagactggtgggctattttagagtagatagttgaggaaggtcactcagaagtggtgacgtttacaggaagactcaaatgacgaaaaggagctaagagtcctgaaggaacattgtaggtgggcagtaaccagtgcaaagaccttgaggctggaatgagtttggcatgtctgagtgatagaagggctaccatgactagaagggaataggcaaaggagaagctgtaggagatgaggtttgacaggtgggcagggctagattgtattggatattgcaggtcatgggaatgagtttgaattttatcccaggtattataggaaaccattgctggattctaagcaagtgagcgagccatctgatgtatgttttagaaagataactctggggctgggtgtggtacctcatgcctgtaatcccagcacttggggaggctgaggcggaggattgcttcagtccaggagttcgaggccagcctgggcaacatagcgagacctcgtctctacaaaagaaaaaagaaaaacaaaattagtcaagtgtggtgtcatgcgcctgtagtcccagctaacttttggggtgtgatgggggttgaagtgggaggattgcttgagcccaggaggttaaggctgctgtaagctgtgattgcgccactgcactgcagcctgggcagcagagcaagactctgtttcaaaaaataaaaaagataactctgacttctgggtagattgtgggtggataagtggagaagtagagaaaatcttagcctgtggtttttttgtcttaataagaaaaataagaataataatatctgtattccatatttgcaaagttgggaaaattaatttaaatatgtaaaagtactttgtaaattgtgaggtgctacacaaattataaggtgagggtgttttaaaactgagttataacttttggattattcatatactatcttcttaatttacattattcagaattagtgtgtttgcttaatcgaatagcaagttctttaggaataatatcctaacataagatatatgtaaagaagttccaaaactggaataatttattgaattaaacattggatttcagggcttcttatatgcagcattaagtcaatttatttcaggtattttaaactagtccaaaattaattttgatggcacttttggtttttttttgccattgtaatagtaggttattatatttaagtaaattttaacttaattactaagtgctggttttttgttgttgtcgttgtttttttttttttttttttttttgagacagagtctccttgctctgttgcccaggctggagtgcagtggtgtgaactcggctcagtgcaagctccgcctcccaggttcatgccattttcctgccttagcctccctggtagctgtactccctagtacaggcgcccgccaccacgcctggctaatttgttatgtatttttagtagagacgtggtttcaccgtgttagccaggatggtctcgatttcctgacctcgcaatctgcctgcctcggcctcccaaagtgctgggattacaggcgtgagccaccgttcccggcctaagtgctgatttttaattactacacgttattttgccaaatgttataactctgccctgtccaccgtgatatccactagccgcatgtggttattaaggacttaaaatgtggctagtctgaactgagatatgctgtaaatataaattatacaccagagtttgaagaattattgccataaaaattgtaaacaaaaatctttgattttttcatattgatgacatggtggagtgataatattttggataaatatggttaagtaaagcagattatcaaaattaattctttctttttttttttcaaagatagagtcttgctctgttgcccaggctagagtgcagtggtgtgatcataggtcactgtatgttggaactgctgggctcaagtgatcctcctgcctcagcctcctgagtagctgggattacagcaccagccactgcgtctgcttgtttcctttttcaatgtggctactagaaaattaaaaattatatttgtggttcccattatatttctattaggcagtgctacttcaactgattaacttaactggttagaataaagaggtggtaagtcaagtcatgagctttgttctcttccactatagaaggtaccccagactctagcctactaccttgccagtagtgtttgcctggactttagtgaaagctttatcatttctctctgacttttggcataaatgacttaacttgtctgtgccctcagcttcattatgtataaaatgatgatgataataatagttcctctacctcatttagttgttataaggatgaaatgagattacatagtgcttagcatggattaaacacttagtaacggttagcctttatttatttatttatttatttttgagacagagtctggctgtgtcactcaggctggagtgcacacaatctcagctcactgcaatctccgcctcccgggttcaagtgattctcctgcttcagcctcctgagtagctggattacaggtgcctgccaccacacccagctaatttttgtatttttagtagagacagggttttgccatgttggccaggctggtcttgaactcctggcctcaagtgatctgtccgcctcagcctcccaaagtgctgagattacaggcatgtgccactgtgcttgactttttttcatattattagcatagtacctggtgcttattaaatattgattgataatatcaaaggtgttaaattatgacatattaattgattttcatgacactcttaaaagttatattcctattttatagattgggaaacaggctaagagaataagagaaggtcagtaacttgcttaagtcacatgaaagtagagccaagagtaaaagctacgtcttcctagtcccaaatcctacagtttttgcaccagagcacactccatttcacatctgagttgtttgtcagaaggggaactatgtaacagtttgttgatagattgagtttgtttaggactggtgttgggtctgcagaaagtctatattggccagatcagatattctatactagtttctagcattctcactttcaacagatatttttttcagtgcctactgtgtgccaggtggctttattggtattagggaaacaaaagtaaacaaatcagacatttttaggagcttgtgtttctaacagggatgatatcacatacatagataaataatgggtaatatgtcagatggtagtatactgcagtgacaaggtaatttaagggaatagagtatgagctagaaatggagtaagaaagccctctccattttctgaggaggtgatatttgggcagattacaaactgaggaagcatactggatagacatcaggatgaagagaataggcagttgaaaagtcccagaaaggggagtgtgcttagagtgtttgaggaacagcaaggaagcaagcccttgttgaaacagattgagcaaggtagaaagtggtaaaagatgaagttaaagaggtagctgagagccagatcatgtaaagccttggtaaggactgacttttattttaagtgggttaggaagacattggtaggttttgactctggcttacattttaattatagcttctgtgtggaaaatacattgtagagtgtcaagagcagaagcaaagaagccagtcgggagattatgagaatagtgcagtcaggacacgatggtgacttggaccatggtgattacagagggtgtatttggatatacagtgttttgaagatagagaaaagtcaaggatgacttcaaggtttttgaccagagcaactgaaagaataaagtttccttttactgagagagggaggactgtgggagaagtggagtaggttggaaggatcagagggagaggggtaaggtgatagacatagagtttgattttgacatgttatgcttatgatgctggctaggtattctagttggagatacataaatctgattgaggggagatctggtatggaaatatagccttgggagtggtcagtgtatctatggtataagcagtcaaatgctgttcacaggttgaataagatctgtttatattaaagaaaggtttggatctgattttttctcctttttctaatgcgctgatgtaaactgatagaatttgaacttcttattcttttttcagttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagtaagtaaaaatattacttgtattgataattttcatttctgtcctgagaagcagttccttttatttacctatttttaaaatataatacttgacttaattgtattagtaaaaaatcacagaatctgccaataggttacaaaagagctagttagtgggttattttagatcttttcctggggttcaggtcacatagcttaactttgttcaacttttataaagatgaaaagtaaagcaagaaatgatagattactctagtgcactacatcaacatatttataaaaggaagaaaaattaagaggaagaaaaattaagtccaaactgctttccttgactaagacataacatcatctcattcaacttccaggtagtacttggcagttactgtactgaaaacactctgttcgtttgagtccaggatacagtctcttgattcttctcctgcctaactagtgcatggaagtgaaaaaagaaaaaaaaaaacttgttttcaaaataggaagtctagaattatttgattctacataagtatatatgaaagtatatatagaaaaatagaaatagttttaggcaggtatactctaaaatttgcaaaaatattacatatcaagtggttttcttgggtggtagaatgaatatatatagtgtgtgtttagaactggtgttatgtacggttttttttttattattttttttttattataagtctgcctgggacatgttagggagcctcaggtattgtaacagcacagaaattgctttgatgtttaaaataaatcagaaccttattcagtatcatgatttgtgggctctccaaaaggttttgttgttaacacaaaagtaaacagtaccagacaatattacctaaaccacagtcttagtcaggaaaccaaattgaaaaaatacaccctctgatggtctataaaataatataatattggccgggtgcagtggcttatgcctgtaatcccagcgctttgggaggctaaggtgggaggatcacttgaggttaggagttcgagaccagcctggccaacatggtgaaaccccatctccactaaaaatacaaacattagccggacatggtagcgcacgcctgtaatctcagctacttgggaggctgaacctgggagattgcgccattgcactctgcactccagcctgggcaacagagtgagaccccatctcaaaaaaaaaatgtgtatgtatgtatgtgtgtgtgtatatatatgtgtgtgtgtatatatatatatatatatatatatatatatatatgtatccattccatttactaattttagtaattgattgattacccaataatgacttacagtgttcttattgctataatgcctgccttggcagaatttttctccccttttaatatgtacaattcagtgtttagtatattcacaaaattgtgcagctattgccaatgtctaattccagaacattttcatcatcctcaaaataaactgtaccctttagctgttagtccccattctcttcccagcccttgacaaccactaatctactttctgtcactatagatttgcatattctgaatatttcatataaatagaatcatacataatgtgcccttttgtttctggcttcttttgtttaacataatgtttttgagttcatccatgttgtaacatgcatcaattcttcattcctttttattgctcagtaatattccattgtggctgtaacacattttgtttacttattcattagttgaatatttagattgtttctgctttttggctgttaggaataatgctactgtgaaatttgtgtacaggtttttatgtgaaccgttgttttcatgtgatacacagagttgctggatcacatggtaactctgtgtttaattttttaaggaactgccaaactgttttccaaagtggctcaccattttgtgttccctgctgatgtatgagaattccaacttctctgcatcctcgccaacattttcttttttgtgtttttgattataaccatcctagtgagtatgaggcagtatctctttgtggtcttgatttgcattttactaatgactagtgatgtcgactgtcattttttctgcttattggacattcgggtatctttgggaaaatgtctatttaaatcttttgcccatttttaattgggttatttaccttgttattgttgaattaagagttctttatatattttagatataagtctcttatgtacatgatttgcaaatattttctctcattctgtgggttgtcttgaaggtgtcctttgaaatacaaaatttttaaattttggtcgtgtccagtttcttttttcttttgttgcttgtgcttctggtgtcacatctaagaaatcattagctaatgcagggtcatggagatttactcctatgatttctttgaagtgtttaatggttctagctcttatgtttagatctgtaatctgttttgagttagttttcatggtgtgagataggcatccaatttcattcttttatatgttgatatgtagttgttccaacatttgttgaaaagactgttttttctttgttgaaatgtatgagtttatttctatgccttcaattctattccattgacctatatgtctgtccttgcaccagttctgtgctgtcttgattactgtaagtttgaagtaatttttgaagttggttaagtgtgagtgttccaactttgtccttctatttcaagattgttttggctattctgggtcccttgtatttccacataaattttaggatcagcttgtcaatttctgcagaaaaggccgttgggattttggtagacattattttgaatcgtaaatcagcttgaaaatactgccattttggcaatattgtcttccgatctatgaatataagctgtctttccatttatttagattttctttaattcttttagcaatgttttataatttgcagtgtacaagttttgcatgtatttggttaaattcattcctaagtagtttgtactttttgatactattttaaatggatttgccttattttcagattgttcattgctagtgtaacatacaattgatttttgtatattatcttgtgtcctggcaccttgctggacttttttttttttaaattaactgtgaacatgtatgttgttttgttaaaaaaaatgagattttttttccttcactaaaataaactgaaactgtagtacaagatgatctgacttggctgtttggttgtgaaacctccagtactactaagtttaggcccctctccggtctcttgtctagaggctgtaggccttgttggcagctttctgggaagtggtggtggtggtggcagtggggattgttaacatgttaatgctcatttaatgttcctgattcacaacaccacccacactctctatagtctagagatcctcggtttcactccccagagagtacacctccagtctaatgccagggtggggcgagggaagcccactagttgcttgatgggagaggaaggtttagggtgcttagctgcttcttaactctttcaacccaggcttcctatttggatgtccgttttcacccctcttttctctgcctgatgccaccaatttctaagtcttttggaggggttggtgttaaaatcaggttgtttcctagttttcctggcgactgactgaggattccatctgatagtctgttcagttagttactattgggccatctgctctccagcttttaaaattctgtggctgtagttattttcccctttgtttttttattcttgtagatttattcttaaaaaacaatccttttagtatctttttgagtgagttttgagagatagtgaaagtaaaatgtatttgctcaagctgtcatctttacccaagactctgtaatattatttctggtggcaacatgggtatttcattgtatggatatagcatgatttatttaactctttccctacagttggatgttgggtgcccattaaggttgcttagagttttcccaccactataaacataaactctgtgattaacattcttgcaactaaatttttcagcatttccttgagtaaatccttaggataatttatttacattggaatctaggtcagaaaatatgtgaatgtatattggcaaagtgcttttgatgcatagtgctgaatttcttctagaagtgaacagtttcagtttccaacttcagtatataaatgtgctcttttcccctcatatttgctaatgctgaatgggcagcaacttgtatcttccctgctatttctcaaagcagttgacatatttttgcatttaattattggccatttataaaaattcgtttgtaaatgttcatttttgtgtcagttttcctaattgaatgttgtactttttttttttgtttttgggagacagggtcttgctctgtcacccagcctggagtgcagtggcacaatcacggctcactgcagcctcaaccaccaggcttaggtgatacccccacttttggcctcttgggtagctgggactacagacgcacaccaccacccccagctaatttttagtagtttttgtagagacatagtttcaccatgttgaccaggctggtctcaaactcctgagctcaagcaatctgccccccttggcgtgccaaagtgctgggattacaggtttgagccattgtgcctggctgagtgttgcatcttttaaataaatcttattaaaaaagataaactaaaaaaatttatgttaaaattgttactcctattttgtatatgctgaaatatcttctagtttactagttgtcttttaattttgattatggctttttaaaaaaatactacataagtttccaaattttatatagaaaaatccatctaccttttatcttatggtttctatctttgatgtcatgcttaaaaaatccttttctccttaacattatagaatggttaatctatgttttttttattttttattattttattttattttatttttttttgagacaaggtcttgccctggcacccaggctggagtacagtggcatgatcatggctcattgtggtgtcaaactcctgggctcaagcaatcctcttgcttcaggctcccaagtagctaggactacaggtgtgtgccacttcgcccagttaaaattttaacattttttatagagataggctctccctattttacccaggctggtccggaactcctgcctctgcctcccaaagtattgggattagaggtataagccagcacacctgctctgttgctcaggctggagtgcagtggcatgatcatagttcactgtaatcttgaacttctgggctcaagtgatcctcccaccttagcctcccaagtagctaggactacaggcatgtgccaccatgcctggctaatgtactgttttttttttgtttgttttttgttttttgtttttgagacagtctcgctctgtcacctaggctagaggacagtagcgcaatcttggctcactgtaaccttcacctcccaggttcaagtgattctcgtgcttcagcctcccgagtagctgggattacaggtacctgctaccacacccggctaattttttgtacttttagtagagacgggatttcgctatgtttcccaggctggtttcgaactcctgagctcaggcaatctgcccacctctgcctcccaaagtgctgggattataggcatgagccaccgtgcctgactgtctaatgtacttctttaaagtattcgttgggctttgttttttatgtttaaaatttcaacttatttgaacttattttggtgaaagtataaggtaggcatttaagtgtagagttctacaaatgactagattcccagtgcttttttttttcataatctattctttgcttgctgattttaaatgacattttaatcataaatcatatgtatatgtggtatatataacaggttattatatatacatatatatgatatatatgtacacacacacatacatatacacatatgccatagtgaacttctggactttatattttttattgctatgctattgtactaatataactttataatacaaatctaagtggggttagtgtacactcattgctcttattaattttcaaaaactttctagctatccaagtaaccatttctaattgaaataatccagtgaaaacaattttgactatcaccatttgaaaacacccttgcaaatttgaagtttcagagctaaggaaatgactaagcagtaagttagttcctgtgttagttttttacataggactgacaatgagattgatttaaatgacctgtcatttgcttctgactggcatagcctaaatcacaggcatttcagaaggaatatcagtgatgatgatcggaagtcctttttcgtatttagttctgtttaaaaattcttcttttgctgggcattgtggctcatgcctgtaatcccagcacttcgggaggccgaggcaggtggatcacctgaggtcaggagtttgagaccagcctggccaatgtggcgagaccttgtctctactaaaaatacaaaaattagtcgggcatgatggtgggcgcctgtaatccaagctacttgggagactcagtcaggagagtcgcttgaaccccaggggcggaggttgcagtgagccaagattgtgcctcttcactccagcctgggcagaagatcaaaactctttctcaaaaaaaaaaaaaaaatccttcttttgctaaagcataggaactgtagggaggttctctttcagtagggccatgccatcctgagaaagtatgcaagtggttatttgctgtaatgtgtactgtatccacatattcttctttagcccataaactaagatattttgtatattattttttatatatcaagtttaaaatttttttattgcacatgtatgctcatataaaccttcagaatgttacagatgtatacaggatagacagtaaaaatctttagtgattctgcctactagatataattaatggtttggtgtgtattactccagattttttgtgctatgatataacagtgtttcatattattggttattgttttattattgttatgatcatcattattatatatattttccttttacaaaaacagggctatattatatataattgtacaacttttttttgctttgtaatgtatgttgtgcatttttttcatgctaggaaaaggtatatatcttcttttttttttctttttaatatggtgtttcagtatatggttatttattatatttaacttactatcttttgatgatcatttgagttgtttccttttcctcctcatctcccccattacagacatttctacagtctttgtgcatatcgtttgagatacttgaacataagatagatttcaagaaatagatttggatcaaaggatatgaatatttaaaagttgaataaatattgccaacttatgtactaaaatgtaccaatttatactacagtaacattttatttcggtgcctgattttctatgctattatcagcattaattattaatttaaaattttttgtcagtcattttagtttttgttttaataattgattgagaatctttttgtgtttctttgtcatttgaatttcttctatgcctgcttgatcatgctcagagtatggtttttatatgtatttcaagtacaaggcatttttttattgttggaaaagcctctttttctcagtagtttttttttttttcttctttttttctctgtagacttcctctgtggacatctcagtagttttaagcttagtgtcagtctctctccctttctattttaggataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggtaagaaagtggacagaaagccagtggggtggttagttactgatcatcattaaaaagtgaagttcaagccaggtgttgtggctcacacgtgtaatcccagcactttgggaggctgaggtggatggatcaccagaggtcaggagtttgagaccaacctggccaacatggtgaaaccttgtctctactaaaaatacaaaaattagctgggtgtggtggcgtgcgcctgtaatcccagctgcttgggagactgaggcatgagaatcacttgaaccccagaggcagaggttgcagtgagctgagatcgtgacactgtactctagcctgggagagagagtgagactccatctcaaaaaaaaaaaaaaaaaaaaaaaagttcaatggcttacttgtttaagttgcaaacaataaatgaattatgtgtaaatttgtaagtgtcgctatagatgatacacctctactgactctagttgtagtcattaattaatttaagtgtgttccacccctctccattccagaggttgtgtattgatagccctctggcaggacataggccatagaaatgcttagtttgatttgtgctactctctctctctgtctgtcactcactcattttgaatagtttagacaaccacattttaacatgtcaacattcactagagctgagtagtggttcagagtatgaactctctactttatcagtctccatgattccctgttgtgtcaccaagtattagctgccacttattacagtatttctctaatgtttttcttataatagtgttaagaagaaagcaaactgtatttttgaactcatgtcactgaaacccagccttgttcattttttatctttcttctgcctggcccctataggtgttttgaatttgtaagttttggtttgtagatccccatatcctcttcatctggaggctgtgtactctccaacccctgtctccttctagaatgttaagggcccatagaatgcatctccagtgaagctcttccagtgctcacaccctaagcagttcccaggcttaactgtcccagaacccttcatcacagcactgttgtaatacacccccccgccaaccctgccttcctcaggggctctgtggtcctctccatccttccttaccacagctcttcctcttctctgactaattaattctcctattaaaagacttacacaaattcatgttcccaaggtaagtcctccctcttttttgggagaaggagtgaggagatttactagttacaattttagatttaaagaatataatttaagctgcttatttgtatagtgttttacttttcaaaaaacatggcttttttaaaattggaaatttaataaataatagtcttatttttggacatagtagaatgtaactgcaacgtagtgggccaatttttaatttttccccctcacacatgcgttgatttagcttactttggaagttaatgaccccattgtgatttttgggacttctggttgatgaccttattgtgtagttgctgctgacatctgggggtggtaataacttttaagaggcagggaaacttgacaactatggggtcaaggttatctttaggatgtagatactcttaggtctcgcctttctactttgaaaggcaatgtactgtggttaccaaaataataataataaaaaagcttgattgatgttgtgaggtttagggaacaagacccatatatgagagagggaaaaggagagagggagatatatcaggttctttaaccatcagatgcttagacttttgttggaatttgggtgagcttctcagtgggtaagtgaaaaatcatttaccaagcttcaaatgtaattccacatgtattttttattggagcattacttttattttaccagatctttttgtttgtttgtttgttctaaccaggcaatcttcatgattcctacaaatcctcctcccacattccgaaaaccagagctatggtcagataactttacagattttgtgaaacagtgtcttgtaaagagccctgagcagagggccacagccactcagctcctgcaggtatgaatcaccctgtgatgccatctcgctccatttcatttacttgctgaccaaaagatgccatgaggtcacctacgtggagatagtaaagaagtataaggcaggctgggtgcagtggctcacgcctgtaatcgtagcactttgggaggctgaggcaggtatattgcttgagcccaggagtttgaggccagccagcatggtgaaaccatgtctctacaaaaagaatgcaaaaaattagccaggtgtggtggcgcatgcctgtagttccagctacctggaaggctgaggtgggaggtgggagaatctcttgatcccaggaggttgaggccgcagtgaggcatgattgtgctgctacattccagcctgagcaatagagtgagacgctatctcgaaaaacaaagtaaaagaagtttaagacattctctacctctagggaggtttgaatctatttgagtagaaaagaatgttaaatcattgaacaagacaataatgtaagaaaatacagggcagtatgggattagagaaagggaactgacatttagtgagtacctgctgtccgccacatactttgcatatgtgccatttaatcatcacatagaccctgtgaagggtgggtattatttcagttttatagataaaaaatggaaacttagggaggtttactcatttcgggtcactcagctggtaagtagcacagtcagtattagaacttgagccttttttattccaaagcaggggtaccatcaagtctacccgagtctgacaaagaattaagagcagtggtgggtactgttgtagttcagggtgggagaaggcctctttggactggagatgcaaaaagtgttttcctggaggaggtagcttctaggcctggtccttgaaggacaggtggcatgtggcaggcagtatgcttagtggttaggagcttggatcctggtcagattgcccaggtttgaatcctggctcccaatttactagctttgtgatcttgggcaagtaacttaatctctctgttcttttggttttgtgatctgtgaaatggggatacagtacctgcctcatgtgttgtgatgattaaatgatataatgtgtgttactttgaacaatgttcacatgtattgaagacagtatggtatgaacgtgataaatattagctattataattgggctaggccaaccgtttgcagtcatttcagacccagtgccccctttttataaccaatgtatatatttaaaaactctcattacttttctggaatgaaactcacatataataaaacctttttatgcccataatttaaaaagaatcaatattgtctatgatgtgatggagaaaaataaagataatttataatgaaataatatggctttcaacgtgcagttacttcagcctgacccagtttgcagacataatgaaatagatacctgtgcctggcatcatgaatgagtttagatttaagagctgtaagaaaatcagaaactagccaggtgcagtggctcatgcctgtaatcccagcactttgggaggctgaggcaggcggatcacttgaggtcgggagtttgagaccagcctggccaacatggtgaatccccatctctactaaaacaatacaaaaatgagctgggcgtggtggcgcatgcctgtaatcccagcaggaggctgaggcaggagaagcacttgaacccgggaggcagaggttacagtgagctgagattgtgccactgcactccagtctgggcaacagagcaagactccatctcaaaaaaaaaaaacaaagaaaaggaaaagaaaatcagaaactacgccatttaagaaatacagtaaaaagaatgagtggacactagcatgaaactgatgttaaataataacaggccagatttatttgtctcttattacagaaggtgggatatgatcttacagattttctaagtggaaagaacaaggcaatatgatattattgcaaatgagctgggtcttatttctaagtggattgccaaattctttttctacctggatggggtagtgacaaaatgttacggaaatgtatctcctgtgttgcattctgaccacattttgaggtatactgtccatctctggagttcttacttggaacttgtatcctttgacgggtgatggagaacagagaatggattgccaagaaacaatggggacaatattggagtaagtttggaagacaacaggcaattccccaaaaagaatttccatatgtaactttcacagcatagatttcttatcacgtgctacaaatacaaacaataaaaacatatgatggtattaatattaaaaacttataaagcaaattttattaatgaaattcagcaatacccctttgtttcaagtatctttggtgattgaataatatttgggtcaaaatctgttacatatatatgatcagttttagtatgtctgcagcaactgcatttttgcactaaaatcctttttacctaaatgtgtagttggaaatgctaccatagaaagaacaagtcagatgagtagatttttcagtgatttctaaataatttctttattccattaagctcccctctctaaaatcacctcccaaatcactggcctttttgcatatctcttgaaaacatttttttagtattatctactaaggtgtatacacaccctgagacatttgaaaaatgtgcagaatctgccacagttcatggtcgtacaggacagttctgtactttgcaaaattgctaatgtcccatgccatttgtgctcaccaaacattgtggcagctataacatgttcccaacatgtttacacaagttcctccaggagatgatactccctattgagaatcgctagatttgacagagagaaatggcataggcatttcagccaggctgaaaaagataggcaaagactgaatttgctctactcagagttataaagcgagtgtggtttagctgttgtccgaagcacaaagagaaagatcagattcgttgattgattcaacacatgttatccagtacctactgtgttccaggtactgttttggcactgtcaccatataaactgtctccagtattttctactttgttcttttagcacccatttgtcaggagtgccaaaggagtgtcaatactgcgagacttaattaatgaagccatggatgtgaaactgaaacgccaggaatcccagcagcgggaagtggaccaggacgatgaagaaaactcagtgagtggcagccgttgctgtgggcctcagacattgatgcttgttattttatgattgccaaaccaggtaagatgagtaggaggtattggatcaacttggagctggagatgcttccagcataactatgtcctaacctggatcaacgcatgctagagggttgttgtatctgtgcttattcttctcccagtgcttcctaaaacacttttaaattttactctttgcccctcttttactcaatttaactttttattttagagagagaatgctcaggtctgggacttggcttttcatatccttttggggaatctgggatccatacttaacatgtagcttttacatttatagacttcttcacaaccctgagattccaaagatgttcacatgagtttcttagatctatgtcacaaaactctattaagaagagtagaggaagaattcctttagggttagatacactgcttattatcacgtggataaatttgtcttctttgcttaagtaacagcgctttcatttctggaaggtgagtttaggacctgaataagtgttaaatctcgaaatattttcactaagacaggtagtagttattcagaaaactcaaagtcttttgtcaaattagccccaatttgagattgtatccttttacaggaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagtaaggctctgagtaaattcactgacttcttagaccaagcatacatatttcagagaagacagattctcatggttcatgcaggcttagccttgggttctttcttttgtcacaaccaaaggagtagaaaacttggaagtttgcgatggggacaggaggtttggtgagggggaaagctggcctgtggagtcaaagtcaagaaagcatcaacagtgagaaagaattttgcttttgaaccagagcagccattttctcattgaatgttgttattattttccttccttaccttgatctttggaggcaagcacatgcattgtttgatgcataattcctgtgaaggtgtaatgacattctgagttatttactgtacatacatcttcagtttattttcatgacagtttgggtctaacccaagtttaccaatactgtcagtcaatgaaagatgactgtacaagttgaaaagttctatccagtttcttctagtttaaactcatctctgcttctgtccgtatctggctgatccttttttgcctgtgactaggcctaacatcttgtgttcagctcctatcttagagtgaaattcttgtgtcattcagtgctcgtggtgctttatgtttcatcccctaaactcaagattaaggcactgtagaaatcccatgtttgatgatgtacaaattatcaactaaatgccatgtactagattgcccttctcctcccctcctgttttaaaagtagccagtatgatttgttagtaatgttcattttgcagtaatgagctactgacctctagttattttcattgactctgagtactaaattgtctacttgtcttaaggggtttaattatgtagatgattataaccgctgtgtaatacaactaggccaacctgttagtatgtgttgtacatgcacgtgttagggaaattgtgcccatttttatttaaagaattaatttttttccaaatgtgattttcataattcaaatgctaattcaatgagttgtttattcttttcagtttctgaacttgttttcagaactggatagttttagcatgtctaatgagaaacatgcatcttttattataatcatgaagagaactgtttaaaaacctaagcagtcacagtctgagtaacattaaatacaatttgttcacagacagtctgttgcagattttgtaattctcccttttggattacagatttgacagatttgccacttattttgagatttttaaaaattccttattgttttaggagttacttaaatttatcattatggaaaattaaaacatacatacaattacacagaataatataatgacccctatagacctatatcactcagcttcagcaatgatcaactcactgcccgtcttatttcagccccacctcaccaaaaagcaattagtaaacactttgtaaaagtattcatttttaaggccatgaaaagcagtgagaggagtaaggggtaaaaaagattcttaaggtaatgcaggcttcaaagtcctgatttataggacatgctatgacatcagtggtattttgggcaagatttttttttttttctgataataactctagaaaatagtaaaatgaattaattcaaagtaaatctgagtcatcataccatttctttataattgattttaagtatttatttaagttattatttttttaacagatagggtcttgttcttgcccaggttagcgtacagtaggtatgatcagctcactgtaaccttgatctcctgggctcaaactatcctcccacctcagtctcccaagtagctgggagtatgtataggtgtgtccagctaatttttaaattttttgtagagacagggtcttgctatgatgcccaggctggttttgggctcctggtcttaagtgatcatcctgccttggcctcccaaagtgctggaattagaggtgtgagccacctctcctggcctgatttaatatttaatattggaccaggtacaagcctggggctcagatactgatctatgtggtgttagataattcactttcctcctatgggtctcagtgccctaatcagtaaaattaaattattactaaacttgtttattttcattgtcccttattcctctaatagtcaacacatttataaaaattgtgtaattcatgacttgcagaactgaaatttctagaggttaaaatttgtgaaaatggatagactttcatttagttccttatttgaacctctatgaaatgtttatccttggaaattaaaattataaatgttaagggaggctatgcatgtgtggcagggagtatatgggatatgggaaccctcctttccttcctctcagttttgctgtgaacctaaaacgtctctaaattttttttttttttttttttggagacggagtctcactctgtcgcccaggcttggagtgcagtggtgcgatcttggctcacagcaacctccacctcccgggttcaagtgattctcctgtctcagcctcccgagtagctgcgactacaggcgtgtgctgccacacctggctactttttttgtatttttagtagagatggggtttcaccatgttggccaggctggtctcaaactcctgatctcacatgatctgcccacttcagcctcccaaagtgttggaattacaggttgagtcactgttcccggcctctaaaaatgtctttaaaaaaatgataactgttggttagtccgagtgcagtggtgtttacaactaattgatcacaaccagttttttctttttttttgagacggagtcttgctctttcgcccaggctggagtgcagtggtgtgatcttggctcattgcaacctctgccttctgagttcaagtgattctcctgcctcagcttcctgtgtagctgggattacaggcgtgtgccaccatgcctggctaatttttgtatttttagtagagatggggtttcaccatgttggccaggctggtcttgaactcttgacctcaagtgattcccccatcttggcctccccgagtgctgggattaaaagtcatgagccactgcgcccggccacaaccaattttttctttgtttttctccactcccactgtttcacttgactagccttaaaaataaaaataaaaaaaaaataatcttttaagaaatgcctgttcatgtcctttgcctaatttttcatggttttttttttcttgtaaatttgtgtaagttccttgtagattctggatattagacctttgtcagacgggtagattgcaaaagttttctcccattctgtaggttgtctgttcactctgatgatagtttcttttgctgtgcagagactctttagtttaattagattccgtttgtcaatttttgcttttgttgcaattgcttttgatatttttgtcatgaaatcctttttttctcctttttttttttcttttttcttttttttttttgagacggagtcttgccctgttgcccaggctggaatgcagtggtgcgatcttggctcactgcaacctccgcctcccaggttcaagcgattctcctgccccagcctcccaagtagctgggattacaggtgcatgccactacactcagccaatttttttttgtatttttagtagagacagggtttcactatgttggtcaggctggtctcaaactcttgacctcgtaatccgcccgccttggcctcccaaagtgctgggattacaggcatgagccaccgcgcccagcctcctttctttccttctgttggattgattgagtcctcaccgccatcacttcctttcccttaccttaatcccctctctccactctcttctaccaactggcaaagtgtatgcataagtatatgcttacttaaatttctactttcctaataaatttcaaagttaatcagtatctctctcctcttcctgaataagaaaaaggatttaagacacttcgcctttttttcaaactgcctctctcatattttgttattgttgtctattgctttggttcaccaggtttttaaaaaacattagcagctgggcgctgtggctcacgcctgtaatcccagcactttgggaggccgaggcaggcggatcacgaggtcaggagatcgagaccatcctggctaacatggtgaaaccccgtctctactaaacaaaatacaaaatattagccgggcatggtggcaggcgcctatagtcctagctactcgggaggctaaggcaggagagtggcgtgaacctgggaggcggaggttgcagtgaaccgagatcgcgccactgcactccagcctgggcaacagagcgagactctgtctcaaaaaaaaaaaaaaaaaaaacaaaacgttagctactataatcattatttagagtcaatacaatttatgaacatagtgagctactaatatgtttgcttacctttgcttctttaagcttatactttatcttatgggctcatttttcttctcctttcagtaggatgtaatgggtagcaaacttttataatttgtatggttaataaaagtcttaatttttttctcttttttgaatatagtttactgaggcatggatttctaagtggactcttattttctctttgtactttgaagagatcattttgatattttctggtatctgttgatggtgatggaaattctgttgtcaatattgttcttttctagatgatttacttttttctctttttttcattttcctgaatattttctgttttaacttattgtctctatgttggattttttttttccttctaattctgcttcttctggctctgtacttttcaatctaaggacccaggactttattcagttttagaaaattctctttggtttctctattattattattttttctaggatttctttttctccttttttattttatttttgtttcattttgtttcggatgtatttatttatttatttatttatttattcccagaaatgtggtcttgctatgttgtccaggcaggtcttgaactcctgggctcgtcatcctcctacctcagtctcccaagcagctgggactacaggtgcatacgactgctccgggcttgtcttacagatttttttctgtttatctctttgaacatttcaatttccctttaaaaaaaaactttcagatcctgctattattttgtgttttttgggtctaatttttctgtttattgtgtttgttatctctcatattgttacatttcttcttacactttgtaaattttgtttttgagcttatgtttggtgagaattatcttgctcggaggtcctttgtattccttgggttgtacaggcatccctagggccctatggggtatttctttctagagcagtctttagattatttctcagttccacattggacttgtggtacagccaagggaattgtatttctagaagttgattttttccacctcttacctaccgaagcagaagccatttttaagccatcttcttaagcttctgggcagtattgtcctggctcctatctttatgctgggaattgagttctggcttcccctttaacaggtatgtcttgccttctgccttatcctgattgctatttgcacatctgccttaaagctaaagtccttgtgatttggttttcccagtaggccactcggctcagtgctgtgggtttctttcccgcttttggcatctggaagttttcgttttctggttctgagcgctatgggttgttttttgtttgtttgtttgtttgttttttaagtcttgagtttctgtttgtttataacaggaggggaggccttagcacttcagctcattccgttatcttaactgtctacagagatgatgtttctccactttctctataaaggaacaggttcagagagattgagattgttgcttgttcatggtcacatggctagtaagtggtggagctggaaattgaaagcacttcagagttggctggacgcagtagctcacgcctgtaatcccagcactttgggaggccatggcgggcagatcacaaggtcagaagatcgagaccagcctggccaatatggtgaaaccccatcttaagaatacaaaaattagctgggcatggtggcgggcgcctgtagtcccagctactcggaaggctgaggcaggagaatagcttgaacccaggaggtggaggttgcagtgagccgaaatcgcgccactgcactccagcccgggtgacagagcgagactccatctcaaaaaacaaacaaacaaaaaaaagaaagcacttcagagtctatgctctcttcattccacagagcttctgatttgttttggttgcctattatattcataggcgttagatccataatagaaaactcatcatagttatggtgattctggtgctgtctttcactgagaatccagggatggcttttgtttgttcgaaacaattgtttattcatttatttatttaaaaaatttcaacttttattttacatacagggggtacatgtgcaggtttgatgcataaatatattatacccaggtaatgagcataggacccagtagctagtttttcgacccatggtcccctttctccctctcacctctagtagtctgcaatgtctgttattctcatgtttatatccatgtgtgctcagtgtttagctcccactaagtgaacacatgcggtatttggttttctgtttttgtgttagtttgcttagaattatggcctccagctccatccatgttgctgcaaaggacataattgcatttttttaacggagtcttgctctgtcgcccaggctggagtgcgttggcacgacctcgactcactgcaacctctgcctcccaggttcaagcaattctcctgcctcagcctcctgagtagctgggattacaggcatgtaccaccacaccaggctaatttttgtatttttagtagagacagggtttcaccatgtcgtccaggctggtctcgaactcctgacctcaaatgatccacccgccatggcctcccaaagtgctgggattacaggcgttagccactgcgcctggcctaattgcattctttttttatggctgcttacacggatggttgcgtagtattccatggcgtatatgtatcatattttctttatccagtccactattgatgggcacctaggttgattccatatcttcgctattgtgaatagtgtggtggtcaactcatcgtatgaatgcatgtgcatttttggtaaaatgatttattttcctttgggtatatagccagtaatgggattggtgttttaagttctttgagaaattagcaaactgctttttacagtggctgaactaacttacattcctaccaacagtatataaccattcccttttctccatagcctcaccagcatctgttgttttctgaccttttttttagtaatagccattcttactggtatgagatatctcattgtggtttggatttggatttctctgatgattagtgatgctgaacattttttcatgtatttgttagccacttgtatgtcttcttttgagaagtgtctgttcatgtcctttgcccattttttaatggaattgttttttgcttgttgatttgtgtaaattttttttttatagattctggatattagacctttgttgaatgtatagtttgtgaatattttctccctttctgtaggttgtttacactgttgatagtttcttttgctgttgtgcagaagctctttagtttaattaggtcccacttgtcaatttttgcttttgttgccattccttttgaggacttggccaaaaactttctgccaaggccaatgttgtgaagggtatcgcctaggttttctttttggatttttatagtttgaggtcttacatttaaatctttaatccatcttcacttaatttttatatatggtgaaagataaggatccactttcaatcttcttaatatggctagtcagttatgccagtaccatttattaaatagggtgtcctttacccattgcttgtttttgttggccttgtcgaagattagctggttgtaggtgtgcaggtttatttctgagtttcctattctgttccattggtctatgtgtctgttgttgtaccagtacaagaacagcattctggttactatagtcttatagtttgaagtcaggtagtgcactgcctctggctttgttctttttgcttaggattgctttggctatttgggctctttttggttccatataaattttagaatagttttttctagttccgtgaagaatgtcattggcaattttataggaatagtatggaatctgtaaattgcttcggagagtatatacattttaattatattgattcttcctatccgtgagcatacaatgtttttccatttatttgtgttgtctctgatttctttcagcagtgttttgtagttctcctagagatccttcacttccttggttacctgtattcttagatatttcattttctttgtggctgttgtaagtaggattgtgttcttgatttcactctcagcctggccattgtttgtgtatagaaatgctactgatttttgtacatttttttatcctgaaactttactaaatgtgcttatcaattctagtagccttttgacagagtctttaggattttctaggtatagaatcatattgtcagtaaagagagatagtttgacttcttcttttcctatttgagtgcattttatttctttcttttgcctggttgttctggctaggacttcccaattatttatttgtttatttatttttttctgaaacggagtcttgctctgttgcccaggctggagtgcagtggtgcgatctcggcttattgcgacccctgcctcctgggttcaagcaattctcctgtctcagcctcctgagattgggattacaggtgcatgccaccacacctggctaatttttatgtttttagtagagatggggtttcaccatattgggcaggctggtctccaactcctgaccttgtgatccgcctgcctctgcctcccaaagtgctgggattacagtcgtgagccaccgcgcccggcctcccaattatttattatatgtaacttatgtgttatactcaataggatagatgttataactgctaataataattattagtgattaggcacttaatatataccacacactgtgatttatcctttaagcatttcacatattttgatcattacaaccatgctgtgtggtaaattgaaccattccctgtttaatagcagttgaaacccagttgcagagattaagtaacatacttgtgattatataatgagtaatagagaagccaagatttgaacccagatatgtttgatttcagtggttatgttctgaatcattagattatactacttctagcagagcccctttatcaagtgttgggagctgggactaaggcttatgttacagatcatgtgttggtgagtctcagcttgtagtaatgtacttctccttgctggttattttgataaccagttactctacatatgtcctcagtatttccagaaagaaaggacagatggttttcaaagggagcatgcctctgataagctaatgatattgttacctctgagggaatttgttttggatgtatgtatctgaatctataggaaggagtcagattgcagttggagagaagggattaaggtgggatttgattgattttaagtggcctcaagcatacatgtgagaacgaaagaggcaaaccatggtccacgttacttggaaaacctctgtctggataaaatattagattggggattttggaaggcttcttctatttgtctagatatgttcttgtttttgttgttgtttttgtttttgaataagggctctagaatagccttgtttacctccccaaacagcaggacacattattgaagtgacatgagagggtctgtgtcagtgttaggatcattgtgcattctctgggccagcagagggagctctgtattaagttaatgggttataatcgtgttcccatttgagttcacaaatcccctttatataaaagtagcctttatgctagaacaagaccattacttattcattcttaagtgtattttaagtaaccgcagtgacactagggcaatgtctttattttatttagttgggagattggatacctcatacttggcaaagttcaaataagaagtcagccaaaacatctcaaaatagtcactttttctctcccttcccagatttctcagtggacttgacacaattggtgttctttttctgtagcatggtaccatgcatatagtttttaaactgtaatcagctaaaatggccttacttgaataactgaataaattttttaaaaaacctaataattcttgtgtagaactgatttgaaagttcttgtgtagaacatacatatatatatatatatatatatttttttttttttttttaagtcaagttgttgggagccaggactaaggcttatgttacagtaaataacagtaaaaatatatatattcctgatatagatcaggaatttgtttttgtttacaatatgagctctagtagtctgttttatttttccatctgaaagacttgcttcctccctctatccaggtctttgatcctgtcaccttctcagtccttctttgactatttgtctgcaatagatttcccatccccttatttttcttttcatcacagattacttcttgaaatttatatcactcttctccgatacaaatttttttttttttttgagatggagtcttgctctgtcaccaggctagagtgcagtggcgcgatctcagctcactgcaacctctgcctcctgggttcaagcaattcccctgtctcaacttcccaagtaactgggactacaggcacgcaccaccacacctggctaatggtttgtattttagtagagatagggtttcactgttttggccaggatggtctcgatctcctgacctcgtgatccgtccacctcagcctcccaaagtgctgggattacaggcgtgagccactgcacccggcctctcccatataaattttaggatcagtatatcaaattttataaaatactactggaattttgacttaattgcattggatacacagattaattaggcagaattgccatctctgtgttaattctttctatgcatgaacatggtttatctttcaatctgtttggtctatcttttatattcttagataattttataattgtaccaacaaagatgttttagagctttttgttaaatctatttttagatacttatttgttgctattacaaatggcatagtttaaaaaacttttgtttctaacatttttcttctatagacaactactgtagatatttatggactgttttattcattgtaacaggttttatggagattgcctttttaaaaaaatggagacagtcttattgtctatgaattatgattatagtttttccttttgatctttatatataatcttcttcttcttcttcttcttttttttttttttgaggcactgtctcactctggaatgcagtggcgcgatcctagctcactgcagccttgaattcctggggccaagcaatcctcctgcctcagccacctgagtagctgggaccacaggcatgtgccaccacacctgtgatttttttttttttttttttttttttttttttatagagatgggatctccctgtgttgcccaggctggtctggaactcctgggtgcaggtaatcctccttcctcaacctcccaaagtactgggattacaagtgtgaaccaccaagcctggccaaggtttttttcttattaagacctccaatacagtgttgcatagtagagctggtagtggacattcttgtcttgttgctcactttaaagaaaattcttgggattttttaccatggagtctgattttgcagcagaatttggtcgataccccttaacaggctaaataagttttggtttatttttagtttaagaggttttatttaaaaaaaattctttaattaatgttgttttgtctttttttaatttgaatagttagctttttaattttcttgcttactaatacatttaatcaacattgtaactttttctcttagttctgttttagctgtattccatacattttcatatgtggtatattgtaaatatttttttccagtgtgtagtgcttgtgctatacacatttattttttaacccatgagttattcggaagtgttttttaatagcaaatgtatgatttttaaaaactgcttatttaaaatttttaatttatagaattgtggttgaagagtgtggtctgttatatcaattctttgttattttttgagacattgtggcctaacatgttattaattttcattaaatgtgctttgtgtgtcttaaaaataatgtattttctaattgtttggtgcaggaatctgtaattagcaatcagttgctaattgtctttcatttgtctatctttaccaatttttgatacttgatcttttagcttctggagatttgttaaaattgttaaattgttaaaattgtcactgtgtggttgtgggttttgttaattttggtattactcacatatgtcatccaaaataatatactggtggcactgaatacaattggtagtactgtgaaaatgatggaattttttgcatattttctcttttatattaaattatatattttctctttcttttatcttaatatgcagaagaatagtttcaccattatccgttttcaagcaaccatttttttaaagcagaagaatttcttctgttttatttgatcattatgaaatagggtgttaatatttagagctaaaatgaaaacggtccaggatgtggtggctcatgcctgtaatctcagcactttgggaggccgaggtgggtggatcacttgaggtcaggagttcgagaccagcctgaccagcatggcgaaaccccatctctactaaaaatacaaaaaatcagctgggtgtagtggggcgtgcctgtaatcccagctactaaggaagctggggaaggagaatctcttgaaaccgggaggcggagattgcagtgggccaagatcgtaccactacactccagcctgggtgacagagcaagactgtctcaaaataaaataaaataaaataaaatggaaaggattaattttatacttgatgtagaaagaatccaagctttcacaacattattaaatatttaaaaagtatatatttgaaagcaaaaaaatattttttttttagtggcaaagataacaaaaacattttggagcaactgaagtagcttgatttgcacagacttgtagtttagcagttaaatgcttttgcccctcatgaggaaatgacaagccaaaggatggccacttgcagtaacatgtactcatccactaaagatttgacatgcggcggttcttcctctcaggattcattggcgataatgtcatggttttcttgtccttaccacattcccaagagatgcatagccctggtcacccctcctcatctccaggcttaataggtcaatgggaggcagaacttggactactaattgaaagaatgtttcccctgaccaagccttcaaattagattcagtgaattgaagggagtgagatgatgattcctctttaaaacttgtacttagtgcataagattctaatttttctcccagagcaacagccacattaatctctttgaaacagaattttaaagcataatgacataattaagttagggcaactaagagacatgttttagttaaattactgagatagtattttgtggtaaaaacattatgtgtttatagttcctcagaaagtcctaagtttcatgaaggcacctattgttgctgtgagtttcctcatgttgaaatcaggtgaaaggctaggctgttgtcaaaatgattttacttcaacaccgtccatcagatactgatttcagagctgcataagataggaattcttgactcagagcctattttctttccatctgcagtttgaaaggggttgttagaacattgtctcccttgtgtgttatctgtcttattctcactgactcagattatggcatttgcaagtacagtaattaggacataaagtactgcaagtattttaacacttcttttaccacggtagccttactgtccaatttctgatcccttcaggatttaaacatctatcatcagagtattgtgttggtgtatgcttgccactcacagtcagcatcacatgagagtttcagacagcattagtccagttatgcaccccaaaactaaagctgaaaacatttgattttgttggaaccctatctctgagtaagggcaagagaaggacaaaggagtagtggagtgaacattgatttttagcatcagtctttggcttgaaactttgctcagggtcttacagactacgtcaccttggtcaggttctttcttttttgatcctcagtttccttgtctgaaaaaatggggcaccaaagttcctattttgtagttttgtcaagatgatatgagattgtatgtgtaaaatatttaatgtgtaaatgctcaaaaatggtaggtattatagtaagtcttttaatgtatgagagtgtttttttcattggacgtaaacatttcttcaacagtgctacttttcttcttcctaattccttttctcttgatactaactttttactaacttttagtttttgctcttggtattgatgatgttttgtaggtgccaccccaggaatgcctgagtgctggcatgaacatggttgagctaagggaaggtcacttgtcagtttcagtaacattttaccattgtgccgagaagagagagggaggctctgtgtggtttgtgtctgtgtgtgtctgtgttttaaattccttggcaataagatgatacatgttttgagaatctattaaatagcccagaatacaaggtgacggatttttaagagggccagactttagatacacatgagccttcttttgtaaagtttcagcctcttatcttaatacagtggaatttattaccgactggattttttttccacccccgaaagataaccactgtggttcactgtgcattttatcagtagctccctcgtgggtgagatttacaatagaagagcagacatcttggtacttaggtttttctcacagtttcaaaaataattcaaggttgtcctgccagagtggagactaaatcctaattgtttgtgcagtttttcttattgtatccagatgttgggcccccttttatctttggaaaccattagcattcttgattcttttggaatgagccaaaaagcacagaactcctgatgcctgaaaattcattcagaacaccctgccagaccacattttaggatatgaaagtaccagatctcagtataacttgagtgaagggctcaaggcctatatattttgaaagatagctactccagtatagttatattggtaaaaggagagccaagaacagccatgagggaaatacatttttcaagagagggcagtagcataatggtaatgaagaacataggaaagtgaatcacaaacaatatactttggtccttaagcctaagaggcagataaatctttcttcatcagttagtggaatatattatttctctgttgctctaagcttgctgttctgaccttcttttgttcagcaagaaaatggagatacatttttaaatatcaatttaagtggatctataaagaaaaagcagatgattcttttcaaatgtttatgctctataaatatcaatttggaatcagtatttgtttataatgaatatttaataccaaccaagaagcatttattaaatagtcactatgtgtcattaacatgtagagtatgaaaaccaaatgaggcattcactgctttcagtaacttatatattaaaaggggaagatgacatttgtcattatcattatctaatacttatggcatgtgtactgttctaattgttctaattccttatgtgtatagagcattactctaggcgcttcaaataatagtatttgataatgatgcgacgtaggagaaaggacttctacatatgaaggtaataatatactaagacaaatgctaggtaagtggtacaggaaagcgttaaaggatttgtgaaaaggaaggcaatgactcagatatgcaggaaggctggggaaggatgttacaggcaggtgcaaagtcagaaaggtagaaatgtgttttcattattcaggttggccgaagcagatgtgggtgttgactggattttggaagactttgaatttgaaagtaaggagtttgaacctgattctcttgttaatagggtatctgaagacactttgactaggaaagtgataaaatggagtttcaaaagactgtaaaaggtgagaccaattaggaaattcttgcaagaaccaagatgtggaccattctcacctgtgaacattttttatctttttagatgtgctgccactattgctctagttagtaatcctttgaattttggatttagctctctttgaatttatatatttcagttcaccagaattaaaacagctagagcaccattgcccagaaattaagtccattcatatagaggcagttactgaaactgcttaactggaagagttattctgggctccagggaaccttataacttatgattccagcaattcttagtggtttcaaaggacattcaaaggaatatttatggctgtacacagctacttggatagtaaccagtgtaattaaatgagctgatacatgtaaagcacttaggtgcctggtaacaaaaacaaaacccaaaaccacacactcataacaaatgttagaaaaaaacaaaccctgtgataagaattgcacattaaggcatactattccaagccagaggaaaacatttgcaggattaccagagttgttgttgttgttgttgttgttgtttttcctgcaaacattcatgcatgaaacagagaaaaaaaatcaggctctgcccagttctctggtttgcacagaattaattacaatttaagtagaaaagagtcattgtaggaattaaggaaacagtaggttgaccatattggtttacttagtgacagtctggaaaatgaaggtttgaaattgaaggtcatgaagtttaaggtctagtagatggtcattccaatggaacagtgggcttcagtctttggtcaaggtccttcccagttatgactacctagacattatgttgtagttcatatgaatccagaaataagagcaaatagttaaggaaaggtgtcttgctgcttaaaaaaaattgagttactgacatataatttacacaccatacaatttgttcatttaaagtgtacagtttaatggtttttagtttattcacagagttgtgcaaccatcaccacaatctaatttttaaaattctatctaatttttaaagttctactttttttttttttttttaatttggagacaggatcttggtctgttgcccaggctgaagtgcagtggcatgagcatagcttactgcagtcttgaactgggctcaagtgatccttctgccttagcctcctgaatagttgggactacaggtgtgcaccactatgcccagctaatttaaaaaaaaaatttttgtagagacagggtctcactatgttgctcaggctagtctcgaactcgtggcctcaagccatcctcctgccttggccacctgaagtgctggaattacaggcatgagccaccatgcctggccactatttttaaattgagatataatttatatgtcataaaatttgccattttaaagcatagaattcagtgtttttttaggatattaacaaggtgttgcaactttaagcactattgaattcaagacatttttatcatcccctcaaaaaactctaatcctgttagcagtcacttctcatttgcctctcacccccaggcaaccattaatctactttctgtctctatagatttgcctgttttggacagtttatgtaaatggaatcatataacatgtggccttttgagaatggcgtctttcattttgcataatgtttttgaggtttatccatgttatagcatgtatcactatttctttttgttgctgaataatattccactgtatggatacactgcattttgtttatctgttcatcagctgatagacatttgggttgttgattccttctgcttttacgtagcatttttcaaagaaaaataaatggaagatacagttgcttatgaattcactgctttgtctgtaggcttagacagattgttcatttagcttgacaaatgctgcttacaaagaaaaataggccagtcttagcataggaattcatgcatttccggcatcagataaaagaatcagagcaagatgtggtattttcaaggcttgatttctctcttcagtccattctttctacggctttaggtttcttgtattatcattcagctgaacatctttatttcttgggatacatctgaaaaaatatgctagctcaagttaaaacaaaaaacccacaagctagctgaagccctgggggacagcatggcctttaatcagcttggaatgattctcttacacttttcaacctgacaagctgctgtccagcacacttgatcatctatctagctaacgggtgctgaaagaaaagttcaaagataaggttactgggaaaattacatttccccactctttctgcacttagtttaatggcagttctaacatgtcaagaatctttattttgattttagagactgtacaatatgagatgtagatcactaaacttaaaacctgacatttggcattcaagtcccatccttgttggttactagcttagaaatctgcaaatttctcacttgtaaaaggggcataataaataacatatatctcaaaagactctttgaggattaagtgatatagtacattttctggcacttgatagatgcctattaagtgtaaggcttttccccctctactttatatggtggtcatgcagtttggatgtgcagtttggatgagaccattatgtgaaagcacctagtagaaagcctgaaatgtagaaggtatttagtgaatgttagttaaatttgaacctaagtttccaaagaatagaactcttttttccagatttaggggtgtatgtttatgcgtgtgtgtgtgtgtgtgtgtgtgtgtgtatgtttatgtttatgtttatgtttatgtttatgtgagatagagatactgaaactgtgtcagttagcttttgctgcattgtaaaccaccctaaaatttagtggtttaaaatagccattttatttaacttgattcatgattctgtaagttggcagttaggttggactcaggtaggcaggcaattctggtctgagctggttagctctgctctgtggtcagctggtgcaataacagctggggatggctgatttatttgttgagacatttgttgacttgggcctctccacgtagtatttcaccatctagcaggctcaatcaggtttatttatattatagtaaaatatacaagactttttttttttttgagacagggtcttgctctgttacccaggctggagtacagttgtgcgatcatagctcactgcagccttgacctcctgggctcaggtgatcctcctgcctcagcctcccaaatatttgagaccacaggtgcgtgccaccacacccagctaatttttttaaaaaattattatttgtagagaccaggtcttgctatgttgcccaggctggtctcgaactcctgggctcaagcagtctacccaccttggcctccaaagtggtgggattacaagcatgagccaccatgcccagcctacacaagaatttttaagtctcttcttgctgtacatttgctattgtctcaatgcccaaagcaggttagatagccaggcccagagtcattgtgagagggagtaaggtaaggatgaagataccaagaggaaattgttgtggccatttttaaaaacaatttatcttagatactaattgtgataggaatgcaaatctgtttactgagaattattatcagtctataaaatcagacttagtacaggtgctgcaatgtaatgacagtgttattcacaataggaatactgctgtcttcttcatataaacttaacatgtcagtaaagcactctcacacatgaagaaagaatcattatggtggaggcatttattttctggaatcactaaatacaaggatcagctaattgtttttgaatgtctgctgtttcttgccagttaaggtggcttcccctatcagtcagttcattcagtttttcactttagttccataaaatatttcatctgcatctctagacgatatctttattacagtttgagttacctcttccatctgttaaaccaccaacaacaaaaaatccaaagaatcagagatactcttgtcactaaaatatttcttgagtcttaactatttttcactttggtctttgctttatgcctgtacacatctagttgtagcatgttttagatgagaggcatccagtatcataatcctactagagataagaacttcttcttttgaatagttattaataactgagcataaatatgttttcatatgctactgccaagtcataaaatcacggaatttttcaaagctgcagggaacattagatataatctggccctgtgtcttctttttgcagattgggaacctgtggttttaccaagatcgtgtagtcagaaccagaatctaaatctttgaactgcaggatagggattactttccatttttttttattgtggtaaaatatacataacataaaatttgaggagaggaatttttccgttcttctgtctccaaaatcaactttagctttttggcaatctgataaatgtaacattttaactaatcattttgctataattaaatttctaatacatatgtgcattttacttacagcttatatctgaatatgtggttagataaaaaaaattctctttttatttcactttagtttttggaacttcgaattctaataaatgtcaggtataatcaggtccctggtattgatatcagaaggtaaaagcaaatacattttagatagactttcttatttgtggattttcattgttgaaagagacaaagaacagttggtgttttaactccaaaaattagaaatttttaagtgggttggtaagaaagaagaactcaaatatgaggcaagcagatgttctcactttttcatctgaacagtgacagaaatagacaaataattatattctcacttaacagacatttctttgatttttatgacatggtttagaattagaccacagaaatgttatctttagtgtttcatcatccttggtttaaagattcaatttcttaagtccacctgtattgcaactgaaagtaattaatgaagaaccatagaaatatattgttttattgttggatataatacattttaaaaaagaatgacgcccttatggtttttgtaaattccattggagaaaaagttttaaattacctgttatttctgtccagaagtcgccatttttattgatgaactcaatttagtcatttatctgtgcatatataaaaatgaatggatggatggataaacagacgtgaatgacagaaataatgagacaagagaggttggtgcgtgatatatgcagcttactctcaaattttaagtgtgtatttcctaagaaagaagataccctcttttgtttgtatttcctacaaaggagttgctcttttttgttaccacaataaagtggtcaaagactgatttttcctttttatttcttgggaccgtgtctcactctgtctcccaggctggagtgcagttgcatgatcatggctctaacatcatacctagagcacacaaaacaaaacaccatatacttgctgattggtcctagcaaataatgtatttaattcttaattagtgaggagaaaacagtgtagtaggaaaccattggcagtctgtggatatgggcagatacgggattggctgctgttgaacttagcaatggtgatagtgagaaaaatgacaaatgttctgagaggtagggtggctggcctgaaactggactaggaagtgtcatgaaataagtaagattgcatagaccaagggtgcctggagagaaacacttgctgttctttatcttctagataccttctcatctacttcttaaggtgctgagccttctggttgtttttcctgattactgtaggaaagggccgtataaacccctatgttcatggaaagcaatgaaaaatacttcctgtatttccctgtattagaatactaatcagaggcacaaagatacttcaacctttgaaacaggtacattcagctagtttgatttttaaatcatgccaggtaaaattattctttctgctcttgttactaataactaatagctgctgtattctgctctcttaacggttactgctactatgtaactgctgatgcttttctccaggatggtttgaggccccatctaagtccccttttaccagtcttccctgaccacacagcatgcaagaactgggcacatataattcttttaatcaattctatttattttatacctgttcaatactaacttctttttttttttttttttttttttgagacagagtctcgctctgtcacccaggctggagtgcagtggcgcgatctcagctaactgcaagctctgcctcccgggttcacgccattctcctgcctcagcctcccgagtagttgggactacaggcgcccgccaccacgcccggctaattttttgtatttttaatagagatggggtttcatcgtattagccaggatggtctcgatctcctggccttgtgatctgcccacctcagcctcccaaagtgctgggattacaggcgtgagccaccgcgcctgacccagtactaacttatttaaaaaaatgttcatgagaagtaaataaaatcaccaatagtcctactaccagagataaaccctgttaacattttgggtattttcccctagttttttttttttcctatatgtatgattttatagagtcaaaatcatactgtatatataatactgtatcctattttttcctgtaagtttattgtaagccatatgtagatagtatttttaaagttacctaatatttcatagagtggatgaattgtgatttatttatgttttctttttcatgtatgtttttctcattattccagttagattatgagattatcaaagaaagtcaccctactgtatcatcccctcttcctacttaaatgcctatagagaatattgtatgtgatagatgctaaatatttttgcttgcttctgtctcattctaaatattataggagctgtttgctatgggagactccaaatgtattatttgcagattatcagaatcattgcatcacccaaatctttccatttagaaagagggaccccagggaaatttctgaatgtattttaggggaaatcttaactcctctggaattccatgagaattttttgggcaaggatttgtgcattttttgtagtttcactagattcttgaaggagtcctttatctaacagaaatatccactgatccagagattgtagcccatctggagatatgtctatttattaaacttacctaaaatttagaatgtttcttttcatttttcatttttctttgttttcaggaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttgtaagtagtgttggaagtaaatggttatgtcttcaggggaagttatttgaaatatcacacattagtgcccaagcattttcttgtgcattttgagtctcctaaaccatccctgacagtgtctactgagctgaaggacagtattttgactgatgtttgggcagttctctggtccctgattagtggcatctttttcgctttcgaagtccatattcagtttttatttttgtccagttagaaattgttcatggtgagagaagtattcaatcatcaaatgaaattgcaactgtctttaatagtttatttggggttttgattttatatttaagaattagattggagggcaattgacactgttttgtggtgtccttgttgttttgctaactattctcctaattttaaccctgctgaaaggattattctcagtttttttcagaggatgaatgtataattattccagtttcatatgaaaaactggatgtgttttcctttctctactgtggaacattttccctcaaccatagacacttattaatgttcataggcatttaaggagtagagcaataaaaattttgggaaaaagtaagctaaggagtctgcattttcttcttgactattactagaaaagatttttctcttcaggagctttttatttttacattctaaaattctgaagtttgatcctccatctgtcataattctgttgtttataaaagaacttagattgggcattgggcttgaattctggtaggcctgtctagttctggctttccactatactactgactggcctagaggaaatgacgccattcttccataacttaatttctacttttataaaatggcaggaatatcacagtttatacaactaatggtagagatcctttgaggaccagaataactcatctgaggtaaattaactgattagtcactgaacccatgatagaacccaggctatttgttttattacctgtttgttcatttacttacttatccagtggtttttttttttttttttggatgtcatgtgtttgacactattctagggatgtggtcattaacagaacagccaaaaacccatccctcatggaggtttcattctaggcgaaggaaaataagtatttagtgtgttaaatggtagcaactattgtaaaaaatataaagcaaaagggaggttaggagacagaaagagtgtgtgtgtgtgtgtgtgtgtgtgtgtgtgcatagttttttaaaaataagagtagtcaaggaagttctcactggtaagaagatgaggatgtgaactatgtgaatatctagaggagagatttttaggcagcaggaatagcagatgcaaagatcctgaggcagggacttggctggtatgtttacagaacaacgaagaaacagtctgttttggaatggcatcaataggatgtgcagcaggaaatgatatcagagatataatggagagcgagataatgcagggctttttgtgtaataaaaaggactttagcttttactcttgagtggaatgaaagaccattggaagggatgacttgaccttatttatatttaaaaggtattattctagttgctgtattaatacattataggagaactgtagcgtttctgaacacaggtgcagtgtttttatttactattcaaaggtggcaaattatggggcacatctgctactattctcctcttctaggcctttggcacccatctgttccactgaatcagggttcagcttcagaatccttcttaacacagcacaccaggctgccactgctaatcatagtagacttacgaaatttgaattattgtgcgtctgttccatgttgcctgtatagttgtcttcaacatgtgtataaggactgatttctcagtttagccagtcttcaggcaaagatgtttaactactgggtaccaaatcacatcattattgtgatagaatgcttgagaatcctcaaatctgtagtacttctaagcttagtttccttgtttttaaatgttttagaagttagcgattttggctaggcgcagtggctcacgcctgtaatcccagcactttgggaggccaaggccggtcaatcaccttaggtcaggagttcgaggctagcctgaccaacacagagaaaccccgtctctactaacaatacaaaaaaatcagccagtgtggtggtgcatgcctgtaatcccagctactcgggaggctgaggcaggagaatcgcttgaacccaggaggtggaggttgtggtgagccgagatcatgccattgcactccagcctgggcaacaagagtgaaactccgtctcaaaaaaaaaaaaaaaaaaaagaagttagcaattttgaaaacccagtcactttaatcctttttaattttaaaaaatattgtttatgatatttttaggatacatgtaatattttagtacctgttcataatgtgtagtgatcaaatcagagtaattgggatatctattacctcagacgtttttctttgtgttgggaacattataaatcttcagccgttttgaagtatacaataaattattaactataattttcctactgtactatcgaatactagaacttattccttctctctgacatatttttgtaccccttaaccaacttctcttcatccctctttcacctctttcccagccactgctaaccgtcattctacactctgtctccataggatccacttttttagctcccacatgagtgagaacatgtaatatttgtctttctgtctctgtcttattgtagctaacataatgacctccagtaatatccatgttgcaataaaagaagcgacaacatttctttctcttttctggcggataatattccattgtgtgtataccacatcttctttatccatttatccattgatggacacttgggttgattccatatcttggctattgtgaatagtgttgcaataaataggagagtttagatatcttgttgatacattgatttcctttcttttggatatatgcccagcagtgggattgctggatcatatagtagacctattttaattttttaaggaacctctatactgttttttataatcgttttattactttaaattcctaccaatggcgtatgaacattcccctttctctacatcttcaccagcatttgttatttcctgtcttattgataatagccattctaactagggtgagatgatatctctctttttttttttttttaagagatagggtcttgcttattctcccaggctggagtgcagtggtccgatcatagctcactacagcttcaaactcctggcctgtagtaatcctcccacctcagccttctgagtacctaggactacaggtatggatcaccacgcctggctaatttttaaattttttccaaagatgaggtctggaaatgttgccccagctcatctggaacacctggcctgaaataatcctcctgcccgggcctcccagaatgctaggattacagatatgagccactgtaccggctctttgtggtttcagtttgcattttcctaatgattagtgatattgagattttttcttatgactgttgcccatttgtatgtcttttgagaaatgtctattcaggccttttgcccaactttaattctaatcattattcttggatcagtagtttcaacgtgtaaagaatttatttctctttgccacagttttctcatactaagatcattggcaggaaacttgttttggtgggcaagctacttatacggaggagctttaggagcttttagagagagtactttttattttggaagtagatgacttctagggggagtgggcccatggtgcacagtgaccaggttagcacattgcatgacttgtattcctcctgagactttcttctaaatctgaggtcataaactggcagcaaccagctcacagacctttctgtgtgtcctatacggtgtttaaatttttaatttttaaaaattagttgcttatgttaaaaacttatgagattttacacaaaatgttggatctccagcttattttgaaaatgtgaaagatctggctacagtagacctacattattggttaatggttgtctggagctgagtggcagctgccctctttaggtatgacctctctaattcttcacactatttgacctacttcactcatttgtattaactgtctgacctgtctgacacttaggggcatttgatattgggactcttgcactaaattgtttggatttatatatgcttgagccagcctattctgatatatgacattctactctatttgtaccttcagaatgttaagataatttacttaataaaagtctcttacagaaaaatttcaaactaagcaataaaattgagatgagagatacatgagctgctctcccaacaaagatcaaatgaaaactgtcttcatagttgatattcttgttacatagcttttaccttgatcctaaagcaagcatttgaaataatagtctagaacagtggttctcaaagtggtcccagaccagcagtgttagcatcacctagagactgttagaaaggcagttattcaggccttaccccaggcagactgaataggaatatctggggacagcacccattgattggtgttttaacctgtcctcctggtgactcttacccactaaagttgttctaaaaggtttttacagtagtatatcttcatatacatttcttgttttcttttctattaggtactatagaaattcagagataaggatgtatttctattttattaacattgtatgatttttaaatttccttgttattccccttttgagtctcctatactcttactggaggtaccaaagaagcacataaaatatggaaaatgtatgtttgtaagtgacatctggcaaataaagagctagtcctttgagtgaagaaagttctgaataatctcctgaaagcttaacgaaggatatgtgtcagacttgctaacatgtttccctcacagttgcttttttttttttttgagatggagtctcactctgttgctcaggctggagtgcagtggtgacatgatctcagctcactgcaacctctgccgcccgggttcaagcacttctctgcctcagcctcctgagtatctgggattataggtgcctgccaccacacccagctaatttttgtatttttagtagagacagggtttcaccatcttggccaggctgatcttgaacacctgaccttgtgatccactctctttggcctcccaaagtgctgggagtacaggcgtgagccaccgggcccagcctccttcacaatctcttacagactttctgatttctaggcagatagtatttaattatgaaaaaagataattctgtttcctcctatgaagagaattgctgctttccaatgacctttttgcccaaaatggcaaataggaagtaatttaatcaggagtagccgaattttgtactgacaaaacttcatattttcatctgaaactgaatatttgtctcatttctaaaagtgaattgcctgtttgccaagttgagaaacccctccaaaaatttctaatagtgtttaagatacatagtgattaaaatataaaaggtgcttaaaaatgcaatagtctctaaaattgatatttcatattctattagcagatcacttttttggaaaaaaatgtaatattttgtgagaattcagaccttcccattttgccattcataaagccacaaacagctgtaaacttaaatccaatttggctcatgaatcttccaaaaacacactgtaatattttagtttaagatgacccaggctgggtgcagtggctcatacctgtaatcccagcactttgggaggctgaggtggaaggtttgcttgagctcaggagttcgagaccagcctggcacatagtgagaccccatctctattacaaaaataaaaaaaagatggcccaagtgccaacagtggtgaacaaaacagaccaggcccatgttctcatggagtttacagtgaaggaaatagacattaagccagtaccctagtaggtatcagttcaggtaataatagcgaattttttttttttttaaagcacagttaagagatattgtgagaaaaggcctgtggagagacaggacattcagctgagacatcagtgaagaggggaagcaagtcacaggaaggtaggggaaataagtacagagactgtgaggcaagacatagactatgtgtaaggaaggaaaggagtccattgtggctggagccgagtgacacatgggatagcagtttaaatgtaaatgcatcagtaatcacagtaaatgtgagtgcactaaaatctcctattagaagagaaagagtctggataaaaataacagtcaaattccggctaaatgctgtttataagagatgtaacggaaagaaaatacaaccgaaaagtttaaaacagaggaatggaaaaagatacactaggcaaatactcactaaaagaaagtgggtgaaacaatattgatatcaaatgaggccaagcatggtggctcatgcctgtaatcccagcactttgggaggccgaggcaggcggaccacgtgaggtcaggagtttgagaccagcctggccaacatggtgaaaccccatccctactaaaagtacaaaaaattagttgggcgtggtggcagatgcacctgtagtcccagctactcagggggccgaggcagaagaattgcttgaacccaggaggcggaggttgcagtgagccgagatcatgccactgcactccagcctggctgacacagcgagacttcatctcaaaaaaaaaaaaaaaaaaaaatcagatgaaatagaatttaagacaaaagaatgttacctgggaaggatatgttttatactgttaaaaggtatactttatctagaagatgtaagtcatgcacctatatgaaacatacatatttatcccaaactgatagaaatagaaggagcaatgagaatactgcaattatagtttcaagaagttaatcaagaagacttaaatattcttctctccaaaattgacatttcagttagacaaaaaactaacgcaattaacaacactgataaaacagaaaatagacaaaatttctaatatatatgaaactttaaaaacatggaatatttgtaaaacaactattttattcttttttttacctttatttcaggttcaggggtacatgtgcaggtttgttacacaggtgaattgtgtgtcatgggggtttggtgtacagattatttcatcacacaggtaataagcatagtaacccataggtagtttttcgatcctcaccctcctcccaccctctgccctcaaggaagccctgatttctattgttctgttctttgtgtccatgtgtactcagtgttgagctcctacttacaagtgagaacatgctgtatttggttttctgtccttgtgttagtttgcttgggataatggcctccagctcatccatgttgctgcaaaggatgtgatcttgctcgtttctgtggctgtgtagtataccatgtcaacatgtaccacattttctttatccagtctgtcattgatgggcatttaggttaatttcatgtttttgctattgtgaatagtactgcagcgaacacaacacatgcatgtgtctttatggtagaacaatttctgtgcctttgggtatatactcaataatgggactgctaggttgaacagtaattctcttttaagttctttgagaaatcgacacatggctttccaccatgattgaactaatttacattcccaccagcagtgtataagtaatcccatttctctgcaacctcgccagcatctgttatttttgattttctaataatagccattctgactggtatgagatagtatctcattgtggttttgatttgcatttttctaatggttagtgatgttgagtatttttttcacatgcttattgaccatgtgtatgtcttcttttgagaagtgtctgttcatgtcctttccccatttttaatgaggtcgtttgctttttacttgttaatttgtttaagttccttacagattctgaatattagatctttcttggatgcatagtttgcagaaattttctcccattttgtaggttgtctgttcactctgttgaaagtttattttgctgttcagaagctctttagtttaattagaacctatttgccaattttaatttctgttacaattgcttttgttgccttcatcatgaaatcttcgccaggtcctatatccagaatggtgttttctaggttatcttctagggtttttatagttttaggttttacatttaagtctttaattcattttgagttgatttttgtatacggtttaaggaggggggtccagtttcagtcttttgcatatggctagccagttatctcaggatcatttattgaataaggagtcctttctccattgcttgtgttcgtcaactttgagttactatgttttttttgttttttgttttgagacagagtcttgctctgttgcccaggctggagtaatgcagtggcgtgatctcaactcactgcaatctctgcctcctgggttcaagtgattctcctgcctcagcctcctgaatagctgagattacaggcacctgctactctacctggctaatttttgtatttttagtagagatggggtttcaccatgttggccaggctggtctcaatctcctgactttgggtgatctacccacctcggcctttcaaagtgctgggattacaggtgtgagccaccatgcccagccaatgtttgaaagggttaaaaaagaaatcaggccacgttacctgactataatgcaataaaattagaaattaacattaagaaagtagtcaaagccactttatcccacctggagatataaaaatatattcttaaatcttactttaaagataaaataaaatataaattataaacaatttagaaatgaataataagaattatacaaaattcaaatccctgtaattcagaacctgtgggaggcagtaaacaatggcacttagaagaagatttatagccttaaatgaattttctttttagaatacaagaaagattataaataagttaaaaataggataaagataaaagcagaatttaatgaaaatagaaaacaaaccaaaaagttgattggtaaaaaccaacagcaagatatttgaaaggacctgatatttggtagatttgatcaagttaaaaaggaagagtgtaccaataaactgcagtaggggaaaggcgagagacagttactagaaacagaatatggcagtgtgattagagattattatttataattttatattattaaatttgaaaacttagataaatagatgtttaaacactatgccatatttacttcccatgtggaagtgtaaatgcataaaaatatgcaagatacttttgaacaagaagaacaaggttgatcttattctttcagagaccaaaacataccacaaaaccacaataatgaaagcactgtgatattggcataagaatagaacataggccaggtgtggtggttcaccctgtaatcccagcactttgggaggttaaggcgggaggatcacttgaacccaggaatttgagatcagcctaagtatcatagtgagatccccatctctacaaaaaaaaggaaaaaaaattagctgggcttggtggtatatgcctataatctcagctacttgagaggctgaggtgggaggatctcttgagcccaggagttcgaggctgcagtgagctaggattgcaccactgtatactgccctgagtgacagagtgagaccccatgtcttaaaacaacaacaacaacaaaagatcaatgttaaagagtaggattaagaaacatacctatgtatgtatatgtgtgtgtgtatatataatatagataaatttttaaaaatatatacacctttgttggatgcatagtttacattatatatgagtgtattatataatgataaaatacaaaataatgcaaactgtaaaatttgtgtaaatttaataaaacacaaatcatgctaccatttctatgtatatgcacacatacagctgcatagataaaaaaagacaggatctaaaaataacttgaaagtcattacctgtggagagaactttagttttagctgtctttacacagagagagaatatattactatatcaatatattacttgcttaacttaaaagaaataaatagagcaagatacatttttaaactttcaattgagattttttttctggttttagtctaaataaagttaaccaggttatatatatacagattaagagaaccacaatacttttcagtcagttatcagctttgcaagtattgttgattattagctttcagtatccttagcttttagagtaaatttcctatttattcaaatgaagttgctttcagatttcttatgacttcttctataaaaagagttgatagtaactggccctcacatattaattcaatctatatttattgaggttctctgtgtgtactatgtgtgaatagataagactgcgagatcttttacagccttcactttatcttacccgtctttgtattcataacacctagcaattgcccagcttagagttagcacaccatttcaaattaaactcagacatagtctctgaattcattcattattttattcaactactagttgaattaaactcaaatatagtcattacgcttagagagtttatgatgtagcagaaaataatcaaatgattttgatacattatactaatgatagcttacatttattgaaaatgtactatgtgccaggcattacatatgttacctcgctctcagaaccatcccatgaagtaggaatgttgttattgccattttaggggtaaaaaaactgaggcttaataggaagaataagttcaagagatctattgtacaacatggtaactagttaataaacaatgtattgtattttgaaaatcactgagagagtagattttaattaagtgttctcaccacaaagaaattgtaagtatgtgaggtagcacacatgtaaattagctcgattgagccatttcacaatgtatgtacatacagtatgtccttatgaggttcattttatgaggtttcagttacccactgcagtctgaaaatattaaatggaaacttgtagaaataaacagtttctaagttttaagtagcatgccattctgagtaacatgatgcaatcttgtgccatggcgcatcatcccgcctgggacatgaatcatccctttgtccagcatatctgtgcagtacacggtacccactcctagtcacttaggagccaatttggttatcagatcaccttttgaggtataacagtgcttgtgttcagggaacccttattttgcttaataatgtccccagcgtgcgagagtagcgatgctggcaattccagcttgccaaagagaagatgtaaagtgcttcttttaagagaagaggtgaaagttcttgaccaaaaataaggggggaaaaaccatatgctgaggttgctaagatctgtggtaagaacgaatcatccatccatgaaaattgtgaacaaatgtgaatcttccatccgcgaattgttgttgtaattgttctattttattattagttattgataaattcttaactgtaacaactttataaattaaacttcattataggtatttacgtatgggaaaaagctgaatgtatagggttcgttaccatccacagtttcaggcatccactggggttttcagaatgtatctcctgtggataagggagggactactgtatttcaaaacatcatgttgtatacaataaatatgtacaaactgtatttgtcaattaaaagaaaaccctgagactaaaagggaggtggttgactacagttatacagacagttagtggcacagtgaggattttaaccaaagcagtttggctccagagcccatcctcttaactatctgtactgtgtggcatttttctaggctattctggtaagttctctccataaagtacataaagaaggggctgtaggagcccaaaagagagagcaagaaccccagggaaggcaccaataagtgtcattggaagtgtgttttgaaagatgaagtgtgtctgtggggatactaaggagtgtggcatgggtccaggaagtactgagtaattgagctggagcattaccagtgtggatgtgtgcaaaaggggaggaagggagcgaaggagagaacttcaggtgaagtaaattaatgcccaatgtacccttttttgctggaaatatttagtactcttttagattttttccttggtatatcagagaaattaaaaatggagtcctaatgcagcacagagagctaatatccatctgacgttgtgtgataatgggtccatcaggatataaaaccaccaaactgttaattcaaaattaatttgataaaagtaacagaacctgaacaaaattgattgtttgaattccctggatagttataagccattcagttggctttttgtggtaaggaaggataaattttagccctgagtttttcccaggaggccgataacaacctatgattccatgaaactttatcttaaccattctctcctagatcagggctccaaatctgattgtaagttgagatttctttgggtttttacaaagaagctttactgaattgtcagaacatagtcagttactcatttattattaggttgtactttttgcttttggctgcacatgttagaaatcagacacttgctgggaggcaagaattattactaccttatttataattagaaatcatgattgaaatggtagaagaaatgctttatttgcctacgcttaagtcaatactgtcaagaatgcatcttgatgtttcctgggaactcagttatctacaatttgaaactttatctgccatttcatagagacaaaaataactctcccaaaacatttggtgaaattattgttcatttatttcaaagtgactctaaaagttagtgcatattcttaaatttaccagcctttaatggtaaggtaaaatttaatgtcccattactcagttacaacaatcatcaagtcagctattcttgttttatttaatccttcacctccactattcacccacactgcttgattgttttgaagcaaatcccaggcatatctcatttctaaatatttcatgtgtatttataaaatattattgaccttttaaaaattataatacctttatcatacttttacaaattaggagtaataaatttccttaatgccaaaaaatgccttgttactgtttagtctcctggatttatatatattttttagcttgtttgaattaggatccaaatgcgatttataggaagttggttgatatgtctcttaagccacttttaatttaaagcccttcctttctgctacccctgctcgtgtactctgagatactgttggagaaacccagttgttatcccatatagtttcaaccttcattcgggatattgctgattgcatctaagtggtcttatttaatatgttccctgagtttcttataaattggtagttttatctagaacagaggtcctcaggaccgcttcatacttataaacattattgaggaccccagagggctttcgtttatactaatatttactgaattagaaattaaaactcaaaaaatgtttaaagaatttatttacttaaaaaaaaagctaattatacattaatgtagtttttttcaatgaaaaatgaccattttcccaaaacaaaaacaaatgagtaagaaaaatagcattgtttacatttttcaaattttttggcttagacagatagatgatcctatctgttttgcattcagtctgttgtaatacattgttctgtttgaagtataggaagaaagtctagcctagcaaaaagaggtgtagttgaaaaagacagaactattgtaatagctgtttaagataactgtggatagtctttgaccctataccaaaactcaacaagtagtggtttcttataggttagttgcaatgtagaatataaaactaaattcatgaaattttcttactctgtatattaaaattcattgatgttttaaaattttgagtggaacttttactcacacatgattttgtaacatcacgcattgggcatttggaagatgttggttcattcagttacatggatcttctaaatgttggcacatttcattaaacaatataaaaaaaccccacattccttgaagttatgaccagtctcatcagaagagtagctaagtgtagggaagttgtcaagctcacagtggtagattcaagttttccagaatacttattttcatttgaaggtttgaattttatcatcagctacaacactcttagttgttttcctttgagtgacagactcacttttttcatttctgagaaaatgtctgccagatacccaagtctgaatactcacagtttgtcatttttcatgtaaaatggtgctctgtggaaaaagcagctggttgagcttgcagctcaattgcacaagtgctttgcttcaaaatgaccattgtatttcagttaaaacagaagtgctatatgcggacttcccatttcatcatagatactattaaaaagacatgaacttttttactacttcatcaaggacattcttaaggatttttaaaaaactgtagccagtgactgtaaagaatgcaataactgctgacactatttggtgccactttttggtttctactgaggctaacagttttagcccccactgcttttgtgtaatcagtacagatgtcaacacagtagaaaagtcaaatagtgtcttaagattaatatgaaaatagtttggtcttatagagtcccctaagagtgtgtcagggatcttccagggatctgcaagccagactttgagaattgctgatctagaagcttgatcagaatcaggttcgatttttttttttttttttggcaagggtatttcataggtggtatgtatacttccatcagaaggttcataatatctggatatatggtcatctctctttttccgttgttagaaaccagtgaaggtcattgtctggatgccatttcattagaggttacaaagtggtgacatttgatcatttcttctccatttaccaattgaagtaaagaagcatttcattatttagataatctcaggtacaatgtatacagaaaagacagaatatgcacttgattttttgatttttattataattttcaaaataatgtattggttccctggcattctccaaagatataaccagggattttttttgtatcataaattcgtggatttaaaaatatttgatctgtttcaatcctttcatctatttcttatgttcaaatggttccatcttgatataaccccagtagttacttttaaatgttttattgaggtatgctttatatactccctggtagtttgtgagagcatccttgctttctagtatgatgagatgtgagatgttccaggctcatcttgtccatgtcttgctccaaacctggaaacagaccttttttttttttttaaggaactcaggtttttaaaatgggaaatggtaattagagaccacagtctgggtgcaagttgtgctcattgcagttaggtcatttttttctaagccttttcaatgtatgaatccaggaaatgtgtttattacaaactcatgcgttcttatgctatttccagtgtagattgaatactactagttttttccttaaccactttcatcccacatctgtaatcctttcccccatgccaaatatcttcccagcaattctaatataattactcatttgtttttcaattcacaataaatgtcagcctcggaataataatgccagtacttctgacaacaatactgaaaacagttaaagatttgtgttgcagcttgttgtccttagggacatcccatatagatgtacaatgaaattattatatgttaaagctactgggaataatttctacgtggttatgccacaaacttaattggccaataggtttttttgtttcattttgttttttgtttgaggtattgctttttattgttttgctttataattatataaactatatggttccaaggggcaagtctacaaaacaaagttgttcagatttagtttctattcctatctcctctgtttcctcctttttttaatgtttgggagatatacacaagacacatgtatgcatgcatgcatgcacgcacagacaaatacatgtatgtttgtactaccattctgagataacagtagtgtcctgtccatacttttctctgtttgttttttgttaattatatatcctagaaattactccatagccatacatagagatagtcctcattcttttttcctatgcttagtattctgttgtgaggatgtattgtagtttattcagccagtcctctgatgatacacatttaggttgtttgcaacagtttttaagttgattgcttcataaacctattcataaatagggaatgcaattttttatgattgttttggttttttaggttcatgctttgtcagttttgagaagcaagttacatgttttaagcgtgtttagcttttttttttttttaaacagcaaggagtggatttattcagaggtctccctctgccacattttagtgctgtttgtataaagcagcccctaagactctagtcataacatcacgtgtcacaggaagagtgagtaatcaatctcctggcaaacattgtttgttagcctgccgcaggcattaaaatgttgccaggtgttaacaacctggaggcctggaattcctaattgctgtaatcagaacctgaagtttttaaagtttgaatctcattacaaccaaagccagatttggttcagttactttaatttttctataatttgaagtcagaaaagaaaaagaaaaacaactgtaacttcagtgttgtttattattcatcaagaaggtttcaatggctgaaatttaaaatgtaaattagctattactctagaaagcacagtttttagttttcagctgagatgaatgtatttttcttattcctggatctatagccacgcttttgaattatgatctcattcacttagacacatatttttcactcttcttttgagctgttgaagatattttcttcagtctttcttttcagctttacctcctgtttttttttctcacacgaactcttgacaattcagtaatccttattcctgggacatgaaatgttgagaagacaaaggagatttatgcaagttttcccactccatccaaagaaagggtctctattagagctcttgaaagtgatatttgcttatgtagcccagtgcctctgaaagaaaaaacatgatgcagaacttttctcattatctaaggtgtgttcctggtgtcatttccctctcccaacaggaccacttttacctaatacaaatctggatcctccactactcaagtgaaatacaacgcaattagcatcttttgtctttgataacacacctactccaagcaccagtaatgctggaatggaaagcatgtttcatttcctttcttcatttctctgttggagtttgatgctgatattactgagatttctaatggacagtgtagggaggagaaggctgattgatggtaatttattgtactgctactgagaaaaaaacacaactcagggtattggttgttcgatacatccagattttttgactgaaaatgttagattttactttttcttttttaaaaatttccaacttttaagttcaggggcacatgtgcaggatgtgctggttttttacataggtaaatgtgtgccatgttggtttatggcacagatcatgccatcacttaggtattaagcccagcatccattagctattcttcctgatgctctccctcctcccaagcccccaccctctgacaggccccagtgtgtgttgttccccaccatgtgtccatgtgttcttatcattcagctcccacttataagtgagaacatgcagcatttttttttctgttccgtgttagtttgctaaggataatcacctccagctccatccatatccctgtgaaggacatgatctccttcctttttatggctgcataatattccatggtatatatataccacatgttctttatccagtctatcattgatgaacatttaggttgttcattacagcactattcacaatagcaaagattttacatttgtttagaaggcttgataaagttgcagttgtgtaccaagtgtaccaaagtgactgttcttttagtgaagaagcagtagatttggtagttaagatcattggaatcaggctttcagcgttcaaatcctgacttcaccatttgctgagtagctgtgggccacttacctctcctctctgagcttcattgtcctcatctgtaaaatgaagtaatactagaacccataggatacattttgaacctatatgagagttaaatggagtaatgcacatcaggggcctgcaatataatacagattgagtatcccaaacctgaaatcctgaaatgctctaaaatttgaaacttttgaacagtcaaagaaagtgctcattggagcatttcaaatttcatatttttggattagagatggtcaacaggtaagtataatgcaaatatttcaaaatcctccaaaatccaaagtttaaaacacttctggtcccaaacattttggttaagggatacttcacctgtagtcacttcataaatgtcagcttctcctccctccttccactttcccctcctttcttgaaacattgtccatggagtaaatttcactacctaaacttttcccccagtgatttgccattgccttctgttataaaatcagagatacattcccaaagaatacttgctcccagagggactgatctaaaactactctaaaacaaaggaattaaaactattactgcttggaaattgattaccaaagtgatcataggtatcaattttagaacttcctaatgctttcttcctttcttttccttacatctctatacaataatacagtgtttctttctacccacctctcaaatcatgaactgttgaggttaacggaaattttcaaatcttgaagctctgaaactacttcccttacagtaacacacttctaccaatagatgccgccctttcacttcttgagtgcacaatctcctgtgtggcatttgcttaaggcagagcttgctggctatgtaaaatgaatgataaaattattgaaccaggccgggtgaatgataaaattaccgaaccagtggctcatgcctataatcccagctttttgggaggctgaggttgcaggatcgcttgagcccaggagttcaaggccagtctgggcaacatagtgagaccccatctctacaaaaaataaaagcacattttaaaaagccaggtagggtggcatgtgcctgtggtcccagctactcaggtggttgaggtgggaggcttgcttgaacccgggagtatatggtttgcagtgagccgtgattgtgccactacactccagtctgggcaacagagcaagatcgtgtctcaaaaaaaagaaaaaagttactgaatcactttagaaatttgacattgtgtgaagtgagtttgtttgaaaatagggaaaacttgtaacacagaccagtagaatgaacattacattacataagaagaagggtgaatggcccaggctttagctgggaccttgggtgagtcaccctcctctttgaattttagtttgtgatctgtaaaaattaaacataatagtacctatcctgcttttcccacagagttggagaaaggatcaaatgaaatatacattgggttatttgaactaagtttactttcaaaactttggtagaattttattagccaagaattataaggccgttgatgtttattttcggttcattgtgtattaagtattatcacttatttttatttcacattttattttactattataaaaaaattaactctttgaatgatgacaaataattcagaagtgaggaagacaaaggagcagttaagcctggatttctggtatgactccgtttgctgatgatagtaacattatcactttagatctaggtagcatttaatatagttaaagatgcattcatagtttgttcttttgtttggcaatgcttacagtgtttctgtgaggtagcagggtggggtttcttatcctcttatagtttgaggaactggagcccagagacattttacaaaggcatctttcctacttggtgccagaatcaggtctggaacccagacccctaagtggcttcctgtctgcgttaattcataagtgtgtgtgttttctcacatgaaaacaaaaacaaaaactatgcttacatattaaatacccaatgttataaaccaggaaaaagaatcttctttcaaataacatgtgatagggactacagtaaccaggaagaatgatttcaggtttattgcatcttcctgggaatttcgtgacattagaggagtatttattattaactcacagtgttttttttcatgcttattgagaacacaatgcagattgacaagctttgtatttcattaattgtttatgcaaacaattcttattggagcaatttaatttgtactttcttttgctgttctttcttatttactttctaattatgggttgtacagtaattttgctattgtcagaaagtgtcttttttttttgtttgttcgtttgtttttttgagaaggagtctcgctctgtcgcccaggctggagtgcagtggcccaatctcggctcactgcaacctctgcctcccgggttcaaatgattctcctgcctcagcctgctgagtagctgacattacaggtgcatgccaccatgcctggctaatttttgtatttttagtagagatggggtttcaccatgttggccgggccagtcacaaactcctgacctcaggtgatccgcctgcctccgcctcccaaagtgctgggattataggcctgagccaccgcacctagccagaaaatgtcattctaactaaaaaggcattattattttaagaacatttttggttttcgccaggtgcaatcccagccctttgggaggccaaggcaggaggattgcttgaggtcaggagttcatgactagcttgggctacatagcaataccctgtatctacaaaaaaaaaaaaaagaaaaattggctaagtgtggtggtgcgtacctgtagtcccagctactcaggaggctgaggcagaaggatcgtttgagcccaggaagttgaggctgcagcaagccatgactgtggcactgcactgtagcctgggtaacagaatgagaccctatctcaaaactaaaaggaaaaaaaaaaaaaagcaaatataacctctgaaaacaaaggtatctattgtggaggaatcttaatggatacaggaaatatttgatatattttctggttatatctctgtcacagtgtgcttgtcagtctcattcaggcacttgttcctgaatttttcttctcttctactctgttatctattgtctaatcagtatgggcttttctgctaatttgcttttctttttttttttaaatttatttatttattttttttccgagatgaagccttgctctgtcacctaggctggagtgcagtggcgtgatctcggctcactgcaacctccgcctcctggattcaagcaattctcctgcctcagcctcctgagtagctgggattacaggcacctgccaccacatctggctaatttttgtatttttagtagagacagggtttcaccatgttggccaggctggtcttgaactcctgacctcgtgatctgcccgcctcggcctcccaaagtgctgggattacaggtgtgagctaccacgcccagcctaatttgcttttcttactccagtgttagataatgaatatttttagtaatcttcatattggttgctcattatcttgtctaattttaaattttattggcagacacacttggtctcttaagactaactacattttggattttgacaaggaaatgatgaaaatagcagttattgaatgcttgttgtgtgttaggtccctgtaaatgttttataccatcttcttttcataatatcctcacatggtagatcttatagatcttattcccacttatttgacagagaggctttgaggcgctaggtgacaagagatgctaggtgacctgtcccacccttggtgcatgattaataaaagatagaccattatttttctcagaataacgcacgtttgtttgtgtgagaatggttatatatgtgccgatggtaaacattcatctaattcagatgctgcatcttttctttctctaacatgtgcagcccttagcgaattgccatagcatgcaggtgctcagaatgtgttatttgattatgttatttgggcccattgtgcactctttggaaatctttttaaatttcttcagattttctttttgtaatatccattcatctatgtgtataggaatatgttaattggactataatttcatagatgtggaatttagatttcttccctgcttctttggtaaaactgtagtaaaaaacattgattggaaatacagtgttgggaattcccttgatcgaattggataaagcataaagcatttagcaaagtgcctggcattcctaatctattattaatatgtgggttccttttagagtgatggcttatttatagtgaagaagagcagtgggttgggaatcaggtctcagctctgactgtaactagctttgtgtccttaagtaagccacctaacctttctgggactctgtttctttgtctgctaaaggtaagattaagccttcaagagccctcaaactctcttggtctttgtttgccaatttaaaaaatgcagctaatgcgtctctctcatagggatcatgtgagcctaaaataaagagcttgtgtaaagtgtgtaaaagatgctcagtatatataaggttcttttcctgttcttttaaaagcagagaaatgcttaggacacccaggacgccaacatgagcatagaaggcagtctgatatactgaccaagagcagatagacttggatccattgctggtttcattatttatgggaccagtaactctaggcttctcacccaacctaaaatgaagatactaatcatatttacttctgagttattgagaagattaatttaaaaatgcttttaaagtgcttagcagagtatctgacacagagtaggcattcagtaaattttatttacatgtgtaacacttagggtgggagacatggatgaactactggaaaagggaaagatactgaggtgggctgccctaaaaaaggaaggtaagaggaagacctacacttatttcacacttttgttgcaggccctgctagttcacacattgtttgctttgtgattttttttttttgagacggagtgttgctctgttgcccaggctggagtgcagtggcgtggtcttggctcactgcaacctctgcctcctgcgttcaggtggttctcctgcctcagcctcccgccaccatgcccggctaatttttgtatttttagtagagacggggtttcaccatgttggccaggctggcctcgaactcctgacctcaggtgatccatccgcctcggcctcccaaagtgctggaattacaggcgtgagccaccatgcccagccatgatatttattttatacctaagatgagcttaattctgttatgactttcttgttcctagggtgagcttaattctgttatgactttcttgttcctagggtttaaatatcaaggatactcactaaaacactgatagaccttttgtgttttctctgattgcttcccttctgtgcctgcctggaggctataggtcctggacagttcccacattgatgttttttttttcaaaacagttttttcctgatggtacatttgttaatgtaaaatagctcaagtaaatgtatgtgcgtatgtatgaaagagacagagagagacagagagagctgtatgggatccatcagctgccgagggtaccctttcatcaagcagagttcacattgcagagcattggatcagagggtggccagcagctggagggagagcaaacttgaatctactttatagacccactagtcacttccatttgccctttacttaggagaaaatacacagcaaaaactgttctttagacatggatgcatctagtttaataaatcttaatgtagtgctattaaaaatgaggtaaagtcaggaaattttctaccccctcccaagtgctcttattcctagatatgcaggaccaagcataaagttattttcacacattgggaagaaatgttccattccaatttcaagtggaggttttccacttttggaagtgctgctgagactgcaattataaactacaactattcttttaaaacagttcctgggatgaattaagatcttgcagtaaaaataccatatacaatctgtcacattatctgtggaactcttccctttgccagcttggtcagtgagggtaacagctgcccagagttcattgctaaacggatgtttaacaatggtactgtgaattcagcacttcatattagaataatgcttgagttcctggtattcggttaatggagttttacgtacagtgatacagaaaatatgtgatgcacaggatttcagctttttaagaattctcaccacttctcctcccatctcaattttgttgttgtggaaaatgaaaatcccacaggaaagccaagtgtagtcctcattccctgacttctggctttgtactccatcactttccacttccttcccctcccctctctacactgttcacctgggcctaaacgtctgaatgactgcagcctcaaggaaagcttcaagttagactagatgacctttaaggttttgttaatcctgagaatccgtttggccacatcaatgagctcctttgtatctactcaaatgtgatagaacagacgagcattcagagtaaggggatcttcctaggctggctgcagagagaacagtcagcagtgctcgtgccatggctacagattacacatctcactctgggggtgtgtggggactgggaaagggggagccagtttggcctgtggcacatgtaatttttatactttgaactactgaaatgggtctgagttctccagctcttcacagaccccatcacttcctgtttttgttttatgagcagactgttgagtttatttctgttgtctttgccagtctctcaaaacatttgtgtttgtgatctctgatttaaccagtctccagctgatggtcatttaggtagccttcagctttttaatattaataaatattgctttaataacatctttgcatggtacgcccttagaattaattcctgcagtagaattattgggtcaaactgttcacaaatttgaaattttgatacatattgttaaatttccctatcgtttttggtatgtgaattgttgctttatattatttactgaattttccatggaattcttattttctttattgattttaaagacttcttcagctatcaagtcaggttatgaaccttttaacatatgtggtaaagatattctgctagaatatcttttaaagctttgtatatggtatctaacttcagacatttaaatttttatatattttgatttattagctttttcttgtggtttctggaattttatgtcatctttgggaaagtttttcacattctaagattacaaaaatattaacccttactttgttttagaatgttttattattttttctttctcaatatttaatctatcatgtatttgtcttggtgttaagagtaaggtagcaatcgagctttatatttttctaacaaccaagggtttaaaaaatacataattaatttagaattaccaaatcttaatagcttatagtacctaaaagtggcttgtttttacagatagaaactttccacttcaaactctgagttttaatgtttttcggcttttaaaacctctagaaagaaactgtgaacagaacaccgtattggttttggcattaaccttaatgcatctcaaataggctgattctacagaatttgatccaaagtacttctatgtcttgatcctttttttgccaagcaaaattgattgtttctaaccaaaaggcctttagtgctagactgaaagaaaagtaaggtggtccttctgtgctggttgtattttatataatttggcatcaagtacaatgctttttatttttctctttagtttctttcttttctctagcctttgatggtccaggcctcttgttgctagggggctttttgggagacaaattcaaatccttactgtctagctcattgttattgtatcttttagtgagttccttttttcatggtagttcaataagtggttaccaggggtctttctttgacagttattactagcttctcttgtatagtgggatttagctgtgggttgatttgttgtgctggtatgttttcaactgcagcgatgcattgctctatcacatggattctttttatagcttcattagaggtgttttagttcctcttttgaatatttatctgagtatcttagtaccttggcagtcacactatcctaaattattatagtgccttctaaagtagattttgtcattgaggcttatgtttaggtcaggcttgcaggcagggagacagattatgccattgtggttgagaggcatatagtggttaaaaccactggagttattctgttagggctcatagcctatcttctccacctattatgccacctgtctaacccttgattgtcttatctgtcaaacatggtaaagtcatacctctttcatagggctgtcgtgagtatcaaatgagatgcaggttgcgtaatcccaaatccaaaaatccaaaatccaaaacacttctggtcccaggcatcttggataagggatactaaacctgtaatgcacgtaaagcacctttaggacaatggtccttactgctggcctgcaataagcacttaataaatgttattattttcttcttttttggtgttggtttgctcttctataatgttacaatgctattttgttaaccttctagttgtaaaaacacactcattatagaaagtttagagactgaagaaaagcttaaagaagaaaatgtctcttacaactcttccaccccccccagcaataataattacattttaacatttccttccagttttttaatacttagatattattttacacagctgagatcattctgcatgcataataaatcttgattttttttcacttaacatatcttaaacattttctcatatcattaaaaacacttgtgaaatcatttttaagggtcacatagtagcccatcacattacattcttttgattgatttaatcatcctctttttacttggcatttaacatttggggcttttttggttggagttgggttgttttcaggtcgttctaatatattaagccaggcttttttcttgtcaacaggaggtttggggattgagtctttgtgattgtttttattgttgcatttttttgcctgttgagtgtgtgaattaagctggggttttaaccatcagcacctgcgctctcagactcttgccaccacctttctggacaatctccatgctctgctttttaaactttttctgatgagtttcttttcttctgtgctagaagaaagatgaatggagactatgtttggtgtttaggtttctgacccggcagtgccatgtgaatgcccagtagctagccaaggtcaacagcactgcctgttaatggctttttactgaagtagtcctgtcgagcagtttctggtgagaagactatcctaaattgttcttgacagggtacactatttttgtttcaacttcttatttttcctgtaaagcttggtttaaagtatgttgagactgaatttatttgtgctttggaatataatgagattttgtgctcttttctttcagaaaactagccaagaacagcagtctggaaaagacatatgtatccaaaattgccagggaaacctgctgtgtagatacgctttctgagaaaccacatggtaaatgaatgtcatctttgtctcagaaccacagtagcctggttctgctggtggatcgtgctagctgatttgagctgggtttttaactcagttattgaaatggctttgagagcaggacttaaatgcctgcggtttttgacctcaagaggttgcttaaaacagtatcagcctgtgtgagcctgagactgtttttcatttcctttgtttggttcggagactgcttgatccatggctgcttggcaggcttcttctttagcgttcattcttgtggccatttattctctgatattaaactacaggataattttaatctcaactacatggtgagaaaaagagctgagtccagactggctcagaaatggagcctaagaactgcaataagtatcctagcaccttaggccctaggaaggactgttccatagttaacttctgtgtggcttcactgtaagcacaggtgacagatgggcatgtcttgaattcctagaagccattgtctctctcaatcatctgttccaacactgtatcagagaatgataaactttcagaattgaaaagggtcttaaaggacatattttccagctcttgctatatttccaacaagaggcatcatctcacatttgcttgactacctgcagtcatttctgagaagagggaattccacaagttggaagtagttcaaatcattgctcaaagctgtgtgtaaagatagtagtttttttttgttttttgttttttttttcagccaaaatttgtccccagggaacctctatccatgaaattttgattacttctcacaggaactttagcaaaagttagttgggattgtctggattttccgttttgcagatagagaaagccaccatctctttcccctaactacttagtactatggtaacttgggtttaggaaaatttgccagttcattgttaccaaggcaagtgactaaatcgtgggttctctgtatgctaatgctgccccgcatataggctttactgctgtccgtgcttcattctctctctgtttagctgagaaaatgagtgtgaaagcacttagccaatagtagtagatgttgggtgacatttcattaaaagtgcagactcctggccaggtgcggggctcacatctgtaatcctagcactttgagaggccaaagcgggaggatccctcgagcccaggagtttgagaccagcctgaccaatgtagctagaccttgtctctacaaaaaattaaaaaattagccaggcatggtggtgcccacctgtagtcctgctactcaagaggctgaggcaggaggatcacttgaacccggagtttgaggctgcagtaagctatgattgcaccactgcactctagcctgggcaacagtgggacaccctatcttttttttttttttttttcaaaaaaaaaaaaaaaggaaaaagtacagaccccagagtcagacagaacctgattcaattttgatttcaaccacttgcgggctgtgttaacctcaatggattatataattcttcaaacctcaaattccccatctgtagcactgggttaataattatagctgtaagatttaatgaagagcaaatgagattaatacatataaaatacttaatgtatggctgctaataatgaacagttaatgcttaaaaaattctggcttttattattgctattgttactattcctgtaatcactgtccaacaaggtccctgaatctgccctctcattaaggcaatacaggcagagcttaaccttctctcccacctgtccttgtgatttcttctctccataggactacccttggtattcattttcacctgatttaccaagaatagcaatataagcatcaaaagaaggggtggggatgggcatgtacacaatttctctggcccctggatatccctgcttctcttacatggggaggtttcaggagtgaccttgttactctgccgtgttgtcagaactggaggttgggcgttaacttattttttctcattttcctgcctttagggaaaacacgtatattcagaaatatcatggttgtctctattttcagagatggtttcatcctctgtggctctgtcatttgagtatgtgtttttaacaatctactcattccactttgtccttgtggtctagatttcttagtagtcagttttgtttggtttcactccagatgtaggtctctgccgcttcccaagacatcttaatttcatgcacatttaaaaatttattggcatcaagtttcagattttaaaatttgcagtatctgtatttatagcttgcttttcattcctgttatttgtttcttcttttttttccggggggtggggatcagtcttatcaaagtgtaattttttttttaagcccaaaccagcttttggttttgttgatccttgctactgcacattaacttttgaattcattaatttatgttcttacatcattttcttctttctgctttctatgggtttatttctcttttcttcacttggacaattcagcttactaatttttaattatctttcttttctttttctttctttctttcttttttttttgttttctttttccccgagacggagtcttgcactgttgcccaggctggagtgcagtggcatgatcttggctcactgcaatctttgcctcccaggttcaagcaattctcctgtctcagcctcccgagtagctgggactagaggtgcacaccaccatgcctggctaatttttgtatttttaggagagacggggtttcaccatgttggccaggctggtctggaactcctgacctcatgatctgcctgcctcggcctcttaaagtgttgggattaccagcgtgagcccccgcgccgggcccaattatctttcttttctaacatacatttaaggctgtaaaatttcctttaaatactatttcaactacctgccacaattttttgctatgtaatatttttgtaaagtcagatttgttgaggtttaatttatatgctatagaacatgctccttttaagtgtacagttggatgagttttaatagaaatatacagttgtataaataccaccataatcaagctatagaacatttctaatatcccatcaagttcccttatgccctgttttttgtccctaaagttttgtcttttctgggatgtcagatgaatggaattgtgcagtatatagccttttgtgtttggcctcattcacttagcatactgttctgagatttgttcatttgttgcatatgtctggagtttgttcctttttattgctgagtagtttccattgtatggatattaccagaatttatctgttcactactactttattttcagtgggagaaaatgagagtattttaattctgcatttggactgtaaatatcatccagactcttctggattggaaagtatcttggcatttttcaaatacaaatatttatttaggttttatcattttgaaagttcttccattagtgggcaaacatgagctcatgtgtattcacttgcacgcttcctcctgtagcagtctgggttcagagaggagatagaaaccacacagtagattaaagaggggaaatttaatataataagtattacctatgataaaagagtaactatcagatatgaagaaactctgtagcgttccctaaggctgagggcgtatatccaaggaaggacaaactgccagggcttcagacttcattggagaagatgtggttcagcccatggaatcacagaggagtttgctggtttgacaagactggagctgatccaaagtctctgggcaagccgtcgtttaccttctggagtgctggcagagagcaggccatccagtgggttactggccatccggtgggtagcagggtgtgggccctggctgggccaggaggcctttagaacacaagagccatgtggaggctttagtggccatgtcagctgagctcccaaaacgttaggataggctgagtctgcaaggtcacagaaagaccacgttctaggctgtcgctgggccacagtgtcgatggtcctcacacccacattgccatctcccatgctggacacttaggacagcctcttcctcccagtgctctactgagaaaacttcacagcacacgttcttcagagaaatgattatcacagaatgcatctagaagggtgcacttggatcttagaggtaacacactatccctattcttttaaaaagaagtgctatcaagtcaagagcagtaataactatatgcttgtgttattaacaatcagacccttcatgaggggaaaagagtttatgaaaattagaacttacgtagttttaagtaacaaagatatgtttatagacaaatagaactataccttcccatgggacctgtgttatatactaatcatgatattgtccctattctcccctctcccagtcattggaatcatagattccaagttgtaagtcagaccccagattggaagcactttctttgttcaagatgtttgctcattatagaaaacatttaggaagcacattttaaagaacggttttataccagagaagctaagtgtttttaactctgagcctagatgagcttactgctaggagtatagtgtttaaacctttcaaaatgaaaaactaggacacatggtctttacaaaatttttttctggtttaggaatttatacacatttgagaagtattaccatggcataaattaattcacatttgattataccaattaaacagttgccgaaaagaataaaagactatcctaaaatatttaggctatatacatactaatgcttttacagaataaggattaaacaaacctatcttttttagagtcttcaaccagaaaaatgaacaaatgataaaaacttatatttagcagtttgaaggtcacacacacacacacacacacacacacacacacacccctacccctatctagacctattttatgtttttgacactgtagagagttcaagtcctaagactttatggccattataaaaagattctgacatgctttgtggaattcttgtctgcttttgttgcagatttttttttttctttcaaaggattgcttgagagggtatttcttttttgggtatttaggttgtgaatctcacccttcattacatgggagtacccagcagtaaggcttacagagtgttatatactttccagaaactgagtgctatgtacttgcaatcttttccacgctaagaaatccccaattttaaaacttcaacctgcaaagtagcttacttagggaatttctatttgtattcttgacaagttttctgtaagcattcttttttcttttatgtgtttaaaattggatcctatttagtctgaagatgccttttaagactgcatctattaaataaagtgagatcaatttgcattttagctttcaaattttgctggggattctttgggctttttttatttggcaggaagagagagaagcagcttggcctttttgctatctcggaaatttccagcccaagaaagcatacagagacatagctcgcagggtttcttatgtgattagctagctcttttcctgaattattaagctgcattaaaacagtagctcggtgcagttggtgttttaggttttcataccttctgaaagattaatattcctacaagaatgaggttatttttgatgcctccctttagtgctttcaaacatcaagagcctcgcattcttgtactctaccttctgtagacatttacaattattctaggaggtgtaatgggtgtttactaacttcctgaaagtgtttctctcacagattggcttccttaagtgtgaaatttatacaccaatttaaaactacagtgtcccccttgtcaatgggggaatatgttccaagaccccccactggacacctgaaactgtagatagtactgaaccccattgccatcagtcagaacgtttctgttcatgtctttcacccacaaatttaatcccttttctatcttaaccaagcgcttatcacacaactgtggttgaaacttttgctccttgaggtatgacagcaaaactagcatgtatttctttttccttcttcacagtatcatgggtagaagattcattcttactgtaatcttagcagccttagtgtatgattttttgttgttagccaacaatgttcatcttttcacttaaaggaagcacatcatggtttctcttcggcatatgtgaattgccagcatcactactcttgcattttgggtctattattaagtgaaataagggttccctgaacacaaatactgtgataccaattctgcaacagtccatttgataaccagggtgactactgagtgactgaggggtggatagtgtgtatagcatggttatgctggacaaagggatgattcacatcccaagcgggatagagcaggacagcgcaggatttcatcatgcgtctcagaatggcacacagttaaaacttaggaattgattatttctggaagtttccatttaatattttcagactttggttgactgtgggtaactgaaactacagataagggggaatataatatactcttaaaatagaatttttcttaaagagcaatcataagcaaccaggactagagaatttttttcatttttttccttgtaattttattgcaagtaggatactgaattagttgcttattttgattttggtatgcatggatcaattttgagtaattgatacaactttatttaatgaacttaaattatcctcttaggcttatgtattgattacatactttcaaagctgaaatgcttgagagaacccagtaaaaagtcagtatcattttcaaacaaaggcttaaagattaaggatctatttctttattaaatatttattaagaattattttttgctggcctgctctctgaaaatatattagatatagtctttaatctcaaataggtcctactttagtaaaagaaaaagatacaggattgagagaggagttggagcttgtgctgagctggaaggttgaatgggcagccccctaagcagaagacagaattagatccagcagaagcttggaggtgtaaaaaagcatggcacctgaaggaattgggagttgttgttagtatttctgactaatgagctcataagtcttttcgtttatttaacctaatttgattagttctctgtatctcaaatgtgttacttgatataaccaaacttgcatttcatttttaaaagttaaaattcagacctttccctgatttagaatgaccccctcttctctgcactataaatgtgtgacgagataaagttttttttcccatagactctgaccacagggattcttccatctgtcaattcctatagcacatgttgccttgacacacagttggccaggctttacagtcagacacgctaaggttcctatcctaattcaaccacttacaacctctgggaccagaggcaaatgcctatatctctctaagcctccagtgtctgcgtctgtaagatgaggggtaagagcacttatttcttggactgttgtgaggattactcgagataatgcatgtaaggtgctgagcacaatgtccagcacatagaactcaattaaaagtatctctaattaatgttagtgatcattagccctcactaataccctagactgtagcttgttttcatgacttccctacctcttttctctccacaactagcgtgaagggagcatgccatatactttttttgtcccatacccactcttactcacccatactcctcgatccttacatgggttctgacacagagtgggtactggctacatttttaaaaagatgtaatgctagatatcagcaagtaaaccttgggggataggaaagtttctgatgggttcttgctgtggagaatcaaggtcaaaatgatagggaaaaaaatctgtgtttggtcaaaactgtattacctttggtcaaaggctgttctaaaactcacagaacaaaaacaaaacaaaacaaaacaggtgctttgtgaattccatagcaagtcgtaaaggctcatgccagaatagagttggaataaattctaagcatgcaaaatactactttaagaattttgtcctgtaaatttgagaatgttttttaattacggtagctcccaaaccttaactatggttttgctttccatggcttcagttacccacaaccaccgaatattaaatagaaaattccagaaataaacaattcatgaattttaaattatgcgtcatcctgagtagtatgaggaaaccttgtgccatcctgctccatcctgcctgggacatgaatcattgctctgttcagcatatccactcggttgcacccattagtcacttagtaggcatcttggttatcataaagactgttgtggtattggtattacagtgcttctgtttaacccttttgttttattttagtatggaaatttttttttttttttttacttttaggttcaggggtacatgtgcagttttttacataggtaaactgcatgtctctgaggtttgatgtagattatttcatcaccaagtaattagcatagtacccaataggtgatttattgatcttttcccttctcccactctccaccctccagtaatcctcagtgtctattgttcacctgtatgtactcatgtttttgttgtttagataagtgagaacatgcagtatttgtttttcttttcttttcttcttcttcttctttttttttttttttttttttgagatggagtcttgctctgtctgtcgcccacgctggagtgcagtggggcgatctcagctcactgcaacccccgtctcttgagttcaagcaattctcctgcttcagcctcctaagtagctgggattacaggcatgtgccaccacacccagctaatttttgtatttttagtagaaacagggtttcatcatgttggccaccctggtctgaaattcctgacctcaaatgatcctcccaccttggcttcccaaagtgctgggattacaggtgtgagccaccgtgcctggcctcagtatttgtttttctgttcctgtgttagtttgcttaagataatggcctccaactccatccatgttgctgcagaggacatgatcttgttcttttttatggctacacagcattccatggtgtatatggaccatattttctttatccagtctaccgttgatgagcatttaggttaatgccatgtctttgctattgtgaatagtgctgtgatgaacattattgtgcatgtgtcttcatgatttatattcctttaggcatatacccagcaatgggattgctgggccaaatggtaatgctgttttaagttctttgaggaatcaccacgctgctttctgcaatagctgaactaatttacattcccaccagcagtgtgtaagcattctcttttctccacaacctcgccagcatctgttattttttgactttttagtaatagcaaaaaattctgactgatgtgagacgataatcttactgtggggtttttttttgttttgttttgagacggagtctcgctttgtcgcccaggctggagtgcccagctttgtcgcccaggctggagcgcgatcttggctcactgcaagctccgcctcccgggttcacgccattccccggcctcagcctcccaagtagctgggactacaggcgcccaccaccacgcccggctattttttttttttttttttttgtatttttagtagagacagggtttcaccatgttagccagaacggtctcaatctcctgacctcgtgatccgcccgcctcggcctcccaaagtgctgggattacaggtgtgagccaccgcacccggccttttttttttttttttttttttttttttttggacacagggtcttgcctgtgtcactcaggctggagtgcggtggtgtgatcatggctcactgcagcctcgacctcctgggctcagttgatccacccatctcagcctcctgagtagctgggactacagggatgtgccactacacctggctaattgtttttgtatttttttgtagagatggggtttcaccatgtttcccaggctggtctcaaactactaggctcaagtgatccgcccacctcagcctcccaaagtgtgattacaggtgtgagccactgcacctggcctcattgtggttttcatttgcatttctctaatgattaatgatgttgagcactttgaatatgcttgttggccacatgtacattttcttttgaaaagtgtctgttcatgtcctctgcccactttttaacaggaaggtttgttttttgcttataaattcgtttaagttccttgtggattctggatattagatctttgttggatgcatagtttgcaaatatttcctcccattctgtaagttgtctgtttactcccttgatagtttacctcttgctgtgcagaagctctttagtttaatttggtttcatttgttgatttttgtttttgttgcagttgcttttggtgtcttcgtcatgaaatctttgccaggtcctatgtccagagtggtatttcctaggttatcttccatggtttttatagttttagattttacttttaagtctttaatttatctcaacttgatttttgtgtatgatataaggaaggggggggtccagtgtttttatttatttatttatttatttttgagacggagtctcgctctgtcacccaggctggagtgcagtggtgtgatctcggctcactgcaagctccacctcccgggttcacgccattcttctgcctcagcctcccgagtagctgggaatacaggcgcccgccactatgcccggctaattttttgtatgttttaggagagacggggtttcactgtgttagccaggatggtctcgatctcttgacctcgtgatctgcccacctcagcctcccaaagtgctgggattacaggcgtgagccactgcgcccggccaagggggggggtccagttttaatcttctgcatatggctagccaattatcccaggaccatttattgaatagggattcctttccccattgcttgtttttgtcagctttgtcgacgatcacttggttgtaggtatacagccttatttctaggctttctgttctgtcccactgatctgtatgtctgtttttgtaccagtgccatgctggtttggttactgtagccttgtagcctagtttgaatttggttaaaccaacttcaaacctgcagctttgttttttttttgcttagcattgccttggtgttttgggcttttaaaaaattctgtatgaatttttaaactgtttttttctaattctgtgaagaatgtcattagtaatttgataggaatagcattgaatctgtaaattgctttgggcagtatagccatgttaacaatgattcttcccatctatgaacatggaatgttttttcatttgttggtgtcatctttgatttctttgagcactgttttataattctttaagtagagatctttcacttccctggttagctgtattctattcacatatcttttatttccctggtattttatttttttgtggctattgtgaatgggactgagttattgatttggttctcagtttggacattggtatataacaatgctacttattatatttttgtacattgattttatatactgaaactttgctgaagtggtttatcagatcaaggagcttttgggcaaagtctatagggttttctatgtatagaattatattgtctgcaaacagatagtttgacttcccttcttcctgtttggatgtcttgtatttctttctcttgtctcattgctctgggaggacttccagtactgttgaataggagtggtgagaaagggcatccttgacttgttctggttttcagagggaatgcttccaacttttgcccatttagtatgatgtttgctgtgggtttttagtaaatgggtattactattttgaagtagtttcttcagttactagtttgttgaggttttttttttttaacatgaagggatgttgaattgcatcaaaagccttttctgcatctgaagtaatcatgtggtttttgtttttagttctgtttatatgatgaatcacatttattgatttgtgtatgttgaaccaatcttgcatctcagggataaagactacttgatagtggtggattaacctttttatgtgccgctggattcgatttgctagtattttgttgaggattttcacatccatgttcctcgagaaaaatggcctgaagtttttttgtttttgtttttgttttttggtggttgttgttgttgtatctctgtcaggttttggtgtctggatgatagacatagatggacacctcatagaataggttagggaggagtccctcctcctcaattttctggaatagtttcagtaggattggtaccaactcttccttatacatctgatagaattcagctgtgaatccatctggtcctggtcctggttctacattttgtagcttgtgagtatagaggtgttcataataggttctgggaattttttgtatttctgtgaggtcagtggtaatgtcctctttgtcatttctgattttgtttatttggctcttctctctttttttattagtctagctagtggtccatctatcttattatttatttatttattttttttcagaaaaccaattcctggattcattggtcttttgcatgttttttcacatctcagtttccttcagttcagctttgattttggttatttatttttgttagctttggggttggtttgcttttctttctctagttcctctagtttatatgagtaacccttattttacttaataatggccccaaagcataagagttgtgatgctggcaatttggatttgccaaagagaagctgtaaaatgcttccttgtttatctcttactgtgcctaatttaaaaattaaactttatcataggtatatatgtataggaaaaaattgtgtatgtgtatatatatacacacattatatacatatgtatatacacattatatatctacacacacacacacacacacacacacacacacagatatctagctagatagtaccaaaatatatacatctgtggttttggacatccactggaatgtatcccttgtggataggggggactactgtaatcacaaaaaactaacagtatgcaagtacttcatattttataaaatgttatttaaagaagaaaacttgttttttgtgtttgccatttattaaatcatattctttatacatacacgtgtgtacacgcacgatgtactgagtctcctctctaggctctgtggacaaagtctttgggttatttgaacgcagtcttctaagagatccgtgtcagaggtcttgtcattacatcaccatgcctgcttgaagccagatttctttgattcacccaggcttatgatctgcatttcattccagtcttcttggtaaatattttttatatatgtggtcaagttctctttgtttggaattttgataatgagaactgcaagtgttgattaattataaacctaaaatgggattgaggcaattgttaactcgtcgtggttttgctgctttccctccttattggagaagaattaggaagactttataggggactgatggaaaaataatttggcatgaccataatttgagtcagagaaagtctcttattaaaattcccacaaggcttatttaaggagcaagatcttttgaaactaatggtgtggtacttacttaatccacacaagttatgatttgattgtcatcttctttgatttttctgcttggctttctgtcatctgatgagagattactgcattacctgagaatctcatcttattagagtcacctctacctaaactagaatccattcctaaatagtaacatactcgcatcaagaaagagtaagtatcctcggtactaaattagtgctctagatgcctttgtacattttttttgttgcacttttccggactttctagtggccagtgttgaggtatgggatggtatgatggtggcttcattcaactttttagcttctatcgagcttccctgtcatcttgctaaattccaaaggtgtgttctttcctcattcttggtcacaacaaaacatcacctgagacgggatcagtctgactcgcccaaccagaagggatgatgtgtttgagaaatcctgtttgtgacactggaggaagaattgtgactgttcatatatgatacatatggaattgaaacttgtccttaaaagctctggcaggtctctctttgatggtttttagggacaatagacttttgaggtgagagtttgtagtggcagaggagcagaactttgaaataggcctaaaccctgtactttggatatgggccagacccatttgtgttccctatggggctggttgacaagggaagaggaagctctactatacattctcatgtgtttagtgtagcttaactctgctgattcaagatgggctaattgtcagtgtaattcctttgaattatctctgtgatgaagtatcagctggagcttgccagtggcactctgggccaattatgcagccgactttgaaaaatggtatgattcagaatgtcagagttgctaaggtgatttatgaagaaatcagttcccatcagccttcattattcatagagatgctgggaatcaggactttgcagtgacctggcccagaggaaataaaccaggtgggtatgatttagggtttctcacatagagttcaatagaggtgcctctgtgtatgtggtatgtgtcctgtaccgtgttgtgagctcatcttagagcaacagcagctattatttacattacatacttcctccatttcccaaaaaaggatataaggtggtagccttcacttacccactttctttctggtggatgcatgacattatgttatataccttaccaatacctccaaacctcacaaccgctgttgtagaacgaataatgtcctccattgaaaaatgagaaaattgaggcacatattagatgatttatgcaaaggcatccaactaccaagggcagaactcgtatagaacccggtccatctgacttaacaccagtgctcttgcccctaacctgagctgcttctctgacaggtgtattgccctttatattcatgttgcccagcagtgttcctggcctagcgtagctgccaataaaattgattgatttgatttgaatcatattcagcaccctggagtcactgcacgtcagcagcagcaccatgtgtgtagtaggcacttggtgcctactacaaaaggcacaaaagcagcaaagtagatagcatacccattttacagatgagaaaacggaatctcagagaggacaagtaacttgcctaaagtcacccgttaccactagtggcatttctgaatgtgagggccatctgatgtatctaatatcagctaaattcataattcttccagtcttccacatttttcacaaacacactcccatttccagaaacccttcatgtttcttccagttgcttgttgtctcttctaattccttgttgtatcacttaaattattttcccactcttatcctcagtgacctcatctctaaaaggaggataatgatgatacctaccttacagatggattaaataaaatagtgcagacaaaatgttgagttcagcatttaacagatgcaaatggtgaagtaattaacatacttcttccatatctatgtgtagaatccaacagtaacacagcatttgtatcctgctaacagagtgaggctgaactttaaactaaaaatatgtctactttaagatacaacacatttccagagatcacatcttttaagagaaatctcatctgcacaaatgttgttgcttttacttattcagacatcctttggcagacatcagacctcatcagactgggtaaaggcgatggtgagggaattctaggtgttagacaatagtgagtgagttcccataagacattagtactgtcaggctcggagcccgtcctcttcctttacccaagactgatgtgttgcttagccttatgatggcaaggaaattctaaataaccatgattaagaggcttattttagtttctccttccactgtgatctctcccagaaagagactcagaaatccttatacttggtctgatctcttcagcaaaacccaccttcagtagcaagcctgtggctctagggttggcccttattttgtcttgtccagcaggatggtgtctcttattcttttgatgatctcattctttccaaagtgtatttcttataacagaagttcttttttgtttgaataaacagtttaaatggacatgcctttagagataacttagccaggactggagccctgcttcttatcagacattacaaaacacagacattctcattaagtgaacagagatttcctttgatttcaaaagaatgttaaggggaattacttttaagtttaaaagctccttgagggcagaacgcacttcttattctacactgactcttcttagcacccatccagaaccttgttgcatatgatgatgccccatgtaagcttgcttcattggtttcagtggcttttgttcttagttgactagaaatgaaggataatttattcatttcttcaaccagtattacgtttagcatagtaaacaagacaaggtcaatcccttacagaacttatatcctagtaagagagacaagtaaaagaaaataaataaaaataattacaaggtacataattgttttgaagaaaacaagagtctgagatagaggataatggagaggaggcagtctttctagataagatggtcagaaaaggcttgcctgcatcctctgaggagttgacatctaaactaaaacctgtaggttaaggaagaacagggcatgaaccatgcaggcagaagattcattaactctgtaggccactgaggctggaaaaagtatggcctgtttgaggatctgaaataaagtgtagctgtagggtcctgagcaaaagagggagtaatagattatgaagttggaggggaggcaggggccagccatatgaggcccatgtagccactcatgagttggattttattctcagtgcaataggaaagaaacctaagggtgaggtgattggattcatttctgtgtttttaattatgtttgttgctgtgagatgatggcagcctggaccaaggtagatggagatggaaaaaagtggttgggtttgagttataccaatatttcagggacaaaattgataggactgctaaaggattggatgttggcaggaggcgggggtgagggaaaaggaaggatcagggatgattttgagcaaatggaagaatgatgataccattcctgagatggggaagactggggagtaaggagacaagatttggggatgaggaagggatgtgactcaagagttttgctttggatgtgttaagctgcagattctattagcgtggtggctcacacctgtaatcccagcactttgggaggccaaggtgggcagatcacctgaggtcaggagtttgagaccagcctggccaacatggcgaaaccctgtctctactaaaaatacaaaaatctagccgagcgcaggtggcaggcgcctgtaatcccagctacttgggaggctgaggcaggagaatcgcttgaacccaggaggcagaggttgcagtgagctgagatcttgctgctgcacttgcctgggggacagagccagactccgtctcaaaaaaaaaaaaaaaaaaatcagatctcatcaggcttactatcattagaatagcatgggaaagacctgaccatgctatttaattaccaagatttaattactttccactggatccgtcccataacatgttggaattgtgggagctaccattcaagatgagatttgggtggggacacagccaaaccatatcacagatttttcacgagataatcagggactgaaatatccagtgggagctgatctggatgtgcgagtatggagtatgggtatcacagaatagagaggatattcacatcctatgggatagatgaggtactgaatgggtgatatttcccatacctcgtgaaaacagctcaagctacttacatggctggattgagaatttgctgcttcaagattctggctgtagcaaaactgtagaatcacagttattttactgcaagatattcatttgaaatgtatttatgccaccaaggaccaggaaggtgaaatgctacacttggcgccatgaaactattgtctgagcttgtttttcggaaaaatccatatctggatgatatgactgagtcatcagcagtgcctggctggctgtgttgtaataggtcagatgtaacttaagccccaaagttcttaggacagccataaattagtctgaaggtggctgagataaggcaagggtgcttgttgcctccagattagaatcaagggcaacaaaactgcctagaaattggaaacccaggagaagctttaggctagagacaggcagcaatactttgtgagaattttactaacagaaaaataaggaagatacagaatcatgtttatcaaacttgaggatttataagaaatacctgtatagcttctttattttagtttatttttattattatttatttatttttgagacaaggtcttgctctgttgcccaggctggagtgcagtggctcagtcacagctcactgcagccttggagtgggctcaagcgatcctcccatctcagcatcctaagtatctgggactataggtgtgcaccaccacacctggctaattttttttcccccgtagagatgggatttcactatttgcccaggctggtctggagttcctgggctcaagcaatcctcccaccttggtctcccagagtgctgggattcaggcatgagctaccatgcccagcgtgaataccttcttcaaaatgcaaaatcctgtacctcacctcccagggagtcttattaagtagctttggactggggctcaggaatctgtgtttttagcaagtgattctgatacaggtgatccataggtcatacactgagaaacattgagtctggaaagacttctgagatcatctagtcagccctgtcttacaaatggggaaattaaggtctgaggaggagaacgggcttgcccaaagttgcagaataagttgcaaagtcagtgcagctccactaacttatatgtcttcattttgcaatttattcttcatcctagtggctagatgaaaagcaagtctaccctcctaattcccagctccccttctttcacactattttttattttcttttttccagagcaccttctaatataaaaataatttactaatttactgtgtttattgctattttccttgcttcattaaaatgtaagcttcacaagggcactgctttttgtttgtttgtttgttttcattaaagtagcctatgtgcctcgaatagcacctgacccatagtaggtgttcaatgagtatttataaatggatgggtgaaaaatattttgttaaactgtacataagttaacaggtattatgtaccagcccttaggcattagcatgaaatagagtagaatattttctttttcacatgtttgattctagcttgaattagaggttacagaaacagcttatttatggaagattaattagagacttaccaatcatatgtacaataataataagaataacaatagcaacaataacaacagtgataacatccatttgtggaatatttactatctgcccaacacatactatatgaagttctgagctaagaccatcagaccattatctcatgtaagtcttagtaccgccccagggtggaggaacaaaatagtattgtctgttttccaaaggaggaaaccgaggctcaagaggtgaaattactgtttaaggttacatagccagtacagatttaggacctgtgatcccaaagattacattcttaactaccagttacattcagtagtaggcttggggaattctctctttgcagaaggaattgaaaatgccaaagactaggcaagcattgctattaggggtgtccttgggccaagaacaccaacctctaaggtagtataaaaccacaggctggaaagatgcattttttttttcagcccgactttccagcatttacccacactctcaagtcttccattctcacattacaaagaacctttcgtcttgaactattagggttttctcacttctcagacaccctccctgaagcaggccaaggaaaattcctgtggtgacaggccatttctagggaggccactgtagcacttcacacttgctctcaccccacccactcaaggaagggtagacagacagagggccctttacccagctcctatactactttcctgtggagacctcaggaaagggccgaggatcatgattttctaaatgtgggcacaacagacctcttgtaagactttgagttcttgaaacactgtacctattaaactggttgtgagcacacagaataaagtatcaccacccactgtggataatgtcagcattcattcccacccctgacagccaatattggccaggcttggaatcactgaacacacatggcagcagagtcccttgccccatagctgcagacacaggttgaacactggtgtatccctgggcttttatgaagagagaggcttataacacccattgccatctttacacacacagtgcagcaggtactgtgctgagaactttacagccgtgatcttatttaattcttacaatacatgtgatgagacactgctgtctgacttctgtagatggggaaggcctggagagattggtaacttgacagagtctcatggcatctgcaacaggcagaaccacattttaaacaaaggttgagttacttctaaaacctgtgctttgctagtcttctgttctgcaacactggttaagagcatagactctagagccatgctgcctgggtttgagtcttgattctgccacttactagttgggagacattgggcaggttacttagctaccctcctccttgggctgttcatctgtaacatagggataataatgtccttgtagcatgggttgctctgaggattaaaggaatccatatatgtaaagcactcagtgtctggtgcatagaaaacactaaatgccagccattattattaatttatatatcaactcattgtttttctttggatgatagaaacttaatctcagaagtttgaggtttttctaactacccacccttaccccaacccctgccaagggttgcgtctgtattcccaaggggcttagactgttacctggtatatagtagcctcaagtaaatgctggtgatgataatagggcagtgccaagacattgggggtgtgggaaggcagggttaggggatggcatctgcgcctcatcagcatcgatcctccatggtgtcgtatcctgaaagtgggaaaggcgctgtccagatagacgcttatctcgtagacagaacaagaacggggaggcaaccattatttcacatacagcaagttactgttattttaatgccctaacaatgaatctatatttaattaacttaaaagataggggaggtgagagtattattcactaagttcttggtcaaggcacattaaatcaaagcggttagcacttagatctcttccagggataaattatctcagacaagcttcaaggtatgccatgctttggaatgaattgtcactttccaaccaccaccactcaacctgtgatctgaccacagtgtcttcctcctgtctcccttccctctgggtgcctgggaaggctgggcttctgcactgttctgccactgacttaagctttgtcgtgactataccttccacttctcttctagcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaa

SEQ ID NO: 227 - DNA, 1148420 bp, Homo sapiens
tcagggagagattctgtattgttttgttttgttctgttttgttaaaaaccatgtattgaatttaaattttagtaaagcaagcattacataatgctttaaaattttaaaagtcggggataaaagtttacatccaaaaagatgaatggaaaattgtgctttcagaatgtagaataagttttcttacagggttaaccatttcatcttgccattggatactgggaatttcatttatgtaatgtatatatgtgcagttcatatccaggtcctgcaaaaatctaaaactgtgtgcttcacttcgcgtagcaaaggcacctatgttattctccctttcgagcaaaagtcatgatccagttttcctgctgacgacgctttttccactgctgtgtcaatcacaccctctgtgttgagcagtacagtaaatcacaagagaaggtggtggcgaatccctgctcacactggaagttgctctgtggaccattcgaagaagctctggactgatcacaagggaaaccgagcagaactgtgaagcagacggacaggaacaaaaggctattctggtgtgaggagaaatcagtcacttcagctccacaggcagatgttgctactggactgacaagtggaacctactcctgctggagaaaggtaaagtttgccattggggcagacgcagagttcatacactgtctgtcgagaacttgaggagctgggtgaagaagatgagaaggagccagttggtagatttcccagcttgattgtctctgcatttaaaaatatctatgggaaaaaagaaattgcattttaattcattttagaaatgtagcatcgagtaatctacatccctcctcaacatggtctaataaggaagtcgacacaacaaacaattccatggtttagctgccatgctttgttgaacaaacaaattacattcctacagtagagtccaaaatatctgcagctatcttctcctttgggagatggtgcattctgacagaaagccctcaatctgaaaagcaacatcatacaatacgcttaaggggccaacccagttacttaaacaccacagaaaattaatgattttgacagtctctcaatttaatttcttaaaaaatcccatagatttccccgtcacatccccctgacaggcccggatgtgtgatgttccctgccctgtgtccatgtgttctcattgttcccctcccacttacaagtgagaacatgcagtgtttggttttcttttcttgttttagtttgctgagaatcatggtttccagcttcatccatgtccctgcaaaggacatgaactcatccttttttatggctgcatagtattccatggtgtatatgtgctacatttttttaatctagtgtgtcattgatggacatttgggttggtcccaaatccctgctattgtgaagagtgccgcaataaacttaagtgtgcatgtgtctttatagtagaatgatttataatcctttgggtatatacccacaaatgggattgctgggtcaaatggtatttctagttctagatccatgaggaatgtcttcactgtcttccacaatggtttaaccaatttacactcccaccaacagtgtatttctccacatcctccccagcatctgttgtttcctgacttttgaatgactgccattctaactggcctgagatggtatcccattgtggatttgatatgcatttctctaatgaccagtgatgatgagcattttttcatgtgtctgttggctgcataaatatcttcttttgagaaatgtctgttcatattcttcacccactttttgatggaattgtttgcttttttcctgtaaatttgtttgtttaagttctttgtaggttctggatattaaccgtttgtcagatggacagattgcaaaaattttctgccattctgtaggttgcctgttcactctgatgatagtttcttttgctgggcagaagcactttagtttaattagatcccatttgtcgtcactgcttttggtgtgttagtcatgaagtctttgcccatgcctatgtcctgaatggcattgcctaagtaagttttcttctagggtttttacagttttaggttttatgtttaagtctttaatccatcttgagttagtttttgtataaggtgtaaggaagggatccaggttcagctttctgcgtatggctagccagttttcccaacaccatttattaaatagggaatcctttccccattgcttgtttttgtcaagtttgtgaaagttcagatggttgtagatatctagtgttattgctgaggcctctgttctgttccattggtctatagatcagttttggtaccaggactatgctgttttggttactgtagccttgtattatagtttgaaatcaggtagcgtgatgcctccagctttgttctttttgcttaggattgtcttggttatgtgggctcttttttggttccatatgaaatttaaagtagttttttccagttgtgtgaagaatgtcaatagtagcttgatggagatatcattgaatctataaattactttgggcagtatggccattttcatattttttaatactcataaaagtgtgtggacttttaatccaaaggatatactaagtagctgatatggtttggctgtgtccccacccaaacctcatcttgaattgtaacccccataattcccatgtattgtgggagggacccagtgggagatagttaaatcatgggggcagtttcccccatgctgttctcagggtagtgaacaagtctgacaagatctgatggttttataagggggaaacccctttcacttggttctctccttctctcttgcctgccaccacataagatgcgccttttgccttctgccatgatggtgaggcctccccagcctcgtggaagtgtgaatacattaattgtctttttctttataaattacccagtctcgggtatgtctttgtcggcaatgtaaaaatgaaccaatacagtagctaatcagcacagtgaacaatatataattattgtctataattagatttgaagtctccatgaaacatattacctatgttcaatacctactttgctaaatcttctaacttggaaaatgctttattctaaatcatggactcaccactttgagagacagtgatcgtatggctctgacatgcatggagaaagtttcagaaaaagaaaaaaaacggatcttgaatttgagcaaagaaatagctctctccagctgtttcttgtttccactgatatatagcttatgattgtctgaagggtatccctaaattgacaggagtaggagagaatattctgctttctctctctttgccctccctcatctaaattccatttgttttgtactaggactcctgtgatagtcccctatctggcctcctggtggccgatttttgtcctcctgtcattgactttacatattcctagagtgaacttttaagaaacgcaaatcaaataatcttgctacactgctcaaaacactctgatgtcatcccccacacttcaattggatcctgatgtctttccatggcccaaaggccctacctacaagatctggcctatctctctaacatcatttcctgtaattcttcctcttgctccagttcttgcattttctcaaaaatagcaaaagcactatggcctcatagtatttttactatttcctcaaaccgaaatacttttctccagagatttaatgagtggggggagatattaactgggtggttgtgaaatatggatgggaggtagctttccacttttttgatgctttttaaatttctgaaccataagactactgcacactacaattaagccagaaaaagaattcatatatcataagtatatatattttaggtcaatttggatgcaaacaaatttgctccaattctccaaaggtcacctccttggaaataacttttctaaacactctattaaaataatgctaatctttcttctctcattaacagttatacttttctctatagtaaaaatccatttgtaatgttacatttgtattcattcattgtttgtttcttctacttacaataagatccatgaggatagggcctgtctttggttcatccatatagaatagggcatggaattgtgaagtgcatgaattacatgatgccttttcttcaccttgaacacatctctcccctctaagttacaaacccacctcccaacaaagcccagttcatctgttttctcttccatataccattccctgacgccccaagatagaaaaaccctttttttaaaaagatttttttaactatactttaatttctggggtatgtgtgcagaatatgcaggtttgttacataggtattcatgtgccatggtggtttgctgcaccaatcaacgcatcatctacttaggtatttgtcctaatgctatccctcccctagcccccccatgccagagaggacccagatgtgatattcccctccctgtgtccatgtattctcattgttcaactcccaattaggagtacatgtggtgtttggttttctgttcttgtgttagtttgctgagaatgatggtttccagcatcatccatgtccccgcaaaggacatgaactcatcctttttatgactgcacagtattccgtggtgtatatgtgccatattttgtttatcgagtcattcattgatgggcatttgggttggttccgagtccctgctattgtgaacagtgccacagtaaacatacgtgtgcatgtatctttatagtagaatgatttataatcttttgggtataatcacagtaacgggattgatgggtcaaatggtattcctggttctagatccttgaggaatctccgcactgtcttccacaatggttgaactaatttacactcccaccaacagtgtaaaagcattcctatttctccacatcctcaccagcatctgttgtttcctgactttttaatgatcaccattctaactggcgtgagatggtatctcattgtggttttgatttgcatttctctaatgaccaatgatgaagagctttttttcatgtgtttgttggctgcataaatatcttctttggacaagtgtctgttcatatcctttgcccactttttgatggtttttttttcttgtaactttaagttctttttagattctggatattagccctttgtcagatgggtacattgcagaaattttctctcattctgcaggttgcctattcactctgatgatagtttcttttgctctgaagaagctctttagtttaattagatcctatttgtcaatactggcttctgttgccattgcttttggtgttttaatcgtgaagtctttgcccgtgcctatgtcaagaatggcattgcctaagttttcttctagggttttacggtttaggtattatgtttaagtttttaatccatcttgagttagttttcatataaggtgtaaggaagggatccagtttcagctttctgcatatggctagccagttttcccaacaccatttattaaatagggaatccttttcccattgcttgtttttgtcaggtttgtcaaagttcagatggtcgtagatgtatggtgttatttctgaggccgctgttctgttttggtaccagtaccatgctgttttggttactgtagccttgtagtaaagtttgaagacatgtagcatgatgcctgcagctttgttctttttgcttaggattgtcttggctatgcaggctcttttttgcttccatatgaagtttaaagtagttttttccaattctgtgaagaatgtcaatggcagcttgatggggatagcattgaatctataaattactttgggtagtatggccattttcacgataatgtttcttcttatccatgagcatggaatgtttttccatttgtttgtgtcctctcttatttccctgagcagtggcttgtagttctccttgaagaggtgcttcacatcccttgtaagttttattcctacgtatttcattctctttgtagcacttgtgagtgggagttgactcatgatttgactccctgtttgtctgttattggtgtataattatgcttgtgatttttgcacattgattttgtaacctgagactttgctgaagttgcttatcagcttaaggagattttgggttgagatgatggggttttctaaatatacaatcatgtcatctgcaaacagagacaatttgccttcctgtattcttaattgaaaactctttatttctttctttttcctgactgccctagccagatcttccaatactatgttgaatggggtgggaagagagggcatccttgtcttgtgccagttttcaaagggaatgcttccagtttttgcccattccttatgacatttgctgtgggtttgccataaattgctcatattattttgagatacatcccatcaatatgtagtttattgagagtttttagcatgaaggggtgttgaattttgttgaaggcctttcctgcatctattgagataaacagaaccaatgacaaaaaccacggttatgtgattgattgattacatatattgatttggatatgttgaaccagccttgcatcccagggatgaagccaacttgatcgtggtggataagctttttgttgtgctgctggattcggtttgccagtattgtatgaggattttcgaatcgatgttcatcagggatgttggcctaaaattttctttttttgttgtgtctctgccaggttttggtatcaggatgatgctggactcataaagtgagttagggaggattccctctttttctattgattggaatagtttcaagagggatggtaccagctcttctttgtacctctggtagaattcagctttgtatctgtctggtccagaactttttttggttggtaggctattaattattgcctcaatttcagaacttgttattggttcatttaggtattcgacttcttcctggtttagtcttgggaaggtgtatgtgtccaggaatttatccatttcttctagattttctaatttatttgtttagaggtgtttatattattctctagtagtttgtattactgtgggatcggtggtgatatccccttcatcattttttattgcatctatttgattcttctctctttccttctttattagtctggctagcggtctattttgttgatcttttcaaaaaaccacctcctggattcattgattttttgaagagtttttttgtgtatctccttcagttctgctctgatcatagtcatttcttgtcttctgctagcttttgaatttgtttgttcttgcttctctggttcttttaattgtgatgttagggtgttgattttagatctttcctgctttctcttgtgggcatttagtgctataaatttccctctacacagtgctttatgtgtgtcccagagattctggtatgttgtgtctttgttctcattggtttcaaagaacatctttctttctgccttcacttcgtgatttacccagtagtcattcaggagcaggttgttcagtttccatatggttgtgtgattttgagtgagtttcttaatcctgagttctaatttgattgcactgtggtctgagagactgtgatggtttccatacttttgcatttgctgaggagtgttttacttccaattatgtggtcattgttagaataagtgaaatgtgctaagaagaatgtatagtctgttgatttggggtggagagttctgtagatgtttcttaggtctcctttgtccagagctgagttcatgtcctggatatccttgttaattttctgtcttgttgatctgactaatattgacagtggggtgttaaagtctctcactattactgtgtgggagtctaggtctctttgtaggtctctaaggacttgctttatgaatctgggtgctcctgttttgggtgcatatatatttaggatacttagatcttcttgtttcattaatctctttaccattatgtaatgcccttctttgtctcttttgatctctgttagtttaaagtctgttttatcagagactaggattgcaacccctgcttttttatttgactctcccattgcagttttttattttaaatatcttattctgctgatcacttaaagtggtattttatagccatcttcacaccttactttccctgctaaatacatcctcctcaaagatagaatcatattgaatttttagtaattcctaccatgtttaaccctgtagatacaccttctacataacacaaatagttattcagtaaatgaatacattataaaacaaatgaatggctgcatttatcaacagtattcaaagttaaaaagcatgattacagcttgtgtttattgatgtcagatgttgaaatatattaccccatagttacttctgtgttaagtgacaggaaagcaaagagaaagaaatgaatttgttctatttttttaagatttgtttttctgatgtgaaagcaagaagtgcacaaaactaagcaaacaacaacaaaaacccaaggcaatacattttgggggtatggatgttgggtctcatttcttcttgcttgtgatacacttgtggctctcttctccccagggaatgagagatgattccttttattggttgagtggaagaggaagtgggcttgtgtagttcagtcccttttccttacaccttttcaggagctagcatgtgtgcagaggaaaggcatcctcaagctctgaaaatgccaaaagtattctaggggcaaactctgagactgtggtgtttaagtctacaggctgggagttgagttcaccttgaagaaatattaaaagctggtgttttggataacaaaccttgagacataacacaattaaggagggggatatgaaaatctaatggagatgtggagaagagggctcatgtgggattgatcagatgactgtaagagtaagtaaggattgcaggtgacagccttagaatcaagcatgagctatggaggcctcatcaatggagtaaaccttgaagtactcaagccttatgatgagtggcttgcttcagcatagccataatggtgttctctggttctcccatccatttaggggctgctttagattgtattcggctatattacagtgcttaaaattccataagtttctgagatccaaaccatagctccacccatataaaaagtcattttttataatagataaattgattcatatggagtacttagagaaaatgatattggcttgagatagaggtataagtcataagattaaaggggctgctatatattgattctttccaacatagcattcctgcacctacctagatttgtgcagcatggatgaacttgagcatatctttttctgttctgccaaggcagtgacgctgttcactttccgacttctaaaattgatatggctcttcaatattgtcttataaaccatataatccactggttctgaaactcttccctgatctcaatcacatccctgagctcttaagtcacagtccagtgtctttcctctaccaagaattcacttatccttctgtcacctgttgaaatccggcccgggactcacaaaacaaaaaattgtttttggtcaggtgcggtggctcacgcctgtaatccttgcactttgggaggctgaggcgggaggatcacgaggtcaggagttccagacaagcctgaccaacatggcgacaccctgtctcttctaaaagtacaaatattagccaggaatggtggcaggtgcctgtaatcccacctactagggaggctgaggcaggacaatcgcttgaacccagggggtggaggttgcagtgacccaaggtcatgccaatgtactccatcctgggcgacaagagcgagactctgtctcaaaaaaaaatgctttattaattatttttctttgatcttgtggtatatatgctgttattgtattacatgtgccattataccacttacagtattctccatacaattacaattcatgttggtttccagactgagtctgaaatactttacaatactatgcctgaaatgactatgaattttcagcagtgcagaatttcacatacaatttcattcttctacatttcatccatcatttcatccatcattttagatacctcaataccatgactgatactaagtagtttaaaaactatctaaggataaggactttatatccctctatattgtttagtaaatgataaatctgtggtacagtcaatgtagcaaaatatatatatttatatgattttatatttcttcataggaaaaatacatgctgttttaagtgctgtgcctttctgtacttttattttgttactataaaaaaaaaccacagatgaaaacctgtggctatgatttatttacagcacaatactcatttgacaatgaagttataatatgtaattgaatcaaaggactctgctgataccatgaataaatgaataaaagaacatatgtaaatgattcttatatggggcaaaatagatattaataataatcaatatttattatgagcaatttgaatgaaagttaccattatcaaagcaactctttaaaaagaatgcaagatgtttaagaaagacttccgtcctactgtgttagacaaagtattgtagtctacaactgtagtggaaagaaatcctgatattaatatattatattaatatattttcaaaatattatacattagattaatatattatatattaatatattttcaaataatatattatattttattaatttatattaatatattaatatattttcaaaatattatacattagattgctagatcacttatggtataatatctgctaacactctaatatggtcctaccagtaaatctgtttttaaaaaggaagtaaatgtataattacaattcatcttgaattaataactgagataaaaaaggaatattccccttttgcctgtattaaattatgacctcatcattatatctgaagaggactgaaatactccagaacatgcctctcaacttatcctttcattctttttcttctcaatttgacctttgtgggctcataatttaaaaacgataaataacacaagaagaaaataaaacacctagggaatgtattggtaggaaaagcaatacaacagatttacactgtcaagaactttcaaaattgtagtaaaaatatatagactagcatataaatcatgtatgagcatttaaaataactaaggtagaattaaaaatgaactggcatgaaagcatctgccaagatgtccaggtttgaaaaaaaaagatgagactgctagacattaaaaacataatcactaaaattaaaagctcaatgtatggataaaatatgagattagatagtggggagaaccctgaaaatatagacctgaataagtcagtggcatgaggcacagtaagagaaagaaactgggaaggagagggtaagagatgtggaaggtgtgaaaatgcaaagttatgtcttcagagtttcagaaaaagaccatagaaaattgggaaaagaccatggaaaattggggagaggttatctgaggttatctgaagaaataatgggaatttccagaattggtaaaaatgtgattctgcagataacaataatcatgtatacttatcactttatagtggaaaaatagaacatcaatgacaaagtattatttaaagcagacagcaggagaaaaaataaatgatgtctgcaggagtagcaacaagatttaaaggaaattcttggggaataaaggtaatatagaagaaaaatactaatgtatacatcctattccaggaaatatcattcctaaacagtaaaacttttgttttccttttagataaataaaggcactctttctatggaaacaaacaaccaaagtgctttctggaagaactttctgaatatcaagatataacaagaattaaaaaaaaaaaaaggactgtcgttattcttctcaaattatatgcatatggttccaggggaagcataaagaagtgctttgtggaaaagtttaaattacacaaatatgtacttttgtttgtttgtttgtttgttttgagacggagtctcgctctgtcgccccaggctggagtgcagtggtatgaagcaagctccgcctcccatgggttcgtgaatgggagtgaatgggttgacgacattctcctgcctcagcctcccaagtagctgggactacaggtgcctgccactatgcttggctaactttatatatatatatatatatatatatataattttttttttttttagtagagatggggtttcaccgtgttagccaggatgttcttgatctcctgacctcgtgatctgcctgccttggcctcccaaatatatacttcttgaatatgagatatggtaacctaatattactttcctaagttacaactccatttattttctactgaaagatattccttcacaagtcaattataaataggacatctaaatacttgtgttttcaaagtgggcagtatagggcgagggtccaactttctgggactcacctccccttctgtagattgcagatggagctccttcctgcaggtggccttgaagtctcctgcagcagcactcacctggaccccacggggagcttccatgatcaaggatctggtgggtgattcaagcctaagggaaaaacaaaaaatcattaataggaaaaaaaaacacaaaaaaatcattaatagaaaaaagaaaatttttgataaactagaagacaacattggtcaaaacaacaaccagacagacaggcataaaggaaaagtcctaccattttaggcaaagccagaatgagtttcagaacaatttttgattgacgtatctatttttggctctttataaaaatctacatttattcacatcgagtatttactctcactttcatgacaatttgcttatggtttcttttgttgtttcccctcagaatgctcatgaaaagtagggtgtgataagtatacttgctaaaatttttaataacttaccagtatataacttactagtattaatgatggaggtttaataaaaaatttacagtttaggatgtagatatatgtattcctcaataaagagtccctgtcttgtaaacatgaatgctttaatgaaaattgttaatattgcacactttcaggcatgtgcaaaatattatgaacttgacacctctagaaactgattaaaataatgaaataagacattttctacatcaactaattctgttggccccgtgaaatgtccacagaatgagtgacatcagtctgtgaaagaaaaatcaataggagggtaatatacaagtacaaatgcgattgaaggttggctacataaattaggagggcaagaaacaagtgttttagacagtcagagttgggaggcagttttcaaactatcttcaaatataacactagagaaaaagcaaaaatgacacacaacacaggaactagaatacagtggtaaaaagtgctaggatgagaagaggtaggatccatgcactggtctttttagatcagctttctgccttggggatgcacctgcctgtgatcgccctaccacaggactttaagaggagggtcccctcgggctcacattcactgttatccagcacaactggttttgtttttgttttctgaggcaatgaattcagagttgttttgcagaaagaaccacctcaaatggttaggtctctggagttcagctccctctcagcaagaaagtgaaacctaaaagcttaaaagtgatatggaaggagtagagccagcattgagaagtggtttcaacacttccattttctttttttttcactcaccaaagcaacttaaaaattttaatccctatgggccatttggagatctagcttcatataatccctggaggggtgaggttttgaatgtgtctatttttaagaaacgtctgtattttttttattaaaactccccatattttccatagaatatttgaaaacttgaagacaatcactcacaatcctactgcttaataaaatttactattagcattttacgcacagtatctaaatgtcaaaatttgaatgttaaaatgtattttttatcactgattttccctgatacacaacccttctagaactacgcagactcttagcaacacagtatcaacaattaaatgttgtcccacttctctcttgtatggaaagtctcctgtccactgaggagggtttcacagacttacttacattatagtagaggttttcaattaaactattcatgttattataaaatatcgtctaaaaagcctgttgaaaaaggaaacccaagtttattggtactacttgtggatttctatgtaattagtcagtgaaattagtgaattataattgtattcatttttataattgtattcatttggaaagcactacagcaaatatagcagtaagtttcagactggctttcacagtgggtacctgggattatggcagagagaaggatagtccctctaccacctggtttttcaaagcattctgtttttttatggtgtttatgtatcaaagttgcaacaagatacagtttttaaggtgttatgcaactatcaaattaaaaaaaaaatctgtggcctaaatctctagaattctcaacattcagaaaaaagaagaattcagactttaaaacaacctaagttgcaagaggcaattattaaatattaagcagaacttaagcatcaggagaaacagaaagaaagagagggaaaaggaaaggaaagaaagcaaataccctactttatcattatgttcttctcataggtagaagaacaccagccaagcaatttacccctttattgaggaaatgtctcagacaaaatcctgactgcttaatagagtttttttccttgaatatattaatgatgtgtatttattaatgatgtgtattagagctatgtgtttctagagattaacttggagcctgcaaaccttaatatttctgtgttaagctgtatttttgcaacaatgagaattatgaaaagatgccaattatatgattaatctgcacttggattctgtaaaatgaattaacatttattttcttattcagtagttaatggatctcagatccaaaaaaaatctttaggaaatgagcactgtataattagtttcatcactttttaccataggtacagaaactcttcaaactgtagtaacttaactatatattaatgtaagaaataaaaacaaacattaggctgttctgggcaaatttactgttatgtctttgttaactatttaacatgttttttttagccttttaaaatatagactcctagtacaaaacagtatcatcttatctaagaaaaattcaaagaaaatccacagttttaaaatgcacatggaaactagcacagaacttgagaaatactagacactcactcatcaaacagctgctgaataaataagttatagaaatccactacatttcttcaccaaaatattaatactctattaataaacttttgaaatgtatttcttttctaaagtctttttgttcttcacaataacaaaaccaaagaaaatgtggctacttactccctaaattaacattttattgacttggccaaccaatgaaaccgtgttgattagaagtaggcatcaaccaacaaacagtacttacctctctgaaaggaaaattgtcagcaaggcttgtaaagtttttctcagacaccctgcttttaattttcattatacaaataaataattgaatacctacataattactctacttttcttctgtttcagtttggaaatttagtaacacttatcttgggggttgccagtctgcttttagaaccagctgataaatccagcttagtgcaatgtttacataatgatgaataattagaaaatgaaaaccagaaacaccatacactagatgtaatatcattcgcattttcacttatgaattgtgaaatatgtcagcaagataattaaaataccagttggttcttattcctcttttaacaagactttccacagtaaaaattataaaatgagcatatagttaccaaaacgttagaaataaaaaaaagttctttaagtataaatttaagtaaatttaaaaatacttctataaatgtattttaagtttattgaataaattggtaaacagctgtgtctatattaaaacacagatgaaaaaaattggaatcaatgctcttcacatgttcctttgtaataactgcagccactttccttatatcccattcatttagttaatgtcctcatttttcagctttgctaagtttcagtaattcacattaacaaatacttattgcaactaggatgtggtaagataacagtgctggctgctacagcattaaggataaacaaggcagatgtgtatcctgttctaatggaatttacagtttgttaggagaagaaagatacaataaatattttcacaaaagttgttgaattcctgcctgaaaaaagagccataaatgaagaccgtagcatcctatgagatgctgtttacacacactcctcagcactgctgaatccctagggtttctatatagagtaggtaattatcatgttgctcttctaaaataagtcttagtccttgaagaaggccactttttttcctaataaatattgttccctagcttgtttgaatctgtgttactcaagtagtgagaaactgagttgtttaggaaattttatcataggactctgactaaaaaatttactgttgtaaagtatggtttcgttgccttaaagattttcaactttatttattttttgtttccatctgagtacatatacactcatccaatgtgaagggctaaacagcaatccttatgaaataaaaaggttttgtaacttaatgtttttattttgcttcccaagacaccaactgtgtctctcaggttgatactatgatccaactttaaaagtgacttttagtatgtgactagtttttatcagcactatgtgcatctttccttttcctatacaatagtaagtgcatttcagaatgtaatttagctatcataaattaattattattaaaccataagtaatcaccaaatcttacgtattgaattaagaacaggctaggcgcggtggctcacgcctgtaatcccagcactttgggaggccgaggagggcggatcagaaggtcaggagatagagactatccggagcaacatggtgaaaccccgtctctactaaaaatacaaaaaattaaccgggcacaatggcgggcgcctgtagtcctagctactcgagaggctgaggcaggagaatggcgtgaacctgcgaggcggagcttgaggtgagtcgagatagcaccgctgcactccagcctgggtgacagaacgagactccatctcaaaaataaaaataaaaaaataaataaaaaaaaaaaacatccactgagcagttttgtattagggatctagattttattattttgaatgtaatcaacagtggtaataattatcctgggaagaattccctataatgttggaattttcctgggtagtgagagcttttacatataaatgcctcctagaaccatcacactgtcaggacatagcttattccattggaaatattagactgaggaaccccatcatagtccagttaagttctgcctttgtctgatttgcttccatattaccctctatataatactccgtggtcatttatagctttctcagcgccctatttgccctgtctttattcctatatacaccacacatttcattatatatgtcggattttccagcattcctttttttgtttttgtattgtgttttgttttgtttttacagatggggtcttgctgtgttgcccaggctggagcacagcggcatgatcatatctcactgcagccacgacctcctgggctcaagcaatcctctggtctcagcctcctgactaacttggactacacatgtgcaccaccatgctcggctaatttgtttttattttctatttttcgtagagacagggtctcactatgttgccaggtcttgaacttctgatctcaagtgatcctcctaccttggcctcccaaagtgctggggttacaggtgtgagccaccgtgcccggcctcaggatccctgtttttattagttcttctcacttactgtataactgcctttgccttttctttttttttccacattcttcctatctaatatattcatttttgtatttattttaagtatattgggagaaacatttgtctagttgtctattttagttcttcatatattaaggattatcaacaatgatggattttatgccacaggtataagaggaagcccttacctgagatcttgggatggctctgctctgatgtgcggcgtctccacagagtgcccaaatacggctccttcagtgcctgggggtagcatgaatatagcagtcagtataagcaagtccacacagtggctttcatctctatgtttatgcatcaaatattcttccaaaacagagaaaacttaaaacaggtacatatgatgtattagtccgttttcacactgctgataaagacatatccgagactgagaagaaaaagaggtttaattgcacttacagttccacatggctggggagccctcagaatcatggcgggaggcaacaggcacttcatacatcgcggtggcaagagaaaaatgaggaagacgcaaaagcagaaacccctgataataccatcagatctcgtgagacttattcacgaccgtgagaacattatgggggaaaccacctccatggttcaaattatctcccaccaggtccctcccacaacacgtgggcattataggagtacaattctagatgagatttgagagaggacacagagccaaaccgtatcacaggatatgaatgagaagaattggaagaatatcaccaggcagggaagagtcaatcaaggtaaatctaaatgtcattatattaaccaattttaaaattaaattatttataaaagtcaaaagtcagtgagtattcccactctctctttaaagaacaaaagctcatctctgtcccctgccttattttccagttaagtgaaattgagggagggctaagtcacaatactcaattctgtgtttctataaataatagcaggtcatgaatgaaaatgtggaggtgagttccagtgtagcctattattggttttttaaagacaaaccctcatagatgtttagcagttctcacacatagagctcccacctttgattacagtaaccacgaaaagctagagaacatgtcatgttactttgacctctctggagttagggcttaatctaaaatcatgaactgctttaaattctggtgttatagttggtttcatatggaattgtagctttccgaagaggtcatatactctaacacttttctcaggaggttgaaggatactctatctcaactttcatttactgaatccatttttttccagattctcatagctttttcataatttaactgagcaaaatggaaggatacttcaattaccaaaatcaagtgggaaaaaaatgttccaaataagatgacattgagaaaatcttttctgtaattttgcataaatgtctttatcaccctcaaaataaacttgatgattttgttttctggtctaatcttcttcaaagttcttgctttaagaacctcatacctgttccatcagtggcttcaacactagataaactatacaatgtaatttaaaaatatgtatttgaagcatacaaaacaaatctgtttttgtctaatgagaaaaatcatgtaaaatatattaattcaagaggcaatgatgaaattgccactaggaaattaaagctaaaattccaattccttaaaactaaattgctatatatggaaatgtattagaagcatcagatgactcctttgcataatatagcaatacagaccttgatcatgaatagaacaggaagagatttttttttcaaagactatatgatttcatctatattatgctgctgagggcaaacttacttaccaggttctgctgcagtaaatccctaagattacagatttctgtttataagctaaaagctattggcatttgttgaactcttaatgggcttaatagtgttctctcttctctctctctctgtcgctcctgagactctgtaggacatatggtccttgtttttaaaactttttttcatgaattttgagaaattatttaagcggtttattcttttgatattttggaagatatttattttatttctactagtggaacattcctcaaggtgggtctttaaaagtaaaacagtagtttgaggtaacactaattttgtgattatagtggggatagcatttgaaagaatattacaagatatacatttgtatatctcaaagagagactctggcattttgtaataagatatgcatcccagaaaagatagtgaaaattaatttttaaactttgcacatggataactatttcatgattatgaaaatttcccagataaggtgacagaaatataattaaacatcggtaatatttactttcaaatacataatggcatacttactaagcacaaactctatcagtgaaaataaaaataacagaatgtcatcaaagtttaaattttcagtgagaattaaaaactgatagaggtctcaattctgagtgccaatataaaaataatcatttttaaaggattcttgaagaaataaatatgtaatcataccacgtaaagggcgaaattttaaactaaataatacgagtgattaacaaaatgcaggcctctagaaaatgagaaattcactctccctgtttttgtcctgaatgagccaaaggtacaaaattaataagcaacacagataatcttaaaggaaatcagtaagggatgataaaagccacctgaaccaggtatgaagtctaacagcataaaaaaattaaaaatcagaaaatgcacagtggctcgtgcctggaatcccagcactttaggaggacgaagcaggcagatcacttgagggcaggagttccagatcagcctgtccaacagggcaaaaatcctctcctctctactaaaaatacaaaaattagctgggcatggtggtgcacagtagtcccagctgcttgggaggctgaggcaggagaatagtttgaacctgggaggcaaaggttgcagtgagctgagattgcaccactgcattctagcctgggcaacaaacggagactatattaaaaataataacaacaacaacaacaacaaactttaaaaaaaaactgtctctctcaagaattgaaaatttttaccatgtagattactagtagggttgtgagatttagcaattaataatatatgacactgagctcatttgaatttcagataaacatcaaatcattttttagtataagtataggatatttacaggggatatacttatactgaaagcatatcttgagtaatcaagtaaattcaaaattagtaagacatcatatacttgatctggaaaccctaacaatttgtcaacatttgtttggtacataaggacagatctgacttacttatgctcacttagagaaaagacagactgtcatgaattctcatatcacaggctctagaaaccatagaaacaaaaaagaaggatagacataaaaaggacaaaaggaacacaacagagacacatattaatatgtatatgtaaacttattgaataaatgtttgtttttcattgctattttaaggggctgttcaaaagggtacaatgttcaacactgcttgattataaaatcctacaaaggatgtttcagataatttaaactcactacaatgttacaagacatagggaaaacctatactgttggctactgcaattgtcagaataaaactaagaaaattcagggtccaaaagtagtagaaaccattcatatgataatttctggcttctgcaggaaagaataaggatggcatattctgctttgccggaaaggagaaaaggcagatatggattatggtcctactttgtatttaaagaccgtttaagacataagctaggatactaccctttacaaatgcctaacataaaatgccacacgctcaaaaacaaattattaaaattaaatgtaagcacctcttctgatgtggctatctatattctaaatgctatctatactataaatgttatatcctacgctactcattattcaccgattgacatccatgtattttttacagaagtcactggtcccagaagaagaggtagcacaagaaaaggaaacccaagaagcaccagagagaaagcaaacaaccaagaaaggcaagaacacctcacattgagaaaaagaaagtcaggcaggaaattatatttttaagttatttgacctgatatgtgccaaatgagaacttttgctggcctttatttttccaataaaatcaactatgatcatgaattttttgagtttttttttttgtggggggggggtgcaaagaagggaatggattttatgtagatatcaacatgatgtgaaagagcaactacaagaggaatccagagtccatggggcaaaggttaacaggacataaacagctagcctcccagccctatggcacttgacaggtatcttagcttttcaggtccagggatatttttctagatctcaaggaacagaagattcctatttatttatgatcttcaaatttgaatctgtgttagtaaatatattcaaactttttggaagtcttcctaccttactttctttttctttatttgcttctgtttcccccaaatctaaattggtactaaaatctagattaagctgggaatagacttgtcttattcccaggtttacttataatttgtttttaaatcttggccaagtatttaaagccctttggtttttatttgtaaaattaaaaaccagatcatgaataacatgatctctaaggtacttgcaatttctaacagaattatacgattattttttcaaacacgtcaaaacttgtatactaataactcttctcattcctccttaaatactagtggaaatgagtttgcaactccagatcaacagaaaataaattattttggggaaaggatggagtaacaatactggaaaaaaatattaattggcatttattgtattccattaaaaaggattgctttgaatactgaaaaatttattacctctcgaaagaagaaatgtcaacctatttcaacatatactacatctcctatttgtgttattttaataatctaagtggtgtttttgcctccacttaccaccacaaaatacaacctatacattgctggagtgattttatcaaaaccattgatatctcacctgtgcaaaaagctataattattttcctggacactgcttttgcccagcattcaatactcctgtaatctgagcccatttgtgtgttcaaacatcttttcttccacttacgtataaaatatctttactaattttcccacctcttaaggcatatgcagatttcttcattctctgaacatatttagggtttactgcctgtagtacttgtctttaaactaccatatctattcttacattttatatttttaattataacagttgcttacgtttcaggccaaaaaaattgaagatacattccttatatgccattgtattcttgcgcaccacatgatggatgggaggtaattaataaatattgataaggatccagatttccagccttttttgagttttctccttttgttttttaattctagtttgattaatggtaaaaccatattccacacaaccaggtgaacccgggaagtatactgagatgtcctttcttgttcaacatccttattagcgtacttgtttccacagcttcaatatcacatacattttctgctcatgattcctccatactggtgccaaatgatgttctaaaacacaaaattgactttgtaactctcacttaaaatattttaagaacccagtgtctgtagaagtcaagcccagatttcttaggatttactgcttagcagttgtgtggattttacatttcagtgacaagacaactcatgagaaccccttcttgttctcagcatatgcaacctctttctcctcatttgatggtaatctcttctcatttttcaagatctgaatctaaattatagtatctgtgaaacattttcttggttcttgccgcttgcttctccttctgcccagttgccgcaggtccttgtaaaaattactggtatatatttctaacattgcattgcaatttgctttaagctcttatccagtaacttacgactttcttgaagtcaaagcctgtctcgataacagttgtatacttagtactgatcatggattctgctacatagttaaggatcagtaaattaaagaacatgaataaaataattaacaaaagcatgcataaaatgctttctattttataattgataggtaaaacatgctaagtttctgtttcctagtgtatctccttgtttaacactttaacacaaatcaacatcctgcgatgattatctgaatgtattgaaactgttattatgagcatagccaaagtgatttttttctagtgaaacagggaaataacattattaattgtcttgggaggaaagcaaaaaagaacaccatattgttcatttaggactgaaaaataagctgccaggatttctaaaaagaaattgtttcaaaatctgtttggacttttcatttggcatttttttcatcatttaaaaaaatatttgaaagcctttactcttggatgccaaataatatcctctcatccacttaaacagtgtcagaagacaaaaagagataaggaaaaagactgctggtgatcaaaaggaaaatgcattaaaataaagctattttcttcaaaattaagtacatttcagaaataagttgtttgttactaatgaaattagactaaaatatatcagcactggaaacgatccagacttccatatggctctcattttgtaaccttcaagaagttatgttttactagcagttgtttctctgagttttaggaggaaaagctcttcatttattatttctattccttttagtcaacaataagagtaatacttgaaatttaaaatcacatgtaaagaaaacagaattaaaaagaaaataaattatttccaaattgaatgaatatgtggtttgatggaaacgacatttttaaaaattgtacataaataatccattttctaattcctacctccaaaaaaaatgaaaaaattacagtggacgagcagagctttcttcgttactcttacatccaataactcttgagatatatattctcaggaaatagttaattccaaagtatgtgattactgaggttgttgttttgccctttacttaaataaaaccagtaagcaaatgagaagtaacatacacacctgaggcttctagagaatcctgagtgagaaagcataatcaagaatgcccctttagcaaacataatctctatgggtatgcactttttaaaaggcagcaatatttgattcaatttacagcttcattataaacattataattttaacgagttgaaatgcaaaaatatgcattaacctatttgatagcacatgagctacccatactgtcatttattacatttttaaaaattttattaatgattaatgatgaaactgagaagattaagattcctaggtaaattatctttttaccacctttacataaagtctagataagctttcaacgtacttaatccagcagtatattttgtcttaagatttggacattttacctaaaatacagatatgatagctgatactagtcttggctctttgaactcacacttattcttatgaacgtaaatcttttttaatttttttttgtataaccctttccttgataacctctatcattaatccagtgaaattcaagctttgtggaaattcatttatttagaaatctcccatcagttacaccataaactgaggtttctttggggggtgggggtggaaattagtaaattccttaatcctatcttttttccttattttattcttcaagctcttcaccactatttagattactttctgaagagaaacaaaatgacttcctactgctagtactcataaagggagaaactgtgttttccactggcaggtcataccgaccattaccaaatggaatgcacagcgctagagattcatctcagcagcactttcattgcttaattctttattccttaggacttctggtacattgatatcaaagtgctttctatggaaaataaaaatcagtaaagaaattgtctaaaacagatggtacataattgtctttgggggcttcaaatattgcattggtttatagatttatctgaaacttctacaaatattttttactctgaaaaacaaaatattgtatgttcaaaagatgctaattgtatcaatagctttatgagcctgagctgcatagttaatctacataaactgacatatgaaattattttttaacatagtgtctcatgaaccacaatttatttagaatttccttcttacctcaagatatctaagagactttaaaacatcaaagttttacctacaatttttttgggtctctctgccgatgagaaaagattcagaatcttcgtacacacagcttgccttaatatgtaattgtcattcatttactaataaccaggttttacaaaaattcacgtaaaaactgaaagcctcataagcctatcatccaataacaagatagtacgacatgcatagagtccaaatgagaatcagaacatgtgtgttaatgcccagataaattctcttcatcttttttgtttctgtgagattatttaccttttgttgctcaaggttgctcctttgatttttattttatcacttgccatgtaattcatgtataccgataggtaaattttagaaagctccatttactttcatttgttttttaaccataagaggactggtagcattctttttacttttaactaaagaaatggcacgtttctccagaaccaatgtctggtttccttaataatgaagtttctacagcaagaacactcatcacatgctcagcgttgattactgtgaacactgtatatttttcttagaggaatttcaagcagagtaagccattactgctttttgcaatttataacgattaaaattatccatagtttacagggaagtccaagcatcttcaaaattattgggctattatggtaacctgtgttttaaaggttgccataatatctttaaagatggcatgtatctttaaagatggtcgtcctatgacctacaaaatgtatctttaaagatgtatctttaaaggtgtttgtcctctgacctacaaaaataatgcattagagatgagcattagacctgctgatataaatgggcctcttctgataagtcagaggtaaaatacacaacttttataatccagatatgtgcttttacattttgggaatcccttgatccacttagcaaatatctcaccatgaacagggtaaacagatattcaatattttcaataggtagtgtttttttttttttttgagaaagcttaaattgtgacactgagatgcacacatctgtgtgtgtgtgtgtgtgtgtgtgtgtgtgtgtgaatgcagagtatagcatctcactggggagtacttgacccgtgtgtgtgtgtgtgtatgtgtactgacacatttacaaaataaaattccaatcttgtaaatacctttccagagaattgaaaaaaaagctgatgccctaatatatgaagtttttattatcatactttaagttctggagtacctgtgcagaatgtgcaggtttgttacataggtatacgtgtgccatagtggtttgctgcacccatcaacccatcatctacattaggtatttctcctaatgttatccctcccttagtcccacatcccctaataggccccagtgtgtgatgttcctctccctgtgtccatgtgttctcattgttcaattcccacttatgagtgagaacatgcagtttttgattttctcttcttgtgttcgtttgctgagaatgatgttatctagcttcatccatgtccctgcaaaggacatgaactcatcctttttatggttgcttagtattccatggtttatatgtgccacattttctttatgcagtctatcattgattgacatttgggttggttccaagtctttgctattgtgaacaatgctgcaataaacatagctgtgcatgtgtctttatagtagaatgatttataatcctctaggtatataaccagtaatgggatttctaggtcaaatggtatttctagttctagatccttgaggaatcgccacattgtcttccacaatggttgaactaatttgcactcctaccaacagtgtaaaagtgttcctatttctccacattctctccagcatctgttgtttcctgactttttaatgatcgccattctaactggattgaggtggttttgatttgcatttctctaatgaccagtgatggtgaggtgtttttcataattgttggccacataaatgtcttcttttgagaagtgtctgttcatatccttcacccactttttgatggggttgtttttttcttgtaaatttaagttctttgtagattctggatattagccctttgtcagataaagagattgcaaaaactttctcccattctgtaggttgcctgttcactctgatgatagtttcttttgctatgcagaagctctttagtttaattagatcccatttgtctattttggcttttgttgccattgcttttggtgttttagtcatgaggtctttgcccacacctatgtcctgagtggtattgcctaggttttcttccagggtttttatggttttaggtgttacatttaggtctgtaatccatcttgagttaatttttgtataaggtgctaggaaagggtccagtgtcagttttctgcatatggctagccagttttcccaacagcatttattaaatagggaatccttttccaattgcttgtttttgtcagatttgtcaaagatcagatggttgtggatgtgtggtgttatttccgaagtttctgttccgttgcattggtctacatatctgttttggcaccagtaccatgctgttttgattactgtagccttgtattatagtttgaagtctggtagcatgatccctccagctttgttctttttacttaggattgtcttggctacgtgggctcttttttggttccatatgaaatttacagttgttttttctaattctgtgaagaaagtcattggtaccttgatggggatagcattgaatctataaattactttgggcactatggacatttttatgatactgattcttcttatccatgagcatggtatgtttttccatttgtttgtggcccctcttatttccttgagcagtggtgtgtaattctcctcgaagaagtccttcacatcccctgtaagttgtattcctaggtattttattatctttatagcaattgtgaatgggagttgactcatgatttggctctctgtttgtctattattggtgttaggaatgcttgtgatttttgcacatagattttgtatcctgagagtttcctgattttgcttatgagcttaaggagattttgggctcagacagtggggttttctaaatatacaatcatgacatctgcaaacagagacaatttcactttctttctatttaaatacacattctttctttcttgtgttctgattatccaggccagaacttccaatactatgttgaataggagtggtgagagaggttaactttgtcttatgccagtttttgaagggaatgctgctttcagcttttggccattcagtatgatattagctgtgggtttgtcataaatagctcttattattttgagatacattccatcaatatctagtttgttgagagtttttagcatgaagtggtgttgaattttatcaaaggccttttctgaatctatttagataatcgtgtggtttttgtgattggttctgtttatatgatggattacatttattgatttccgtatgttgaaccagccttgcatcccagggatgaagcccacttgattgtggtggataaactttttgatgtgctgctagattcagtttggtagtatttttttgaggatttttgcatcgatgctcatcagggatactggcctgaaattttctttttctgtgtgtgtctctgccaggtttggtatcagaattacacaagaaagaaaatttaaaggctcacatttattcctagggatagataccaaatttctaaaaaaggtattatcatatggaaaccagcaataaagaattatcaggaccattcctttaacatctatcactggaatataagtttggtttaatggcagacaattaataaaattcaccatagtaattgactgatggagaacaatatagaaagatattagaagatagagaaaattcattcaaaaagttcatcatgattaaccacaataattgtcactgtttaggaaatgagaacagaagtaaatttctccacctgaagttgtcaggtacaacataacctctatcaacatcaaacttattggtgacatgctgaaacatttcatttaggaacagggatatttcacttaagaacattacacaaaagtacaatgtggttttatatttggctagaatcaccactttaattcaactctatactatatatagttcttgtcttactaaggaaaaatatagatctataatatgtatattgttttgaggaaaaaataaaactaacatggttcacataaaatatggttttctatagaaaaaaaatccaaaagaatctacagaaaattaaatacaattagaaaacaaatttgacttgagaaaaatgtaatgcatgttctgtgagactgctactgctatggaatgaattattaaatttaatcaaaaggcattaaagagatgttaattataatgagaagtataacataaccatatgtaagattatcctatcctaaagttaataattttaccaaaaactttgaataaatttaatgcaatcttaatcagatcatcaatgatagtttcatggaactggacaagctgattctaaatctctatagaagaatatcaggaataataaggcaatctgaacctcctccacaaaaaatttaagtaggcagattttcctgtccagataacaagtattattataaaattctaattttactaagtcaatgtgactgtgaaatagagaaatagcctaacggctaagagagtccccagaaacagagcaatagatatccttctcacggaaactcaacttaatggcaaagtcaatgttgaatattgaacataaaatttagtattaacatatattcaacattcaattaaattacattaaatatattcaactatattatattcagtattgaatatataatattaaatattagaaaaatcaacatgtcacgctgtcatagctgagataaaatgttattcactactattctccactttaggctcatagcaaattgatgccgttataagggtgtttaaaaagtgactaattttgtgaaacttataaaaacaatatttgcactgaaatagaaaataatgctcttttttaaagtacccgtttaattaattgtttttaaaaaatatgtgatatcttaccacacttccatgcttctttcaaattatacagggtttttttggtattgccgttattattgttgttaaactgactaaaatcatacatgaaataatagaaatcaggcctaacatcagatagacttttccattcagttaagttattgtgtagcaaaatttattttgtcagttcactacacagtgtgacagtatatagtttctctaatagagtaacattaaagaggacatataatataaccaaaaatttgagttccagataagtttggtgtctcactagcaagatgacgttaaataactcatttaatttttttgaaatcttaattttctgttctgtaaaataaaaagcaatctgtctcttgtccaaaagactatgtaggttttttaaaaattttttattatgtcatatacatgtgcatacattgatacataaatagccctacaatgtatacctcacagttgcttagcattatgatgtctgaggtcagttagaagactttaaggaggccgggtgctgtagctcacgcctgtaatcccagcactttgggaggccgaggcgggcagatcccaaggtcaggagatcgagaccatcctgctaacatggtgaaacccggtctctactaaaaatacaaaaaaatagccgcgcatggcggcaggcgcctgtagtcccagctactcgggaggctgaggcaggagaatggcgtgaacccgggaggtggagcttgcagttagctgagattgcgccactgcactcggcagcctgggagacagagcaagactcagtctccaaaaacaaaacaaaacaaaagactttaaggagctatggtgattcagagataggaacattctcattcactgcccatgagagggcaaaataacaaaaacattctggggtcctttccctttgaacaaataattcaatttcaaggaatttatcccaaagagttctttatgtgcacagagatgtagctacaaggatgttaagaacagtccatgtaggttcattgtatttaatcaaaatgttcatcaatagggaattatctaataaactattgtgattcaacaaaatagaatacttttagccatttaaaactattagaacactagtgaattgagtaacctaaaaatgaatattaaatatccataagatatgcataaatgtctacatttttaaagagtcataacatcttcactggctaattccagttagcagccatattttcaagttgtggtcaactcatttcttctccccttgtttttaggaattcttctttctcccttatccccattagaaactcaaatatactgttcagtatgcagagaaatttgggaaacattatcacatcttaaaggtttctattttaagatattttctttaaaaagtgagccagctacctcaacaaaatgtttatcattctttttaaaaggtagcagtaactcaactgaatgtcatcttaaatagaagtatgttgtaatcccttttagagataaagtgaatctttttagtcaattttgactaaagataaatcagactgtcctgagaagtcatgatagttctgtcaccaagtgttgaaaagaagaacgaccaaattacaaagacgtaagagagaagattcaaacttttttggaagaatgcaataaaacttaacgtacattttaagcctgagattccaagatatttatttcatctgccaaacaataaaggggtgatgagtaaacagactgattctgaaagtttgttttgattcacttgtcttaaagaccgaaaataacaaagcaaacaatcagtaattgccaattaattattcatttggttttacagttgtaaacttaaaagaagccatgcaatgaaacataaattatttgccaattttgttgaaatgtgggaaatgaagtgatgttaaacaatttgtgggtaaatgggaaaatgatcctataaatgattactatacttaatatagagagatttgaaaatattatattgtgattaaatcattcttaaatatcatccatcctacttttcaaggcatgtcacatgagattaatagttcacatccagagccatgaccaagacctatatactccatcttctgaatgagttatttctctgtagcaatgcaaaaacagactaacatagtaggaaactattgcttctatcttctagcagttttcaatttaatagtaaaactatttttaaatgaaacagatcaattatcaatcaattagaatggtagacataatcgtgatctcccctgccctcaatggtctccatcctaatccctgaaacctgtgaatatgtcacagttaacaggcaaagggtaattcagatgacaaatgatactgattgctcattggattatcttaaaaacaggattatcctgcattatctaggaggagccaaaataatcaccaggactattaaaaatggaagagagaggcacaagaatagtctgagacagacagttggctaatgttgttaactttgaagatagaggaagggccaagagctagagtaatgatgagggtctttaggagctggaaaagcaaaggaaacagattgactcagaagggagctcagaccaggaatcaccttgatatcatcttagtgaaaacaggttcaaacttgtaacctctagaactggaaataataaatttgtgttttgtaagctgctaaatttttagtaattataacagcagcaccaagaaattaatacaaccatttaataattttaaaatgtaggcagtccattcgagcttgaaatattttttcctttgtccttcactccctctttctcctctctctctctccctttttacctttactgtgaaatgacagattgccttggttattatttacatgaacatggcaattttatccaacttatgtgaaacacacccacacaagaccccaaagatgaaattaggaataaaatttatttttatatactccagcaagttccttttgaagacaatggtcagcttgattaattaatatacagttgacttaaaactaaaatagtgcttctcaaattgcaatagacatttaaaattgcagatgaagattatattactgttttaccaaattgattataacatcaatcattcatcttaatctcttgctctgacattgttaggcatatcttaagtttccaatttacatagctacatcaagataaagagtttctccaggaggaattgtgatttagttaagaaagttacatatttaatattcaaatatgctcattcttattcacttctttttccagcacactaaataaatctgcttgaaataacctagctacaaaataaattggatcctaaaagcccatcttcttcttatagaaatttctattaagaacctaaaggtattatatatacattcatgtgatgacacaaataaagtagaaatgaagctgaccaaaagttccttaaactgataagcaacttcagcaatctcaggatacaaaatctatgtgcaaaaatcacaaaaattcctatacacgaacaaaagacaagcagagagctaaattatgaatgaactcccattcacaactgctacaaagagaataaaataccaaggaataccactaacaggggatgcgaaggacttcttcaaggagaactacaaaccactgataaatgaaatgagaggacacaaagaaatgggaaaacattccatcctcatgcatagtaagaatcactattgttggccaggcgtggtggctcacgcctgcaatcccagcactttgggaggccaaggtgggtggttcacaaggtcgaggtgggtggttcacaaggtcaggagatcaagaccatcctggctaacatggtgaaaccccgtctttactaaaaatacaaaaaaattagctgcgtatggtggcgggcgcctgtagtcccagctacttgggaggctgaggcaggagaatggcgtgaaccagggaggcagagctcgcagtgagccgagatcacgccactgcactccagcccaggtgacagagaaagattccgtctcaaaaaaaaaaaaaagaagaagaatcactattgtgaaaatggccacactgcccaaagtaatttacagatttaatgctatttccatcaaactacaatggacattcttcatagaattagaaaaaatactttaaaattcatatgcaaccagaaaagaacccttatagccaagacaatcctaagcaaaaaggacaaagctggaggcatcacactacctgattccaaactaccaggctacagtaaccaaaatcacatggtactggtaccataacagacatatagaccaatggaacacaatggagataccagaagtaagaccacacctctacatccatctgatctttgacaaacctgacaaaaacaagcaatgggaaaaggattccctattcaataaatggttggtgctgggaaaactggcgtgccatatgcagaaaactgaaaactggatttgttcgtcacacattacacaaaaattaactcaagatagattaaagacataaatgtaaaacccaaaaccataaaaaccctagaagaaaggctaggcaataacattcaggacataggcatgggcaaagattttatggtgacatagccaaaagcaattagaacaaaagctaaaattgacaaataggatctaattaaactaaagagcttctgcacagccaaaagaaaccatcatcagagtgaacaggcaacctacagaatgggagaaaatatttgcaatctacccatttgacaaatgtctaacatcccgaatttacaaggaacttaaacaaatttataagagaaaacaacaatcccatcaaaaaatgggcaaaggacatgaacagacacttctcaaaagaagacatttattcagccaacaaacatataacgaaaaaactcaacatcactgattagagaaatgcaaatcaaaaccacagtgagataccatattatgccagtcagaatggctattattaaaaagtaaaaacaaaacaaaacaaaacaagatgctagagcagctgtggagaaataggaatacttttccactgttgggaatgaaaattagtgtaacaattgtggcagacagtgtagcatttcctcaagaatctagaaacagaaataccatttgacccagcaatcccattactgggtatatatccaaaggaatacaaatccattctgttataaagatacacacacgtatgtttactgcaacactattgacagtagcaaagacatggaaccaacccaaatgcccatcagtcatcaactgggtaaagaaaatgtggtgcatatacaccacggaatactatgcagccataaaagggaatgagatcatgtcgtttgcagggacatggatgaagctgtaagccatcatcctcagcaaactaacacagaaaatcaaacaccacatgttctcatttatatatgggagctgaacaatgagaacacatggacacagggagggggacaacacacactggggccatctggggggtcagggggagggagagcatcaggacaaatacctaatgcatgtgtggcttaataccgaggtgacaagttgatagatgcagcaaaccaccatggcttacctatgtaaggtaaggtttacatggtttacctatgtaagaaacctgcacgttctgcacatgtatcctgggacttaaagtaagataaaattaaaataaataaataaataaatgaggctgaattattattgtcagtgagaaagcataggtctggttcccgttctgccactgatagctgtgtgtattttctataaatcatttaacctgagaccagaggttacagagtaacaataataatacacatcccctaaatactgaggagcaaatgaattactataaatgactgtgttttgtcagtggcaaagcatatgccaatatgttaccaatctcatcactttgattaattttaatattgtgatttatttattcatttttatttctatttatttatttttttgatactgagtctcactgtgtcacccaggctggaatgcagtggcacaatctcggctcactgcatcctccgcctcccgggttcatgccattagcctgcctcagcctcccgagtagctgggactacaggcacccactaccacaccaggctaattttttgtattttttagtagagacatggtttcaccgtgttagccaggatggacttgatctcctgatcttgtgctccacacgcctcagcctcccaaagtgctgggattacatgcatgagccaccgcgcctggcctgttttagaattttttaacttttattttataattggagatacatgtgaagggttattacataggtaaactcatgtcacaggggatttttgtacaaattctttcatcacccaggtattaagcccagtacccgataattatcttttctgctctgctccctcctcccaacctccccccgcatcaagtagaccaaagtgtctgttgtttccttctttgtatacataagttcttatcatttagctcccacttataagtgagaatatacggtatttggttttctgttcctgtgttagtttgctaaggataatagctatcattaaacagtcaaaaataacagattctggcgaggttgtggagaaaaaaatgcttatacactgctggtgggagtgtaaactatttcaaccattgtggaagacagtgcttcgattctaccaccattaaaaaatgggcaaatgacataaacaggcatttttcaaaggcagagacataaatggccaacaagccatttgaaaaccatttttcagcaaaccaacaaaccatgttgaaaaaatgctaaatgtcactgattatcagagaaatgcaaattaaaatcacaatgagatatcattttacaccgttcggaacagctactattaaaacttgaaaataacacattggtgaggatgcagataaaagggaacgcttatacactgttggtggaagtgtaaattactacaacctctatggaaaacagtatgcagatttctcaaagaactaaaaatagaattattcttcagtccagcaattccagtatttggtatctacctaagggaaagtaaatcattttatcaaaaatacttgtaactacatgtttactgcagcactattcacaatatcaaaatcatggaatcaacctaagtgtccatcagtgaatgtctgaatttaaaaatgtgataaaaatgtgatgtgtgtgtatatatacatatacacacacacacacacaccattgactactactactcagccataaaaaaagaataaaatcatgtattttgcagtaacatggatggaactgaaggtgatcatcataaatgtaatgattcagaaacaaagtcaaaaacgacatattctcacttctaagtgggagttaaataacagccatacagagtggaataattgacaatagagactccaaaagtggacggtggagaggaggatgagggatgaaatcctacctatttggtacagtgtacactttttaggttatatgagtacgctaaaagcccagacttcaccaatatgcaacacagtcatgtaaaaaaccttctcttgggtcgggcatggtggctcatgcctgtaatcccagccctttggaaggccgaggtgggtggatcacctgaggtcaggagttcaagaccaccctggccaacatggtgaaacccctctctactaaaaatacaaaaaaaagctgggtgtggtggcaggtgcctgtactcccagctactcaggaggcagagagaagagaattgcttgaacccaggaggcagaggttacaattagccaagatcgtgccattgcactccagcctgggtgacagagcgagactccgtctcaaaaaaaaaaaaaaaaaaaaaaaaaaaatctgctcttgtactcataaatttatagaaataaaaatttgaaaaataaggaagactgaaaaatccataaacatgtagaaattaaacaatagcctcttaaccaatgggtaatgaaagaaaccataacacatttaaaaagagacaaatgaaaacaaaaacacaacctacccaaaattttgcaacaaaggcagggctcagaaggaaatttaaaaagataagaacatccattataaaagaagaaagacttcaacaatctaactttataccttgaagaagagaagagaaaactaaacacaaatcagtgtttctatacgtcattaaaaaaaatcaaaaaagacattaagaaagtaattccattgacaataacatataaaataatataataatagttaggaataaatttgacaaaaaaggttaacagccaaaccactgaaaatgacaaaacattgcccagagaaatgaataaagacagaagtaactggaaacacataacatgtccataggtaagaagatttaatatggttaagctgtcagtgttatcgcaagtattcttcagattcaatgcaatccttatcaaaatcacaacagccattttgtgcagatatggaaaacgtgatcccaagttcatatgaaatgattatcagtcaaaataatcttgaaaaaggaaaacgaagtcaaataactcacagtttctgattataaaacttaacacaaaactacagcaatcaaatcagtgtggaactagtataaggacagacatgtaggccaatagaataaaattgaaattaaaaagaaactcacaaatatatggccaactgatttttaagagtgctaagtctattcatgtatataaacacacacacgcaatttaattacggtgcaaaataagaatcttggtagaagctaaacctctaaaatgaaaaaaaaaacaaatgattcaaaatgtcagaacttttctcttttatcactatataatcaaaatatattattgtcaaaaatatggagataagaaaaagaatcatagctgttaagaaaatatagataacagtccttccttccacgatgtgagcaagatagctgactaggggttcctgccatgtttattcccacacacaaaaaaatgaataaaacaacaaataaataagcagtttttgactagactgcctgaagaagaaggctaaagtacagcaagtgagtggaggtaacacaggggctaaaaagaaattatttaggcagatagtgagggtaagagagtccttggtgggatttccttttaataaaaagcagccactaaatcatttattttctaacgaaaaacagcttgaaaaatcaagctgcagacataggtatgcaagctggatgcttgcataggtaaatgccagcagctgtgccaatagaaaaagggaccgtacctggaaggcaggtatgttttttcatagaggctctagcttcccttttctttgttgccgtgtgtgcagtaagcaagcaagcaacatggtgccagccaggtagagaatccagttgcataaaaaatattagggtggagtagccaacttcttcaaatgctatgtaaatggcacagctagtccagccaatcctttgtgccctgtgtaaatcagataccacctcctcaaactcatctataaaaccagctgcacctaaccacgaatagggagatctgtttggaacgctgtccctctgcaggagggatctttgatcttttgcctatcaaacttctgctcttaaactcactccttgtgtgtccacatccttgatttccttggaatgaagcaacgaatctctagtattaacccagacaaaagatgccgcttcagaggtatcttgatggagtacagaaatccagggtggcaccttaaagggaggagcaaagaacgcagcctttgccacatcatttccctgtcaggatcagcttggaaccaaaagggacttcttgtagacaggtaagcagtaggcccccagaaatgcagtttgttattaccactgcaaacacctacagttcttggttgacaagttgttgttgtttttgttctccatagaacttttagcaatttctgtatgttattccaattgtattctggcctctatggttcctgatgacaaattattgatcttattgagaatcttttatctatgacaagttccttctctcttgctgctttatacattccctttttgtctttgtttttgccagcttgattaaaaagtgtcttgtctgactatctttcagtttatcctacatcatgtttgttaagcttcttggacaggcatatgcacgtgtttcatcaaatttgtaatgttttaggccattatttcttcaaataagccatgaaacagataacattttagtcagcaacagataacatatatgacagcgatcccttaatattgtatttttatagtacattttctatgtttacatacacaaatatttactactgtgtgcaactgcctacagtattcaatacagtgacatgctgtacagctttgtaacctaggagcagtaggttattttatatagtctaggtggatagtaggctgtcccatctagggctgtgtaaatacactctatgatgttcacataatgatgaaaacacttgagatgcatttctcaggatgcatgcctgttgataagtaatgcatgattgtattttgcccctttcttcttatttgacctccatgatacatatattggtccatgtgatggtgtcccagaggtcccttagcctgtcttcaactttccttattcctttttttcatttctgctcctcagactcagtaattttgcttggcctgtcttaaagtttgctatttttttcttctacctgcttaaatctgctactgagcttggctagtatatgttctatttcaattattataatgttaaataccagcatttcagttttatttttgaataagtttattcctcttaaataggtaatatgtgtacacaacacatgattgcaacaaaatacaaatttcaaaggcacagaagcatttacagtgacaactacttctctttcccatccttgtcttccagctatccaaagtcctttgtacctaagacaaccaccattactaatttcttgtatatcgttacagaaatcttctaaacaatacgttctgtttgttttatactttctatttaacaatattcttattttgtttatacattatttacttcatgttccttagtttttgtccatgtttttctttagctacttgaacatattttaaatcgctattttaaactctatttattaaatccagtgtctgaatttcttcagggttggtttctgtccatttatcttgttccttttagtagccttttcatttctgtttctttgtatgaattgtgactttctgttgcaaactgggcatttgagtattataaagtggcaactctaaaatcagattctgccaccttttgcgaattgtgctggtttttgttgttgttgacacttttttaaaattgtaggaatttatttgcttagtgacttttgttaacttttttctaaagactgaaattcgctttgtgtgcagtctctgaacctcttttccttgtgctcagctagtgttttgagaagatttccttgaatgctaggagctgtaacaataaaaaaaacaagcacacaaacaaaaccaaaatgaataaaaaaaccacgtttctcagttattgcagattggctctgtattggggcactctttcaacacttagccaggggactgagcctggggatcagcccaaggtgaaaacttaaagtgacttcagttcttttgtgaacatgtatcttgccctaagcatatgtgcagctttctcaatcgcccaccccgtacacatgtgattctgaacgtcccaatttcccagagaaattctccacaatgtttgctcctgatccattaatgcatctattttatattttccatttaatcttttaacctaacatctgtctgtcattaattcagcttgcattgttttttgagcaattccattccattttccaggaagattttatggctagagttctgagacagatgaaacagagaagagcatcttttctttcacgtagtctccagacaggttacaagagacacatacaataatttgtgcataaggtcttctctgcttcctctggaaccaggggccaggactctgttctaagaacactaattgttggtgtctgaagactgccatagagccaggaacaggattgggtaggacaagtaaaaaactcctcaaagatttttaccattttgaagtcacttttttactattttttttaatcagtgtttacttggttgctgtaaacctttgactctttttctgagttttgacaaaattacttttgacagtttctgctttttttttaatgcttctttaggaggatgaaagcttggagctgctgctccatcatttcgctcatattaacctcaacatgtattttaaaattaccactacattatactgcactccagttttgtgtaacttatttcccttttccaacattgactacttaataaatatatttaggtactatgccaccagaacatttatttcctcaggctgtgtgtattgcaattttacttcctatttcaaattgatccaccagaattcagtacatgaatatgcatcagaatatgatagaatccaatacattatgatgtataaaaatgttatttcacatgtgtgaggtacagctacaggttatgttatacgagcataacaattgacaaatatctattttacatttacatttgtatacactgcattttcaaacatattcttgacaggagaaaacttccattttcactaggcacaattagatattagataatagatatgtgaaattttacaaattcaataattagaatattttccataaactagtacctcatcaaataatttttgtcctccagaacatacacactttcagagccagtacatgtatcatgatgcagggaaaggcagcctaatggcctgtagaagtattcaagcaagtaattctatactatgaaggctaaagatgacaggtatgaatgaaagtgaacatatgaatatatttgactatatctcaatatatgtgtcattcaaattaactgtgcctgtaatttcctgtgtctgaggaaattggcatagaaagtaatagaattcttaaatatttgagttactgtatgttattttgcaccacttaaaaaatatatcagagccacaacaaattgtcagggctctcaaatttaagcactgttcgcttcttggtaaatcctctttacctatgtgggaaaaaataccatgagcaggtgttagctctcagcctatctgtataggctgccgcaaagacttcgttttctctgtgtcctgatttcacatttctgtttttttaaatcagggtttggcaaattggcccatgatccataccaagttctccacctgttgttgcctggcttgtgagctcagaatggtttttactgtttgatatgttttttaaaaacatgacagatataatagttcatgatgagaatgttaaattaaaactttaacataaattattatgttattattgaaacacacagtagcgtatccacttacatactgtctatagataccttcacactatcacggcagaatggagtagttaaaacagagtgtatggtcaaaattgcttaaaatatttattgtctaaccttttaaagaaaaagcaaccaccacccagatcataaattctacattaacaggataaattccattacgctttctactgtgtttcctagaatataatagagtactaggcatatagtgggtattcagtaattttgtttaaatgaataaataataaaataaattcaaagctttttcacctgtgtaacaaaataatattttgaattatttcactttttctccttcactatctcttcctttcttcttgtttataattatcttctttctttaaaggggctgatgtgataggaagaaagcagaaatatcataggcatgcctaacttgtttctaaggtgggggaaaatactggagagttatgtggctttgaagaatacaaaagaagtaagaggataacagggctttctcccagatgagtgaatgactatcttgagtagtcatgggcatagatgggtatagtaatctgaagaaagactgaagaaaatgtagaaaaaaatgaaaaaaatctcacaaaatgcaaactattaaaactcaatcgacatgaaataaacaatctgaatagtcctgtaactgttaaagaacttgaatttgtaactgaattgcttccaaaaaaagtcttcaaacacagatagttttactggagaattctaccaaacatctaaaaaatgagttagcaccaattttacatatcttccaaaaaacagaagaggataaaatactaactagttttatactaactagttttatgagattggtagtaccctgataccaaaatcagaccaaaaaacagtattaaagccaaaatactatagaccctggagaattctacaaaacgtttataaaaggagttagcaccaattttacatatcttacaaaaaatagaagaggataaaatactaactagttttatgagattggtagtaccctcatacccaaaccagaccaaaaaaatagtataaagccgaaaaactatagaccaatattgcacatataattacacagagaaatcctcaacaaactattagcaaataaaatctagcaatagataaaaagcactacataccacagccaaaatatgaaatgctcttcaaacactaaagaatcaactggatgatggttccaagatggccgaaaaggaaaaactccagtctacagctcccagtgtgagtgacgcagaagacaggtgatttctgcatttccaactgaggtaccgggttaatctcactgggactgcgtggacagtgggtgcagcccatgaagtgtgagccgaagcagggtggggcatcaccttacacaggaagctcaaggggtcagagaattccctttcctagccaagggaagcagtgacagatggtaccttgaaaattgggacactcctgccctaatactgcgcttttccaatggtcttagcaaatggcacaccagtacattatatcccacacctggctcagtgagttccacacccaaagagccttgctcactgctagcacagcagtcccagatcaaactgcgaggtggcagcgaggctgggggaggggcttccaccattgctgaggcttgactaggtaaacaaagctgccaggaagctccaactggatgcagcccaccacagctcaatgaggcctgcctgcctccatagactccacctctgggggcaggacatagctgaacaaaaggcagcagaaacttctgcagacttaaatgtccctgtctgacagctttgaaaagagcagtggttctcccaccatggagtttgagatctgagaatggacagactgcctcctcaagtgggtccccgacccctcagtagtctaaatgggaaacacttcccagaagggccgactgacacctcatacagcaggtgcccctctgagacgaagcttacagaggaaggattaggcagcaacatttgtcgttctgcaatatttgctgttctgcagcctctactggtgataccaaggcaaacagggactggggtggacctccactaaactccaacagacctgcagctatgggtcctgactgttagaaggaaaaccaacaaacagaaagaaagagcatcagcatcaacaaaaaggacatccacaccaaaacctcatctattggtcaccatcattaaagaccaaaggtaggtagataaaactacaaagatggggagaaaccagagcagaaaagctgaaaatttaaaaaaccagagcacctcttctcctccaaagatcgcagctcctcgcaagcaacggaacaaagatgggcggagaatgactttgtcaagttgacagaagtaggcttcagaagatcagtaataacaaactcctccgagctaaaggaggatgttcaaacccatcacaaagaagctaaaaaccttgaaaaaatgttagatgaatggctaactagaataaacagtgtagagaaggccttaaatgacctgatggagctgaaacaatggcatgagaactatgtgatgcatgcacaagcttctgtagatgattcaatcaagtggaaaaaagggtatcagtgattgaaaaccaaataaatgacatgaagtgagaagagaagtttagagaaaaaaagagtaaaaagaaatgaacaaagcctccaagaaatatgggactttgtgaaaagaccaaatctacgtctgattggtgtacctaaaagtgatggggagaatggacccaagttggaaaacactcttcaggatattatccaggagaacttccccaatctagcaaggcagaccaacattgaaattcaggaaatacagagaacgccacaaagatactcctcaagaagagcaaccccaagacacataattgtcagattcaccaaagttgaaatgaaggaaaaaatattaagggcagccagagagaaaggtcaggttacccacaaagggaagcccatcagactaacagcagacctctcagcagaaattctacaagccagaagagagtgggggccaatatgcaacattcttaaagaaaagaattttcaacccagaatttcatatccagccaaactaagcttcataagtgaaggagaaatgaaatcctttacagacaagcaaatgctgacagattttgtcaccaccaggcctgccttacaagagctcctgaaggaagcactcaacatggaaaggaacaaccagtaccagccactacaaaaacatgccaaattgtaaagaccatcgaggctaggaagaaactgcatcaactaacgagcaaaataatcagctaacattataatgacaggatcaaattcaaacataacataacaatattaaccttaaatgtaaatgggctaaatgccccaattaacagacaaagattgtcaaactggataaagagtcaagacccatcagtgtgctgtattcaggagatccatctcacgtgcagagacacacataggctcaaaataaagggatggaggaagatctaccaagcaaagggaaaacaaaaaaaaaaaaagggggggttgcatttctagtctctgataaaatggacttcaaaccaacaaagatcaaaagagacaaagaagggcattacataatggtaaagggatcaattcaacaagaagagctaactatcctaaatatatatgcacccaatacaggagcacccagattcataaagcaagttcttacacacctacaaagaaactaaaactctcacacgataataatgggagattttaacaccccactgtaaacattagacagatcaatgagacagaaagttaacaaggatatcccggacttgaactcagctctgcaccaagcggacctaatagacatctacagaactctccaccccaaatcaacagaataaacattcttctaagcaccaaatcgcacttattccaaaactgaccacatagccgaaagtatagcactcctcagcaaatgtaaaagaacagaaatcataacaaactgtctctcagaccacagtgcaatcaaattagaactcaggattaagaaactcattcaaaactgcacaattacgtggaaactgaacaacctgctcctgaatgactactgggtaaatcatgaaatgaaggcagaaataaagatgttctttgaaaccaatgagaaaaaaaagacataacatatcagaatcactgggacacatttaaagcagtgtgtagagggaaatttatagcactaaaagcctacaagagaaagcaggaaagatctaaaattgacatcctaacgtcacaattaaaagaactagagaagcaagagcaaacacattccaaagctagcagaaggcaagaaataactaagatcagagcagagctgaaggagatagacacacaaaaaacccttcaaaaaatcaatgaatccaggagctggcttttgaaatgattaacaaaataggtagactgctagcaagactaataaagaagaaaagaagaatcacatagatgcaataaaaaatgataaaggggatatcaccactgatcgcacagtaatacaaactaccatcaaagaatactataaacacctctacacaaataaactagaaaatctagaagaaaatgatgaattcctggacacatacaccctcgcaagactaaaccaggaagaagttgaatccctgaatagactaaaaacagcctctgaaattgaggcaataatagcctaccaaccaaaaaaagtccaggacttcatggattcacagccaaacactaccagaggtacaaagagaagctggtaccattccttctgaaactattccaatcaatagaaaaagagggaatcctccctaactcatgttatgaggccagcatcatcctgacaccaaagcctggcagagacacaacaaaaaaacagaattttagatcaatatccctgataaacatcgatgcaaaaatcctcaataaaatactggcaaaccaaatccagcagcacctccaaaagcttagccaccaagatcaaatttgctttatccctgggatgcaaggctggttcaacatatgcaaatcaatagacgtaacagaaccaaagatcaaaaccacatgattgtttcaatagatgcagaaaataccttcgacaaaattcaacaaccttcatgctaaaaactgtcaataaactaggtattgatggaacgtatctcaaaataataagagctatttatgacaaacccatagccaatatcatactgaatgggcaaaaactggaagcattccctttgaaaactggcacaagacaaggatgcccttccaccactcatattcaacatactgttgaaagttctggccagggaaatcaggcaggagaaagaaagaaagggtattcaattaggaaaagaggaagtcaaactgtccctgtttgcagatgacatgattgtatatctagaaaaccccatcatctcagcccaaaatctccttaagctgataagcaacttcagcaaagtctcaggatacaaaatcaatgtacaaaaatcacaagcattcttatacatcaataacagacaaacagagagcaaaatagtgagtgaactctcattcacaactgcttcaaagagaataaaatacctaggaatccaacttataagggatgtgaaagacctcttcaaggagaactacaaaccactgctcaacaagataaaagaggaaacaaacaaatggaagaacattccatgctcatggataggaagaatcaatatcatgaaaatggccatactgcccaaggtaatttatagattcaatgccatccccatcaagctaccaatgcctttcttcacagaattggaaaaaaactactttaaaattcatatggaaccaaaaaagagcccgcatagccaagacaatcctaagcaaaaagaacaacactggaggcataatgctacctgacttcaaactatactacaagcctacagtaaccaaagcagcatgttactggtaccaaaactgatctatagaccaatggaacaggacagagccctcagaaataataccgcacacctacaaccatctgatctttgacaaacttgacaaaaacaagcaatggggaaaggattccctatttaataaatggtgctgggaaaactggctagccatatgtagaaagctgaaactggattccttcgttacaccttgtacaaaaattaattcaagatggattaaagattcaaatgttagacctaaaaccataaaaaccctagaaggaaacctataccattcaggacacaggcatgggcaagaacttcaggactaaaacaccaaaagcaatcacaacaagagccaaaatagacaaatgtgatctgattaaactaaagagcttctgcacagcaaaagaaactaccatcagagtgaaaaggcaacctacagaatggaagaaaatttctgtaatcaatccatctgacaaaggactactatccagaatctacaaagaacttaaacaaattacaggaaaaatcaaacaaccccatcaaaaactgggcaaaggatatgaacagacacttctcaaaagaagacatttatgcagccaacagacacatgcaaaaaggctcatcatcactggccatcagagaaatgcaaataaaaaccacaatgagataccatcttacaccagttagaatggcgatcattaaaaagtcgggaaacaacagatgctggagaggatgtggagaaataggaacacttttccactgttgatgggagtgtaaactacttcaaccattgtggaagagagtgtggcaattcctcaaggatctagaactagaaaaaccatttgacccagccatcccattactgggtatatacccaaaagattataaaacatgttgctataaagacacatgcacacgtatgtttattgtggcactattcacaatagccaagacttggaaccaaccaaaatgtccaacaatgatagactggattaagaaaatgtggcacatatacaccatggaatactctgcagtcataaaaaatggataagttcatgtcctttgtaggcacatggatgaagctggaaaccatcatactgagcaaactatcgcaaggacagaaaaccaaacaccgcatgttctcactcataggtgggaattgaacaatgagagcacttggacacagggtggggaacatcacacaccagggcctgtcgaggggtggaggcatgggggagggatagcactgggagaagtgcctaatgtaaatgacgagttaaggggtgcagcacaccaacatggcacatgtatacatatgtagcatacctgcccattgtgcagatgtaccctggaacttagagtataataaaaatttaaaaaaaaagaaatatgaaaacacatacacacaaattttttttctaagaacaaaattctaacaggaacaggaggggagctgggctggctctaaagtgttcccaccataatgtggaaaatacacacatgatgatatatttgattactaagatcccattaggcccatttaggcactttatgtatttcctttgctctggacgttgagtcgttttctgctcagtttgaagcaactggcttattgtctcagagtggttctagaactttgctttcaggtgtggctggggagggagccctggcatttcaagacaggtggaggtgatatggttggactctgtgttcccacccaaatctcatgttgaaatgtaactcccaatgctggagatgggcctggtgggaggtgacgaggccatggaggtggcttctcatggtctagcaccatcccccaggtgctgtcatccctgttgtgagttcttgtgagatctggttgtttaaaagtgtgtggcacctctccccttgctctcttcctcctgccccagccatgtaagatgtgccagcctctcctgtgccttctcccatgatcataagtttcctgagacctccctagaagcagaagccagtatgcttcctgtatagcctgtggaaccgtgagccaataaaacgtttttctttataaattaaaaaaaaaaaaagaatcaaccaacataagcccctgtgtcaataggctaaaaaagaaaaatcatatgattatatcaattgatgcagaatagcatttggtgcttaatataacgccaattcaaataataaaaatatctcaggaaactagaaataaaggagacctttctctatttgacaaagaacgtatttttaaaaacctatagcaaacattgtacgtaatgatgaaagactggatgagttctctctaagattgcagacagggcaatggtgtccaatcacatcattcccttactaaaatagcacttggatttctaaccatttttgtatagcaggaaaaagaaataaaatacatacaggttaaaaaggaagaaataaaattttctctatttgaaaatgacattattgtctacatagaaaatcccaaggaatgtgaaaacaattttctataactcataaatgcagtcagtaaagtcagaaggtcagaggatataagaacacattagaaatcatttacttttatatattaataataagcctgtagaaacaaaattctgaaacaccatattggaggtagagcaagatagcagacatgtaggctccaccaatcatcccctactgcaagggcaccaatttaagaactatctacatagaaaaatcaccttcataagaaccaaaaatcatatgagcactcatagtcgctgatttaactgtgtatggctgaaagaggcatgaagagataaagagccctaaatggtcaatgccacccttcccctctacaccccaccctccctacatctctgcagcagtagtaaggagaggagaatgactctcagtgctgggtgagggataacacggcaattgtgaggcattggactcagtagtgtcctgttagagcagaaggtaaaactgcatgaaactcagctgatgcccatccacaggggaaacatttaaaccagccctaacaaggcaggaatcaccaatcccagtgacccaaacttcaccaccaagggatacagtgctctgtgtctccaaataaacttaaaaggcactctaggccatgaggacttgccaactcttggcaagtcctagtgttaaactaggtccagagacagtggattgggagggcatgtgactgacatactgagacaacagccgggacagccaaggtaatactggcatcatccgtcccataaccctaggctgcacaactcatggctccaaatgagaccccatccttccacttaaagagaggaaagtggatactttggacatcttggataccagcttagtcacagcaagataagtcatagtcagagtcatgaggactccgttccaggccctagctccaaaatgacatttctagatagaccctgggccagaagggaatccactgctttgaagaaaaggacccagtccttgcagagttcataacctgctaactgaagagcccttgggccctgagtaaccagtagcaatacccaggaactatgttgagggcattgggtgagatgttgagacatggtggcttcaggtgagactcagtactttaccagctgtgttggctacatggcaaaactctttctactggagaaaagcagagggaaaagtaaaaggaagaccaagtcttgtatcttaagtatcagcattgccacatgggtgtagagcaccaagcaggctcctggagtccccagctccaggacttgactcttggatggcactatggacctgctgtgggccagaggggagcctattgccctgaagcatgaatcctaggccatccagcattcaccataagctgatataagagtccttgggccttaagggaatatcagtggtagtctgaccgtactccttgtggcctggagtggtggtggctactgggtgaggctcgtttgtctttggaaagggaagggaagagtgggaaggattgcatcttgtggtttgattgccagctcagccacagtaaaatagaacaccaggtagacttctaaggtttttaactctagtcctaactccctgatggcacctctggatctacctgaggcccaggagacctcactgacctgaaaagaaaaagacataggcctggctggctttgccaatggctgagagatacagaggcctgggacaagacccagtgctgtgctggcttcagttctgaccaagtgcagtcatagtggtaggggccacaggggtgcttgtattactctacccccagcttcaggacagagagaatcttttttttttagaaagtaagggaagataacaagagtctctgcctggtaatccagagaattctctcagatcttgtccatgaccatcaaggcttaatatgcagatactaacaacccctatgactatgcaggaaccactgcatttactgggcttgggatacaccctatagcagatacaggttagatcacaacacccaagtcctttcaaatacccgaaagtcttccagagaagaatggctacaataatcccagacagtggagactctaacaaatacctaactcttcaatgcccagacaccaaagaacattgttaatatcaacactatccaggaaaacatgacctcagtaaatgaactaaaaatagcaaaaggaccaatcttggagaacggtcacacgtaacagagatacgtgaccttttagacagagaatttaaaatagctatgttgagaaaattcaaagaaattcaagataacacagataaggaattcagaatgctacccaataaatttatcaaagagattgaaataattaaaaagaagcaggaatcctggagctgaaaaatgtaactggcatactgaagaacacattagagttctttaatggcagaatcgatcaagctggaggaagaattagctctaagacaggctatttgaaaatacacagtcagaggaggcaaaagaataaaaaacaatatattgcctataggatctagaaaatagcctccaatgggtaaatctaagagttattgtccttaaaagaaggtagagaaaaaggtatgggtagaacatttattcaaaaggacaataacagagaagttctcaagcctaaagaaagatatcaatatccaagtacaagaaggttatacaacaccaagcagattcaacccaaagaagggttaaactctcaaggcatttagttatcaaactctcaaaagtcaatgataaagaaaggattctaaaagcagccagagaaaataaacaaaaagagctccaacaggtctggcagccaactctttcagtggaaacttacaggctgggagagagtggtatgacatatctcaagtgctgaagcaaaaaaatggttaccctagaatagcatatttagcagaaatatcttttgaatatgaagaagaaataaaaacttccccagacaaactaaagccgagggatttcatcaacatcagctctgtcttagaagaaatgctaaaggaattattttgaccacaaagaaaaggacattaattagcagtaagaaatcatctaaaggtatacaactcactggccatagtaagtaaacagaaaaacacagaatattataacactgtaacagtggtgtgttaactactcttatcctaaatagactaaattataaagcatccaaaaataataactacactttgggaggccgaggcgggcggatcacgaggtcaggagatcgagaccatcccggctaaaacagtgagaccccgtctctactaaaaatacaaaaaattagccgggcgtagtggcgggcgcctgtagtcccagctgctctggaggctgaggcaggagaatggcgtgaacccgggaggcggagcttgcagtgagccgagatcccgccactgcactccagcctgggcgacagagcgagactccgtctcaaaaaataaaaataaaaaaaataataataataataactacagcaacttttccaagacatagtcagtacactaaggaataaacagaaaaaaaaaacccaaaaatttagtaaggagaaaaagccaaggcttagagttttgagtagttttcttcgtatcagtgttaagttcttatcagattaaaataatgggttataaaatagtatttgcaagcctcatggtaatctcaaaccaaatatgtacaatagatacacaaaaactaaaaaacaagaaacgaagtcatatcactggagaaaatcaccttcactaaaggaagacaggaagaaaagtaggaaggaagagatcacaaaacaaccagaaaaagaaaatggactaaattatccaatcaaaagacagtgactggctgaataaatgaaaaaacaggacccaatgatctattgcctccaagaaacacacttgacctataaagatacacacagactgaaaagaaaggtatggaaaaagatattccatgccaataaaaaccaaaaaagtgcaggagttgctatactcatatcagacaaaatagatttcaagacaaaaactataagaagctacaaagaaggtcatatataatgacaaaggtatcgattcagcaagaggatataacaattttaaatagatctgcacccaacactgggacatccaaatatatagaggaaacattattataactaaaaagagtaatatgtccaaatacgataactggaaactttaacaccccactttcagcattggacctatcctcgagacagaaaataaagaagcatctgacttattctgcactacagaccaaatggatataacagatatttatagaacatttcataaaatggctacaaaatacatattcttttcctcagcatgtggatcattatcagggatagactatatgttaggtcacaaaacaagtctgaaaacatttaaaaaaatggaaataatgtcaagcatattcccataccacaataaaactagaaattaataataagaggaattttgcgaactatacaaatacctagaaattaaaccatgtgctcctcaatgatcagtgtgtcaataaagaaattaagaaggaaatggaaaaatttcttgaaacaaatgataacctaaacacaacataccaaaacctatgggatacagcaaaaatagtactcagagggaccattatagatataagtgcctttatcaaaaaagaggaaagccttcaaataaacagtctaacaatgcatcttaaagaactaggaatgcatgtggaaaccaaacccaaaattagtagaagaaacaataaaatattagagcagagataaatgaaattgaatttttttaaaaagtacaaaatatcaataaaacaaaaagttggcttttaaaaaagttaaagaaattgacaaacctttagccaaactaagaaaaaaagatacaaataaataaaatcagaaacaaaaaaggagtcattacaactgacactgccaaaacgtcattagtagttactatgagcaactatatgacaacaaattggaaaatctagaagaaatggacaaatttctagacacataccatctccagagactgagccaagaagagatccaaaacctgaacagaccaataagaagtacaagatcaaaggcataataaaaaaaaatctaccagtaaagaaaagcctgggacccgatggcttcactgctgaatccaaccaaataaacatttaaagaggaatgaataccaatcttactcaaactattccaggaaatggaagaagaggaaatacttccaaactcattctatacaatcagtattaccttgatatcaaaaccagacaaagacacatcaaaaaaagaaaactacaggccaaaatctgatgaatattgatgcaaaaatcttccataaaatactagcaaactgaattcaacaatgcattagaaaaatcattcatcatgaccaagtgggtttacctctgggatgcaaggatagttcaacatgcacaaaccaatcgatgtggtacatcaagtcaacagaatgaaggataaaaaccacatgatcctatcaatagatgctaaaaaataattcaaaaaattccacatctcttcatgataaaaacccccaaaaacctgggtatagaaggaacatacctcaacataacaaaagttctatataagacacccacagctagtatcatagtgagtggggaaaaactgaaagcctttcctctgagatctggaacacaacaatgatgccaattttcaccactgttattcaccatagtactggaagtactagctagagccatcagaccagagaaagatttgagcatccaaattgaaaacgaacaagtcaaattatccttgtttgcagattatatgatcttatactaagaaaaacctcaagattccccccaaaatgattagaactgataaatttatggaatttgcaggacacaaaatcaacatacgaaattcagtagcatttctatatgccaacagtgaacaatctgaaaaagaaataaaattcatcccatttacaatagcacacataaaattaattacctaggaattaaccaatggagtgaaaaatgtcagtgatggaaactataaaacactggtgaaagaaattgaaaggaacgccaaaaaatgaaaataaatagttcatgtatatggatcggaagaatcaatgttgttaaaaagttcataccacccaaagctatctacagactcagtgcaatccctatcaaaataccagtgactttcttcataggaaaaaaaaaaaaaacacaatcctaaactttatatgaaaccacaagaaaatccaggatagctaaagttatcctaatcaaaaagaatgaaactggagtaatacatcacctgacttcagattatactgtggagctacagcaacaaaagtagcatggtattctcataaaaacagacacatagacaaataaaacataataaacaacccagaaacaaatccacacactacagtgaactcattttcaacaaaggtgccaagaacatacaatggagaaaagacagtctatcaataaatggcattgggataactggatatccatacaccaaagaatgagactagacccctatctcttgccatatacaataaacaaatcaaaatggattaaagacttaactctaagacatagatctatgaaactactacaagaaaacaacgagtaaactatccaagacattggtctgggcaaaaatttcttgagcaatacctgacaagcacagacaaccacggcaagaatggacaaataggatcaaatcaagttaaaaagcttttgctgttatgatcaacaaagtgagtcaccaaagtgaagagaaaacccacaaactgggagaaaatatttgcaaactacccatctgacaagggattaataaccagaatacataaggagctcaaacaactctataggaaaatgtctaaaaattcaatcaaaaaatgggcaaaagaatagatatttctcaaaagaaaacacacacatggcaaacaggcatacaaaaaatgctcaacatggattatgagaaaagcaaatcaaatctacaaggagatgtcatcttacctgttaaaatggctttcatatccaaaggacaggcaataataaatgctggtgaggatgcagagaaaagggaacccttgtatactattggagggaatgtaaattagtaaaaccactatggagaacagtttggagcctcctcagaaaacaaaaaaaattgagctaccatatgatccagcaatcctactgctgggtgtacacacaaaagaagagaaaacggtgtatcaaagagatatctacatgcctgtgtttgttgcagcattgtttacaatagtcaagatttggaaacaacctaagtgtccatcaacagatgaatggataaagaaaatgtggtccatatacataatggagtactgttttgccataaaaaagaatgaaatccagtcacttgcatcaacgtggatggaactggagatcactgtgttaagtgaactaagccaggcacagaaagacaaacatcacatgttctcacttatttgtgggacctaaaaatcacaacaattgtactcatgaacatagtaaaacgatgattaccagacgctgggaatggtagtggggatgcgtcaggtgaggtgggaatggttattgagtacaaaaaatagtaagaaaaaatgaataagacctgtttgatagcacaatagggtgactatagtcaataataacttaattgcacattttaaaatgtatcttaaagagtataattgaattataactcaaaggataaatccttgagggcatgaatactccattctccatgatgtaattatttcacattgcattcttgcatcgacatctcatgtaccccataaatatatatgcatactatatgccaaagaaattaaaaattaaaaaattaaaccatactatttataatcacttcaaagccaaattaaaaatttatcagaacatttacagataatttatgctgaagtttaaaaatgattcctgaaagataccaaaaaaaaactaagtaagtgaaaagacataacatttttatagatcagaggattcaatatagtaaaaatgacaattctcctaaaatttttacacatgtttaaggcaattaaagcaagagtattatgaagaatataaatacatattctaaagtcaatatataagaatagaaacacatattctaaaatcaatacataaagacccaagcccaagaataacaataataatattgaaataaagaatacagttggaggaatcactttacctaatgtaaaggtctattatgtggctacagtaatcagctgtgatattgtcagaaagacagatattctgattcatagaatgcaatagagaagtcagaaatacacaccaatttacctaacagacttttgacaagtgtgtaaaaagaaataatggaggaagaaaaagcttggaacaatggcatacacaacagaaaaaagcaaaaagattgacttaaaactcacattttgtacaaaaatcaaccaaaaatatatcatagactttaatgtaaaatataaaactataaaaatttagggaaaaatgtagaaaatattgctatgtagagttaggcacatagttcttatattttacaccaaaagcacaattcatttaaaaaaataggcattggatctcaaaaatattaaaaatttgtctcatgaaagacttgactaatagaataagaaaacaagctatgagagtaggataaaatatttgcaaacttatatatatatcctatagaggactgttacctagaatatggaaagaacctcaaaaccataacaaaaaaaactcacaaagaattcaattagcaaatgggcaaaagatgtctagacattttactaaactgaatatatggctggcaaataaacacataaaaaggtgttcaatgtcatgagctattaaggaaatgcaaactaaaagcacaatgagttaggcaaggtgacaaatacttgtggtcccaactatatgggtggatgagctgggaggatcgcttgagcccagaagttcaagaccagcctcagctacatagcaagatcctgtctcttaaagcacaatgaaatatcactacacagctgttatcatatgacaacaccagactggagaggatgtgaagaaattgaattcttgcaggaaaggatatgaagtgttataatcattctgcaaaaaaagtttataaaacaaaacttgcatccaccatatggcccagcaaacacacccctagatatttatctcagataaagaaaaaaaattgttcacacaaaaacttgtacacagggttcatagtagcattggtcataatagccaaaacctagaaacaactcagatgttcctcaatggatgaataattaaataaactgtgatacattcatactataggttaccaattagaaataagaatgaaactattgatatatacgacaacttggatgaatctccaggaaattatgctgagtgaaaaagaaaatccggaaaggtaagtaaataccatatgattctgaatataacattcttaaaccatcaaaactgtagaaatgaagaacaaataagtgattgtcgggggttaacgtgagggtggaggaaaaggagtgaggtttcaaaaagacaagggatgcccacagtgatggaactgttctgtgtcttaactggatcaatgtcagcatcctagttgtaatatggtattacagttttataagatgttaccattgagaaaaactaggtgaatgttgcagattctctctgtattatttgttacaactgtatgtacactgataactgtctcaaaataaaagtttataatcagtgtttaggtagtaatttcccccataaactcaggatttggggacttcaatctgaacacgaacctcggtctgtaagcctattcaaaacttcttccaggggaaagttttgactttgtcaaagagtgagctccagcctacctctgaataccagtgcaaggcttagaggaatcagttacctaacctggtcagagtaattgggagtgcgattctattgcagcaatgaaatgatacatcccatagagtaaagtgaccataggtttcatactgtcactgagaagaacaaagagagaaataaaatggacccaaactttaggattctctttcatttaataccacaaaaggcctgtgtttcagccacaggcaggtactacagtcttccattgtttggaattcagctactataaaccccctaccaagccaactgatactcaagggaaagaggctaaggaccacatagccattgatgtgtctagaatctcagagatctagcatgatatcatatgctgaaatcctaaccctcaatgtgattgagtttgaagatggcatattgagagacaattaggtttagatgaggtcatgaggatggggtcctcttgatgagattagtgcccttatgagaagaagagacaccaggtcggtcagtctgtctgtctctctctctctctctctctcacacacacacacacagacacacacacacacacacacatatatatgaagacacagcaacaaggcagctgtctgcaagctagtaaggagtctttatcagagcctgaccatgttggcaccctgatctcgaacttctagcctctagaattgtaagagaataaatttctggccgggcccggtggctcatgcctgtaatcccagcattatgggaggccgaggcgggtggatcatgaggtcaggagatcgagaccatcctggctaacacgctgaaaccctgtctgcactaaaaatacaaaaaattagccaggcgtggtggtggtcgcctgtagtcccagctagcaggaggctgaggcaggagaatggcatgaacccaggaggcagagggtgcagtgagccgagatcgtgccactgcactccagcctgagcgacatagcaagactctgtttcaaaaataaacaaacagcaacaacaaaaaaaaaccgcagaaaataagtttctgttgtttaagccactcagttcatggtattttgttatgggaccctaagctgatcgagacacatgtgagtaattcttttgtattctgaaacatgttacccgtggtttattaataattttgttgcaaattttatttttgtttgaaacaattttaaacctaaagaaaagtcatgtgcataatttttaaaaattgttgtatattctttgggacctcattcaaactttgctaaatctgattggctttaaaacatgtctacaagttctttagcgctccttttataaaatggtagaggctgtttcagaaaatttggtacagcttcctcctctctccctctttgaaggcttactcttctaatacaggcaccatgaattaaggaaacggaggtacatggatgggccacatgtaggtgttctgacaggtagtcctatctaaggtctctgatgacaactatgatcagcttccaggcatgggggtgagccagtcttcaaatgataccagccctcaaattctgagctgtctcagctgtcgcccagtggagcaggtatcagctacctccactgaaggccgttgaaattgcaggttgcgagcaaaataaatgccatcaactgatttacagccactctgttttggagtagtttgctacagagaaatagataactagaaaaccatctgttccagtaacgcactctgtagacaatgaatccaatctagaatcacgtggtatacacagctggcaaatgtccagtttccttcaacagtttctcaatttttccttgattcctgaccttaatatcttccaaaatgtttctcaatttcagattgtgctaaatctcttcaagttaatgctcaagttatgcgtttttgtctgatataatatagaagttttttttcttcctttaacgtcttatcagatgttgcctgatgtctctttggcccatgactggtggtagttactttcactagttgactaagactgtgacagccagaggttcccactggagttacttttccctctattaaaattaatgttttaaaaatgtgcttggaatatatgaaaaaaatcatgtctcatatcattttctcccgttagtctcatcatccattgataattttgcctgagataaatactactcagatcattgtgaaatggtgcttttctaatcctatgatttcttgtacatttttagttggcattctatagtaaaaatgatatttattcatttataatatggattcaaagatttttattttattcaatcaaacgtattgtcattatatatgtaaaatatatattatatatttatatatacaaaggcatatatctaaatatacagtcatgtgttgcttaacagagtgatattctgagaaatgcatcatttggtgatttcgccattgtgcaaacatcacagagtgtatttaccaaaaacctgacaaacctaggctaagtggtatagcctactgctcctaagctacaaacctgtacagcatgttactctactgaatactatagtcagctgtaacacaatgttaagtattcgtatatctaaacacagaaaaggtacagtaaaaataatgatataaaagattaaataatggtacacccctatagggcacttctagtcctgaagcttgcaggacgagaagttgctctggatgagtcggtgagtggtgagtgaatgtgaaggcctggaactttactgtccactactgtacactttataaacactgtgcatagaggcgacgctgaatttatttaaaaatatttttcttggccactcacagtgtctgatgcctgtaatcctggcactttgggaggccgatcactaggtcaggagatggagaccatcctggctaacacagtgaaatcctgtctctactaaaaatataaaaaagttagccgggcgtggtggtggtcgccttgtagtcccagctactcaggaggctgaggcgggagaatggcatgaacccaggaggtggaggttgcagtgagcagagatcatgccacttcactccagcctgggtgacggagtgagactccatctcagaaaaaaacaaaaacaaaaacaaaaacaaaaaagttctttctttcttcaacaataaccttaacttactgtaacattttaatattatgtaatttttaaaaactttttgactcttttgcaaacacttggtttaaagcacaaccatgtatagctgtacaaaactaaactatttctttctttctgaataatattattcaaaactattttctttctttatactcttattctataagcttttccctatttaaagtttttctaaaaaacatttttgctaaacaccaagaaaatacccgtagcccaggtctacaaagaatcaagttcatcaatatcactgtcttccagctccacatcttgtcccacttgaaggtcttcagagacaataacacagatgaagctgtcatcccctatgataaaaatgcgttcttctgaaatacctcctgaaggacctgcctgaggatgttctccagttaactttttttataagtagaaagagtataatctaaaataatgataaaaaactacagtatactatagtaaatacataaatcagtaacagtatttactgtgatcaagtattatgtactgtgcataactgtatgtgctatagttttctatgactggctgcaaagtaggtttgtttacattggcatcatgacaaacatataagtagtatgttgtgctctgaccttaggatgcttatgacatcactaggtgataagaaattttatctccatcataacctcctgggaccaccaatgtatatgtggtccttcattggctgaacattatatagcacataattttatatatatataaaatgtatatacatattatatttaatatacaatattatatgttatatacatatatatgcctctgtgtgtgtgtgtgtgtgtgtgtgtgtgagtgtgtgtgtgtgtgtgtgtgtgtgtgtatgctcagcccatagaagcatctcccaactggctcatatgtctttttgacatgtccccatcattgagcatttttcttactctctaacacaggagacttaagtgtttggtatttgataatactatttttaccaagtgataattttaaataacattactgttatttatttgttagttgtaaaataagtacttgtgcagaaaaataaaaaaaaaacatggtcagtagattaaaaaagaagaatgttgaaagtacaggaaatgtgaattgtatattcactataagaaatataaaatagtacttcttactaggtatctggaaatagttgatgcttctagagaaaatgtaaaaagagggatagaagaaggtgggtaagtaatactagttatatccccataatacagtagctcaaattatataaagtttattttctctcacagaacactgaagacatagacatatgaatagtctgatttcctatagatcatgatgttaaaaacacacattactggccaggcacggtagctcatgcctgtaatcccagaactttgggaggccaaggtaggcagatcacttgaggccgggagtttgagaccagcctggccaacatggtgaaacccccgtctctactaaaactacaaaaattatccagggtgctggtaattgtgccaaaattgttccagctttggtcctaagttattttcacatgtctttttttttttcctcatcaaaaccctatgtggtaagtgcttcttataatggtcctttaatagaagaaaaaacaagcctagagagattcatactttgtacagtacagtaggcagaataacctcttttgtcctgccaaagattttcatactttagattctagagactgtgaatatattattctacacagcaaaagagattttgcagatgtaatttaggctcctaataaattgaccttaaaataggaagtttatcctggattagccaggtatccgggtaatgcgatctccacagagcaacctggcaatgtattcccaacagctataaaagctgactagatggtgcccacctagattgagggttagtctgcctctcccagtccaccgactcaaatgtcaatccctttagcaaccaccctcacagacacagccaggaacaataccttgcatccttcaatccaatcaagttgacaatattcactatcacagtggagaaattcaagccatgagaggaatttgacttactgttactggaggctagatatttggaaaccatgagaagtccgcatgagcagccagcagtgcaaataccaggccctgaatgatggccagcaaggagacaaagtaactacgaccaagtcttgcataccatattctatatatatatagttttctatgtttgcttgttttgagatggagtctcaatctgttgcccaggctgcagtgcagtgtcaggatcttggctcactgcaacctctgcctcctgggttcaaatgatcctcctgcctcagcctctcgagtagctgggactacaggtgcccaccagcacactggctaatttttgtagttttagcagagatgggggtttcaccatgttggccaggctggtctcaaacttctgacctcaaatgatctgccctccttggcctcccaaagtgctgggattacaggcatgagccactgcgcctggccagtaatgtatttttttaatatcatgatatataggaaatcagactattcattgatacatggcaggataaattatgagattttgtgggtctaagacctaaagctataagagacactttaaacatcaaatggacaattttaaaacctctacagagagaagtgagttgatataaccacttttttggtggctgcaggtggaggcaggggaatgaactgtcctcttttatgactgttctcccatttcacctgttatttaattatattttcaagaagttttgctttcacaaaactatatgaaatatttaaagcttaaaaaaataaatcatgaagaggaccgttggtaaggtgcttagaggaaacagcttattttgtgaagatggcattctttattatttatacacttcaaaacctgaaatcaggattcacctggagacttaaggggaaggtggggtggtactaatatttagtgtcttgggaatttttattttcagtaagttcaaaaagcaactagaaaactgagttgagtgactgatccaggtctacaaactttaaagtttcagcagagaaaatgaagtgattgcacgttccttttctcagcacctaatctaatcacatttcttcatgggttgtttgaacaaagcggctccatcctgctgccggagtgttaccgcattcttggcatttggacagtgaagaggaacaatggcctatctaatagaaaggttgagtccaaagctgaccccatcgcagtgtgccaatttaatagacaagaacaaggatgtagaagatgaactaataaaaacaaaccagaagatattgattggaacccagaagcatggtgtttaatttaaaagacagctcttcagaaagtcctttcttctgttgtcaaacagacatgggaacttgcctagacttccaagcattcaattagaacggaggcaaaggactgatagtcttggctttcaaacaaacgctagggcactgggtagatgcagagttggatttcacgattctttcaggtttttagttttaattgctactgtctaaaaaaaagcagatatgctttcttttgatatatttaactgctgtcctcttttacatcatagaaaaaaaacaggtctagatctaagtctaactaatagcttttaatttaccatgaaacaattctacggggctgatgtctttcactttttaaagcagagtggcttattcgtgaaatttgttttctaaagttaatatactatgtggaatacgaatgaaactgcagattgcagttgattgattctgcctgaaagcattaaatttaagagacttccgtgtgtaaaggtttattcctttttttgttgtgttgactaggtctcaaaagataattgaattaagtcatacctttggccaatagtagggaatacaaaataaaaatatagttttcaattgtgcataggtgagctaaagtataaaactcctatatattcagtgatacagagaggacatgttaaggtcaaataagtatcattatactaagatttaagcaaacttctcctgggcaagacaagtaatgtcaagagtggaaaattacaaaccttaagcatgtgattgctctttatggtgatggggtattgatagatggtggtgttcaggtatgtgtttaccattttacttctgtgtcctcacacccatgagtatctgaatgtatcaggtaaattcctgctgctttgtaggtagagtgaacgtaaatatcatgagctacgctaggtctgtgaatcattatagtcataactgactttgcctcagatatacagacacatcccttgtctaaatgaatccatccactgaagtcatcctgaaagacaagttcctttataaaatggcattgctcaaaaaatataaagctgcaaggcatccattttaattcctataaatattgcttaaatagaaaacatttgtgccacaaatttgaaattctagaataaacttcacacatatctgtcatcacatgtaactttgaagtcctgtcagcacaggtatctaatttatatgaagcaccctggagtcaatgtctctttgtactgttatttgtcaaatgattcaagcactgctttaaagtatatgtgaggttactagtcaatcttaacgctctaaatctgcatgctatgctacgcacatttttttcctctaagcacatgaaattctaaattatatttgcctttgatatttttatttttctttctttaaggaatatcacgggaaagcatgaagctgttataaagttaatatctgctattctggtaaggagtaaagtcctggcaagaattagtttgtctatgtgcctatgtgtatgtttgtgactctagggtgtgtaagtggtaaatgggctcttctaagagacacagaaatgtgattggatagtgaggacagttctaatcaaatgaaatattctctaatttaccatttattgattaccaatattcaccctattgtacatctgcatcaggttaaaggtcaacattgtttgctatgggcaatctcatagtttgtgggtgtttctttcattctaagtattatgttccaaccttttacaataatctgcttgtaattttattattttattaagatcatctgaaagtatatgacatagacttctaattaagtaggggtgtctgagataattggaaaatatagatcaatcgagaacattataaagaataaatgcaatactatgtgcatatatttgagacagagaaagaaatgaaaagagagagccagtgtgaaacacatatatgtatatctatacatacagtcacataagtcacatgtacacatcacacacacatagacacattttacacacacatgggatggggaaggagaagcaataggaggaagaagggagagagagagaaagataaagggagagagaatagataactgccttaaggcactgaattaaaaagcagaaaaacttagatttttcaggaagcactttcttgccaatttgggctaaggaagcacttagtccaagcaacatttcaaggatggcatcggggctactaagcaaaagcagaaaatgaatgtgaccatctgcctttacttcgctggaacaattatgagacaggcaaaggtaatacaaatatcagaagaagtgaaaattccatgagatcgtaaaagctgccaagaactctagaatctccctttacttatgattgtaaagtacccaatgagaatatcggaatatggattaaataaatttttgataagtgtgtaatgtcctagaatttatctcaggattatgttggtctcaagagtgatgaccagtaagcattaccagggttcaaagattattaatgttgcccagttcccctgaaggcatttctaccctaaggaacctcacttactcaccaacaagcaattcaaatgttagtgctcagggccctacaactaatgtcctttctgatttgtctgtgttctatgacaaacagaactctctttctctctctttgtccctgctctcctaactcaggactcaagaaggtcaatctgtaccctccgtacgtgcctcctttcctagccttcccaagaagtcttaagaaaaatggacatcaaccaggtgagtattcatggggaccatcctaaacactcacccaatggtggaggctccaccctctcagcagaacttgctcccaagggacaggagggacaggcgtaggggtaagggtggtaggatttgattcaggccaggggatacccagtgagggttcccattcaataatccctgttgaatttcatcaccatttaataacacatctttttattttattttactttcgagagagggtctggctctgtcacttgtgctagactgcactggcatgatcttggctcattgcagccttgacctcctgggctcaagccatcctcccacatcagcctcctgagtagctgggactatggacacacaccttcatgcctggttaattttcaaaaattttggtagacacaaggtctcactatattgcccaggctggacttgaaccaagcgattctctcacctctgtctcccaaagtgctgggattataggcatgagccactatgtccagccaatacactttttttaacttttaagttcaggagtacatgtgaaggtttgttacagaggtaaacttgtgtcgtgggggtttattgtacagattattttgtcacccaggtattaaacctaatacttattcgttatttttcctaatactctccctcctcccaacttccgcccgcttacaggctccagtgtgtgttgttcccctctatgtgtccatgtgttctcatcatttatagctcccacttataaatgagaacatgtggtgtttggctttctattcctgcattagtttaatacacctttcttgaaatcaacacaggccctcctgtctctgacatttgcagtatcaatattatcatcattaataaatataaagagccaacacaacctcttcattatgtactgagcacattctcatcacacaactacacacacatgcatttaatttgaccactaaagttattatcatttcaatcattcagatgagggaaaatcagaggcatctagagttgaatatatggagaggcagaggcaggattcaacccaaacaacccaagaacagagttgatgttcttcaattgccatgctaactgccctcacctgacccacaggactgtttgacccaaattaatatggatagatacgcatgagctgtttccaaactcaagtttgggaaacatgaagtcaaatatactttattattttcttcttgttttttaaaatgtagacctccttgggtactttcaagggattgttaaatgtgttatcaaaataaaatttgtcatggttgtgaatcaagtaattcagaagagattgtgcttaaaattgtcatcaaattattccccaatcctggtcccacttttaccttttttaaaattttaatttcagctggtggttgactttagtgaccccaatattataataatgacttttaaataatatgtgtatagcattagttttttatttacatacttttgaggataattatgaaagccatataaaattaatttagtttacttttattataacttcccccttacttaattctaaagttaaaatttccattttagttccttcgcacgtcttttattttaaaataatactcccaaattattatttgttagtcccctttactcagaatttgcatttcatctccaccccgcccagccacatcattttcttccccctgcctccacctgagagatggctttacttttatgtcattgaggctgctaatatttgcattcttttctacaaccacaaccagtgccttccatttgaaggctacttgaagaacaaacgttgtgattatgtaagactctactttaggcataggaatcatccatcttattaagaagctccttgtgcagttgtatattctttaaagaagtaaacaatttttcaagacctccatctacagtacctgtaactttcagcttttcagccccaatggtaatctcatcttcatctgcagaaaacagcaccctgccatcttcactggctctcacttcaaatcttttacactgagcttccacagcatcagctcctatggtcagaggaaaggtttaaaaatgaaactggtatgcaggaaaccattaacatgtattttttggaaatagactagaaatgcatatattatttaatttgtttatctctgctgtatgttttgcatctgagttagtatctttaaattgtcaccattttcaggaggctaatttgggaatgtacttctgtgctaggctggttaggcatacaggtgacctctggatgtctgacatagcatgtgagtttagccagttaagagcccttcacatatccacaaaaagagacaatgtttgctttgttctctgttgcaggctgaaaccttggcatcatacctggcacctgctggatgcttaataagtacttgtggactgagtgactctcatgccttacctctgcagtgtagacaatagtacccatgcttgctacatcacggaggacttgttaagcattattcaattatgaatctttagctagtctacatgtcatagattctaatattgatgttttctaccctttaatataagtgaattttaatccattttatagtacatcttgaaattatatatataatttccttagtggtacctaatgtatcttccaatcaataattttcctgatttattgaaaaacggtattaaataaatgtaattacaaaaccaacttactggccaattctacacactgatctatacacaaaactcaaagccagcttccatatttagaaaacacaattagtttgagtattaggctttggcaagaaaatctaactgggccttgaaggtgaatgttaactgaggaggaagaaatttgagataatggccagcagtaattcatcttcccataattcatattatgtccaaatttctttggacataacacttttggcatatggatctatagttcccgctcctattaagataggaaaccttcctcctcttctatttatattaaaagctcttatcagatagaacccagctgagtcagggaagtaggaatcacacatgtggggcatagttcttttcatttgtctttatgtattcactttatttattagatatatgacacccaggagctcaaagcaggacatcatctttgtattccaaaacatccttaaattgggagatgtgtcgcttctagtagcaccagtagatgaatattaaatagatgaatgaatacttaagctttcatccattcattggtccctaaccccacctcagcactactcccagtgctagccaataggctgcaaaaacttactcctccccatcatcatagctgctgaggagcattcatcaagagaaaaaataatttaaaaccctaataacatgtaagctaatttctccaaaagccatatgtattttttttaatattctgaaactacatacatgcttccaggaccacataaaaatttgaaaagcttcaactagggctatgctaagtaagattaaaactaatgttaaacttttgggctgtaaagtttaaaataacagatttttaaaaatagaattcatgctttttaaaaatttttaaataaatacctttccttatataatttaatgaaaatatggaaaccattgaagacctattgtccttggtcatagttgttgcatttgatcttgaaaacattatttcgacagcttgtattcatttgagtgtgatttgttctaatcatagtctaatcttattttgtgccatagacgacaatgagccatagtaatccaactattgggtgatgttcaaaaaactgtgccagaggccaatgtgttaatacatgtgacttactctgagggacccaggcacacattaaccctgaactgcctgaaaggtattatagatatcttacacataaaacctcaatatttacagtacattgcttccttcaaatatactcagttgctgagcataattgattctcaaaatatatcgctgactttaatggcatagatgtacattagacaacattaaacacacacacccacacacacataataccaagacttttcttggcataacacttaatgtcattatatgaaagatacattattaacataaacatgctatattgcatgacatataaactgttagaaaaataagtggagaggtgtctggatatggtgaagtgaggtgaaaccttaattcattaaatgtaaataagcaaaggcaaataagcaaacaagaaaatatttacgcacatagatgagatgcatctaagccataaataaatgcatgcagagtcatctaattgaaaaagagatataaaaattcatactgcagactacactttattcatcatattagcataattacagaaggcaaaattacaagcaattagcaatgcattgatagtacataaatattctaaatcagaaaataattttgaatatattgcatttatacattgcttttctttcctgcaaatggaaaatgatatgttcttggggatatagtcaattattagggatatttatgcttaaagttaatatattaggctttatgaaactgattttattatattctaagatgcactgtgttacttatctgtttttcatgtaacatcacatgttctctaagataggtcaaggcaggattcagttacttagagaagcaacaatgccccattcaatcttaatccaccaatgatgctgccagtgttgcaggaaagcaatgtgtctagatgactctgggtaaggagctctgattccttaacaagtagatcataggtgatgggattatctgggtagtgctatattttcttagtcatcttaaacaccaacttgctaactaaagtaccaagactaaacacttccttaggaacatctctgagaaagtttatgtcaataaactcacaatcaacaaagagaagtcaaggatagaagaaggaaagagaattggcaagaaaaaaaaagatgtaagcaaaataataggttccataaaaagactggagtattagatatatgtgcaaatattttctctacttttttaaatgttctatatacattcttaaaagaacaaaccaccaccatcaccaaggacaagcataaagccaatttcttgcttctctcagagatggctccatcactttttttgaacattcacatctgttgcagtcttaatcaacagccaaagtcatctttggctgacaaagagagataattcagtaatttaaatactggtctttgtatgttctacagtacatcggtcaaatacatgaattggaaatttttcttctattacataaaaatcttcaaagaggctcaaatatatattttcaagattcctcttggtactatttagcagtaattcaaggaaaacaaaacaaagataaaaatggatatagctgcttgtttctagtgtgtcttcctcaaacttgtcatgatcatcctttcttttctatataactcttcactttaatcttagatgcctgtcagtattttcaaggccttgaagaatagtattactaaaagattcaaaatttccacaaggaaaacaaaaatgagattcaaaattaccaactaaattctatattcagaaattcctggtttagaattgctgtgggccaaatcagtcaaccaaccaacaacaaactaagtttaaaacaaaacaaaataagctgctttcatgaaatataaatataaatatacactgtaatatggtttggttgtctccccacccaaatttcatattgaattgtagctcccacaattcccacatatcatgggagggacccagtgggaggtaattggatcatgggggcaggtctttcctgtgctgttctcatgagtgtgaataagtctcatgagatctgatggttttataaaggggagtttccctgcacaagctcttatcttcccggctgccacgtaagatgtgacttgctcctccttgcctgcagccatgactgtgaggcctccccagccacgtggaactgtgagtccataaaccgctttttctttataaattaggcagtctcaggtatgtctttactagcagtgtgaaaacggactaatacgcattgtgagttcttttattttaccctatgctagtcattaagaactcattgtgcaacatttgcagaaaatctgttatatgagatccctggaaaaggaattgcctactttttctttactttgtccctagattttccaaacaaaacttcaagttaaccatttagcggacttactatatgctaggcagcaatggaagcattttacaaatataaattaattaatttaatcctcataacaatcatgggaggtgatccctatttgaccgatgaggaaaccaaggcactaagatttaagaaatgttcctaatatgttatacgtaatgcactctagagttaggattcaagccaaggctgtttgagtactaagtcctaagtgctaagttctaagagctaagggagtctttgtgtggctctattatattcctaacttttatacctcctggagaaggtacaacttgacattccacaagattaatatttgggggaacttttttgctaatgatgtataacaaaattaaaaataaatttctgaagaatgtatgttgactcttccttcctctgccagctactgtctccccctgctcccagtaccccatcctcctaagacccttggctgacaaccttcttgaaagcatcttattgaacaccattttcaattcctccattcgtagtctccttaaagccaactccaatcaggcattatctcgtcagtattaccagtaacttccaagtcagtaaattaaggggccaatccttgattttttaccttacttgatcttttaggagaatctgacacactttcatttacttttcctggaaatctttgcctcactggctcccaggacatccctctgctgcttcctacctcctttgtcacccatgtccatctcctttaccaacaacacacttcctgtagccagtccacaggggtatgtggggctggctatctttcgctagtaattgtccagttctgttatgagcattattttctctgaccaaagcaattgattcaagcataagcagttgactccaacactctcttgatacaagttttgaaaaagaggcatatttttgtaagactataggtaccgagcatgatataaacttggagcttttaaggctagctgtacctccatatggatgcagtctgcttgagaattcatccagttagtgaaaaaagaaagaaagggctgaaaggcagagaccagcatagaaagacactcttggagaaattgctgaaacagctggatggagtcagaaacaaactttcctattacttgaatcagtaagttaaacaccccaggaatacttgaatactttgtaaattttaaattgggttctttcacttgattttttttttttttacttttcctttattctttgagttttcatatattattctctgtatctctcatcttaacctttattaaatagaagttttagaaatcttccactttcaacaatcactgcatctccccccgcaccgaatccacacgtacaaatcctcagtatttaattaaaagaaaaaatatgctctagcatttcctgaagtaatgctgtgaggaaaggtacaaaaacattctgaggtgaattttctcatagcctttgtattaggtaaactacatttctatttagacaatttcaaacctgatcttaatggcataaatattatatttctaacacttgtattcttagatctttttattcctaaaataataatattaataaaggaattgtgtgactacctagcaagccatttaataaactaacaccaggaatgtgatattcattcctgggcctggcctctatgaattttaagaggataaggtaaaaatgatctctctatccacttctattgactacattgtctaagagaagtgaatgcagatggcctcaacccactgttttatttaagggtcccaatggaacaacatatgtacaaaatattgtttttacattgtatacaaacataaaatggcaatatttccaaactgtagctagaacaaagttgacgggtgagacgttattttgtaaatattttttacacctcatagtcattcaaataggtacacgtcctttttgactcgttaagaaaaaaatagaaacaaaaaatggcatgtcacatgcaatgaacaaatactatgagaattattatgcaagtgtagaatcaatgaatacttaaggaatgaaaggagattgtgattaactgcatttcaggtcattacttttgaagaaaaaaaggataataatcctagtgtcttctggtaatctcacattcgctaaattcattttggcagttgttaatgtcaaaaatgttactgtataatttatggaaggtatgtgggtagaaggtggaagttgcaaacccatttcttgaaaatattttactaaaatgttttgcattgcatcttgttactttttatttctaatatgtgtttcattaaaaaaaaaaaaaaaaaactaacacctcagaatttttttctttttctcatttatcatccctggtcttcggctacattttgacacatgtatcagggtagttttgcataagttgttcatacttcatttttctttctaccatgcattttctgatattttgtttcaaataacatcttaaaaagagatcttcatgttgcactttaaacacaattatgaagagttggtgcaaagttttctaatttatttttatgcatctttcctctaaactatatgtaacataacttgtttagttgcagaagtaaaatctgcagatgtattcaactggtagtataatctcctagtaccaattcagtacaagttccacatgaaatttcaaattttttctctattttaaaaatattctattttgaatatttatcacttaaatatcatactgaaaggcattttaaaagtacatatatttacattttctaacataaaaaatcgtatacagaaaccattttaaatggagaatgtattatctcattaaaatgttatcaaagagtttctatcttttcttgagtacctcctaatatatttatttatcctaccacttatgccttttaataaggatatctaagctatgcttattgacatttagtttttatataaaaattattctatgtttcatcttgataacagtaagatttcttgtttctgaaattcatttagtggaaacatgcttttagtgtcataaatcagtgaattaaatgctgaacaagaataaatgtcaaaattaacaatttaaaaaatcctattatataactgtttcattacaatatcttaggcaactgcgttactattttttttatagctagtgtatatggaatgcttagaattgcttgctttgaagagtattatttgtggttcccaaagaagtatcacagaaagtctggtttctgaaaaagatgaccagataaggtatttgcattaaagctcttatataacaaatgatgacctagtgttttatgcaagagaataatcttccaaattccacacaacaaagacttattttttgttcatgcccatttccagcatgggtcagcaaacatgctttaattactgtaatcacctacaaattcaaatgatgaaggctttatctcaacacagtctttcaagattgtggcaacaagagaaagggatatggccaactcagcactgcctcacctttcatttggaaggaacacatcacattttatttcattagcaaatgaaaattacattgcctggtctgtttttagacatgcaggaatgaataatcccactgctaaactgaaaggattattggttaacagcacgaacggcgccatgcctctcaaaggccatggtggaaaaatgaatcttggacttattttctcatgtaaacagttataaaactgggcaaaatgtttgttgtaattgtctttcagatattagacaaaagacaacaggatggtgatctctgaggcaaagaaatacaacgtgtactccacattcattacatcgttttcctaaggaccatttgcaaatcacagtacagggaaatagagcccatcggtgttggcagctagcaggaggagagatgagatttcaggaaattgatatggacagaatttgtggggcaatgaaacggagaaagggagctgagcttacaaggctctccagaaaacttataggagcactcttcaatctttgtaaaaaggctgcattgtacatggacaggatgataccatatgataattattagataaagactactagggaatgtgtgagatgaacaaaggttatcaatgcaaaattctagatgttgggcttccaaccagagtgttggtatttccctaagcaccctggacatgaagttgaggcccctgagtgccacagtttagaactaaaactatttagactgtaaaataataactattttagattcagtctagaaagtctaaaatcatacttgaacaggagcaagctgatatgctaataaactaacttcctgctttgagagttttttttttaagagagacaacaacgtttattctttcctaaaattactagatgtgcaaaaatgtgggaaaattgacactaaccaggagaaaaatcagcaatagaatggggcccagatttgctccatatgctagagttagcaaagatatgaagttattataaacatgttcaaagatgtaaaggaagacggacataatgaatgaacagaagatgaatcctagcaaagaaattgattttaaatgtaagaaaaaagaaggaaaatgaaatgcatagggctgaaaaattcaatatgttaagtgaaaaaaatcagcaaatgggactaaattcgcgtattataattccttctgaagaagaaagaattagtgaacttgaaaaggtgtgtataacaactctccaaatgaagcagcagagataaatgaagactaggaaaagcataaatacaacgtccatgagcctgtgaaacaagtaaaagaggcttaactaaaaagccaatactggagattaaactgaacattaaaaagtactcaactgatgaaatggagcaggaacagaggataaaataaacaaaagatagaggagatgtacaggaaacagagcgagatgatagacaaatggaaacatatcaataattgcattttaaatataaatggacagacactaaacactgccataaaattcttacaaaaacaaaaatttaaagtttacaaatcttacaagagatatatttgaaatataaaaacagacatgctaacatacatgactgcaaaccttttaataagatattagaatggttatattaataactgctaagtaaacctcaaatcaaggaggataaagagttttaaaaagctactttgtaatgagaataataatgaaaaatagagtttcaaacaacatgaaaagtaaaacaaaatatatagaataaatagataaatccaatccaatacaattttcatacttaacttaaaaattatacagacaggtaagtgacctggaatagttaatacaatctttaaaaagaacaaaattgaaacactttacctgttttaaagacatactatcaaactacattaatcaagacactgtgatattgcataacgatagaaaatacatcagtttatcagaataatgagtccataaacagactcaatgcatgtagtcacatgtacatggttcaactgattattttacaaggatgccaaacaattttctggagaagaaaatgtgttcaacaactgtagctgaaacacttgatcatacatgtacttctaatttaaatttactggtattcctgacagagaggagactgaatgaaacacacaaattcataatgaaataatgaaagacacaaactcaagaagttcaatgtatgcccagcctactcccaagaaataaaatccccacctaagcgcatcttagtgaatatgcagaacaccaaaataaaaaagaaacaacactgagaaaataaagataaattaccttcaaagagcaatatttaacctaatactgacctctcaatatgaaacggaaataaaatagtggaatatggtgtgccttgccagggctgctgtaataaagaccacagtctgggtggcttaaacaatacaaacgtattgtctcacaattctggaggctagaagtctaaaacaaaggtgtcagcataaatgcttccatcttaaaggctctgagaaaaggatttgttctggacttcttttcttccaatatctcttgacatcatcttcccttttgatggatctgtgtgtccaaatttcctgatttttgcaaggacaggggtcatattgtatggtccaccctattaatctcattttaacttggatatttttattgccaaataagaacctataccaaaataaggatacattctggtactgaaggttaagacttcaacatattaattttggggtgggttgaggggcatatcattcaacctataaaatgtgtcttcaatgccctagaagaaaaaaatttttaaatgccaatctctaggattttatgtctagcaaaattatcatccaaggttgaatggccaaagatatttacagactaataaaacctgagagaacgaatcatgaacaaatttatgtgaagaaaattataaaggactattttcataaaaaaggaaatgaagacagctcaaaaatcagagacatgggaaggaattctttttaattatagtggaaaaatatgagtagatgtaagaagtactgaatataaaaagcaataataatgtcgtagtttgagaaatatagagaaataaaatgcccataagtaatggaatataaatttggaaaagaataaattagaggttatgcattctgaggttgcattatccccaaccatcttaagatacaaagtaatagactttggtaaatcaaatttttactttttcttttggcataactactaaaataatagaagaatctaaattagtatgtttaaaaacactattaataaaaacaacatgcaatccaaaaaatgctacaaggcaagagaacaaaacaaaaaaggaggtagaaaaggagattaaatactcaaatatgtcactaattacactaaatacaaatggactaaacactccaggttaaaagtcaattataatctagctggatataaaaccaaatccaatcattggtagtttatatcacacaagactaaaacataaaattcaaaaataattaaattgatgagataagaaatgatatattatgcaaataccaaatgaaactgtactggtatacctgtagttacaaagcattaatatatctattaggtgttattccataacgacaaaaactagaatcaccgtgaatctatttcaaattttgcatcattatgaatgtatgattttcaaaacacaaagcaacattggaccaaagaacaaaaagaaattgtcaaatcctgaatcttaataggagattataaaatgctttctcagtagtacaaacaaaaaagtaaataatgaaacaaaacattatcatcagtgttagcatactggtcctacacagaacccttagtccaacaatatgccataaagtacttcttttcaactgaatattttacaaggcaggttataattctggcataatgcaaattttaacatattacatcatggaaattacaaaactttttatctggccacagcataattaattttgaaatgaaaaacaaaaagtaactaatttttatgtttataatttaaaaactttaaaataagccatgagccaaattctaaataactgtaattagtaagtgtttcaaactgaataattacaatattattgtcaaaacttgggaaatattaccaagtcagtactgacaaagaaatgtatgtcctcaaatgactgtattagaagtcttaatattaatagtccaacatttaagttgagaagttagaaactaataaatataaaaggacaaaaatataaattctcaaaatgtatgcagtataaactctcccccaccaggttactcaagggcatatgtccattgcttggatcaggctaggttcaagtgggtggggggccaagaacacgatacccagcctaggagcaggtgtcagaccccaaacattatggagagtatctgagatgctatcaagcaaaactgtctcattgctaaaccatagtagacaaagagccagaaaattagctgaaaagcaatttggagacaggaggcagtgaggatcttgaaagctctcctgttgccatccaggagtgccttgtatgtaagtcctaataaactcaagaacacatcaaactggacttgtccaagtcattctttggtctctgagctccttcctactttgggagcaggacacgttacatcaccaaggttttgtgtaacggttggtatacagacaaggatcgtagagagtaagcgatgagtcactgggaaggagcatctgtgggggaaatcctggagtggtcagcaacatgcctgtggggtggagttgcctcgctgcttgacttctgtgggttgccagatgagtatggggacacttggaaaatgccagtggggactgggcacctattgcaaaaagctacgatattaaccataagaataccaaatgtgctgttgttgcaataaggctggctactgagagcagggaagggagaaaggattgaaactcctgcaaaagactgaacgcatgacaggttttctagaactccagattgttacatattacggccctttcttgtgaacataatttaactgatgagcaagttacaacaacaacaaatcagcgctcaaacggttaacctacaagtatagagttaagtaaaatcttttaaagctatctgtttccttttttgtttgtttgtttgtttgtttgtttttgagacggagtctcgtgctgtcacccaggctggagtgcagtggcgccatctgggctcactgcaagctccgcctcccgggttcatgccattctcctgcctcagcctcccaagtagctgggactacaggcgcccgccaccacgccctgctattttttttttttttttttttttgtatttttagtagagacggggtttcaccgtgttagccaggatggtctcgatctcctgacctcgtgatccattcgcctcagcctcccaaagtgctgggattacaggcgtgagccactgcgcccggccctctgtttccttttctatctgctttgaatctgctgtttttaaactactggtcttgagataaaactcaatgttactgccaattcaaggccacttggagattttatttttcttttttccttcttttctttttttttctttttttttttttttttgagacgaagtctcactctgtcacccaggctggagtgcagtggcatgatcccggctcactgcgacctctgcctcctgggttcaagggactctcgtgcctcagcctccctagtaactgagattacaggcatgagccatcacccccggctaattgtgtttttgtggagatggggtttcaccatgttggccaggctggtctcgaactcctaacctcaggtgatctgcctgccttggcctcccaaagtgctgggattacaggcttgagccaccacacctggctgattttgtttttcttatacagttcagtcagttctagctaaatgtaaatattgaaaccatttgaagctaaaggaaataaaaagtaaaagaggtttttagaatacaactgctatagcaactgccttactcaaaattttggtccatagccgtcattagattacctattgaggctagcaaaccatgtaaacaggtccaaattttgttagaaataatttagatccagctgtcttttataaaataatgagtttatgatgctttctcatgactagagttctgagataaaggctattggatgtttgtctgttggatattttgataagcaagactaatttgatactattggttaagtgagaacagctgaattttctgaatcaccagcaaagatgcccatgtgtttaaacttcttgcttaggtaaacacctgatattcacaggctacacaaatggttaacaggagaataacttggaatgatgactagttttgtctaatgtctaggttatcatgaataatacagataaactgttaaagataaataaattgagtaaatgtaaatgagataaatgcttacaggagaaacttttatgtacttcaaaagcttaaaattattttaggaactcattaaatgtctaggtcatttccaatgtaaaaagggttacgacatgaggcattggtcacacttctgagcccattaatgggaaatcagttctgtgataggaggaaagcactggcagacctcattgagctaaagacaaggattgagtccataaggtaatcaggaaacaaaaaggagatggatgcttgtacacttgccccggccaaggcaggcagtaaatgtaaaacaatattatctgccagggggacactctaaaaccacccaaacaatccagaaattatgtaagatacaaattgtcaggtcagcccaaagcccccttctcaacagtcccatgtgtcctgtgaaaaagccagatggcatctagagaatgacgggaaattatcataacctaagcaatgtggtgccccctgtacatgcagccgtatccaatattgctcaattgttaaaacaagtggtccttaggctggaaagcatccacactgtgaatgacttgggctaataccttttctagtatccctttagcagaagattcacaagaccagttcgcctttgcttaggagggcctacagtggacttttcaggagctaccacaagggttcctgcacatccccactgtctgtcacagtctggttgcacaggacctgtctagactctctttgcccacctcagtctccctgtttcactatattaatgataacatgctaacctcagagtctcttacaaatcaggagactgctctacaaatagtcatggatggcgtaaaagacaggaaatgggaaggtaatccccaaaagatacaggggctgagcacagtcatcaaattcctgagagttcccacttgggtaagacatgtaacatactctaagctgtcactggtaacatggcacacagcagcctgttccccagacagaaaactaactccaggtattcctatacttactgggctgctagaagatactcattcctcacttggtataaaccctctacccattatacaccccaataaataaaaagtgaaaaaaaatcatcactggacacatatagagcaagaggtatttgatgaaccaaacatattggtgaaaccggcccaagcactaggggcctctctgccacagcactcttttgtattagaagtcaccagagatgccaaagggatatattgcgatttgtggcaaaaataaccaatgagaatggtacctgcagggttttggtctcaattatggaaggaggcagaatcccaccatacagtcttagagcaacgactactggccatgtatagggcaatgcaacaagtggagcccatcaccaaaaacagtctgtcacaataaaaatcccataaaagggtgagggcgagttgaaggcctcctagccaagcccacctccagggtggcataattacacaccctgcagaaatgacacacttatctataacaaaggagtgtcctgatcactagtccttcaagcactgcaggaagtgcttggacctatccactctgaatgcggggagggggccagcatggcagtggagccacctaccaggccaaccaccatatggggaccccactaataactctagggcctggtacgctgatgggtctagaaagaacgtatccaacactgagcactagaacaaaatatagactggaagtcccatttatcatataacccaacatgcgcagtctcattgaagaaaaaaaaaatgacctgttaaaaaccgaattgccagtactgttccaggagtgctctttaaggccctggactaagaatctccctaaagggatacaaacttaaaataagtcacctactaccacacatggcatcactccctatgaaggtttgtcatggcctttaaaacaggcctgacaaaccctcagggttacctctgaaactccaagccatgctcctgaagcaggtggccagactgtgctcctgagaacaccaatggatctgccaagtggcgatggctatgtgaacctgaatttgagctggacagtgcccccatactagattggttttacggcagtggggagtgccatgaagactaccagaagggaggtggttccagctatacttgatagaaatctaagaggcttacaatatcaacatgaggcagcaccaatacctgtagagcagtcatagagtcgataccgtttgcaaggcctgaatttagcaagcggctattatgccccctcctagggagggaagccatgtgtgatagtctaagccaggcctgaggcccacagtagtctccctaatagggccaacgggagaaaacccaatggtaataatgttacaaaaatggatacatttatgagggtccctactaaatacccgtgttttcaaccataggtggttattcttcctaccttgggagctgaaaatatctttctgaattggtctgtgactacaacagcaatcagcaacaagttcaattgttgggtatattgatacctccccctatcaaatggtaatggtgtgccttaaaatactctgcttttctaatgacagaactaaagtgactgtttaaaaagaaatagtaatacaactcagactcactggggattgcatccacccagaggtaggtgggcatcccccatccccaaatcaacagagaaccaacataagctcttaaaggcgttacctgttgatatggtttggctgtgtccccacccaaatctcaccctgaattgtaataatccccatgtgacaagggcggggccagatggagataactgaagcatgggggtggttccccaatactgttctcatggtagtgaatgagtctcacaagatctgatggttttataaacgggagttcctctgcacaagcgctcttgcctgctgctatgtaatacatccctttgttcttcctttgtcttccgccatgattgtgaggcctccccagccatgtggaactgtgagtcagttaaacatcttccctttataaattactcagccttgggtatgtctttcttagcagcctgagaacagactaatacacctgttacaattatagccctgataaacacagtaattttacaaacaccttaaattatttgttaactcagagccatgagttaacccaattaggtttctctgactcattctcaaattggttacatacctaacctcaaattggagatatgttttactagcaggcatcataaatatagttagtttctcctttgcatgctgctatgtatactgtatatgtggcctgtacgcataagccatgggtacacttataggcctgtatagttcttcctctcatactctactcagggactctgacacaaaattgggggaaagaatgcaaaatctagagaacagtatggattgtagtgctacagattccacacaagtttgcttaagggcatatgtccactgattgaaccctgaaggctgtgcagtgagccaaggccatgatgcccagccgagcagcaggtttccctgagaatccatacatcctggagagcatctgagaaccaaccaggaaatccagtcttattgctcaagcacagtaggcatagagccagaaaattagctaaaaagcaatttagagacaggaggcagcgaggatctccaaagctgtcctgttgccatccaggagtgccctgtatggaagccttactcatctactcatccagctggacttgtccaactcattctttggtctctgctccttctcaatctgcagaagggaagagaatattatagtacgaaggttttctcataacaatgtagatggaaaaaataataaagacaagaaaaggaattaatgaaatgaaatatagcataaaatttgttagatcagtgatgacaaaagtagattataataagcaataaaactgactaatgtatggccaggcatgatggctcatgcctataatcccagcactttgggaggccgagagggggcggatcacctgaggtcagaagttcaagaccagcctggtcaacattgtgaaaccccatctctactaaaaatacaaaaattagctgagcggggaggcaggcacctgtaatcccaactaggtgggaggctgagacaggagaatcgcttgaacccaggaggcagaggttgcagtgagccgagatcgtgccattgcactccagcctgggcaacaaagagcaaaactccgtctcaaaaaaaaaaaaaaaaaaaattactaatgtgtcgtaaagttgattaagaaaaaaattaaacatttgcaaataaatagtaataaaaaacacattattacaaatattacaggtgttaaaatggtacaaatatttcatggcaacattataaatctgaaaattttgttgacatgagtagatgcctacaaaatattgccaaattgacttaatcagaaatagaaaacctggatactcctgtagtattatagaaactacagaaatagttaaaaatttttacatgtacacacacacacacacacacacagattctaggttttcaggaagaaaatgatagaaaatcataactcttcttgagaacagaataaaaatgggaaacactctccaacagatttcatgaggttagtagaattttgccacaaaactcaacagagatagtacatgaaataaaaattacaagataattttgctgataaaataaaaatcctatgcacagtatctgcacattatatttactctgggaatgtaaaggtggtttatactagaaaatcattaaatgttttaactaccttgagagtttgaaagagaacacggaatattatctcagcatagttacaaaaattgtttcacaaaatttaacaccacccatgagaaaagcgtttaccaagcttgccagcttaacctctaatctacctatacgtattaaacacttgataataatgaaatattgaaaggtttccctgtaaactaagaaaggagaaaacaatgcctattgttaagttatattaagcattattctggaggtcctaaccagaggaataaaactagaatggaataaaagtattgaatatgttataagaattggaaagaaataaacaaagctaaattactcacagatgaaatgactctctatgtaaaaaaattccaaagaatccacaaagaaatacttatagttaagaagtgaacttagcaacgtctctgaatacaaggccaatatataaatatcgattttatattagaaaacgaaaggtaaatgatgctatgtgcattatgcacaacagaattacaggtaaaaccatcatcattttcatataatgtaaatttattccacgagtaacaaagaatcttaaaaaatcattctaatgattaaaaatttaacaaattccagtatatttaagaataagtactgattttaggattttgatctgagtgtagttttacatgggcaaatgtgtacagattatctgtgatctcatatcagcaggagctaaaatattcccacccccaatagcatctttataactcatacacttatggcctggacataaattagaaaccaagaagcattaatttatcttgaagtcatatttaaatgatttttagtcttatgtaatccagagtattaattatcaatcaattgaaaagttctttattaaacatccactatatttcaggcattattaggctaaatgataaatgtattgaaatgaataagatataaagtttctgtatcaaagaagattattatatattggaactactaaacactgtacagagctgataaagccaaacctacacggattgtttgattatgttatcaatgctacttcctcactagaggcatcacagtcaagctatgggtcctcaaaagtacattatttaaaagtatctagcatagttttggactaaaaacagatattttccaaataaaggaaagcagtgtttaagaagagaagtaccttaaactatggtttttccatatgtgggcttaatctttcatgattttggatcagtttacctgatattactagagcaaattttgtttaacaaaagtgcccctctaacttaaaactataccagaatacattagagcatgaagatttagtatcttataaaatatagcaccacaacacttatgattggtatagcaataaaattttttatcattatgtctctatcgtctaatattgactaaggggtagtaattttgttttttaattagactttataacatttaagtttcttttcaacctttataatacagcaaatgctttagttatgtatttgtactacaaaatttttccacgtcaagcattcaatcaaatctggctttcacccaggcacggtggctcacacctgtaatcccagcactttgggaggccaagaggggtggatcacgaggtcaggagatcaagaccattctggttaacatggtgaaaccctatccctactaaaaagatacaaaaaaattagctgcacatggtggcacatgcctgtagtcctagctactcgcaggctgagggagaagaatagcttgaaccagggaggcgtaggttgcagtgagccgagatcacgccactgcactccagcctgggcaacagagcaagactgtctctcaaaataaataaataaataaaataaaaaaacaaaaaatctggctttcattctcattactcagcttcaattgatctaatcaatatctaccatatactttattttttttcaaaattcagtggcttcagacctcatttcatgtgatctttctcactagcatctgactcattcaaaaactgtcttcttccttaaaagctcctctcatagtacttttgtgaaatcatattctcttgacttttcttctatcttactacccattgttttgttttgttgtgttttgttttgttttgttttggtctatatccctgctcactcatcgtctttctattctctaaatatttacatgtcctggagctcacagtaaagactcttaaactgtgttgtatgtaaaaagtctccagcacaaaagaaaaacaaatgaaattgagcagaccccttctctacttatattcatttatcttggagttctcatttaggttcatggctttaaataatatctacatgttgaatcccaaattctcaccatgtccagtaatattcaccttggaatctgcgtttctaatcatatgattagtttggatatctaataggcattggatgttagtttgtcccaatacaacctttgagttgcacacacttgccaatttattttttccttctataatcctcttctcagggaatggggccacagggctccccagtaatttagcgctctactactagagttccttgtctcaggttccttttctgtaatgacaatgtgaaagcttggctaacatgccgtccagtaaaacagcttaaaatcattttgaaaacaacaatttaatgtttcaggaaatggtctaaaggacatgcagcaagtgaagaaatatttattgaagaaaattttttaaacagcagaagcagagagagactgtatcattttagccatgaatctctctatttccttcccaccccatcctaatgtgatggaaattccactttatgtaggtgcagccaagaacacaggaatccttcttcatctatgtcacagtattttcccagcagagggagatgtcaacatttcttaaatccatggccctggccctggttctttcataggatggagggtccaggccacgataggctagacaagaagactaaaggcactccccaacccctactataacaagtgcttagttcctaagcagagattttactgagagagaaacttaccactttttctgctttcggatacacagctatagtgcagacattttgcgcaaggagagaggcaggctgtaaaacagggggttctgaagcctattcaaatgaaagctttatttgccacagtgctagaagaagttcaaacctaaaagtactttataaaataatgttgtgatgaaagtaattaaaaggagaccaaaacttcatcggagacatattgctaggctacagggtagctagtttagtgagagagccaggcaaagagacagttaagagctctgagtcagaacaaatttcaaaactgagctgagaaactattcctggaaaaaagttgggatttaactgcatcagtccatggagcaattcatgccccagatcattcttgaaaacaattgataaactctaccaattgctggctgattatcagctgggtctgggtcagggaaagagaagtcaaagagagcactgtcattctaaggtggctgagtacacatgcctaagactgtaccctctgaggaactgtgggtcagggaagaggcaaaggataaaaacagactttaataaattaatccagttcatcattaaacaaacaagtaaacaagttctaagagttggggagtgaggaaatccagagttgggattatccagatttctcaaaatatgttacctaaattttccaatgttcaacaaaattatgagataaatgttttaaaaacccgagaaaagtctgaaccatagatgaggaaaaaagcaggcaacagaaactgcttgtgagaatgagcaaatgtcagacttaaccaagaattcaaagtaaactttataaatatgttcaaataattgaagacaactattttgaagaattaaatgcaggtgtgatgaaatgtctaatcagatggagaatatcaacaaagatataggaattataaatgaatcaaatgaaaattctggagttgagaaatatactgattgaaaaaaatcactaaagtgttccacagtagatttaaactggaagaaaaaaagaattaatgatattaaagataatagagattataaaatctgtagagagaaaaaagaatgaaaaaaatgacaactgcaggacaccattaagaatgtgaacgtgtgtgtaataggaataccggagtagaggaaaggagaagaaaacattcaaaaaagtaatgactaaaaattccttaaagtttattgaaaaacaataaagtacacattcagaaaactcagagaaattcaaataagataaacacaaagagacccacacatggatgcatcataataaaaatgatgaaagccaaagacaaggtgaaaatcttgaaaggagcaagagaaaaatgactcattggttataaggaatgcttaataaggttaacagctggcctctcatcagaaacaatggagaggaagtagtaggacagcatattcaaagtgttcagatttaaaaaaaaagtcaaccaagagttctataggcagcaaactatcttttaaaaatgaaggcaagataaagatattcccagataaagattgagcaaatgtgtttctagcagacctatgttataagaaatagtgaaaggaaattcttcaggcagaaagcaagtacattctgaaagtaattcaaacttacacaaagaacctagtaaagagagttataccagcatcagaaacagaatacatgcatatttcttctcttttcttcctttgtgtgatttaaaaggcaaatggatccgtacagtaaagttttatttggccttagaaaggaatggagcagtgatacgtactgcaacattagtaaaccctgaaaacattatgtttggtgaaaaaacccagtcacagaagactacattttatatggttatatttatattaaatgctcagaatataaaaatctttgaatgcagaaagtagggtagtaattgcctagaggggtgggacaggtctgtcggtgctgagagcgaaagggttcagagtttcttctggggataatggaaaaattctgaaattgactgtggtggcacaattctgttaatatattaaaaaccactgcattgtacatttaaatggatgaattgtatgatatgtgaattatattccaataaagcagttaaaactcttctagcaagtttcattgattcatccttcaacacatatccaaaataataatcccactttttccagatttcttgttttttttttgtttgtttgtttctttgtttttttttgtttgtttgttttttgagatggagtttcgctcttgttgcccaggctggagtgcaatggcacattctcgtctcattgcaacctccatcacccgggttcgagcaacctccatcacccgggttcaagcaattcttctgcctcagcctcctgagtagctgcgattacaggcacctgccaccacgcccagctttttttttttgtatttttagtagagatggggttttactatgttggcaaggctggtcttgaactcctgacctcaggccatccacccgtctcagcctcccaacgtgctgggattacaggcgtgagccactgcacctggcccctcttgtgtcttctttgtcaaaaccactatcatctataatctgggctgctgaaacgccaatcttagtgggtaactctgctttccatcttgttgctttacttcccaatatatcttcttcacacagaagccagagtcatatatttttaaatgaaaatcaaactgtaagccttttcgtttcaaatcccttcaacagctccttatattactcagaacacattctcccttttcaacacggtctggaagacctctctggttcttgcttctctttcagtactcatctcaatctctgctttattcccaataatccttttgccatttcttaaacacaatgactttgctacacacacaggcttttacactttctgatccttcaccctgacatgttctcagccggatcttcgtgtgctttgctcattgttttatttagcttttcataatgagccgtctgctcagagagctcagccctgaccactgtcttcttcctgtgtcctctctagagaaacttgctatgtcctttacattgttggtggccttacctgaccatgatatctgaaacaatcccattcctcccatcacttttttccactttaacctgctttgtcttatcacttttgtttgcttggctatttttgaatacctcactaaaatacatgcttcattacttccaggatttgtatctgtcttgctcatctctgcatcttcagtgattaaaatgtttctaacctgtaagagaagttcaataactactgatagaaaatttgtttatttaataagcttcttccatttagcataatgtcctttaggttcatccatgttgtcagaaatgggagaatctactttttctttctttctttcttttttttttttttttgagacggactcttgctctgtcacccaggctggagtgcagtggcgccatcttgactcgctgcaagctccgcctctggggttcacgccattctcctgcctcagcctcctgagtagctgggactacaggcgcccgccaccacgcccggctaattctttgtatttttagtagagacggggtttcaccgtgttagccaggatggtctcgaactcctgaccttgtgatccgcccacctcggcctcccaaagtgccaggattacaggcgtgagccacagcaccccgccagcggaatctacttttttaaggctgaataatatcccattatgtatgtatgtatgtatgtgtgtgtgtgtgtatatatatatatcaataaagtgtgatatatatatatcacactttcattattgatacgtctatcaacagacacttccaatgttttaatatcacaattcaatagtgaatactggtgcaatggacatgcaagtgcagatatctttatgaggtggagaattaatttcctttggatatgtacacagaagagggattgttggatgacatataaatcttctcttaatttctttttttgtttttttgagatggagtctcgctctgtcgcccaggctggagtgcagtgacgcgatctcggctcactacaacctccacctcccaggttcacaccattctcctgcctcagcctcccaagtagctgggactacaggtgccctccaccacgcccggctaattttttatatttttagtagagacggcgtttcactgtgttagccaggatggtctcaatctcctgaccttgtgatccacccgcctcggactcccaaagtgctgggattacaggcatgagccaccacacccggctaatttatttaagaatatccttacttgttccacactggttacatcaatctacattcccaccaaaagtgtacaaggattcccttttcgtcacatcctcgtcaacacctgtaatgactcgtctttttgatattagccatcctgacaggtatgaagtgataaattatggtggttttgatttgcatttctctctttactgatattgaataccttttcatatatgtatgagtcatttttatgtctttggaaagatgtctgttaaggttctttgcccatttttaaattgggttattcattttttttcttgctattgagctgtgttatatattttgaatattgacctttatcagttacatagtccaaatatataatcctttaatccatatgctgccttttcattttgttgattatttcctttgctgtgttgaaagtttttagtttgatacaacctcacttatttttgcttctgttgcctgcgccatatgacactatccaaaaaatcactgccaaggttaatgtcaaagagtttttccccttatgttttcttctaggaattgcatgatttgggtcttaggtatagatctttaatccatttggagttgatttttgtgtacggtgtgatataaggctctaattttattctttggtatgtatcatttggaaatgtacaaaacacctcaacttacatctcactgtgtaaaactcaaacacacctggctgcaagggaaatgtgtaaccctgagctggccagttggttatatgtgcatctagaacttgagattgtatcactaaaagagaatggtaaaaatcgtaaagagaagagagaaactaagggtatgtgaaacatcatacaaatgtttttatattggaaattaatcttgattatatttcagacttcgaagaagcccagagtcaaagttcatgtgcttctttctatgattcttttagctagtaatgactggactccatatcctgtaggattcctcaacctagtcataatactgaaattttatctaaaaaaaaagtaaaatactgatccttttacctgtaaataaagtataggaaagctcaaagaagatatttcttaataaccctttggtcacactttgtataaacatactattaataggaggtaatacaaaattcttatgacctgtagaaaaatgtcatttaatcaattgtatttaaaatcaaagcacatatatataaagtggtacttcctaaaaaaatactggtcaagtgaaaatatttcttcataaactttcacatgggtagtgctttacagtaaaaacagaaaataggtaattgtattatctttttatttagcaattattatgcttaccaaatttttgcatttgaaataaagatatatcccaaggtagtaaagaatactgctgtatttaatgttaatagtggtcagctggacaactaccatcaaatattcttatctaacctgaattttcttctttgtaacacataattttcatattgctacacgctttttattttttataactagatctctagtgttttctcatgtataatttggaaaagcaatatcccattaagatactgaaagtctttgttatctcccagaattattttataaaacttacccatacaataactctgaatacattgcatatgatatttgagtttttattcaagagttctatccaagaatatgcttattattagctattttacctgattctacattacttttcttctcagccttcatcttcattaattagataagaatgaaattgttgtcattgaagtagtttctcaatattatatttatgctatttcagaatatattattaagctattgttagacataaacttctgtaacaaaaacaatggaaagttttcatggccacgtttacatttagaatacaattttcatttgcaaaattaaattattatggagaccagcctgaaataatgtaatagaacatgaaataatcagtgcagtatttcttgagactatactttatacattatatgtttatgattggtgtacatgtccgtgtatattcaaaggtatgattaaatctttttaaagttgccacagttacatatatgctgacaaagcttttctaaatatacaaattatggttatattggcagaatgggatacttttcccaaagatgtgtctatgaaagactgtatcttataggctgtcaaaatcttttttctatattattattcttaaatcaagttttcttttttgacaaagtaatggattcatatgatgtgaaatttaaaatcataagctacactacagaaacatccattttactcctgccatgtatatgtctaccttttccactacatggaataattttgttatttgtgatatatttttttcatttttagcagaggcaagcacaaatcatcatctccctctttcctataaaaaatgcagcatgctattttttttacaatgtttgaccattgtttttcatgtaacagttgaatgagtgagagaatatataataatgctatctgagtatgtatgtaactgtggcaacattaaaatggtttaatcatacctttcaatatacacggacatatacacccatcataaacatataatatgtgaagtataatctcaagaaatacagcactgattatttcatgttctattaaatgatttcaggctgctctctacaataatttaattttgcacattaaaattgtattctaaatgtaaatgtggccatgaaaactttccactgttctttgttacacaagtttatgtctaacaatagctgagtatattctgaaatagcataaagataatattgagaaacaacttcagtgacaacaaacttatctaacttgtctgaatgtctagcttgtcacccttgtccagtccaacatgtatttgttttgtatttgcataaaattattctgatatgttgtaaacgcttttggtttaataaagaaactcctaccttgaacatgttttaggagtcattttgattaatatataatattaattttgattaatatactatgttaattaaattttcacctgacaatgaaactggagggatagctacataacataactagaatttcaaattatcttgacaagtcagcatgatgggacaatagttttttttaaatatatattgaaacaaataacatatatttctcatggaaataaagaaacattctgtgaaaaactactcaacaatataatacgtaagagatttatccacatttataaataatttttgtttgttagacaactatgttagatgcctttaaaaggtaaatattatcttagactgtatagatagaaatgcaatagtggtaagcaagaaaatgattatgctgaactctggattgatcaaaacatgaatgtttggaatactgtagtttattctgggtattttttgatgtctgattgaaaacgagaccagagtaagtcaccccagctagtgaagagatataaacttcagttaatactgtgatattactaatacaagtctaatgtaatcttagtttaattaataagagtactatataaagaacagaggctgagagagaacttctctcattgtggtcatactttgcttgagtattcatttatgtttgggactctgaggttaaagaaggatgttggcaaggctaggaataataaaatagtaaaccaggaataataacataataataaaaataataaatacatttttctgcttctggccaatatagagttatgggatccaagttactttctcatctgaaacaggaacaaaatacaaaatatataattctggttttcaagacattgaacatcagtaaatgcagcacaataatacaaaagaggcagaaacaaattatataagccatgtgattactgcagattaccattttaagagagctgtgaatagtgcctactagatttgaacaaagcaaaagctcataggccatggggcactggtattgtaactcttgaatcataattcataatgaggaatgattagctttacacctagcaatgctatgatctgccaaagaaacctcacgtgcagaattcagagggttaatctgttcaactaacttaattgcaaccagaaataagtttaagaatatttatagaaaccctaatatacctagcaccaaaaagtaaaatgtacatcaaatattgaaagattactaggcattaacaggagcagaaaaacattaaccataacgaggattttagccaattaaaagtgacccagaattgacagtatttacacaagtgttcaaacatgcataaatggacattaaaaacatgtattataactgtctgctgtctggagaaaagtcagggacatgtattaaaaagacccaaatcaagctgcagtaggatgaaaaactacattgagacggagaatacgctgaaaagggttgacagcagattagacattacagctgaaaatataagtgaactcagtccataacaataaagaaaaaattagaataaaaaaatgagaattcagtgatttttgaaacaacttcagctgagttcacgtacttagaatttggagtctctgaggaagaacaaaaggggatcagaagacagaaaaaaataattggagaaatgatgggataaagttttctaagtttgatgaaaatcacaaaaccacatctcaacaaatcctcagcacaaaaatacaaagaggactatgccaaataaaaacacaatcaaaatgctgaaaatcagtgatggagtcaaaattttaacagcagtcataaataaaagacacttttgtacatagagtaacaaagataaggaaggcagctgattaatactggaaaaaatgcaagtgatgacataggagagcaatatctttaaaatgccaaaacaataacaaaaacaatggatgactcccaattctacacataataaaaatatccatcaaagtaagtgaaaaagacaattatagatgtagaattactgaataaatcatctctagcaacctgcactatcgggaatgttaaaggaagtttttcagggagaatgcaaatgacatcagatggaaatatgaatctatacagagaaataaagggtagtgaccacctgagtaaacacaattttcttattatttaatctatttaaaaatgacagtttaaacaaaaataataatgttttgtggctactgtatctctacagtatccaaaattcaggagaggagaaatggatgtacaccagtctagggttctattgaaatggtataatatcacttgaagatggacatagataagctatagatttatattatgaacattaaagcaatcagtaaaataatgaagcaactaaatcaataagaagataaaataaaatactaaattaattagagtaatttttttttttttttaaagacggagtttcgctcttgttgcccaggctggagtgcaatggtgtgatctcctgtcacagcaacttccgcctcctgggttcaagttattctcctgcctcattaattgaaagacagaaagagagacaataacaagtggtggaaaatttgtggagttacttgaaatgcaaaatttttcagccactgtgaaaaagaaattggttatgttttaaataaacacaaattgactacatgaaacagcgatttcactgctagctatcaatgcaagagaaataaaaacctacgtatatacactaatttgtacattggtgtttaatggcattattcttaataactgcaatctgaaaatgatctatatgttcatcgactggtaaatgaataaacaacaggtagtaaatgtatgcaatggaatatattcagaagtaaaagtaatagactaatggcatatgctgcaacattgatgcaccttagaagcatgctacgtgaaagaaaccagccgccaaaactatacaagttaaaaattaaaagaatggaaaaatatttgccatgctagcaagtaaaatgaaaacaaaattgaatacttcaatatcaaataaattctaatttaaagcaaatatccagaaatgccatatttatatatagagaaaataaattcatggatgacggaaaggcatataggacaggaaaatgactgcaaatggacaataagtacatttcaaaggtaacagaaatgattcaaaattggattgtggtaatggttgcacaactgtaaatttgctaaaaatcattaaaatgtacatttaaaatgaacatgtttaatatcatgtaaattaaatagcaatacagttgttataaaataaagtttcctaaggaaagtgaaggtccggatggctttctttggcataataatggcataataactaattctactaaatatttaagcaaaaaataatactaattctcaactaaatgttcctgaatatagaaatgaagggaacacttcacaacttattgtgacacgaatgttactctgataccaaaattacacagctacaacaagaaggtagaacaatatccttcatgaaagaagaacatcccaagtcttcaatgtattggataatcataattatgaacaaatcaaataaagcaatattaataaaaatgataatacatcatagataatgttgtttatcacaagaatgcaaggctggtatgttcagcctttgaaaaatctaccaatatagttcattaaattatgccagatcaaattaaaaaaaaacaaataattatcttagtacctagagaaaaagcttctgtcaaaattcaaattacatttattataaaatcttcttaataaattgggaatgaaaagaaatttcctctaccttataaagggcatttacagaaatcctaaatctaacatcatatttaatattcaaaacctaagtgcttttcccctaagtttcagtttaaaaagcaaaaatgtcattcaccactttattttgcatcacactagaggtcttagccagaataatacaaccaagaaaaataaatgaataacacagagtctggaaaaaacttaaacaatttctattctcagatgacctgattctctaaatataaaattaaaaaatatatataaagttactaaaagaatgttattttagcaagtttgcaggaaacaagctcaatataccaaaaattaattgtgtatctttacactggaaagggattattaggaattaaacttaatatttttatagcacaataatacattatagcagtcctcacttaactgtggttattaaatggaaaattccagaaagaaacaattcataagttttaaactgcatgctgttctgagtagcatgatgaaatcatatgccatctcattctgtcccacctgggacatgaatcagtcagccgtttgtctagcatctccatgctgtctctgctatcactctgtagtcatttgcaagtttttcagttattagattaactgtcatggtattatagtgattgtgtccaagtaacccttattatactccatgatagacccaaagcacaagattagcaaagctggcagtttggttctgccaaagagaggtgttaaagtgcttattttaagtcaaaaaaggaacaatggacattagggaatataagagggaagaaaggagagagccaagggttgtaaaactacctattgaatagtatgcaaacttctttaatgatccattcagttgtagtacaaaccccagtatcatgtaatatacctcagaaacaaattgcacatgtacaccagaatctaaaataaaagttgaaaaaaaagaggaaaaaaagaactgatctttttaaatcttagtgaacctagttgttataaaattgtgctgctaatattctgttgcgtgaagtcagggaccacaaacggagggaccagctgaagccatggcagaagaacataaattgtgatgattttatggatgtttattagttccccaaattaatacttttaaaatttcttatgcctgtctttactgcaatctctgaacatacattgtgaagatttaatggacacttatcacttccccaatcaatactcttgtgatttcctatggctgtctttactttaatctcttaatcctgtcatcttcgtaagctgaggatgtatgtcgcctcaggaccctgtgatgattgtgttaactgcacaaattgtttgtagagcatgtgtgtttgaacaatatcaaatctgggcaccttaagaaaaggataacagcaatgttcagggaacaagggagataaccttaaactctggctgcctgtgggccaggcggaacagagccatatttctcttctttcaaaagcaaatgggagaaatactgctgaattctttttctcagcaaggaacatccctgagaaagagaatgtgtccctaaggggaggactctgaaatggctgctttggcgatggctgtcatagcggacagatgaaataagcccctgtctcccatagcactcccaagcttattaggacaaggaaattcctgcctaataaattttggtcagactggttgtctgctctcaaattctgtctcctgataagatgttatcaatgacaatgcatgcccgaaacttcattagtaattttaatttcgccctggtcctttggtcctgtgatctcgccctgcctccatttgccttgtgatattttattaccttgtgaagcatgtgatctctgtgacccacaccctatttgtacactccctcccctttttaaaatcactaataaaaacttgctggttttacggctcggggggcatcacggaacctgctgacgtgtgatgtctcccccggacacgcagctttaaaatttcactcttttgtactctgtccctttatttctcagactggccaaagcttagggaaaatagaaaagaacctacgtgaaatatcaggagtgaatttcccccgatatattctaacaatgttaagtgaatgaagaaataaacgcatttcctttttaaagaaaaaatgtgaaagttcacgactgacaatgaaaaaaatggattttgaagatctaagatcttaagaacaaatcttctatccatacaattctaaagaaggaaaaataaaatttgatactagttttgctgttgtaactcaaactacaaaagttacagccatagtgtgtgataagtgctcaattaagatgaaaaagacattaaattttggggttgacgacgtaaacagaaacgtattcttattgatagcaattgggtccggtagtatccatggtttctgacatctcctggcagtgttggaatatatcccctgtggataatgggcactaccataattacttcagtttaaatgaaactaaatacatacaaattctgtatgctgaaagcttcaaattactaaagaacacaaccaaagaagatctaaataaatggtgggatagactgtgttcatggattaaaagactcaatattgttaagataatcgattttccctaaacaggtatagtccatgcattctcaataaaaatcccaacataaatttttgtagagattgaaagatgaatctaaatttgttagtggaaaattgaataatctaaaatagccaaaattatttttataaagaagaacattggacaactcactctaaccaatttcatggctcactataaagaatcatgtacagtgcagtatttttaaaaggactgaccaatcgaccaataggataaggtagagagcccagtatgagacctgaacatataaaataaatgattttctgatcacagattctgacgcaatttaaaagaggtgtttttttgtttgtttgttttgttttgtttttccaacaaaacatgctggaatatatagaaaaaataagtcaaaatagattataaactagaagcctcagagtagagcatagaataaagtctttgtgaccttgagtgagtcaatgatcttattaactatggcacccaaagtatgatgcattctaaaatgaatgaattaaagttcctcaaatttaaaagctgctctttaaaacagactgttaaaggaatgaagatacgtcacagagcaggagaaaatatttgcagaattacatatctgataaacttggcctcaaagcatatacagagctttcaaaattgaataattataaaacaacccacaaataaaatccataaaacatgcaaacagatattgcattaaaagaaggtatgcagatggaaaacaaaaacacaaaaagatgctcaatatagctagtaattaggaaaatgacaattaaaactattaaatacacattggacaaaaatgtttaaatggtgaaatagcaagttttgctttggatatagaatgaagcgaaatgctcatacaggcaggtagaaatacaaaattatattagcactctgaataacattttgaaatgttctaatatgaataaacctacacttatcatacaacgttgctatccctccccaggtatttatgtcatcaaatgaaaactaatgttcacaaaaaaagcctgtatgcataagcttctagtggctttatatcaagaatcaccaaaaaagactgaaaaatatctaaatgtcctttaactttcaaatggatagagaaactgtggtacatccatgcaacagaatactccttagtaataaaaaggaacaaaattgttgattcctgcaacaatatgaataaattcaaatccattgtgctgagtgaaagaaaccacactcaaaggctacatattgtgtgattgtatttatgtatttcagaacagatttacgtatttcagaacagataaaaccgtagatctagaaattgatgagaagtgtcaggggagtggatgctaggtttgactaccaaggggcataatgtatttgtttgatacctcttgattgtggttgtagttatttgactatatgcacctgtcaaagctcacaaagctctatactgaagtaggaaaatttaactacacaaattataccttcacagactcttgtaaaaatgtgtttatagaaatgacaatttcaagattatcagaagtatcactagtgagatctttaaaaaacaacaacaataacaacaaaactgttaggtctatcttttgcaaaaggtgtactatctttgtaactttttaaaatatgaaaatatatgtaagacttaaattttaatgaaccaaaccataatatgcagaataatgaaacccctcagaacgccccacctcctaatcttcagcatttgggattatgttctgctacaatggttgcagatagaattaaggttgctcaccgcctgaccttaaaatagggagaatatgctggataatcccaatgtcattacagagtccttaggatttgaagagggaggctaaagaagagtcagtgttagagtgatgaaatgcaaaacgactcatccagccattgctgactttgaagatgaaagacagtcacgggccaaggggtaaagataacctctataaactggaaagggcaaaaaagtttgtcctccacaattcttagagtggaacacagtcctgctgacatcttgattttagcccagtgagacccatttagattctgactctcagaattgcataataattttgtggtggtgtaagacactaagtttgtggtaatttgttgcagcagccatagataacgaatgtaccaactcttgtctatttcatattgggtttcacaagggaaaaaaaaatgagaaaactattcatacttggataattttttttaataccctacattgacaaaaggcagatcaatgcagtaagttttattctaaagctaggttggtatgagaataaatgcaaatatttgattaagatgtttccattgatctcctttcaagatattttatgaaatttaaagatcccttggtaatttttaacattaatatagaagttaaattgaattcttttttgtgggtgtttacaaagtcatcttcttccttcctaaacagatctctcctgacacattttaaaatagcagaaaagtgcatttacctaaagtcttaatatttgtagatgatatggatatggtttggctgtgtctccacccaaatctcatcttaaattataactccgacaattcccacatcttgtgggaggaatcaggcgggaggtgatggaattatgggggcgggtctttcctgtggtgttctcgtgatagtaaatgaatctcagaagatacgatggttttaaaaatgggagtttccctgtacaagctctctttggctgctgccatccatgtaagatgtgacttgcttctcctcgccttccaccatgattgtgaggcctccccagccatgtggaactgtaagcccaataaacctctttcttttgtaaattgcccagtcccagatatgtttttatcagcagtgcgaaagcagactaatacagatatatttaggtgtgtttgaattttaactttcaatctataaagacacattaaatagatgctatttgaatattaaacaaattggtaagtgctgttaagacgagaagagtgtaggagatcttttcttatctacgttcataaatgagaaattttatcggagctaaagataagctaattatttaccttggctaacatagaatgtttttatgtttttaatacctaatacaattcttttccttttgatttttgtgccaataatatataagatttataatctctcccactcatatgtatttaaatttttatttcactggattcaatttaatgtgctcctaaatttcatcttttatataattttcttgccagagtttgagtattttctgtcatcacaaggctgagtcattacaatggaagtgtttgaatgaagatgaatagaggtgaaggtcactggaggtgagcaccacaatccattgctaaattaaacatggcctttatagtcaaggaccttattaactaatgagggctatggagaaagaatcagataattaaagcagaatgcacttagtattgatggggagaattagagggcactattgaaacatacagtaggggcatgtaaatcagacaggagttacatggaatgaaagtgtaagagacctgtaagaattatctaggaaaggaattgggggaaagagtgctccaaaaagaaagaataatattcataaatatatggagaggggagacctgtaagaattatctaggaaaggagttgggggaaagagcgctccaagaagaaagaataatattcataaatatatggagaggggagacagcctggtgcatgttggaaatgccaggcatttccatactgatggaggataaataactcagtctctgaatctgggattggtttcggaccgtcttcggcaaatttttggacctttgccccagcaacagtgtggtttgggaaaatggggcataaaacgaaagaaatagatgggggtaatttgtttgtgtcatatctgttgcttagagatggatcttgctatttgggttcttctcacttcactctgaatgtttttttttttttcttgcttttggctaacacccatgtctcccctttataccaaataccagcattacccagaacatggaatgcgacattctgtcttttccctgatttgagaggcaaattatttgagcagctcaggtctactatgggtgaatgtgagtccttcctaagtcttccaaaaccattgttgacctgccttgaagcacgtaaggtaaaaatctggtctgtgatggttaattttaggtgtcaacttgattagatgaaggaacaccttgagagctggtaaagcattatttctgggtgtgtctgttagggtgtttcagaggagattgtgtatgagtctttgaattgactagagaaaacctcccctcaatatgggtgaacaccatccaatcatcagcggcgctgggtagaacaaaaagttagaggaaaaccagatcctttatttttatgctgaagctgggacacacttattttcctacccttggacctcagaacttcagggtccctggcctttcaactgtgagacctacaccagttcacgctatcttcaccaggttctcaggcattcagcctccatctgatagttacgtcattggctttcctggttctgaggccttcagacttggactgagccttgttactggaattccaggtctccagcttgcagagatcccataatgggacttctcagcctccatattaataggaacctatatcctctcacccatacgcctgtttgtctgtctatctatttattatctatctatgcatcaagtctatctatactattggttttctctctggagaaccctttaattaagataaatccacttctcaaaatacatgcatcagcctttaatcgactacacacaaaagtggtatcctagactttattttttttttttcacttcttaaagagaatcactctataagcagagtacaaaatgacagttgtcaaagattctctggagacatcaattgaaatagactccccctcaacatgctaactagtcattaggcaatgttctctagggtttttgtgtattgtcaaatcttcagaaagcaatgtacctggaccattttccaagcaatctgctaaaatgtttttcagaaagttaaaatttaatgttattctgctttttaatgcagaggttatgtaagaaatgtccaattgatacatgtttcagtttttttatttttgcaaaaccacagtctaaacattgccgatgatgtcatccactgtttgttatttaaggattaacccactacagttcagggctgaaagagaaacttttctccctaaatgatctattatattttcttcaatctgacaaagcaaactatataatccaatatgcaaacctttgtttggggttttgttttgtttttcatctaagtttccaggcagctctgaaccaattttaagtcttagttgtagacaccagcttaatgtggttgaatggcataataattttatgttattttaacttggactttaatgttagtttctttttaaaaataattattctatttgatgcactgagatttatagtctatatcaaatattatttgaaatttaggaagatattttcataaaaaacaaattacccaagttttctcataagaatcatagggcatttttctctattttacatagaaataattcgagttcatataggctaagaaagttgaccagatttaactaaagaagttacataattgatatttaaactcggttctctgctatgaaatttaatgctgtttccattatatgattatctaattaaacatttctctaccatttaacaaagcaaaaaaatatattttgatgtacaaataatttttatgtttctaagtatgtgtataaggtcaagttattaatattagaaaacatcatatccttatagtatgatctaaaaacaacttttactcctttgccatatactatcattacctagtctgtaatgtttaaattatagtgtaagaaaactcagaaattacaagccttatgttgtaaagataacatacgttttaagtgaaggctatgtgttatacatccagtcaattatttggtactttcacctgttgctgaataaaataaatgtaaacataaatcataataaataagcacacacaatggagtacacacaaaactattcacttcaaacattaaataaatcacagaatctccacatttatacaaagaaaaatctaagctgccaacaaggagagttataaaacatttgaaatcctgctttgctgctttattagagataatttcatccagtgagatttgaaagcaatgccctggaaatttatgatgtgacttttactaagatgtatgtaagtttatagaacgatgttcactagaaacagatttattctgtttatataacaagcagttacctctggcctgctctccctactgtatcctgctataactggtaagggtattaccccctaaattacctgctgttaggaatggccatgccagtttattcctataaataaggcaatctctctagccctatctctgtcattttaggcagttgcattcagtatgccccttccctaagtttgttttgtgtctcagattcttatacacatgagaacacctgggaatagacctggtggccttcaacccacaccaaggcaagcacaatgtctagaatgacttatgtcacttagccatggacccctgaggttccgtcactgacatcttattttctgacgtttttgtggagaactatttaaattttgtgaatagctgcttaattggctaatttagtgctctattttcaaatatcaacaataagacccctttcgatgtaaagaatcatttttcaagaaagggtagagggtgatggtggctattcttttttgcttaaactagcttgacctttgtagtctgattcttataaacagaacaagaaattagccaattaagcaacttgtatttaactagttttttcaatttaaatgtaacaatttgataaactttgctgagaatgtctattaactgataagataaattagaagtaaatggtcagttctttagttctacttaacattatcatattctgccatgacagagtagcattaagattcattgtttttagcctcatccatcttattgcaaacatattgtaaaatacttagttcagaaaagaaatatttatactcaacctttctgcactactatgtttatggtttacatttttctaaatgctagtctagtcaacattgatctagttttctatatttaaagcttaaatatcttttttgtagtgtgttttttttcagtttactatgttaagttataatgaacacatttaaaatactgtttcttctgtttatgtagtagtgctctattgttaaatgaaaactagaggacaaagtatgtgtagattgccaaataaagaattagttaccctatgtttgaacacctcaagaaggaatatttacatttcattctacccttctactacaactacctactttagattataaactcatgaagggcagggatcttttgagcaaagctcatatcattttgcataagaaaaatatacttgatatgcgatttggggtagatctgatcatatggctactggaagtgcaaactggctggtggttgtgatgagcatggtactacttatcctagaagattttcattcctctaaataaggcagaaaatgctgaactgtctttatacacactatgatggactattaatgtttcttccctacaaacagaaaatgaagttattaaatccaatcaactttcatttactacaaaggtttaaatgcctatactcaatgtacttcctactaaccatgtttagcttaacataataaaaaccctttattgaaccccattaaaatgaaagtctgccactcaaccaatcagctctgttgaaagttttggatgctaaagttccatgctgacttcaatggatgacagataatttaaaggcaatgcatataattaacaggattaacatctgaaactgtgtttatcagttagttgaaacattaattgcattgatttgaagtaaaaatctgacaccgtaagacattcacaaggtagtaattttggattctgtgtcaaggtaatattattctaaacatcccaaatggaaggttgtctctctagagcaagtatggaggaaccaaaaaggaaaaaagaaaaatatatagagctgatatcaaaaataattttgtcaaccacattaacaattgaaacatgaaaatacacaaagatatgttcctatcaaattgtcaaagtggtgtttatgaaacaaactcaatattagcaattataatagaatcagacatttttctttttttttggtgtgaagatggttattaccattatgaaaacaactagaaacacttaattatacagttacttatactgctatttgtttttatcataaaattatttttaaaacttgacttaataattaagtggtaatttatctgaaggaaataatcttatattcacaacatgtattatgtataaagatgctaatcatagcattattacttatgctacaggagttaagaagaaattaggcagatagcgagggtgggagagtactcagtaaggttttccttttactgaaaggtagcccccaaattatttccatttctaacaaaaagcagcctgtaaaatcaagctgcagacatggacaaacaagctggaagctctcttgggtgaatgctggtagctgtgccaataggaaaaggttacctgggacttggcatgttcaaaatgacgcctccatgttcccatctctttgccagccatgtatatagtaagaagcagaaaacacggcgccagccacgtggaaagcccatttgcatattagtgcggggtggacagccttcccagaacgttatgtaaacgtcacatgttgtccaaccaatctgtggactccatgtaaatcagacacacagcctcttcaaacctgcctataaaatctggtgtattccatggtgggccagaattcttattcagaagcccctctctctcaccagggagagagctgttctgctttctctttctttcgcctgttaaactctgttcctaaactcactccttgtgtgtgttttcctgaccttaattttcttggtgtgagacaggaaccctgggtatataccccagacaacaatgctgcttcgcttatgataattacagatcaggagtgtggaaagagtacatttcctattacataagaagtgcttaataatttacagaataaccaaataatggaatatatgggaatatttaaattatgttttcgaagaatatttaatataggacatgttcatattatattaagtgaaaagttgtgtcagcaaatgtacattcaatataatatcctttttattagctatgcctattttacatttaaatttatgtgacatatttatagaaaaaactggatatgtatatatcaaatttatcagcagtaagtaaacgagagctgggatcaaagttacgttggtatttaaatatttctgaattccatattttcataaaaatataacctgtatgattaagtaaaatataacctgtatgattaagtaaaatataattagctcattttatcttatgaattagttaaaataattcattttgagctgaataaatacatttctcatttatttacttctatgtgaaatgagtgctgtgtcttcaaactaactgtaaagccttcagattcttatgtttgatacaacttgttatctacactattaagttttgtttgtttgtttgtttctctttctttgagacagggtctcactctgtcgcccagactggaacgcagttgtgtgatcctggctcacagcaacctccgcctaccaggctcaagcaattctcctgcctcagcctcccaagtagctgggaatacaggtgcacactactaccgtctagctaatttttgcatttttagtagggaaagggttttacaatgttggccaggctggtctcgaactcctgacctgaagtgatccacctgcctcggcctcccaaagtgctgggattacaagggtgagccaccatgcctggccattattaacactgttttaaaaacatcattaccattttcccaaacccttggaattacccttaattgttccctttctagtacacttaaaatagtattatgcaacttgaacttttttttttttttaaacagagtttcactcttgttgcccagactggagtgcaatggtgcgatctcggctcaccacaacccctgtctcccaggttcaagagattctcatgcctcagcctcctgagtagctgggatgacaggcatgcgtcaccactctctgctaaattttttgtatttttttagtagagacggggtttcatcatgttggccaagctgttcttgatatcctgacctcaggtgatccgcttgcctcggcctcccaaagtgctaggattacaggcgtgagccactgcacccagcccaattatttctaatttatttaaaaaaatatttatttgtggtcactatttgccaaagattgttctttacagcaaccagttagataactgcatcataactaaatgcctagaccattgcaataatcataacggcttttactgtattcagtattttgcaagccagtcaaagaccattcttgattgcatttggcaagactctgcattggaaatgagagaaacccacttcaagctatattattagcaacaacaacaaatagctgggagattcttgtttcccaaagggaatgtgctagtaatccatttatcgtctttcatctctaaatccatgattttgcctgcctccctaaaaatggaccctgaccctttcaaaagtttttccttgccagctggcatgatgctttgtcagtagagggcgctggagggacactgcaggagtaaaggtgttttgcttgcaggactcctgtgtctgctttctgtgctcctgggctgtgcagtcatcccagtgtccgggtactgcagatgggtgtctcctccactcatgaactctacagcccatgaagcttctctgccttcaggttgccgcagcacccaggcgctaccagtttcccctgacaccgtccatacttctccacttatgatgtcccagcaaaggacctcaggcgagacatcttatgaacagatttctctagtatctacctaaaggttatcaatcagttctcacactgctgtaaagaaacacctgagactgggtaatttatgaagaaaagctttaactgactcacagttccccaggcttaaaaggaagcattttagagaggcctcaggaaacttaaaatcatggcaggagctgaagggcagggaagcacgtcttaccacaattaagcaggagagagagagagagagagagtaaaaagggaagtgctacacacttttaaaccatcacatctcgtgagaactcactcactatcacaagaacagccgggggaaatctgccccacaatccaatcacctcccaccaggccccttctccaattcaacatgagatttgggtggggacacaaatccaaatcatatcagatttgttttttgcaagatcaagaggacagatgtccagaaagtaccacagaagtggtaccacaacttctctgccacccaatgagccacagctgtgccatacccagaaagttctgaatctcagtcctgaggtggaagaatgggaaccccttctttgaatgatctgtcccatccctaagatagtgactgttcctctatctgctattctgtatgattttgagttctctcttcttcttgatagtcaagagtcctcgatcttgtagcagacgattactgaggcttggcatctcccagccattcacattgtagtaaggagcaatccagaactagcattcctaggatctttcaccaagaagcagaaggtgacccacactggctcctccctttgctggatgtaccagcagagattatgtggaaagtccaagagaaaaaggctagtgaaaaacctaccaggggagcaactctctttcctatggccacggcatctccaacgccttacccatagatactgggtgaaacaaaaaagttttttgttttctcacgtaacaccagaaggcatcaagcaggagctttaatagatgatccccctgcctcttcaaagagaacaaccaacaaagaatgcaaaagacaaaaaaaaaaaaaaaaaaaaaaagttgccagagctcagaaagccaaaaagttgttagaacatcatcccacaaagtaggccatagcctacacattaaacctaaaccaggtggcgtgactgataaaatagaagatttcaataggatcaagagtctcttaagaaaatatccacaatgtccaagatgcaatttaaaatttgaaaattactcatcatagcaagaagaagggaaatcacaacttggaagagaaaagacaaacaactgaagccaacattgagatgaattagatgtaggaatgaaggacaagaatttttaaaaagcaataatgaaactgtttcaataagcaactacaaatttttctaaaacatattaaaatagaaaatctaggcaaaaaatagagtttatttaaaaataccaaatgaaacttatcaaactaaaaaaatataataatggaaataaaaacaaaatgattctggatgggattaatagtagaatggaaataacaggagatgtaatcaatgagcatcaagacagatcaataggattactcagtacaacaaaaaagaaaactaaaaaagtaaatggattctcagggactgtgggacaacagcaaaagatataatatttgtgtaatcaaaattacagaaggagaggagtaagaaggaggggataaaaaatattcaaggaaagaatagacaaaatctttccaacttgtggtaagacataaactgtagatttaagaagctgaaagagaataaactcaaggaaatgcagaagacacatacctaaatttctgaaaagtaaagacacgcacacaaaaattcctgaaagcaattaaagagaaaagcatgcattacctttaggggaacaacaatttgtatggcagccaatttttcatcagaaaccatggagaccagaaaaaaattggcccattttccaagcacacacaaaaaaggaactatttacctcaatttctatatttggtaaaactatccttcaggaactaaaggaaaataaacaccttcttatacaaagaaaaaataagagaatatgttatcagtagatctcgccttaaagcataattaaaggaaactttccaaacagataagctatgctattagcacgctttaaatttcataaaggaaaataaaacaacaaaaaacaaaaaaaaatggtaaacgtagaacaaatataatagacctcatgaaccttttaaatcatatctgtcagtttaaaaatatcaagtttgatataatgctccatatgtatgaataaaatacttaagacttaaatatttgaagatatttaaatatttaagaaatgtaaaagatcatgggacctaaatgaaagcaaagtttcaagacttcacttgaagtaaaaaagttatgtcagttgtgaaaaacgtaatatatgtacatactagttttataatatcatttatgtagctactttacccttaaggtggaaaaacttaactcccagctgcttaattagggcgtgttcaacatgttcatagcaagttcaacatgttaacttttttcaagtagtacagtatttaaagagagccaaaaagagtgactttacagtggagaaatctaacaaacgttaaccaggtgatcaaagctaccaccaagtattaattcatgttgattgcatgtgcccttgatatgatgtgatgataatattgtgctacttctgtcctccccagaacacattacttcagtgtaattatcagaaaaatgtcagacaaatcccaatcgaagggcagtctacaaaacacaaaccagtaattctcaaaactgtcaaggtcatcaaaatcaaagaaagtctgtgcaactatcataaccaagaggaacagtagagacaagactactaaatgtagtgtgatatcttccatgggataccggaacagaaaaagaacactaacgtaaaacctcaggaaatttgaatatactatgatcttaagctaatatcaatattggtccatcaatagtgacaaatgtaccacaccaatataaaatgttaatcataggaaaaactggaactttctgtactagttttactataagtctgcaaatgcaaaactgatttaaaataaaagtgtatttataaatagaggttaacagaatggatttaaaaatggttcagctatattgtttatgagaaaataatttcaaacataacaatataggtatattgaaagtatggaaaatgtgtaccatgctaacagtaatttttttaaaaaaagcaggaatatctatgagtattagataatattataaagcaaagaatattacccggacaaaaaaaaggacattatataattattttagaaatccactaagatgacatagaaatcataagcaggtatgcaccaaataacaaatcttcacaatatatgaagtaaaaatgatagagttgaggagaaaaaatggataaatccacaaattatagctggatacttcaataccacacttgcagcaattaagatgattaggggaaagaaaattagcaagacagagaaatactgaagaatattatcaaacaatgggacctcattcgcacatatagagcacttcactaaacaaaattcagacacacattattttcaagtgaccatagaaccttcatcaaataaagcacttcctggtcctaacaagaacctaaacaagtttaaatagtttaaagacacaaaatatgtttcttgactatactgaatcaaactagaaatcaatattagaaaggtagcaggaaaattttcaaacacttgaaaactaaataatacatttctaaactatctatagacaaagaagtctcaaaagttaaataaatacatacatatgtgtatatatacatatttaaaaatctaagaaataaaaatgaaaatatcacatcagcactaaagcagtgataacagacaaacttacagcatccacttgccctagcaaagaggagagtagtcaaatgaataatctaagttcttacttctaggaagtaggaaagaaggtaaacagaatcccccaaaaggcagaaagaaaaaaaaagaagtcaatgaaatttaaagcagaaaaaatagagaaaaatcaataaatacaaaagctaattgtttgaaaaaaatttaagccattcaagatttacaaagatgaaaaaagagagaaggcacaaaatcaccaatatcacaaaagaaagagaccatatcactatagatagtttaatctttagaataataagatatcataaataagtgtatgctcacaaatttgtacatataaaaataaaacaactcaaaagactacatattaccaaaagcaaaataagataaaacaaacgaaaaagacccataaccttaaataagagtgtgtaattaaaaatatcccaaaaagaaaataccttggcccagatggtgccgggtgcaacccgcagacactggacgaaagacagatgaaggaatgcactcagacacaggtacccagtgaaagagtgggctaggggaccaggcccctcacagaccctgaggagggtgctgtaaaaaggcagcagctgcagcctcaacaaacccgccctccaggcatttattcagcacagatttaatgacaaaggctttgaatcaacacatttgtggaaaattaacatgatcgccctcccctgagagagtagccttgcaggtaatgattaaaggccagattcccagtcctaagtaaactaacttatctagatcagtttctttacatccccttgttatctaacctaagctcttaggagaattcagctgccttcagccaaattttctttcgaagatttgcaaacccctggacttccgagaagttttgtgtccttttcctatactttctcctaccaccctgactgatctcctacaagatggtattatatcgtctcctccgaatcacaggagaaggcacttcctaatttgtcttatgaggccagcgttactcggataacaaatctacacaaagacagtgaaaacaaaacaagtcacaaacaaacttcctagagtccaacatttctcatgaacttagatgcaaaaagttttcaacaacgtattaggaaacaaaatctaacatatcaaaagaatcttgctccatgacttagcgggatttattctaggtatgccagggtggttcaactttcaaaaaccaattaacaaagacaaattatacaatcacattaacggatccagaaaaatacttaatgatgttcaacacccatttgtgataaaaactctcagcaaactagaaatagaagaaatcttaaaaaaaacaaaaacctacacctgtcatcagaatggtgaaagactaaatgcttttctcaaaatcagtaacaagaaaagcatgttatcttgcagcactctgagtcatgtaagtcctaacattgtattcagcaaaataaggcaaggaaaagtctgggggtaggagcaaaaagatgtagcacaagagaaactgtagcagaacagttatgtatactgacgtattggtagtgacccaaggccacatatgtggtgaaattgtataaagctctatagaggatgggcacggtggctcacgcctgtaatcccagcactttgggaggccgaggtgggtggatcacgaggtcaggggatagagaccatcctgcctaacacagttaaaccctgtctatactaaaaatacgcacacacacaaaaagttagccggcatggtggcaggcacctgtagtcctagctatttgggaggctgaggcaggagaatggcgtgaacctgggaggcagaggttgcagtgagccgagattgcaccactgcactccagcctggggatcagagtgagactccatctcaaaaaaaaaaaaaaaaaaaaaagctctatagatacacacacacacccacacgcacacatacaaatggatacatgtataactggttaaatctaaagaaacgcctattgtcaatctcctggcatagatattgtatggtatagttacataagagatgacattgtaagacgtggggtgaaaggtgtggggaacctctttgcacacttatatggcacttcccgtgaatcaataatttcagaataaaagctaatgagttcacctcataaacaaaaaaagcacatgatgattttgagagatgaagcaaaaacacttgagaacatttaaattcaactaaagtttttttttttttttttttttttgagacagagtctctgtcacccaggctggagtgcagcggtgtgatctcggctcactgcaacgtctcactcctgcgttcaagcaattctcctgcctcagcctccaaagtagctgcgattacaggtgaacaccaccacgcccagctaattttttgtatttttggtagagacaaggtttcaccatgttggccaggctcgtcttgaactcctgacttcaagtgatccacccgcctcagcctcccaaagtgctgggattacaggtgtgagccaccacgcccggccaactaaagatttttttaaagtgcaaaataggaaaagaaggaagtgttctcaatctggtaacagagtctgcaaaaaatacagagaaaacattttaccaaagggtaaaatattgaaaaatttcccccaagcctaggaacaagaaaggatatctacttgaccactctacttaactttgaactggtccccctaggcagtataataaggcaaagcatttaaaatagtaagagatataaataaaattacttctttcagatgatataatcttgttcatagaaagtaaagaacatacaaattattaaaatgtatgtgtatttctaacacaaagtcaatataacacttttgcattttcctgtattagcaacaattagaaaatgaaatgttaaaaggtataccagttccaaaaacataaataagaaaaactctaggaagaaaattaatgaaagatgttcatgttctttttcagaaagtattaagttattgctgaaagaaaaaactgacttaaacaattaggggggacattatctgttcccagattagaaaactcaatcttgtaaagacaaaagtttctgaaaaattgcttaatatcaggttgatgcaaaagtaattgcagttttgcattgtttaaattttgtgtgacagtggaatgcattcttaaatgtgtttatgttaaatgacattttaatgtgcatttctcactttattttttcttgctaatgacttgttacttgctgtttattttatatttattttagattatggaaatgatgttagagagcaaactccggccattttcttatttgagttcaaaatgtgtcgtaaagcagcagagacaactcacaacatcaacaacgcatttggtccaggaaccgttaatgaatgtacagtgttgtggtggtccaagaagttttgccaaagcaatgagaaccttggcgatgaggactttggaggccagccattgaagtctacgaccaccaattgagtgcagtcatcaaagctgattctcttacagctacacggagaaattgccaaagaactcaacgttgaccgttctatggttgtttggcatttgaaccaaactggagaggtgaaaaagcttgataagtgggtgcctcatgtgctcagcaaaaattaaaaacaaaattgttcttttgaagtgccctcttactctatgcagcaacaatgagccatttctcaattggattgtgatgtgcgaagaaaagtggatttttgatgacaaccagtgatgaccagctcagtggatggaccaagaagaagctccaaagcacttcccaaagccaaactctcaccacaaaaagtcatggtcactgtttgatggtctgctgcctgtcggatctactacggctttttcaatcccgcttaaaccactacatctgagaagtatgctcaacaagttgatgagatgcaacaaaaactgcaatgcctgcagccggtattggtcaacagaaagggccaaattctaatccagacaatgcccgactgcacgttggacaaccagcacttcaaaagttgaatgagaactgggcacagtggctcacgcctgtaattccagcactttgggaagcggaagcgggcagatcacaaggtcaggagttcgagaccagcctggccaacatgatgaaaccccgtctctactaaaaatacaaaaattagctgggcgtggtggcgcgtgcctatagtcccaacttttcgggaagctgaggcaggagaatcacttgtacttgggagctggaggttgcagtgagccgagatcgcaccactgcactccagcctggcgacagagtgagacttcgtctcaaaaaaaaaaaaaagtttaatgaattgtgctatgaagttttgcctcattcaccatattcacctgacctcttgccaaccgactaccacttcttcaagcacctcgaaaatttcttgtagggaaaacgtttctacaaccagtaggatgcagaaaatgcttttcaagagttctttgaatccctaagcacagattttaatctcacaggaatgaacaaactttatttctcattgacaaaaatgtgttgattgtaatggttctcattttgattaataaagatgtgtttgagcctagttatagtgacttaacattgacggtccaaaaatgcaattactattgcatcaacctaatagatcggtgcttctatttctagttatatatcaaaaagatgcatataaacgtacaccaaaagggaggcagaagaatggctttttgtgacactactacagccccaactgaactgaactgaaaacttcaataggagtagaatggataaattgtagtgtatttatgaatggaactaccatgcgcaatggtaatgaactatgcaaaatcattgtggagtatcagagacataatattacgagaaaaaaagtcagatgcaaaataatgtatcatatgtgaatttatttatatacacttcaaaaatcaaataatggtttagctttgagagtagtaactgagagaaagcagatggtagagtcctgagcttctggggtgctgttctagatcttgaccgtgatcttaggtgcactgctgccttcactttgtaaaaatccctcaggggacgcctttgagatttgtttacttttctgtgtatgtgttataagataataaaaccccagcctgaccaacatgttgaaagcccgtctctactaaaaaaaaataatacaaaaatcagttgggcgtagtggtgcctgcctgtagtcccagctactcgggaggctgaggtaggagaatggcgtgaacccgggaggcggagcttgcagtgagctgagatgacaccactgcactccagcctgggcgacagagggatactctgccaaaaacaaacaaacaaacaaacaaaataatcggaccttaaaaaaagattgtagccacttctaccatttaaaggtgtgggaagcaaaaaaggaaatagcatttcaaaatttgttatcttaagttgtagatgttggaagtaaccatgttgtcattgttaagataacacaatcctgagtctttggacatgaacttagagtttcagtatttatttggtgtgcctaatatagaaaaaaaaaatagaatttcatggggaagcccaagtagaggtaactcatgaaatacagaggctaggagccttgacggaaaaaaatgccaataaacggaaatataaatcactcctacatattcaaaatgtacataaaatctataagcaatgtcttatgtgtgtatgtcattgtgtaagcatatgtgtatgtgtgtgtaaaaccaggagagggagatttggttcacttctagaaaaatggtagctctgaacaaggaaagcatacgttgaaagacaatctatgaattactaaaagcttcctttgcccttacgtataaattttaaatgtaaatttacacacatggtttataattattggttgacacctataattttcaggagaggcaattgttgtttttgctgtgttgtgtatccattcctaccacagtgcctgaaatatggtggcacccataaatatctcttaagtcaaaataatactgaaccaatgcactgaaataaaaatactagcagcagtaacttacatattgcagtttcgacataacaggcatcctgctttatatacatggattgtttgaattaccattacaattgtgtatatgttaatcccacagttagttatcatagtttagattcaaataagaagtggggtcgggtgtggtggctcatgcctggaatcccagcactttgggagaccgaggaaggcagatcacctgaggtcaggagttcaagatcagcctggccaacatggtgaaacctcatctgtacaaaaaatataaaaaattagctgggtgtgatggcgtgtgcctgtaatctcagctgggtgtaatggcgtgtgcctgtaatctcgggagactgaggcaggaaaatcgcttgaacccgggaggtggaggttgcagtgagccgagatcatgccactgcactccagcctgggtgacacagtgagactctgtctcaaaagaaaaaaaaaaagtggaagtggggtctcaaacccaggagagattggaataaatgtatgccaacaacagaagtacccccaacaaactgaaagggctattgccaccacctactgtaagacttctttagaatctccaatgagatggtactttagctttagttgttatttacattacttcaggtttttgttgttgttgttgctgtttttttgttttgttttgttttttgaggcacagtcttgctctgttgctcaggctggagtgcagtggcgcaatctccattcactgcaaactccgcctcccgggttcaagcaattatctgcctcagcctcccgagtagctgggactacaggcacccaccaccatacccaactaatttttgtatttttagtagaaacggggtttcactatcttggccaggctggtcttgagctcctgaccttgtgatccacccacctccgcctcccaaagtgctaagattacacacgtgagccaccgtgcccggccacttcagttttgttttagggggtgttgacctccagaataatcttaactttcatgcatataaatcagtaaatccttccttctgcagcttctgacagattatgtattctggaggatattctcccacgaagatcagaaaactcttctaacagattttttttcccattatttattgttttgaatcgaaaaatgaaactttactccatggacaatttactgttttattgtataaagatgaagagacttaatgtttggttctaaactattaaccaattttacctacctaacttatttaataactaattccaccctctctcagtcacagtgattttttttttttttttttttttttttttttttttttttgaggcagagtcttgctctgtcgcccaggctggtgtgcagtgggtgatctccattcactgtaacctctacatgccgggttcaagagactctcctgtctcagccttttcagtagctaagattacaggcacgtaccaccacacccagctaatttttgtatttttagtagagacagggtttcaccatgtaggccaggatggtctcgaacttctgatctcatgatccacctacctcggcctcccaaagtgctgggattacatgattgagccattgcccccggcccgtcacagaggttttaaaggacatcttcatcttacatcgaattatcacagatatatggttcctttgtacgttttacccttactgtattgttactgattttcaatacctatactaattccacactgtactaatgattgtgcttgtgatatttggtgcacactattaaatttttctcatattttttcatttaatgagaatactttggaaacatttcatcatcactagtattttcatttgaattgctttacatttgtaagttaattttagagagaacggataactttaataaataaagacatatactatagagttcagattatttttcaatatatattttcaatgaatattgatgtaaagtaattcaattaatagaattcaatttactactcatttttatattcatctaaaacagtcacatctagaccaatatatatatatattttaacagaattagtgagctgttggaactaacagggaataaatataaaacttcaatgtcctgtcagttatttgttaaagggacagatgctataggtaatttaatgctgcttagcacccagcagcattctcatgaatgccatgacccacggaaccacctgcctattctgataaatcaagtgataacccttaacaaactaaagatactagaactaaatattactttggataatcattcacaccatccaaaataaagtagggtaactctgaataaaaactaccttctgctttttctcccactaggaaatgaatattagtattactaatagtgatagcagttaacacttttccagtaatgtgaaaagagtttcacttatcccatctcaatcatcaacataactccagtacatagatattattaaaatgttcattttatgtttaagaaacggaggcacagagaagtcaactggacaccctcaacttgtacctattcatcagtttatttctaatttacataataaagcacatctttgacactattctggtacccttagctcaaacttaaaggaacttttcaaaacaaataatgtacacaagtttgacttttattttaaaatgatacaatatggactgaacttgaacctaggcctttcatatgcaaactacatttgctgacaaaggatacaattaatcattacactagtacatccagaaattcatttaataggggatggaaataccaagggtagaaaagaaccaatagtgacattgcaatgaggttcagtattctccttgtcagcagataagattagtaccaggtactatggtgagtgtgagctaggggcagacatagagggaatatctctagctctgaaggtgaaagggatgcagcagtgagttggaaaatcctttaaacattctagctgcgctgccctggctttgtgataaaaatcagggtcaccatttagtatatattatgcaactttgtgcatctggaaatatttccctatgtgaaagctcaattatgctaaaatatttatttattactttattacgttggctacgcagaaagacagaaaaacagtaagttcatatctgtggaaggtctgacacagaaaagcttttattgtgtcaccataaaaattataaaatggccagggagtaagaggcatagcaaagtagagaatggaaggaggccagcaggtccatttaagatcatattcatcattaaattacttgtaacaccacctaatattctttcttggaaacacttatcaaattctatttcaaaactacttgctcttgttacttatactgtgaccctaccaacgttttcctcaagccactaaatattctctacataaagaaattactttggtttattttgcaaaggcatatttggtgttcatcattttctacatgcagccagtaaccctgtgaacttctgtttgacactaaatcagctttgccacatatcttctttttacattctaaatgcattctcttttaaagctacttattcctaagaatcataaatttattcaatggagtatatgtagtttgtactagttttacgttacttgcattcatctctttcctcttatcaatgtgataatgtgattttaaccaatgaagatgatagataatttctatttttattgtggtttaagaaggttactcatagcagaggtgacctatttaatgttgtacccccaaaagttatgggctattctaaatgatctgctgtttatgtgtgagaatataaaaaagaaaagctgggttttgaaggtaagctgattagttttgttaaacttaaaaaaactctcagcaaatatgaaatattagtgttgaaaatacacttaggtaccactatcttttaatactaaaaattgaggctgagataaatgaccacttagtgtttttaaaatacccagtaaaagattaatgttgaattagaaatcaacatgatagtcaggtgtaatcatagccaaaaataataatactaattggttcattgggttttatgctagaagaaaaagacagaaaaagtcagagggatagatttgggtgttatccacatatatgtgatatgctaaaggagcatgtataataaaagctcattgtatgtataatgagcacataacacacttagtcagataacagatataggtgacataaaaacagacgaagccaacagcaatgatggccacctcaactggaaattatttggaaataattttatcagccttaagattgaaaatgaaatgagactggtctaaacttgctttaaatcaataagaaggcttgagttatttcaataatgagaatctttgcgaccgacaagcatttattatacattttatgatacctctgaaagaaataaagttacacacgtatcatagaccttatcaaaagtttccacaatttatttgacaaaatccatgaaatcataaggtatattttgaaaaggacgatggtataagtgatattctaatcacttattccacacttatttggggggctaccatgtgtcaagcagggttataaaaacccaggcatacaggataaattccccactggacctgaagtgcagtatttccttacatagttgcatgaagaaaatattagtattcagaatgttaagttatatataaaaaaagacagacatcatgtaaatttgggaaaaacttaaaaagtatttcaagttactatagagtcaattttcggtgtatacttctgtgaatcctaacacatgcagattgctgtgtaatcattactacagtcaaaatataggacaggttcatcaccctcagaaaactctcttgtgctatcgctttgtacctaaaccctcccccataccatccctgtgaactacgcatgaatctggttttaccatagttttgtccttttaagaacgtcatataaatgccatcatacagtatgtaaactgccagactgacttattttacctaacataatgtcaatagcttttttaaaaaattgttgaataccattccactgtgttaacatagcacagtgcattcatccattctcttgctgaaggatatttgagttgactcccgttgttggcaattgtggatagagctgctgtgaatatctatagaaactttatggtgtaaacatgtttttatttaacttgggcaatcacctaggagtgagattattggaccatatggtagttgcctgtttaacttgataggaacagggaaactgtgtttttagaaaggtgtaatgttttgcattcctagcagcaggagtataaaagttccagtagctttgtatccaatctaacacagtattgtctgcatcttttattttagtcactatacttatgacttatgatttctcaaagcctgaaatgtgaaaacaggtatggtcaatttcttaatgtgtaatattgaaggctttcttccccagatacatttacctataatactctagtgtgctttaggtagctgatagatttactgattcaattagtagctcacaggttaggtgagcaatcagcccgcaagtgagaagaataaggaggtggaatcataaggacctctggaagagatatgaggaaagaaagcacattttcttagtctgcaatgcctgcttccctggagtggcaggctggtctctgaattacgttcaataatctttgtagaaaaatgaagtatggcaaaaaaaatgtaagaatgcaaacagttttctttattctaattatgacatgagaaaaggtgatctccaaaatttatgaattattaacatgttctaattcctttgggaagggtaaaggaaggaaagacattaaacaatagactgatgggtttgtgagcatgttgaaaacaaaacagctaatatgtgacctcagaatcaaaataagccatgacaaaatgagatttttcattttttccataggattattggatcaaaacatagagggatcatatagtattaaaaattcttaactacaggcaaatatattataaaatatctagaaataatattggaaacacaggttgcaaatgaattcagaactgattaaatattttaaccaaagaatgctgattaagggattcataacaatcttaagaaatctgaagagatttgggtaatactgtttcctcattatgaaatatatgttgtcaggagtctaataaatacttggaaacagaagaatagctggggttcattttctcctcttcctttgctcaattttctattcccactacggtttatttttctggtatatgcattatctgacttggaattttcccaaaactaaatacaagaatagacacaaaatctaaagtgaaagtcaggacaaaaacgtaactgtagttaacagacctagatcataagtaatggtttccccctagcttctctctctctctaccccatgaccaggcaattagtattgttgtgcagtcatctgggcttgggtgccacctcatttaggaaccctaatactgaagtgaatgatcttctgtgtacatatggactcctaaattttatttagcttcctgcctccagatgttttcagataattattcccataaccttacattagtgaacattatgccccattaaccaaatttccaaagacatgtttcttatcaaggcaaacacaaaactgcatgttccataagacaattatatatggaactccaatgcacctgcaattccgacgtcccacaaaggaagcctcattaaaaacaatacttggttaagtatataagctatagactcattaatttcagataaggtatgtagtcataaggtctaataaaatatctaaaagagaaaatttaaagccactcctttcttactttgtttaacttattttacttttatcctttaactggctctgtaatatatcatttctattttatcacaattactttaatattaaaattcaaacactagagatatactcatattttgaataaacttatataattatcaaattaataaaatgtttattcatctgcttagtgatttctgcagtattgtgcacttaagaaataattagtctgtgcattatatttattgaaataaacttgtattatattttttattaatatataaggagatgggggcggcctaagtagtgctaaaataaagcagtgggacacctttacaatatgtcttaaaagaggcacagtttgtcactttatcctatcaccctcatttatataccctcaagactagaattactttaacaactaaagttactgttaccaaaggccatatattcaaatatgtatattttgtctggaaaaggaaaaatttcaaagatatagtattcattgacatataggcatgaatgattttaccagattagctacccttggtcttgagaagtagaggccaatgccatgcaagaatggtctttaggaccacagcacagagcactgttaagcggagctggctttgtagaactgcagtgattgatgttaaacaagggcatagggtacttggaaagagaaggagcaagccagcaaaggttgaagatgaccagccaaaccgtctctttcaggttttagtctaggtcctccaggaaggaaaatctctagaattccctgattctgcacttctatctgtacaaataattgtcaatttaattaaatatttcagccagtccatatttctgtttgtaggacacaaacaatgagcatctctgaggcattggtataatgattcaggatgtttaaaaaataatataaatactcctttgatacaacttttcaaaacatgatcactagtgtctttccttcagacataattctcattacacctgagttacaaagactgagagctctaatttctaaagcgtgacatccttgtcctgatatcacaggcatctacttcaacttacaatttcctcaaatggattaattaattataaatttattaacatgaattaactaataatgaactcaaaatcaacaatgcatttaatcatttgaaatgtatatgtagtattaaacctaagtattttgttaatctatccttcaagatttgcacaactcactttacatcaaacattcattcttattaaattatcccagactattacaacattctctaagttaaaaaaaaaaaaagagtcaattaaaaaaaacataaatttggaacctgagaataatccataaccttctactttttatacatcctataccatctgcagtcaattaaatgattcccaggtgttcactgtaattgctttaacgcaagattgcatgtcattttcagggtctttaaatatttattataaaaccctcatctacattttttctccattcatttaggaacaaaaacatgtttatgcttagcactaacaaaaataagccgattggacttaaactgttttgtggattaaatttcattgaaaaataaaactttttatatgccataacttgatgaaagagtaaaagcatagctaggatgttgatttagttgtgctcatttaccttcttcattttaaatttttgcacaaaatacgtgcctatgctctatggctaagatgtcaaaacatcaaatcagatggcattttgtcaggataattgaatattgaggaacgtaaggaccagtagattcatcaactgactcccttctccaaaggtaaaaagtagtttttcattatttagacttggaacagaaaagagtcgtggagacaatctagcaaaacagactcatttcatacacaaggcaactaaatcccagagacttggtcatgtgtatagagtagtacacatgcagtgtgaacaaaaaaatcacaatcactaacttatacataatgcatactatgctccaggaagcgttccaataccttactatatgttaacatatttaattttcacatctactatatgaggcaaatactcatattccccacagaaacctggaacggatgcctggagtaatgtacataaggtcacatagcgggcagttgacagatctgggatttagcagtctccaaaatccatgccattaattggtgaagtatacgtccttcctaaaaatagtttctgaagatatcatgatttccacatgaaaatactctccatgacatttttacatactgtatacatcatatgattgtccccacaatattattagtgaaaatctatatattcctacatgttttaataattttaattgaacatatattcttgtcttctttccttcttttttttttggtggtggtgggggggtggttactcaaacatctcttaataatcaaagtgcctttctagtaaacatgttttgtgtttgatatggtgcaattttggaataacttaaatttgtgaaacacgaaagagtatctactggttaaaaagtaaaggaatatagtttcccttaaacatacgtggttgtacaaattgcatacattactgagattttatttcaacgtggtaaatgaatagaaattactttaaaaaatatatccagactcaaattatgttggagtatattgcatgaattaaaatgctgaggttttaatcagcctatgtgtatggactgggaaatcttttttctaaaaggtgtcctgactctgactttgcttcctagtactttccttgctttgattctttgggcaagtgtgtgtgtgtgtgtgtgtgtgtgtgtgtgtgtgtagtggggagagagagggggaaagagagagagagacagagagagagagagagagacacagagagagagagagacagagacagagagagagagtgtgtctgtcttgaatgttggaggtgggcagaggggcactggcccagttaagagtcttagggaaggtcttcagccttttttaaggaatttcatcaatatcaatttcatcatgaggtcatgttatttcagaaacaaacaggtccagccacagtcactaatgttttgagatctcacctcaattgaccaatggcaaacacaggtccaattatgcataatttaaagtgtatttaaaagacacacacacaccatgtcttgcagttaagtctagattttttttttctgaattgagttggaccaataaacatgctctgttcatttgtctcccatccacaattattttacataactaccctttttgttatgaatccagcattctttaaagcatgttgtcagaggattactaggctcaatgattcttttaatgtagagttgttaaaaatagggcatatcatccagatttctccctattaaacaaaatgtacattttattcagcacatgtgagaaaaacgtgtttgtttctcataagatcatatgcgttcttttaaagcacagtgggatcatttggttacatttccttttacccctttattaccaggaacatcactgtagtttaattactctgtaagatagagatgccttcttatgagtaaacatttactaatagaaactttagatatatgtgtatctttttataaacttacatagttttaaaaaggaagttatttcacaacatggatgctattattaatagacattgactcaaaaaatacaggaaaacaaattttcaaaattatttactttcagaatcctaatgaccaattttctaatcaaacaaatcttctttcatcatatatatatacatatatatttaatttcaatttttaagtgtgtagctgattgacacactctgagaagtgcaaatgaacaatcttgaaacctttattgtggcccatctgattatcattatctctacttcctgacttcataaaccttcttggacaaagaaggcaagcacctcagatctctgaagaaaccagtcaactctgctacaaaagctgtttacaacagtttctattgttaagtgatgttaattgctcaaagtgtaaaatatgaaaaaggaaactcataataaatacaaatatcactttgtttaattgcttgcaaatgacattcttccttattaacatatagtcaggcttatttaagccctaagtttcaagaattactgaggaaaaacagaaaatgagaaattaaagattataattaagatttttatacaatttggttatgccactgattttgttttttattttttattttattattattatattttaagttttagggtacaagtgcacaatgtgcaggttagttacatatgtatacatgtgccatgctggtgtgctgcacccattaactcgtcatttagcagaatatcaaagacaagtaaatgattctgacaataacagcaaggcttccctaggtgttagttcattcagaattcattcttccaaatttattgagcattaaacaaggatacctatgatgaaatacaagatcctatttaaagcataagactgtggttttaagcacactctaaaactaaaatttcagaagaatgacattcagttttttaatacccaattcaccttaatgttttactgggataataatatagatgtgggattgtggaacttcttcttgtttatgacatagggccccataagtagccataataagtatctcaaaagtcattgggactagaatttaaatgaggaatgctaacaaaacgaacaaataaacaaacaaaacacaaaacacaaagctagctctaccagttaagattattctttttccagtttctgaatttatcctcctttcatttttatccttcagctatagactgacagcataaggcacatgagaaaggaaaataaaatattagtttttagctattacttcatcaaaaataaaagatattttgtaatataagaaaaagcaatatatagcttaataacagccatgctggctaagttttttaaaggagaaattattttactgaaatcaacctatactttgtaaactacttataaatgtagtttaaaaatagtatgttaaatatcaatgtaatgttattgataaataaaatataattatcctcatgatattgtgggaaacagtattacattttcagtgatccaaattactacagaattattattagtagcgttgtaaacaaagtctgtataaaaactgcataatactttatttatactaccataaagatttttattctatataaaatatagatatatatatatattctatatatatctttcctgagataataaaacaaatttcacaaagatggtgcataatttacatcctttgcccacttttttgatagaaagtcatggaaaatatcatcatgttatcaacatatatgaatatataacacacctaaagtcaaacacttttttcacctataaaagaaaaataatattctgctaaaaaacataataattatagattaaatagaaaattttgacctggagaatggttctgagactcgtttaagaaagttcttgctttttcttcaaggagtctgacctcttgggatgttgtactttctttaaccacttctcaacaacaatctcattcctctctttcagctttattctaagaagagaaatttggaggaagaaatcttgagttcatcaatctcctccaatgttatgaaggtcaagaaaattagaatcctagacttagtgggggaaattggatattatttggtcaaattcataaagcctggaacttcatcaattcacagaaaatatctgtcaaattgatttttctacctaaagttttaaaatatttagatttagtttttgttaggcttgagccagaaacatataaaatatttctcttttgcatttattgtattagaaataatttgatttaaaattctatcagtgagtcaggattagaattagtacataggatggcctaatcactggactacatatatccctgtgagtggaattagtaggaagctaggcttacagagaaagaaaaaggtggggtacaagaggaatggatattcgctttgctgaaactacttacatatatttttgaggaaaaatggtacaatgagaataaaatatggaaaatactcaaattgttatgtttttagaattgactatacctttctaacagaaatcgatgcattctattggtagacaatagaattgttttacttagaaaatgaagagtaactgaaattcttttccctaactattcagtttgtgtgctaatttttttaatattgcaaaaatagtatcatgactgtactataaccaaggccatacacataaaaactgaaagaataagaaaagaaatagacaaggagggttagaacagctactttatgtatacacaattaaaattagagtctttagaattaaattttacttttctacattgcttgattcattcaagtatgtcttcaaactctacataaaggtaaatttattcttacataattgaagagtttctgaacatgggatacactttctgtgttgtgttttgtaacgtatctctcaacagtaccataattcaaccttatctaatatcacacagatacactgaatagaaaagcatcatgagatttctcccataatatcactgtatttgtaacttaagtgataccaataattacactcaccatcatcacaataatagattcaatatacaattccctaccgtttgtagacactgacaacaccatacttcttataacagcattcaaaatgtgtcattatccccattttagagatgagaaaacggagtgtccaaaagattaactatttcattggcacccaaccaactactaaatagctccctgtggctttgtttcaaatatgaatacattatctcctttcacacagccctagtcttcttttgttctatgttcactaaaatatgcaaaccagcaaaaatacataagtcatcaaaaatacactcaaaggaccaggatattaaatagtttttaagtgtaagcctcagtagaataaatgcatttctccgcacaacaagctgctgtgtcattaacttaataatttgctgcatttaaaactcagcttaacatttttttctttctccgtcctcctcttgctattttctctcatttggcaaatgccaatataacattaaaatcagtttggaacggtaactgaaaatactagcacactaaattctttatttcctgcaggaaagcatgcagtgaaatgcaaacagtatttgcacttcacgtaatcaaatgattgctttgctctataggcgggcattaagtagctattgtgtctgacagtgggcatgggtatatattcttggtgcacttaatttacgtttttttgagacagagtctcactctattccccaggctggagtgcagtggcccaatctcggctcactgcaacctgcgcctcctgggttcgagtgattctccagcctcagcctcctgagtagctgggattacaggcacacaccaccatgcccaaataatttttgtatttttagtagagatggggtttcaccatgttggacaggatgatctcgatttcttgacctcatgatccgcccgccttggcctcccaaagcgctgggattacaggcatgagctcccgtgcctgacccttaatttacattttgacatttctactaagaacttctttttatatcaaggactgaatgcaaaaggcagttctatctggctgaagagttctcaactttaagaaaattaggacatggaaaatctactaaggttaggcccgtttccataggcctatagtttctgcagttccaacataacaggaatgaaacagcatgaatatttaagtggatggttcttgcttctgaatcagttctatatccatacacatatctcttttatttaatcttgaatccatttgctaatagcacccctctataactgctatatctctaattatcacaaaatattatccagttgtagcaattaatagatatgtaatgacaaacttttatgatgtaaagcaaagcaatttttacaaataaaactatatttttagaaaattcatatatgctaaaatgtctcctttttgggttcatcaaaacaaatatttaaaaaaaacctacaaattaagtacacagaatcaaaattcatgtttctaaagctcatatttcaaatgtattatttttgcataatttaattagaaatattggaaatatacatttgcatttaaagatgattaatttctcattaaaataagaatacctcagtcctcaaaattgtaatttacttttctctttccctctttctcattctctctctctctatatatatgtgtatgtatgtataactagatagagataaacagatatgtaatgtttatggtaagtaatttctctgcagaaccaatacagtgttacaaaaataattcagaatctacatgcatatcaaaactttaaattacaaattacttcttatttgccttcttataaaaattgagtcaaggaatcaatcttgtattttgatataaatctccaaattaaaatatttatttgctatgagaaaaaaattaatacttcaccattaatttatattaacaacacataaagcctataaatcttaaaatataatttcaacatcaaatatagaagtaattgataaatgttaatatttattatactcatgcaatttctaatttatataagcagatacaatttattagaaaatatttcccctagaaaagggatacacagacctaatgatgttatctcatgtttccttaagtttatttattataatttaacatatgctatgaaaatatttcttagaaaaatggtgcatttcataattcaagagtaatgaccagcaaaataaatgtaattcaatctcaaaataatacattggcaagagtaataactactaaatacaggaaacatgactagcctatgacaagtcaaatcatgtgcaagaaaattgggctgtaatggaatgttgagttatgtatcagggaaataacatacttccacttttctcaattaaaacaagcacagtaggccagatgaccccgattgcttgacctcgtgatctgcccgcctcagcctcccaaagtgcactccagcctggtgacagagtgagactctgtctcaaaacaacaacaacaacaacaacaacgacaacaacaagaaccaaaaaccaaaaacaacaacaaaaaaaaccaagcacagtaggagcaatctttaccccaaaacactcacctatggtcagctgtccggttaactgccccatgtgatttcttgcattcactgtgacattcctgtcagactgtaagaccagcggactatcctgggaaacatgtataaaataaataaatagaaaatagaaatatcgtcaaatttacaaaaaaatatactgcatttgtttggatattctgaaaaatttaatttgtttgctctatattagacagttaatttaacgtcccaatcattggtggacaatgtacaaaactgagagcctcataataattacttgacagaatatttcattttcataagtgggtactaactatcagatgcaagcatttccaaccctactgattgctgcacatcaacggtgtagtaacccttttcctttttctctcccagtgtcctctatgcctgcctgtgcagatattccagacgctatcccaatggcaaaagtccctttttaagtttaagttgcatctttcagatctcagcttaaatgccaccttctcaaaattggctcatctaatcagtgtaactacagagtctttcaatcctcaaactcccaatgtccatttagtttgtttaaagcacttatcacaaagcaatttaattttacgtgtctatctgggatttttttgtttgcttgtttatttaattttgtcacaaaaggaaagatccagggacaggaaccatgacagctgtgtctatgcagttacgtcattattactaagcatgctgctgaaggaaataatttatgaagtgttgactgagtagataaaaaaatcttcagagtaaaattgatactatagtaacttatttttcaatctcatggaaatgctctgtaaatcatacaaggatttcacaaggaagtatatacaatatctgatttttgtaaattctcctttaggacataaaactctggtaacgtgttgacttttattagtaatttagcatttaacagtaaaacagttgattgaaggacaataacactgccttaacagctcacatattaggcttctgtcataccttccacagacaagtaacatccaaatccctacattctcattttaacgctctaaaacctaagtagggtgatcatttacaaatctctattaatttattcaataaatattcattgcatactcattatgtacaatataatgttctggggggggacatttcggtgatcaaaaaatagaacaaaacttgccctcttggtgcttgcattgtggatgctgaaatactatgaaaatctcctccaatatcatccttaccatctaggcagtatgtcacgtctatgtcaatgtcaatatacaagtgctttcatatgtaagctatattaaaactctcaatattaggatttggaattggtgatttggagatatatatgtatatatataaaaattcatataaaatttttatttcgacagatttaaaagaaaaaaaagtctagtttttttttccataggtgtaactacctacagacacttatctcctaaaagatctaaaatatttaaaattaattacatcatcctaatcaagtgatatatccaaattctgtttaaagtatagttcatggactaaagattgtttgcaaacagctatcttatacccaataagaatactactgtctcttgataatgacataaagatgatggttcatacatgaacacacacacacacacacacacacacacacacacacaaattctattcaatcttggcaaaattcaatgtaagtatgttaaaaaggagctttgaattaaacacatttgaatatttgaatgtaagaaacaggaaaagtctatgaaacatcctgcagttcaaaaaattgtgaaaaaactataggtcaaaattatgttcactttctctcaatatttgtatgatatagcatacatgagtttggtttagagttttaaaatatatgacactatatgtttttatttgagttactagacatattaaacataagcttcttatgtcaacaatagagtaaaacaccataagcatttgtatatataatttatagactatgtaagtatattataagaattatttcacgcctgtaattccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaaaaagaattactgccttattacacatgttaaaatagaataattaggttgagaaggcaatggatagtttacttaatttaaaagagaaatagacttgttagaatggaaagtttagtccgggcgtggtggctgacacctgcaatctcggcagtttggaaggctgaggtgggaggatcacctgaggccaggagtttgaaaccagcctggccaacatggccaaaccccatctctactaaaaatacgaaaaattagccaggcatggtggtgggctcttgtaatcccagctactcgggaggctgaggcaggagaatcacttgaagctgggaggtggaggattcagtgagcccagattgcaccactgcactccagcctgagtgacagagcgaaactctgtgtcaaaaaaaaaaaaaaaaaaaaaaaaaaaagaactgaaagtttaaaagtttaatcattccgcatctttgtttgcaacatagcaatctccttttactctaaccgcagagaatttgttgaagttctgtctctagcactcttcccttcttttcatataattctcctaattttttgtcagaattaaaattttatatctagattaaaatttcactgtgatagcaccaataatctttttacttagtagaaccataaacgtgtagctctcagaggtagtgagttattctctatgctgtgttcctatgaacatcaatatagtattaagctatacttatttattataatgtgatcaagtgatctgaaccaaaaccaagtatccatttttgataaatgaaatttgatgcctgtaggatcatcacttccatccacaagtcacataatcatttctgtattttatatcaataccatatctttgtggattagacccattgctcatgcatttgaggtttaacacatgactttttacacactatccactcagtactaattaaaacacatgtatgtgataaaaatacgtataatgatgaaaaaatctttcagtcatttaagggagatacaatcctaagcaattcataaatctgatctcaaatatatgtttaggttagaatcagcaccaacataccacctcttaaaaacaaaaaaagaaagacatttaagaaatgttttccctaaataaagaaatgaatgctccttaagttttatgtcttttttcttgtgtttgtttctccaaaggtctctgtatgagaaaatgagaaaataactgatactaatattttactccattccactgtctgatttatatcctttatattatacttgtgtgttccaaaattttgaaagcgaatatgtggtttaagatatttaaatagacatagtagtactctcttatagtttattcttgctgagaagataaaggagagaaatctattttgttgatattttctcatggaatagtaatcagatatttaagttatgtaaaagtaagaaagtagttaatatattgcatgatacactactataaagatataatatttatatatagcatgataagctagtataaatatataaacaatatataataatatatatcctatatataatatatagcatctacataaaacaatatatataatatatagcatgatatactaacataaatatcttttttttttggaaaaagaaaatctttatcttctgatgtagttatttttcctccaagccaataaatctcctataacagaaataaggtatctcatggttttccgaagctgacccgaacttgcctctagctctagaggacatatccgccttcttatgtcactctttagacaaagcagataggtgatccagttagaaaggcaacgagactgttaagtgggcctgagaggttctgcttacaattctgttacacacatattcttcatgccaagggcatggctgcaattttctaactgttagataaaaataatgaaatatgttcttctcattttaatatttttttctgataggctatgcatatgaccaatggaaaaatgattttttctttttatttctattgccttcactttatttataacaaatatttactcagtgcttgtaatatattcagcactctgctaaccactggatacaaaagagaaagaaaggagacagacttctttattttctggagttcccaatctggtagccagacagacaataaaccagataattaacaatcatacaaacagagaatattaacaggaacaggctggtgtgacagatatttccttaaaaaagcattagtaatattgttgagaagatatgggtgtttcaggtaaggatttagcttcagatgctcattctctccagtttaactattacattaagtcgtagtgaaatagcagtggtacaaacagcaaccaacatttactggcccttaatcaatgccagatactgctctaaatactttacatatatgagatcatccagttatgaagcttacaataaaaccatccacgaagggtcaagataataacatgattgtaagacagacaggggaccctgaccatttgagttcaagcccaaaggctgccaaatgctgacttccaagttactccacatttctgcatcatagtctcttcatctgtaaaataggggtcatagcacataatttatgtgcttgttataaggattaaatgagacaacatatgcaaaatgcacagatcagagcctccctctgttgacggcaatgtgtgcttttatgatttattcctcaatttaactatagtattttactactaataatactggataccatcactcttgtttcacaaataagtatagtacaaaaagattaagtcacttccttcaaatgacacagctaaaaaaggtaacaagccatgttggaactccataattttgtttcaaatatgccctgtctaccacgaggaagtactgtgtttcttggggctcatctaattctagattttctgaaatgtcaaaccaatataaaaaaaataggaaattgaattcaacaaaacatactttaaaatttctttaagcattttggtctctaaaagaaacatcttatactcacacacacaaacacataaagcttaaagtgtaagatatgacctctactttgctgctatcatccaggttttggtagcatgaccttgtttgtcttgtttcattttgtctcctcagattccaaatgaggagggtatgttataaactgtcatctgcctacacattttagaaagtattgcctatgcaaatctccctacttggtattctgaaagaacatcactagtgacctattttgttcagtgtagatgatgtgaatttggtattttgttaccgaagtttgtatagtttacaagaaaaattttcttctcagggatggaaatatagaatttgccaacaaatctaccttatcctcagttcctctaatcttcctaaatattcagtcagctgcgtcagaaatacttcttgaatgcatcttttcctgtttttccatgcctacttctctaacagatttaaaactcacatcgcaataaccactcgatttttcatatccagtgttacttaaaaatacttttaaaacatattggcatacttgaatgaaaagaaaacaaaacactgattgattcctaactctcagcttgaaagaaatttatgttcataacatgtaaggttcttcacaatgtgacccaattctacttttctatctctacttcacctcacttccgtcatttaagagtaagccaaatttcccatgtttgtcaactacataccacttatatttattttcaccttcagtttcccaggcctgaaattcttatccatgtctctttatcaggaaaaagtatagacatttttccagtccaagtctaagtcctgtcctctgtgaagcctttctactcctccagagttaaaattcacctcccacccttcagttcctcagtcagtgttgacatcgatcacagtactcgttgtaggctttttgacttactttgttttaatcattcatgtgatttgtaaccttcatttaactgaactgtcctgaaaacatagtatgctgtcaattagtttttctcatacagacttttaaaagtatagtttgtgtcacgcttgacacatactttatgttcaataaatgcatgttgaatgaatgaactgaactgagcacattacaagatccaggctacatgggtttaagtggatttgtgttcagatcacaccaaatttaggaagccattactccccttcttttcttccttcttcctcctcctcttccttcttcctcctcctcttccttcttcctcctcctcttccttcttcctcctcttccttcttcctcctccttctcttccttcttcctcctccttctcttccttcttcctcttcctcattcttcttctttttcttccccagagcaaggttggtaaaaattcatttccgtgaaacaagtcatatcaaattattatttaatggttattcatcatccctgtgcccaaggcagctacgtcattcctttccttaatacttgacccactgaagctgcaaaacaagtgtttactttgttctttgaaataaaaagtaccagtaccatgctgttttggttactgtagccttgtagtacagtttgaagtcaggtagcatgatgcctccagctttgttcttttggcttaggattgacttggcgatgcgggctcttttttggttccatatgaactttaaagtagttttttccaattctgtgcagaaaggcattggtagcttgatggggatggcatagaatctataaattatcttgggcagtatggccattttcacgatattgattcttcctacccatgagcatggaatgttcttccatttgtttctatcctcttttatgtcattgatcagtggtttgtagttctccttgaagaggtccttcaagtcccatgtaagttggattcctaggtattttattctctttgaagcaattgtgaatgggagttgactcatgatttggctctctgtttgtctgttattggtgtataagaatgcttgtgatttttgtacattgattttgtatcctgagactttgctgaagttgcttatcagcttaaggagattttgggctgagacaatggggttttctcagtatacaatcatgtcatctgcaaactgggacaatttgacttcctcttttcctaattgaataccctttatttccttctcctgcctaattgccctggccagaacttccaacagtatgttgaagaggagtggtgagaaagggcatacctgtcttgtggcagttttcaaagggaatgcttccagtttttgcccattcagtatgatattgactgtgggtttggtaccagaacagagatatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactgcatcccttccttacaccttagacaaaaattcattcaagatggattaaagacttaaacgttagatctaaaaccataaataccctagaagaaaacctaggcattaccattcaggacatagacattggcaaggacttcatgtctaaaacaccaaaagcaatggcaacaaaagccaaaattgacaaatgggatctaattaaactaaagagcttctgcacagcaaaagaaactaccatcagcgtgaaaaggcaatacacaaaacgggagaaaattttcacaacctactcatctgacaaagggctaatatccagaatcaacaatgaactcaaacaaatttacaaaaaaaaccacaaacaaccccatcaaaaagtgggtgaaggacatgaacagacgcttctcaaaagaagacatttatgcagccaaaagacacatgaaaaaatgctcatcatcactggccatcagagaaatgcaaatcaaaaccaccatgagataccatctcacaccagttagaatggcaatcattaaaaagtcaggaagcaacaggtgctggagaggatgtggaaaaataggtacacttttacactgttggtgggactgtaaactagttcaaccattgtggaagtcagtgtggcgattcctcagggatctagaactagaaataccatttgacccagccatcacattactgggtatatacccaaaggattagaaatcatgctgctataaagacacatgcacatgtatgtttattgcggctgtattcacaatagcaaagacttggaaccaaaccaaatgtccaacaatgatagactggattaagaaaatgtggcacatagacaccatggaatactatgcagccataaaaatgatgagttcatgtcctttgtagggacacggatgaaactggaaatcatcattctcagtaaactatcgcaaggacaaaaaaccaatcactgcatgttctcactcataggtgggaattgaataatcagaacacatggacacaggaaagggaacatgacactctggggactgttgtggggtggggggagcggggagggatagcattaggagatatacctaatgctaaatgacgagttaatgggtgcagcacaccagcatggcacatgtatacatatgtaactaacctgcacattgtgcacatgtaccctaaaacttaaagtataataagaaaaaaaaaaagaaataaaaagtaaaagctgggcatggcggctgaagcctgtaatcccagcactttgggacgccgaggcgggcagatcacggggtcaggagatcaagaccatcctggctgacatggtgaaactccgtctctactaaaaatacaataagaaattagccagtcatagtggcgggcgcctgtagtcccagctactcgggaggctgaggcagtagaatggcatgaacccgggaggcagagcttgcagtgagccgagatcgcgccactgcactccagcctgggcgacagaatgagactccatctcaaaaaaaaaaaaaaaaaaaaaagtaaaacttttatatttgaaattcatttccttcagaatgcaaatcatctaattattgaaatttttatgttaaaggaagaagtgcttattatgaaaataaacttatctagagctgtttacctgacttccttgaattctgcactcacattttaacttgaatgtgaagtaatgcagaagagagatattatctatgtatcaatcaactttatgcatttctactctgatacttttattgagaatttccccatttggtttagtcacggttatgaattagctagtcatggaggccactgctaggaatctcttctgagaaggctctatgactttgcattgtccttctggctcctgtccacctctttaaagctatacagtaatcagagtagtccccatcctgaagctctctttctcccaaccgataatacggatggtattgatgaatatgtatccagaatgatgctgcagggagcagttttacacatgacagtccatttacagggaatctggggtaatctatcacttcctgtatcagtcaaaaacctccaactccacctttagccatgggtgggcttaggaaacaaatgcttctagactcattatcctaaaagggaatagtactatctctatctaaagtaacaaagatccaaataaatcagacactgctgttgctttagtcagatgaaaagatgcttcttcttttcctcttaggcaacatttgcagcaactaggagatatcctcctcttagcacttctatgttgggttgccacttttccactccagctgcctcttcagttgttcttgagggtaatgttgccctcacaccagccccagggttccaaccctatccactgtgagtgctactgtctgtccagtcagtatgttcactatggggacatgattgaggtacacctcaattgatgaggtcaaagagactgcatgttgactaagtagaatttagacattgtgtcttattttggtgagcagaaagaaatgtacagcatatgtgaaaatttactttatatagaaaaatagacaatctgcagatttaaagcaaacgactaaggtaaagcagtaattttccaccaatggatgaatggtttagccaatttgtatgtccaaagaaatcaaattttaatggaattagatattttaaatcacttctttttatggatcgaggaaattattaaattttctagaattctagaatggaactccccagtggtgagctggtagatttttcaaaccaagcactgtacaaacatttttcccacttctcttctaatagaatgatagttcatttctgtagtattgcatgcttatggcttggaaaaaaacaagtgatgagttacataaaaagcttgtgaaacttttgaaactactggctaccatgatcttaatttattaactacctatcatgatgatggtgatgacgatgctaatgatgataatgtgcgtgtgtagagagtatcccagatgcgtatttgtatatgatacacagttcatgttatatgagtatcatgaatgatgaaaactagaaagtaagtagggaactaagcctctattaaactggttttcttttatcttggtgggaattggtactgtaaaaagaataagaagactctgtattctaaactttttaaaggacatcatatttaaataagaaattaatctttatcaaataagttggatatgttttccaataaatctctaactagaaggaggataaagaaatggagagcttaagagaaaaaattgcctttgagattattttccacagatatattttcatttatgataattacatttgtactagttgaaaaaaaatctttttttttctcctaaaatctgcttggattatgaggggttttaaatatctggaaacattagggccacatatttagttgactttatgtgcatgtatgctgtaacttaatttctatagaaacagatgagaaaaaccagagatataatatttatgacaaatatgtttctataattacaaataataatggaattacaaaatataaacaattggatataaactcaaataagtacaacacagttatagtacctgtgatggttagttttgtgtcagttagactggagatgggtgtccaaatatttggtgaaacattattttgagtaggtctgtgagagtgtttctcaatgagatgaacatttgaatcagtagtcccattcaggaagattttcttcctccccagtgtagttggacctaaatagaataacaaggcagaatacaagagaattcactctctctgcctgactgtcttcaagctgggacatgagtcttctcttgcttttgaattcagatcaggagtggaacttacaccattggcgcttttgattttcaggccttcatgtttggtttagcatgatatcacaggctttcctgggtctccaactggctaactacagatcctggggtttctcatcctccctaactgcttgagtcaattctttataataaatctctttatttattggtctgtttctctagagaacccagactaatacagcaaccatattatttactaaaggaacatggtaaaaacatgcatgaatgctaagcaacaaggagaccttgcaagtagcaattattgtgcttgtatgagacactatgatttcgcatactttgaagcattttgttaattgtggttataccttagctatatctgagaaggcaatactgcaggagaaatattagagataatctattttcaacttctatagtcattactttgaagatctctagcaagtcttacccttttcttcctcaactaaataaatgtggggtggggggaatattcctgagattactttttcaaatgactggagcgatttcaaacttctgacatttttctacactaatggaagataaaccaagcccctgagcctccttgcaagatggcaagattttgagccagaagcaatgtaagtatgtctagctaaatcaaaagagtaagtatatcatgtgtggtgggcaaacattaagaatatgtcagaccaaatagcacaagacacaactaagaagattactccaacccagtgcttacaaatcaataatgtacatacaaatcatctgaagatatttctaaatgaagacctgagttgaagcctaagattctgcatttcaaacgagcttccaggtcatgccaacaaagctggtctgcagattactctttgagtagaatgactctaacagcccagctgaggtgcaggactagaaatggacttccaaaaagctcccagccagaaccttttagatctggagtgtggccccaaatcatagatcaagtagaacattgcaattgttgcaaaaaaatttttgaactatttcccagcccatgttaaacctacaaatctataaattagaatgtttgccctccacaccccaatttccatgggaaagactgctcacaaaaatgtgtcgaaatttttttttaaagcaatactgcagttaagctacattttctaatcttttttatacacaggcataaccatacctccatgttataatcagcagaatgtgggcagaagtgatataggacatttacaggcctgcactataaaaacctgcagtgtgctagcctccccacctgaggtcctagagcgatatggaaccacacatgaaaagaataggggtctccatatatctgcatggatcagaaccaccagtcctacaaataccactggattgtgtagtgacagatatataatttttgtatttgagttaacccttgagatgccagaatcgtttgttattggagttggcctgacctgacagaacagcccttgctctcctctgtagggacttacatgtcccagcgctcctatgcacccaaggctccttccctgtagtgccctgacaactcttcttccctgtcttaagttggctccatactcctcatcctttaatcatgttgacttttcttataactctgatataccgccagataattattaagctagagatgtgtatgttaaatgacatacttgggctaggcatggtggctcatgtctgtaatcctagcattttgggaggctgaggtggagggatcacctgaggtcaggagctcaagaccagcctggccaacatggcgaaaccccgtctctacttaaagtacaaaaattagccgggtgcagtggtacgcacctttaatcccagctactcgggaggccaaggcaagagaattgcttgaactcgggaggcagaggttgtggtgagcagagatagtgccactgtactccagtctgggcaacagagcgagactctatctcaaaaaaaatgaaaacaaatacaaacaaaaacgaaagacatactcaaaggcactgatatctaacatcatgtttttctctcagggataattaatcaaaatggcttcattcagagcaggcaccggccaacttttattttcaagagacagacagaaaatcagatagtaaatatattatgctttgtgggctatgcagtctctgtcaaaaccattaaactctgctgttgtaggtcaaaaggagccacaaacaagaactgaatgggcatgtctgtattataccaaagtattatattttaataagagacagtcagctgcaagccatagtttgcctacttctgatcttgaaactgaatctccactgaattttggaaaccaaagttatagcaactaaacccataacattttcaaaacaattctagtattatataaaaacattgtttttaataatttttaaataaataatgcatagtattagacttgcatgcattttatataagaattcataaaaaggaaaaaaattccattatgttaaatgtaggtataaatttaactttgtaaaatgtggcctgggatactttgcctcccgggttcaagtggttctcctgcctcagcctcctgagtggctgggattacaggcgctcaccaccacctaatttttgtacttttagtagagacggggttttgcaatgttggccaggatggtctcgaactcctgaccttaggtcatcctcccacctcgacctcccaaagtgttgggattacaggcgtgagccaccgtgcctggcctgattcatgtcttttattagattgggaaaacttctcatctgttagctcttcaatagggcctcttcttcattctttacagtctccccatatggaattcacattagatatgtgttatatcttccttcattctgcctttcatgtctctttaatgctctcttatctttcccatctccctgtctctctgtgatacatgctggcttatggcttcatatcttgtgctagcagttcttagctatgttactcagctcttaagttattcattaaaatattaatttatgaatatatttttgtcatgtatttttttcagacttgtcagatatattgtttttattgttattgggttttactatttttattccattgttcatttctgaagcattgatacatatatatgatgtatatataattttaatattctgtatctgaaaatttcaattactgaagtaactgaaaaatctaaacttgtgaataattgtttctgttaaatttcactcgaggtagcccattttctgatagcctttttgattgtttgtttagatcataattaaaatgtgagaagcctaaggaaccaggattaagggttaaggaagcattcttctagagaaagtttgtattgtacctgctaagtcctagagatgagtacaaacctcgagataatataaagtcgagggggcaggacaaaattttcaagaggctcaaggatacagtacttgtaactccaatggcctgatgttccttttcctgtttccagccattagtccccagagcttcagctttcaggcagtgccagttgtctctaagggaaattctgattttagctttcattttctactattttttcaactccctgtttctgaaatttacttcaccatactggctttccattatcttttgcaaatttagaaattcaaagaaaatacatctttttgtaacttaaggcatagctaggttgcctgtgggattttatttcagaacatacagcctgtgaatttactggatgcgacgtcctcattaggcatctttttgcataaccaatgaactcattattcatgaaaaataaataaaagaaggctagagtatggaggtaagggttgagaagaagtaaatatagaatatgctgtcattaagaataaaacagtagataacttgaaattagagaacaagatagaacttagaaacatatattatcatatgcttctaaaaatatgcttctaaaaaataagttgtgtgtagggtgtgtgtgtgtgtgtgtgtgtgtgtgtgtatcagtcaggaagaagtgtttgcagatttaatttttgtttatgaattgccagatcttacgtgaaatcataagcaactgtaatatattattataagataaaagcatagtgcttacttgtactatttgtacaagtttcatccagaaaaagagatttcaattacatttccttgaaagactagttgacatgtatatgaaacaagtaatctttatgcctcaaagctgacccattcttttctcttttttgacttaacagaaaatcactttttcttcaaatcagaaataataatattatatctgtatccatatatctgtctatgtaaagagatatagttcattggttatataaaaaggtatctaatgagaacttctagtaaatttgcagactctgtgttctgaaataaaatcccacatgtaactgagctatgtcttatttatatatgtaacataaatataataaatagcttattcttgctttacagaacgagctatctatattaaaacagtagaaacaactagaaatttccacatctaataaacattagcaaatattggtataaataattttttctctcaaagtgtgaaccttctcctagtggagaaataaccataggactttcaaaaatcttttttacatgtaaaaaattacagtttttctcacttgttctgcttttcatgaaacatttaaaaataatgcaatctgaagaacaaacatacagaaagaaaaacatatttatgcttgtattaaaacagtacttcttccaaaaagatattaaatatgttacaaccttaaacacagtcttaaattgggcactaaaatccattaacagaactgaagactttttaaaccatgagaaataaatgtgtctaagcacttatctcgttgcttataatcagcttgttcctagaggtgaaccctggattttgagtttaccggcagttaaggcagaataaaaatgttacattataaaattttcattgcctgataaaagaaagcaaagaaatttacacagaaaaatattttcccacaatactagcatttgatcttcgctctctcagaagcttaaatatgttcatttaaagcattcgcttgtaaatttgggcaaatcaaatggtgccctgcactgctggcactgaggcctgcctcacctaatgctactgggggccaggtgtaggtagagcattagggatatagtcagatgttatcttaggtcaaaaataagtgaagcagtaaatgaaatgaatgaatagtgttaaaaaagattttaaaaattgaatccagcttttagtgtcatattcctctaaattgtttcatttcccattatttctatatgaaaacattaatttgatatctgatttacattaagaacattaacaagataaaatattttaaatgtcatcctttccactaaacatatttaaaagtgaaatgaatatgcatacttaccattttagaatgtgaaagacatcgtgtcgtctttttttttctggaggaggaatttgtgatgtgtgagattcattattctaaatgtgagtgatcaatttactaaagctgtagaaagtgtgaggaactgatctgtattcatttatattcacattctgcactgtacaattcttcacaattcagtgactatgaatttgcacaaagttcaaaatctcttcctgatccacaaagtgaagttctgaactagattcagaaaaatcatgcactgcttttctattatttctccagtttggctgcttttgctgcctcttccaatgggcatggaggtgggtggatgtcctctatgtatctcagtattagttccagataattctctctctcgtctccctcccccttaacctttaaagttcacatcacgacactacacaagtcactacgcttatcagccctcattcctggaagatttcctcttttggttcacccactgccatactcccaggaatcattccagtcataattgttggtaatttcagttaccatatagataatttcctgatactttgaactcttaggttgttgatctatcctcctatgatcttgtcacattcacttcatgagcctctctcctgctcattcgaagatgttttcatgattaataactgtatctcttccattatctccattgtaagcctaacacaatatacttgtccttttagcttactgcttctaatgcccaacaccaacatgtaaaaaaatttcttgaggattgaggtaaaagtacaattaaaatttgtattcaactgataaaaagacaattacattataaatttgttttatcatcgctaaaaagacaaagtataaatttattaaagataattacaattaaaaatttaaaaaatataataaaaacataaatcatccaaaaatattcttttaatgaatttttctccaattagttcactgtctttggatgaatataacttattaatgaatgaaagaggttcaacattagatatatgctacctttgcagtataatgtgtgggatgagaaatatattcatataaataagtagaaataaagagatttggcataaaaatgttacttaattattgaacagattttgaggtatttccatcaaaaaccctatcacattgatttatcttcattatatttgacaatagcccaattagatacaaccttcaattttgcaataaggaactaatcagaaaccaacaaaactgccacatgtttcattatctattcattaaatatattacatctctcacttcgaggaacatgcctaaaaactttttagtaaaactaagtgattgcttgatatacctcttattttctcttgaagacctactttgtttaatagatatattttaggaaaagctgggatacttgatagatggcagaagcatatgatatataaaatgctttctttctttaatatgcttcatccatatttttaccataaccttggagcccaggatttactttaataaattcattaaaaagtcttccatatagccatcctaagaaagatgtaagagaggtgcatgtatgagacatagatttttgccatatagtcattggctctatattcttaatcatgtctcttcctcagaaaaagtgcactttaacaccagtcagggggtgaaaaatggaagatccctagatggaacttgttagcactctgatctatcattctacaagatacctaaatataaaacatttcagctccttcagaataacttgcttcatgcttaatattaaatccctcatatacatatatgatatataaatcctactatgagtttttgatgttcagttggaattactctctctttctcctccctgaaggtttaaacccttaagacaatgcattttgaagataaaaaactatgattttacattagaaagatgtagtttaccataaccaatatttctaaaatgctccatccaatgagcatctctaagtttttatagtacctagtgtaccttataatctgtttgtctcatttctcaattacatgaatctatccacaacacaaaatctgagttatcaactttccgggttcacagaagctatatcatcaaactgtctaatatttactcttactttaattacagctaaattaattatttatagaccattgtttaaatgatatattcctctcaccattacggccagaacactgagttagacgtatataatagagtattcatttgttaatcttcttcaaaatcacttttatttaacctcaattaaaaataatcctcattatttttagggtgatacaatattaagctagattgaacaggtttctggccaggcgtggtggctcatgcctctaatcctagcactagaaggccaaagtggacagattgctttaatccacgacattgagacccacctgggcaatatggcaaaaattcacctctacaaaaaacaaaaattagctaggtgtgctggtacacacctgtagtctcacctacttgggaggctgagatgggaggatcacttgcttgatcccaggaggttgaggctgcagtgaaccgtgattgtgccactcactccctcactccactcactccagcctgggcaatggagtgagaccctgtctccagaaaaaaaaaagaagaaagaaaacaaaacaaaaacacaaacaaaacctaaacaggtttcctcttttactctaaaactgtttttgcagcattctttctttttttttaatacatccaaaaagtacattttaacgtatgacaattttttttttatacttttagttctagggtacatgtgcacaacacgcaggtttgttacatatgtatacatgtgccatgttggtgtgctgcacccattaactcatcatttacattaggtatatctactaatgctatccctccctcctccccccgccctatgacaggcccaggtgtgtgatgttccccttcctgtgtccaagtgttctcatggttgaattcccacctatgagtgagaacatgtggtgtttggttttttgtccttgcgatagtttgctgagaattttgcagcattttatattgttttcctccataatctccttaggaagctctacataacaaatttctttggcaatttgtgttaagaagagctttgtttcttttaattactgattatattcttatatttgaaactggaaagatatagatatagatatatagacatatctacctaccaattcaagatcaataaatgaacaatttgctgcagtgtctcgaagcaaatgaaatgtcgggggaatttggtagtttgttgaataagaaccttgcgtgacattttgattgaacttggacttttaattacaactaccaaagtagtgaggctgtgttattcaaaagaagtgtcattaattatgagatcactttatgttttggaagtattatatgctaaaagagaatatagatactaaacaatcagttttatatctaaatataaacaaaattctgtgtttcccccatgtatgaagattataatgaaaactaggtctgtccttgtgagtttctcaggacattaaacttacaccattaatcattaaggtggcatatttcatttaaagagggcaatgtattagtcctctgcactctgcaaacacatgccctgtacttccctgatctctcgggaatactctgacctactggaggattcatggaacaaagtcaaaatcatactgcaaaagataggtcacaactctggactaactgtagaaattcacatgacattctggaagagccaaagttcttcattaggttaatagacaagatatgaagaaatataacagaagatttgtacttctccaaaaaaatactgatactatattaagtaaaattatattgaaaatttatctatatattgtgatactgagctcttatgaagtatattcagaagagcacaaaataatatacaaattttactggattaatgtaatggtcttgtgattagtttacctgcaagcaggcaaaacccacattaaactgcagtttgtatatcttaaggtattttagacaagcttgcatgaccttcaagtgtgaggattacacgcagcacaatagaaataaatgagaaataggtcagtttgtagaaactattcaagaacatgcccttgccttcttcatgcttgcaactaacttccaaaaataattagacattataaattatgtagcatacaggcaaaggcagagagcaggtttataaccttagaaaacgttcagcaagaagcttaaccatcatcacatcatatatttagctgtgtcttcctgtttgattccaaaacgtgctaaaagtcttccctctatactttagttttttatgttatgaaaaaaggcatttagccttgggtaacctctagtatacggatttgtaatactatattttgtaaggcaaatgcaattttcaatttgttatgaagttttccatttatgccatagataaaatacctactgagttaattaaaaacacacatgaatagaattggacccacaaaaatgtataaaaggcagcaagttattttcctttagaaaacaaaaacactatgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtcgaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatttctgttttggtaccagtaccatgctgttttggttactgtagccttgtagtatagtttgaaatcaggtagtgtgatgcctccagctttgttcttttggcttaggattgacttggcgatgcgggctcttttttggttccatatgaactttaaagtagttttttccaattctgtgaagaaaggcattggtagcttgatggggatggcactgaatctgtaaattaccttgggcagtatggccattttcacgatattgattcttcctacccatgagcatggaatgttaatttccatttgtttgtatcctcttttatttccttgagcagtggtttgtagttctccttgaagaggtccttcacatcccttgtaagttggattcctaggtattttcttctctttgaagcaattgtgaatgggagttcactcatgatttggctctctgtttgtctgttgttggtgtataagaaactaccatcagagtgaacaggcaacctacagaatgggagaaaattttcgcaacctactcatctgacaaagggctaatatccagaatctacaatgaactcaaacaaatttacaagcaaaaaacaaacaaccccatcaaaaagcgggcgaaggacatgaacagacacttctcaaaagaagacatttatgcagccaaaaaacacatgaaacaatgctcatcatcactggccatcagagaaatacaaatcaaaaccacaatgagataccatctcacaccagttagaatggcgatcattaaaaagtcaggaaacaacaggtgctggagaggatgtggagaaataggaacacttttacactgttggcgggactgtaaactagttcaaccattgtggaagtcagtgtggcgattcctcagggatctagaactggaaataccatttgacccagccatcccattactgggtatatacccaaaggactataaatcgtgctgctataaagacacatgcacacgtatgtttattgcggcattattctcaatagcaaagacttagaaccaacccaaatgtccaaccataatagactggattaagaaaatgtggcacatatacaccatggaatactatgcagtcataaacaatgatgagttcatgtcctttgtagggacatggatgaaagtggaaatcatcattctcagtaaactatctcaagaacaaaaaaccaaacaccgcatattctcactcacaggtgggaattgaacaatgagatcacatggacacaggaaggggaatatcacactccagggacagttgtggggtgtggggagtggggagggatagcattgggagatatacctaacgctagatgacgagttagtgggtgcagtgcaccagcatggcacatgtatacgtatgtaactaacctgcccaatgtgcacatgtaccctaaaacttcaagtataataaaataaaaaaaaagaaaacaaaaacacatttttgcaatataaaatttcacttaaattctcaaaccactggatatcttgcccaagtaaaacaactttctttcccttgcctcttttgctaatacagagacatctgagctgctactcaaagcctgtcttttaatattttaatcataatttttaattgtgatttaataagcacatagaatgatgcttattaaaatgtttaaagaaaagggctcctttctaaacaaaaaattcagcgtaggttttaaagaaagtaagtattttgacagtttatgttcttgttgttaaagaattaccgtagtgtaaatatttccttgcaggtcgaggtaatatatatcaccaatattgttcttctgaagctctacaatgagttcactccctttgaaagttttgctgaacataatattttatcagcctctgtaagaacaatgcaaaaccagtctgttcatctggaccaatgccaagtataagctatttgagctaagtggatgtttatagttattcttaaatttacttgtcaataatttgaccaaagagtaacgttgatcataccaaccaagcaatgtaaagctgaacaaaagaatgatcaaaccattctcacgctgaagattcactttaggatggagtaacagactccataaatacccaataaattattccatttcattagggtatggactaactctttaggatatagaaagaatatattaaaaactaactgggcatttgaagacggtcagaggatctaaattccagaagcaaagcaaaagtagaggaaaagtttactgaactttcaaggtaaaattattccttaaagatctggttttactcacacgagttgaaagataattgattaaattaatttgaccaactcctactctaagcaatttaagcacgacaaaataggcactaatcagaggatacagtatagtttttgagagaattaaatctgtgacacattactccttgcatgatcacatgagtatcaattagcaaatgactatatttactgatatgcattaaggtaactttgtttagaatgaacttcagttctccaagtaaaaccattagcaatttaaaaacacatatattaacaggctaaaaagcaaggaccttactgataaggtcgaatgctacaaaagtgatacacgttttaataggtaaactgttctttgcttcacaatcatttcagttgccttacgttgtttaaataattctgtacaatagcactttctgtgacaatgtgaaggcttatattatctaatgcagtatacactggccatagagatttcctgagcataggaatgaatatataattttaaatttttacttaaggttaattaatttaaagtggaatacccacatgtgacaaatagccatagtatttcaaagcacaggaataattagagcaattcagttctgcaaaagtatcctataaaaattattctaatttccatatttaattataaaaggatatatatatataatctacattgtagcgctcaaaatattttcttatatttagacttttctcttttattgtcatcgagctttaaaacttcaagaaccttgaataaataatacaaaaatcatctaccatcatcaaagatgtatcgtgatatatgagcataaaacctagaattaaaaaaatcatgatgcaaatcccagtcaaacaaagtttcaagtaatacttcaagaaaaaaaaaaaaaacagcacagagcttcttgaattagaaaaagcaaaatgtgagaagtataaatcttatatatttaagcactcactacatcacaactaagaaaacaaaaccaaaattgagaaatcccttattaccttgatttacgcgaacacttgcctgcatttgtattttgtacacaaacttctcttttcttaaattttaaactatgcatttcctgaacaataagattattttggaattgtttcatgaattttttctgcattagtttttgtttccactattttgtgtttaatggaagttaagatattaaacactacaaactaaaaataaagcaattcaaaactatttttcaacaaatcgtaagtgtaaataaaagtatagtagtttatgagaggttaaaaatgaagcaggacacagtaatatgttttaagtctatgaaaagatttaaaaatcagaaaaggcctcatgcctgtaatcccagcactttgggaggctgattcaggcggatcacttgaggccaggagtttgaaaccagcctggccaacatgatgaaaccccatctctaccaaaaatacaaaaattagccaggcgtggaggcacgtgcctgaaatcccagctactcaggaggctgaggcaggagaatcacttgaacccaggaggcggatgttgcagtgagccacgatgatgccactgcactccagtctgaatgagaaaatgagattctgtctcaaaaaatacgtatataactaaataaaataaatgaataaatacataaataaaaatcagcaaagaagaggcagagcaaaatggccaaataagaccctccagtgatcatctacccacagaaacatcaaatttagcaactattcaagtgccaaggtaccctcacaagagcttaaaataccaggtgagaggtcaaagtacctgattttagcataaaaacaaaaaaagatgcaatgaagagggcaagaaggacagagtcacactgccatcttcacccctctcccaactccaagaagcacaactcagagacagacaaaactctcaggaagcgagagggaagtaattgcaggactttggcgtggagtcccgtgccaggcctaccagggtgaaacccagcatgaagcccagtattgggcagaatcccacaacctctggctccaggccacggcccacagacagatagagccacctggacttgcctcagctctaaaaggcaacctacagccccagcagtatggtctcatgttccagccagcactacccagtggtttacagcagcctcagaccacaggcgaacctcagtgacaaggaggccatagctgccctggtcccagtgaccatggacttcaaatatgacctagcattgcagtagccatggtgactgtgggaatggctacttaatccatccctcaattttaggcagcacagcatgcacagggatgctgtgtgtttaaggaaaggagaaggaggttgaaagaaaacatagccttggagaccagcatcgggtccttcacaatgagacagagtagagtggagctctgcagtgcctcactctaggctggttactgtggatggagcatctggatcttcctcagcctcagacagaaatccatggacccacatgccagatttcccttccttcaggaacaaaacatccgcagtagacctgcggcaaacctcagcttaggctgccatctagtgctgaacatggggcaacacaacacctgcagactagtaacaaaaatgggcttagagcattatctggcgatgatacagaggcagtgaccaccggctgaaagaaaataatcagtctgcttagaaatctcgtgaagaacaagcactaaaaccccagatggttgccgggagcggagtctcacgcctgtaatcccagcactttgggagtccgaggcgggcggatcacgaggtcaggagaccaagaccatcctggctaacacggtgaaaccccgtctctactaaaaatatttaaaaaattagccgggcgtggtggcgggcgcctgtagtcccagctactcgggaggctgaggcaggagaatggcgtgaacccgggaggcggagcttgcagtgagccgagatggcgccactgcactccggcctgggtgacagagcgagactctgtctcaaaaacaaacaaacaaacaaaaacacaaaaaaacaaaaaaacacgccagatggcaaacactaaattcctaatttttcagtatgcaggtgtcattgcatatccacaaacatcaagaatatttaggataccgtgacctcaccaaacagacaaaataaggcaccagagaccaaccctaaagtgatggagatgtgtgatctcttagagatttcaaaatagctttaaaacccttttcccatttgtcctgagaataccagtcattggcactcaaggcggcagtgtttaccctgagataactttgccgagaaatacatcagttttattattatttttatatcgctctagtatattgactttggaaacaaaagacgtcattttctttatagcattctgattttagtagttccatttccatttacaaaatatagaaattcttgatcattgaaaatgtcaaatcctggaaaacgctggatctctatgtgtgatgctaacatcattcttgaatatttgttggccaaagatttatttgacgaatctgcttttttcaaaatagacaattcagatgttagctctgtttagaaacagctacaagaacagattttatattttattttcatatcgcaaatcagtaagatttgctttgatctcaaagaatgtgctcatgtaaaattaaatactcatttaataaggatgcaaactgcaccctttgtttccctaaacagtaaaaaggttaagcaaactcaacatggtccaagaaaatgtagagagacaattcagcaatttatttaaaaagaaaaaaaaaacttaacagagagaatgaaataaattaaaaaaaaatcacacagaaatcctagacttgaaaattacaataagccaaacgaaaaatacagtaaagagcatcaatagcagaactgatcaagcagaagaaataactagtgaagtcagggagaggagatttgaaaacacacagtcagaaaaaaagaatgaaaaggaacaaagaaagtctagaggaattatgggagaacatcaaaagagcaactgtttaagttattagtgttcaagaggctcttaagcatgccaagaggtagaagacatattcaaagagataataacagaaaactccccaaacctaaggaaacatatgattatccgaggacataaagatcaaagatgaccaaacagactcaatcccaataagtctgtcttaagagatatcataatcaaactctcaaagtctggaagattaccgattcatataaattgaaccaaaatgtaatgatccattactatggggcagggatgaagcaatacaaatataacaggcatgttccttttcattcagggtcttccatttttgtgggtgagacattaatgaaatacattggaatcaatatgatgataatatgtttcacacacttccacagaagcaccaagataactcacctaatatgaacaggcatattaaaaagtgtttttctcaagacatgatatttgcactgattaaaaaaatactgtgtaggaattagccaggtagggacccaagaagaaatgcaggacatgtctgcactaggaacagattaaatggagagagaaggaaagggacaaaatagggaactgaaatcagtttatttctagacaacatgtcacataagatcacgatgtgaaaatgtagtgaagagtgaagaaatcgttagggacctgatgggtcattgtgagggtttttatcttatcctaagcaaagataaggagtcactgagacacttccagttgtctatgatcaaagcaactaagagcaaaatccacaatgcctaagtagatgaggtaaaaacgaagtaaattatgatgaaacttcagaaacacagatccgacataaactggtaatcacaaagagaacactggaatccaagtcattataaccacaaaatggagtagaggaactattgcaagacaaaatatgaagagctagaatgaatttcttttactagctaaatgacttctgtgaaggaactaggacaaaagtggaatttaagttagttctaaaagattaaaggctcataaatcatatcatcttatgtttttacagggtttcactttgtcttataatatttttgttttcttatttaatttggaatataatgagtgtggtagataatagtccttttatcttttcccactttccagataagagttattattattattttcttttttagtacattatggattaagtaatatccttgacaatatgcatactggggtatgtatatccatcaagtgacagttttaatactgaacaagtattatatgtcataagatgataaaagagctcaaaatgaatctaagatcaatgagcaaaataaccccacgggaggaaaaaagcatggaaacataagtagcgttatcatttaaattttatttatctaatcagcctactagtgccactgctgtgtattgtaagatgtggtttgctataagattttgataagagaaatagtgaactggacattaatggtgttacatggagcgtttaggctatagacatcatttttattgtttattgtttagtgcttgtccattctggtatcgcctagtctcatgatgctattatgcataatattcttaattcctcaacattcactgctacgatatttttgttgtcactgttttactcctgatgcttcagagagtttttgatgattgatgagcagcagtgggattgtgaatatgatacatttgtaaaatctctttgggatcttggtccactcatctgtatgtagtgtgaggagtttgggctcattgatctaaaatgctttcattttaattgctgcatatatttaagaatctttcagagcctttatctattcattctgtgtttatctcatattctttgctcaaggtatatattcttaagatgtaaaaaagtcattctatttttacatttaggttctttctgcatttctcttacatcagttgctagaaaaaatcaaatttagtctattcaaaattggtcaattatagcatttcaaaagaattatcatgtacttatatatttatataaaataaagttatagcctaatttactttttcttcaaagttttgggaaattatgtttactgtttatatttctgcaaatttgctgtttcagtgataatatatattgtatctttgaatagtttaatgataaaatatagtgagaaaaacagaaacaacggaagcaaaatactgggaatacggtagactatatatagaaattatatataaatatatatatgtatagaaattatatacaatttctgtttgtattgtcttccctactcccaggatacatatacatatatatatttgttatagttaaaagcaaatcaatgataacatttatatttaaaaatatatatgtgtatatatatatattctctgcagtgtctttaacattgcttcataccatttttgcctctgactttccaatttcaagtaaaaatctgtctcactggcattcaaatagttaatacttgcatatttgctataacacaattggaagttaattactcattgacaagtcacagacagtttttcataaagcactggtggtctgcgtatcgaaattaggggatagtatttaaacaagtattggttatactttacatgtagaacccatacattttatctttggcttgcttttaattataacaaaaataaatatatttttctacttggtggcatatatatgtgttattagaacatgagaaaattataaaaacaaagattattaaattaatattatatgtacatttgcattcattacttttgtattgctcatttaaaaaatctagttacatatttagtctggaatataaaacatcctcatctgaattcttgaagtatgttaaaaacgtattagaatgtatcttgactataacttaaagagaaaactttaaataaaataattgaaatataatacatatttttatttcaaattattaagtatatatcttaagtgccattacaggctagcagaatttattacctgtaaatagaaaatagaagagtaaaacaaaaaagaatatataaaacaataataatcacaaaatccaattctatatcattaaacacaattataagtgtttcactcttgtatattctctatgatatagtcataaatttttttatttgttttcataaatttgggaattagtctgcattagagagcagcttaaggttttatcatagcattatattgtaagcactttcacacctcaaatatttgagattattactttaatggctcaaatttattttgtaacaatatgttaattcattaaataattcaactgttcttaaatattaagaaatgtccactttttatattagaagcagtgctaatataaacattctcgtgctgtaatcactgtgtagatctctaattccttagcataaatttccagagacaggatcatatccatttacttgccttcatactatttttaattatttcaaaacgaggcactgcatcagaaatatatgcagccctctgaagacaatactgagctgctgtatatttgcataactcacaaggtgaccatgatgcacactccttggtatactgcacattcagctttcaactttcaagtgatttatgtgacccagattgcctttgggtcattgatctccatgtcagataaatttctgatgatagtgtggagagttctttaagtcaaaaattctggaggacaaaatgctatgacatgatgctgtcaacttcaccatccccagtgagtgtacaaatgagatatgaagaagatgtcaactgattggggacactgctgtggggtcagcccaggtttgactgggtcaacagtctgcatacgtttttgcttgatatcctttcaataattttgagaaagaatgtgtgctgtcatgtatgtttatttgttatgtaaatatgtatttataatttaacaagtctttgttaacaaagggagaaaaattttaaacaccatataaggtaaaataaggattggctataagtggaataaatatttgatgacacaatttcatggaacaccttaacttcttattaaaataaaaatcaagtccaggtgtggtggttcacgcctataatcccggcactttgggaggccgaggcaagtggaacccctgaggtcaggagttcaagaccagcctggccaacatggtgaaaccctgtgttctatgaataataaaaaattagctggttgtggtgacccatgtctgtaatcccagctactagggaggctgaggcaggagaatcactagaacctgggaggcggaggttgcagtgagccgagatcatgccactgcactcctgcctgggtaacagagtaaaactccgtctcaaaaaaaaaattaattaaaaaattaaatctaaacgatatgtacaaattttacacttaaggttttttcagcgtattttgagaaatgtgatagtcctgagaaatatcccagttacattttaaaatgaaccgatacggcttcagtttttctaaatctaaatcaacatggcccaagcttcaggctaaacagaaataagtataaaacaatatttccaattatccctttacttattccctgaagggatttaatatatctgggagctataacagctaagattgggttgtgtgaagcctatacctttcttccttaaaatgggaaaaatgtgaatgtatgcaataccacactttcataagaaatgatgtataggaatagtgccgcaataaacactatttctatacatcatttcttatgaaactgcggtatagtatacattcacatttacaatagcaaagacttggaaccaacccaaatgtccaacaatgatatagactggattaagaaaatgtggcacatatacaccatggaatactatgcagccataaaaatgatgagctcatgtactttgtagggacatggatgaagctggaaaccatcattctctgcaaactatcccaaggacaaaaaaccaaacaccacatgttctcactcacaggtgggaattgaacagtgagaacgcaaggacacaggaaggggaacatcacaccctggggcctgttgtgaggtgggcggagcggggagggatagcattaggagatatacctaatgttaaatgatgagttaatgggtgccgcacaccaatatggcacatgtatacatatgtaactaacctgcacgttgtgcacatgtaccgtaaaacttaaagtataattaaaaaaaaaaaggaaatgatgtataggagttgactatctaataaaggaaatcttaaaaagatctgtgaatcgtgttctttagaaatttctttacattattactattatctataattcagcctaaaaactttagatgagaatcattttgtttttgattgattcatatgaattgttaaatgtgagctttaatatataatagtagagttatctccatgaagacttgtagatagtttcatacccagcaatatcaagaacaaataaaatattctgaaggagatgtctcatttgaccaacaggagatatttaggaatgctgcttcactggaggtgggttctggaattacaattttgacttaggtattggaacaaacctgagtttcctgttccttttacaagacagcttttcctctaacttcctatatgcttgtccaatatatagaaagatttttttcctggttttctgctggagatgaaacacacagatcaacctccttgactggggtttttatatcctgacttgctctgcaaaccctctacttccttgtccgcttctaaaacctcagctgtccaagtgaagatcctgattcatatctactgtaaggcatttttgctttgtagaaacaactgaacaattgctgttaaaagcctcgatctcagctttacatctctctttataaatcttaccatggaaagccaaagttaaacttttccatgtacatttttcgtaaatatggtgatgacctaattcccatgggccattggacaaattttcatatattgcatgctttcattcacttaccaatgccctaagtaattttatttttaagatggagtctcattctgttgcccatgctggagttcagtggcacaatcttggctcactgcaaactctgcctcccaggttcaagcgattctcctgcctcagcctcctgagtagctgggactacaggtgcctgccaccatgcccagctaatttctgtattttttgtagagacagtgttttaccatgttacccaggctggtctctaactcctgaccccaaggaatcttcccaccttggcctcccgaagtgctgggattacaggcgtaagccactgcacccgacccttaaatgaaattttgatagctgagttatataaattccatacagggtgactatatgacggacttttcctgagacagtctcacattgcactattgtcctgaataaccaccagtgttctggtaaaagtgtggctggctcttcagaagtaaaagtcctgactggtagcacttggaaatttttgtggggtgaatgacttaatgttggctgatttcaagctattaatatgacatgactgaacttggagttgtcagtgaaagcacaaattaattccttgcaagcctccaggaagaggctgttgctaactgctgtatggtacctcctttcaaacttaaacgtgtcctggtgtgtagaataaattatgttcatcataattttaagccattgactctttctgaggttagtagggaatgactctaagtttacttgaaaatattgttctgaattcataatattggtgaacagcttgttataacctcagttttgactgtgtcaggttgaaaaactaaaatatcaattaaattttacatttgaattgttatatcttgaactgtaactgtagggtactatgtaaaaatttttatattagaaatgacttgggttaactcttagatggagatgataaaaaactattttcagtttctatgtaaactcaaatatatgagtgtgaatgtcgaattagaaataaacaaagttacatttaagtaaaacaaattaagtgaaatttcttaataacaactaagaaattgtatacaaaattttgtatacaatttcttaatttttctggtgaaatattttgatcacctaagtgtcatcatgaagagcttttcctcagtggcaataattcattaaggcctttattttaaatgagtacaaaaatattgataaaaagaataattaaaattaaaataatataaaatgtacttttgcatatgttagcctctttatagcttagtcctaggctcagtgctgccattttaattacaagaaatttcactgcactttgaaaatgacctaatatttccttcctttatcatccagcaaaatgtgtctagttttgaaatgtgagcacaaagctctctctttctgaaatgactgttatatggcacacatttctcccacacaaatatccctcagatggacaaacaattcaactcctcacactctccctaaacttgcaaatgaagtagtgctcatccgatcttctgatggatttcccaatcctcacagagacatttaaatttaggtttttattattattaagcaaaatgtttaactacactacatactactttaaagttttatacatttttgcatattgtgttttaaacctttaacaagaaaatccaaaggtctgggataacatacatttaaactactgctatgatgtgttgggtaaactctttcaatatccaaccttaaccaagaaaagaaacacaggcaatatccaatgcagcctagatactaagtgtaaaaactaatgagcatcgtaatagcctctcgagagatgcacaacaaaatattttatattttatctcagctcaaaatcatagagacttcatcaccctagtatcttagaagtctgaaagaggtaaaaaatgtttacgttgttttacaagaaaaactgaactatttttagcaaacatacctacaaatttccaaaaagcaaacattcagacaaatggtctccttccctcctgctggtatttgttagaaataggcttcagtgtaaaattcctcagggtattgttttttttcaaatcccctgttacatgtattctaatattttactattcacttgttttcttgaagtttcatttgcatatgttaaactagagttttgagtacactatttcttatgctattgttgtttttgctttttcaaacggtaatgaagtaaattgtattgcaaatatctgacagaagaaaataaagcattgaacttaacagaaggcatattctgacctcttttgtggagttcactggaaatttcaagtgaatccaacatctgacaatcttttagcactgttaaggtttattattaacgctgcacttattaaggagacagttggtccataaatatttcaccttactaagctgtgtacaagtcgttggttttaaactcagatagggtttaacaagaaacatttgacaaatccaaatagcacttgatttcagaacacaagtttaggttataaagaatgaaaacctctgtgtgctaacactatatttttctagtgctataaggatttaatacagtcttcacttagtttcctaaccatgttattgtatataacaatctccttcaaaacttagtccagatacgagcttatggtaagtgacgttcatttggaggctccctaaacatttatttagacaacctcaaatgtgccctttcttcatacatttttttccacatataatttttttcacaaaaaaattatactgcttataattttatattcatgcttctcaggcattgaaataagaaacactattatcaaaattattaaaatcataatataggtctcataataataatagtgataattatgattataatactctagtctaggcattacataaagtaaaaattgtgaccctacattcatttgttccatagagttttggcaaactcacttcctatcttaggtttggtcgttcatgatcttttaaacaagtgaaatatacccaagaaatattattcattcgatattcagaattttagaatttaatatcagacatcagggatcagtgagttgaatctttaatgtacatgtaggaatacagaacacaaggtgctgaaaacatgtgtccatagttatgctggtcagagccgaaagccaggtctctcgactcagtcaaatttaggttaagtaaccaacatcaaactgcaagttttctaatcagtatggaaacgaaatgtaaacccataagcctaaatgagactgcaagttggaattcctccattgcctactctctcagtaggatgacttcttccctatcccttttgataaaacctgatcaaaacccaatgagttttcagcatattttcagaaaatggaaagttctctttgtaataattcacgtatttaatctactgtacaatctaaaggcttcgaacagcccctcctttcccttggctggggcctgctgacattagctgtcttcatgtgtcaaagggaggcatattccctttctctgtttgatcactcagcacttctactcttccttttccttctctgccatgtcagatgtgtcagggtttaggggaaacataaaaggaaagggagtattcttaccccaggaatactgtcctgagctagtgttagcactgcaccagcttacggacactgataggcaactctgtttcttctttcctggaatgcttcttcccttgattcagtgaagacaacagccaactgctggagatccctaccgtgcaggatcttttgtgcaatggaatccttctactgctgctggtggctgaaggctggtttcatgcccctgggaatccaaggatccacccctgtaggagttactttacccctaatggcagcccacttaaatggaagacagatccagggtaaacatagtatcctttgtctgctaaactctttgaggaaagccagaccaatgtgtcaaaaccttttaaatctctcaggctgagtcaaaaactgttcacagtgtctcccaagtcctaggggacatatatcaccttctccagataaagccatgatgcttctccgcctgtgctagaggtggacctgcttcttccttgggggagagcaggggacacatatgtgaaatgatcgctctaaacattctctaaaattcctttacatgtgtatccttagtctgggtgggcattgaaagtagtagaaattattttgtcatgcttcttttgcaagtcctgtatggcagtttcacatcttactttggaatgtggtgtgtatttacttgagcctcaactgaaactgattaaatgattccattgaatcatcacgtcacagcttcttagggatcttatagcattcatttttgcattctcattgcttagcatggtgactgaaacagagcagacattcgatatcagggtttcattgcatgactgaagcgattgttaatttatgtcccgtgccatgtgctctgcaaagaaaaatgtaagtggctcttgatatatttctctcccatggcttcaacaacaaatagtacctcaactgttaataattctacatcttttttatcactggactctgctctctccatgtttcctatatccactggcttgtttcaggtgctcacttctcacttggactgttctaaaaaatcctgaactatttccttattataatctcttttctttccaatttgtattttatactgtctctggggctattattctaaaaattcaaatttgatgatttaattctacgccaccactctgccttctgtttaactggggcaggaaaatagggtctggaggcaggaaacagaaggccaattcccacttcagctattacaggaaatatcctctccatagggtggacaccgagtaaataactttgaaagtttacttcatcttcttcatttatatagggtgtacaccaagtaaccaatggaaacccctagagaatatttaaacccccacaaattatgtaacggggccttttggcccctatgctcagacctgctcccacactgtggagtgtactttcattttcaataaatctcttcattccttcctcactttgtttgtgctatttgtccaattctttgttcaagatgccaagaacctggacatcctccactaataacataactatttctggtttcctctcacatattaaatagagtctaaatttcccagaatgacacaactgactttttcaatatgacatgtgccaatgtccccattactgtcttctatcttttttcacttttatcctcgtaaagttcaaaatgttcaaccatgaagagattgctaattgggtcatgttccttcataagtttcagcttttgcaatcctgtcccctttacatagtatgccttcctctttatctggtgaacttcaaatgccagttcaaattatatttttacaactctactcagaaatagtcacttcctcatttctgctatttctagaccaaaagtgctcctaacacatgtatcattctgtattatttgtttatgtatctgtcttttcaacttgactgaagggtaacctttttattgtaatcaattaatacatggataattgcaaagtcaatgaagtaaaagttattaaattgctagtaagatagtggtaagaaaaaagcaacacaagtattgggatacagagaatgataccctgaagtatggtgttctggcatgctgagcaccttgaattaaagtaaattggcaagacatagaagctgcctaacttcctaatcttctcttgtttcttcacccactcacaaccccaagtgaggggaggaatgttctctggaatctccttatctgaggaaggaaacttctttcccaaagaaaggtaattgtcttaaaatcccccctttaggaatgtaagcaaataaccaggaaagattaaccaccagagagagagaaaaagaaaaaagaaaaagagacagagagagagacagacaaaagaagtcatcgccatgcccagacagaatttttatctactcttctgagggcagcacgaagagattacctatgggaattcatctgcctaataagactacctttgttcacagtgcagttccaacactcacctttccataacttttcactcccatcgagtttcccaaaataatcatttacaaactattgtctggtttggctagctcattcattctccctaaaaattacttattaccctcataaaattgcctacagtcccacatatcgcccctcctccgtaaggtatttaagcttcagccatctggcccctctttgagtgtcacatttgtgagacctctatgaccacgtgcacataaataaatttgtgtacctttttctcctatatgtctgtatattatataacatttgttattttcatttattttaaaaccgtgtatagtcacaacatccatgtgttctgcttctccttactgagccatccaaataatttagtcaaattacaacaagcaaagtgacctcaatggaaaaagtatgcagagaagccatgttgtgagatgatgagtttttaggattatcctgcccaactactcaaagttatagcgaaactcatttcacgttgaaaaatagtattaaaagaagataaaatattgtgaaatataacagatctcataggcttatatattctctatattgctatttacctagctgtatatattctgccaatgaaattgccattgatttgatataatctttctagtatctaactgaatatgcttctaagtatcataccaaacacttaggttaataatggtagcagcacttcattaagacctcataaaaagaggctggtattcttctatgatctacctctatattggactttgtgtttgtgatatactcaaaacacgcacagaaacatgagaaatatgtttaataatctacaaggtagttttaaatggtcagcccacaaaatgcatgggaattgcttttataaatgcctacaaggccatgtatctctctgaataaatttatgtgttaaagaaatggctctggttcctggtctaggaatttaatgggaaaacttccctgcaaaataaaataatgtgataggaagatattgtgccacttctcttactatataatttaatcttaattaccatcttaggttgaattccctagaaatcagagccggagataaaagctatgtgccagcactttattaagaagctcaataggtccctgaggagcaaggggggaaaggggaaaagtagagtttacttttggttttctttgagaatttagattaaaaaaattcataaaacatagcatttacaaactttgccaaatattaagtgatttattgttcatatatatgctgcattaaaacaatgcaactacagatagcaatagccagctatttaaaagctaaaatatactgcatttcaggttatcacaaaaatgggacattttgaactctttagaggacactacctttttttccctagattacacattttttttcaacttctaataaagataaccagcattcagtggcgggaatttggattggatgactccataaatatctactatctcttcacaacaaaaataatttgtgaatatgctttattaatgacaacaaaaaagtgaagatgcaccaagaatccatgactgtaacatatgttaacataccacagtgatggatatagcttctttgactgcacagcttcgggcaggttaaagtcatgtgtattatctcaaatagactacacatgaaagcaaattccagcctctaaaaagtagattcacagcctcattaacaaccatttagatatttaataactgaattttcagaaaatactcttatttataatctggatcctcatgcttcatgctccattttttttttctaatttagtccttagagaaaactaacaactagtccctgtgaaaagtcatcctctgacttatttgttcactaatattttgatcttggcctagatgtgacaagtccaaacagaaaacttactcagcttaggggctttgctagattcattttcattttgccaccatctttttgaatggtaggagtcaaatatagatttctgagtcatacaatgtgggattttgttcaaatgggattaagtttgaattaggaggaaaaataatgaaatatacttttacagtataagcagaaaactgtatacagaatcttccatcactgtcaattataatgacataatagtatggatgataataggattgttctattttgaatccgtatatatataaatagtctgtgtattctgacatgacagaggagaaaaatatgatattcactatctcacatgttcaaatacaggtagtaatataaatttagttaatgtcatatatataacagcagagtaagagagaatcagaatgattaagtgtttataacctcaaggtaggcttttattcctttatctaatactcctaaattctaccttttaaaaggaagaaatattgctattaataaatttttaagggactgggctaaatataattttataattaatcttatatccatatgaaatatgactcaaagaagatattactttgactttgttttagtggtattgtttctaagcccttaaatcggaaatctctgaggatgtgttaatggcacttagattttttatactagctttctaaatattaagaaatggcagtacaatcattactattactattgcttatcttgtggtgagaaaaataatttttggaaaattgactttggacatctttcaaacgaggaagttatgttcttatacttttgtgctattagcttgaccctttcttcagtgcttttaaactatagggttttttttttttttaatggacttatatgaaaggtggtttcactggcctactctcttacatacttgggaagaactgaaaacaagagagagggagaaagtacatatgaaacaagaaggtcatcaaactaccgggtgaataaaagtgttttttctaatttgataaccatatcctttctgaaatgaggttgatagcatttcagatcagacaaatttatttccctgctaatctatatacttcatcacaactataaaatttgagaccttaggtgatgtgcattaccataatggaacaaaaaatgtttcagtcacattcttgagattgatcactagctctagaattttaaaaaaatgaatgaattcaagatactcatttaaagtagactacatatgagacttagtttctactctatataattggcacaaaatatatacctcattagtcattttaattaaatgaaataataagtttacataatattagtatttgtttcatgattatgtgctaggccttaggtcaagatgctttatacatacttaaaaaatatctaatgtgaaaactgtcactattagctccgttctccactactatcctcaattttccatgtcattctaattttaagcaatatttgtatccactaaggtagtgattcttaatttttttatatcatagaactttgagaatcagatgaaaagtatcatcatccaaaaattcaaattgaatatacatgcacattttgcatgcaattttaaaaggtttgggggcctccaatttatagaccatctagtgataaaatctaaactaagaacttacatgctatgtaaacggaaataacatgatcatgtcaaattctcttaatacaaatatacatcaaaaaggcattgcttctgaatttaaaacatttaatctgagagaacaacaaggaatatttgtgtcaatacaaaacacatagaggggcctgtgaggttatatcttattgtaataaatataagtacacttctaagaaatatgtgtatgtatatctgggtgtcttggagacataaattaagtttgtcagaaccatactgttctttttttttattatctaaacctcaatgtgcctcaaacgataattatttttcttatttttcctacactccattttgcatttaaacgaacaacatcaatccccttctacaacattgatctaaccaaatgatttcagcttagtttatatccaaccagttatcaaaccatattggctctagttaaaagaaataaacttagtctttctatattcttcatactatcaaaacaaggaatttaataaaagttgactgcacatctactatgtaaaaaaaaatcaaagaaaactttttatgacctaaacattattcataatattgttttcttctttgccttaatagactaacccttaagaatactgatccgcctgtatccctctttaaaggctattaattatcagaaacatttgtttcttagagtcaggggtagattagatatcttcactccacactcacattaccatttgtctgtctgccaaaaatccctttctttcaaaaaaaaaatcttatcaccaatttattctatcatcttcctaacctcatttatggcagtaactatctcttgatccctcccactgtgcctcctattcacaaacacacacacctatgaatatttcataaaccagctcactctcttcctcagcacccctattcttggtgttttcaacacctagtgtctcatttattttacctcgcacctaaaactgtttactccactcttcctcagccaacttctatggtcacatgctaacatgagaaaggagaccactttcagaatcacaaactgaagcctgcatattctgttctcagttgcctgatccttccatttcacttcctcaaatgttccttctgcaatattttaaatattaggtcttccaattctttcatcccctttccccacctattagctcttctggctctacatttcctacctttcaatatttgtttttctagttaatcattataatcattctctttcaaatacttttttttttttttttttttgagacggagtctcactctgtcacccaggctggagtgtagtggcgcgatctcagctcactgcaagctccgcctccagggttcacgccattctcctgcctcagcctcccgagtagctgggactacaggtgcccgccaccacgcccggctaattttttgtatttttagtagagacggggtttcaccgtgttagccaggatgctctcgatctcctgacctcgtgatccgcccgcctcggccttccaaagtgctgggattacaagtgtgagccactgtgcccagcctcaaatacttttaaccagctctctccttctcttgtcgatatagattaaaaaaataccaatcttaaatgactatctagctcatatttcttttcgccttttcccacagctgagaattgctggaaacgattcccattctgctcaattaattctgagcccttttcacttttccaaaactctccatccactttcctctgtcgcaactttctcagcatattactacacgtcctctgtaagagaatgcaagagatgagaatatctaatgtttctcgttcaacaaatgttcatttcctacttagaaaaatgtcattatccgtatgtgctctcgattcttaccttgtaatttctcaacactcttttcatatatatataaataaaaatcacttttcatgagccatttgagagtacttggggtgtacagtgttccttcacgttaaacccttgtgggttattacaaaaaagacaacaatattctcttacataaccatgttataattctcaaattcaagattttgaacattgcagagatacagtgatcgaacatgagtcagcaagctttttctgcagaaggccagataataaatagtttaggatttctgggccatatggtctctatcataactactctactgcaatggcacaacagcagccataggcagtgccatcaaccaatgtccactgctactttacaaagcaagtggcagactctgaattaaactagtttacattaaaaaaatttcaattgacctaagaaacttttgtagaatttgttcttgtttaaaacttattttgttgcttattggatatttcctttcatttctttcaacttttgttttatataaggtgttattaggcatatgtaaatttaagatttcttaatctttcttgtgaattgggccattttatcaataagatgtctctccttatttctagtgatattattttatgctaaagtagattcatctgctgagcctcgtggccaatgcctgcaatccaagcactttggagtccaaggcaggcagattgcttgggtctaagattttgagaccagcctaggtaatatagtggaaccccacctctacaaaacatttgaaaagttcgccaagggtggtggtacacagcttttgatctcagatactcaggaggctgaggtgggaggatggcttgagtccaggaggttgaggctgcatgagctgtggccatgccactgaattccagcctgggtgacagagcaagacattatctcacacaaacacacaaaaaatagacttgtcttattttagtataggtttactaatctatatttggtggatgtgcacatatatctagtttatcttttttgttttcaaattatccatgcctttagatttaaactttttattccgtacgtagatgggtttccctttattcatacagataatctttgtcttctaattggagctttaattcaatttacatttaatattgcttttgatattgttaagtttaagcctgtcttcttactttatttccctttgtcccatctatagattgatcctgttattttctgcaccttgttactcaaaccaatcaatgtgttttccttaatttggaattttttttaatactagagtgcatatttggtcctaagttactgttgaaattgttgtgtacatctttactattttcactaatagaatattcattaaagatcatgtctgtttaatgctgagatcatctgtatgttttttctgttgtctgcttttctgttgatttttgatcatgtattcctgccactttgtatgtctagcattatttaattctatgttgggcattttctataaaagtctatgaaaggtgcctccagatgatatcttccatcaaattttccctcttttatattggacagatagagtgagagacttattacattgattcttttaagggttgatttttgcctttaataaggctaagactcagccttattaaatctcaactttgcctggtttcattcagttccttggtcatgatccttctaggctttttattaaaaatctaataaatctccagctgttccacataaaatatatgtgtcatttcattcattcttctggaggcttcagagcttagtcttagtcttgtaacctccaaaattaaaaacattcccaatttcttaagggaggagcaacctgtttgtttgggacttatttcctccttgtattgaaatattgtattctaagaacaagagattactggagagttactctgtctttttgatacgctcagcataactcctgagcctttcgaactggatccagaaatctgaagcttcttagtactctaccacctctgaggaaccatagacagaagagtatcattgaattattgaggtaaaatgtatgtattcacagtatttactgaaaaaataggtcctatctaaagtgttgatttttatgtgttaaaaataaaacaaatgattcttgccattagagaaaacagacctagataaattgatatttataagagaggaaacaaagaagtcctgactatcccaagaatagtggatagttgtacagaaaccaggggaaagtggtttctatgtctccacacttaatactttgagatatgggatttgttagtgtacgagaaacaaatagctcacaggttctctatcaatatcagtaaagagtggagagaggcttatactgcaaccttcaggggtttgtattacttacatatgaaattcctaccattgctgacaattttatgtaaaaaaggagacatcctatgattagaatacaacattcgctgtaggaaacacatatgtttttggttttgtataataatgtatgtgtatctaaaagaaagatttattatcaggataaattattactaataggaactatttatttagcatttgaggcttagttttatgctaatgcagtcaatgtattttgttttttttctctacagtcctcaaattggcttcccatattaaagcttatgcacaagtcttttagttttctataatgaatcctttgcttccttgcatggtattctatctatgggataccaaagtgctctgctaattccttgaagtgactttgtctatagcatatttttctaatcatattcccatttaacattttagacatctggctaagatctggtttaaaaatcacttttcattaagccttgtccaactagcatagttacaaacaaactcaccattcattctctgacctccaattacaattctaattagcgaatgcgtgcagagtatatttaaaatgacatagataactcagctgggacaaagaagttcccttctcacaaaactccagctgtttgacagctcttttctaaagcgtgttgaagagtgttctgaggttgtacccgagtttaaatgacagcagtagtttatatctaacaatataccagatattatggaatttctttttaacttatcatgatcattttctcacacaattaaaaattaactgatcattttatttttaatgaaagcactaacattacatcacatttacctaattgtatgttattttcaaagtttgacttttagaattaatactaaattattcactgtattcttaggccatatttccagaaatcaatctgttacacagcagtctttgaaagtttttaaagctgctaagatacccataaaattgtttctagaaagattgaagcaatttgtattcccattagtactttttgagtgctggtattatcacaatgagaaagctatcactaaaaatttctttgaaaagtaaacaaatgtatgtgattatactataaataagcattttcttcattaccagtgagtttagtttttttcccctacttgtgcatattagccatgtttttgagagttatctgtgatttctttgtaaaccttcctatttctctaatagagtatttatgctttcttacaaatacataagtaattgtcacataagtatataatatttgagtcaaatagcacatacagtattttttaaagcatattaaatttttggttgttgcaaatcatttcctgtttaccagttgtctttagttatatatatataatttaattttttcaatgtgtatataattacataatatcaaaaaaattaaactaggaaaaaaggcgaaaaggtgggtcatttcaatgtcatactgggtgttatgtgtcagtttaagttgaacataatttaattatttaaataacaaccctctatttgactttgcttaataacaattaagtgctaagactctacaaagacacatattatattaccgatttctgtctggtggaaaaaaagtggccccaaggtttacagtttattgccctgtaagatattaatgagtttggtctctaactcagcaaacctatttcaagatgtctttactagtgcagtgttaaaaaccctgttttacaaaatgctctttgaactagcattgccatctaaacattatagtactaatgagataagaactctttgacatgtttatttttatatctatatgacagtcaggtttttaatttttttaaatatattttcaaaagttcttcaggttcccccattatccccgattggattcagctgtcagatctcattaagctacattgactaagaggtgtacttcacaggctatttaaatagaaacaggattcttggtttgggcagtgattcccaagtagcccggcagctttatttttgctgagtcttcatttgcagtaattgggaatctagcttaatggtctgagaatttgatgatgtattttagagggactataggatttattcctcttcggtgaagtaaaacagaaattctggtttgttagctatttatttttatttttttacctactatttatgagaagtaaatttgtatgccctttggaaaggagaactattctttgagataaatactgtgaatttttgtgtagctgttgacttttgacccatgaataagaattgaagatgcaagatctctgttgacatataattgagaaaatcttttacttctcagtatgtgagtgtggaatactcttactttttcagtgtattataaaatttaattattaatctcttaaattaatttagctttgtattagctggttaattttttattgcattgaaatacatgtaacataaaatttaccctagaataattttaaagtgtacaattaagtggcaggtagtacatcaacgatgttctgcaaccattattactatcaagttccggaaattcttcagcattccaaaaggatatcttgtatcttttaatccatcactccccatgtctccctaccctcggccactggtaacctctaacctgctctccatctccacggctttgactataatggatatttcatacaaatgggcttatataataaatgacctttttggtcagactttcacttagcatgatgttttcaagattcattcatgttgaaatgccatattatgtaatagtatttcaatcctttcatagcttaataatactccattatatggatttaccatattttatctatccatccactgatggacattttagttttttctacattttggtcaatgtaaatagtactgttatgaccatttgtgtacaagtttttgtttgaccacttgttaccaattctttggctgtaaagttaggagtagaattgataagccatattttacttcttcttatcttttggatgactgtgaaaatgttttccatggggctgtcctattttacatttcaaccaataatgtgtgagtgttccaattactccacattttcaccagtacttgttattttatgtcttttgtgtttcagtcattccaggggactgcaatgatatcttattgtggtttttatttgtgttttcttgatggctaacaatattgaacatctgtatgtacttgatatctattcgtatatcttctttggataaacgtgtattcacgttatttgtacattttgtaactcagttgtcttcatgtttttaattacagggattctttaattattttggatgttagagttttatcagatatattaattgaaaatattttctcacatagtaggattttttttttactttcttgatactgtcctttaatgagtatttttttaattatgaagaagtataatttatctgttatttctctttggttgtttatgcttttgatattgtatctaagaaaccattgtcaaatccaaagttatgaattaatacccctatattttcttcaaataattttgtagtgttagttgttatacttaggtcttagatcctttatgagacaattgttcaatatagtgcaggcaatggtcaaaactcattttacatgtaaatatccacttatcctacagctttatgttgaagagactatgactttcccatcagataatccttatactcttgtcaaaactcaactgaccattggtctatgtgtctatttttatgccagtaacatgctattttggtcatgatagctttgtatagaaaggccagaaataaactcacacatttatagccaactgatattggcaaaggcatcaactgcacacaatggggaaaagacaaccccttcaataaatggtgctaggaaaactgcatatacatatatagaagaactgtattagtccatttccaccctgctataatgaactacctgagactagataattaaaaaaaataaaaagaaaagaaaaagaggtttaattgacttacagttgtgcatagctggggaggcctctgtaaacttacagtcataccagaacatgaaggaaaagcaggcaccttcttcataaggcaggagagtgagtgagtggcgaaccaccagacagttttaaacagcagatcttgtgagaactccagcattatcacgagaacagcatggaggaagctgcctccatgacccagtcacctcccaccaggtccctcccttgacatatggggattacaacttgagatgaggtttgggtggtgacacagagccaaactgtattaagaacaaaattaaaccttatcttttatcatataaaaataactcaaaatggataaaagccttaaacgtaagactcaaaactacaaaactacaagaaggaaacatagagggaaatttccataacattggtctaggcaaggatcttttgtatgaaaccagaggtacataggcaacaaaagaaaatatagacacatgaggttagaaaaactaaaaagcttctgcacagcaagaaaataatgcacagagcaaagagaaaacctacagaataggagaatatatttgacaactgcacatcttataaggggctaatatccaaaatatataagaaactcaaacaactcaataacaacaaaataatgacctcatttaaaaatgggtcaaaaacctgaatagacatttctcaaaagaagacattcaaatggccaacaaatatgaaaaaaatgctcaacatcactcatcattacaaaaatgcaaataaaaacttcaatgagatgtcacctcactcaagtatgagtggctagtatataaaaattaaaagacacccagtgtcaataagaatgtggagaatagtgaacaaatacactgctggtgggaatgtaaatgtaaattagtacaattcttttgaaaaacagtatggaggttccctcataagctaccagtagaactaccatatgaaccaaccataccactactgcatatattttcaaaggaaaagaaatcagtatgttgaagagatatctgcactcctacttatatagtaacagtattcaccatagctaaaatatggaatcaccctaaaaatccatcagtggatgaatggataaagaaagtattgtaaatatgtaccatgaaataatattcagctataaaaaatgaaatcctgttgtttgcagcaacatggatgaacttggaggacattaagtaaaataagccaggcacagaaagatatcactcatgtgtggaatctaaaaagtttttatcacaaaagtacagagtaaaatagcggttaccagaaaatggggagagtcagggaaattattaaataggcacaaagctacagttaggagaaataagttctaggtatctattgcctagtaggttaaagagagttaacaataatgtattgtacatttcaaaatagctagaagaggggtttttaatattcttactgcaaagaaatgataaatttttaaggtgatagatatgctaattaccttgacttcatcaatacaggatttatacatgtagtagtgcataaatatttatgattatgtgtcattcataaatttttaaaaagaaaaaatcaattgaccctagattgccaaatttatttgtgcacttttatgctggtaccatactcttgaacactttagctttgaagtaatccctaaaattgaaatatcttagctgtctatactctttcaagatagttttcaccattctgggtactagttgttttactaataaattacattaatatgtattttaaattttagaagacaaaaaaataaaaagttcttattctttattcggaaacatatatatatatgtattcttttactttggtacaactttcttacagtggagttagaggactatttgtgtgcacacttttctattcctctctttaggatttaaagaaaacttgggtacaggagaattatttatcaaagttgttttctcatgaaaattcaagtcaactctatctttgctgggcttcttccacttaccaaaaacagaaattttactctatgattcgcattctgagtttctgtctaaaagccccaactactttaataacatattcagccagaagaaaggagataataattggcttttctaatcttctctccattaggtgaagaaataatgcatcatattttactgggcaatgtaataggtggaagcttctttaagcttcaaggctcaagactgtgacaggtagatatcaaaatttagtgttttattttaccaagcatcattaattaatcaatgtaataaaaacttattaagtacgaactaggagctagatgcaagacataaataacagactatggctttaattttttcattcttcaaacaagaaaatgaacaaacaattgtagtacatatacaagtgtgatggagatttgcataaactaatctggggcagacatgagagtagctactcaattacggttggtgaaaacagcctaggaaagtcctctgaaggatgtagctcctgagacaattaccatgacatataatgatgcctcaggtaaaatttaagaaagtaagaagtggagaagaagcaacagatgcagtgacatcaactcaagagccaacagtaaactagagatcaacaaagaattcaacatactctgaagatgaggcacaagatagggaatgaagagacatgctgttgacgatggaaaaggctgctttgtgttagctcctaaaatattccatgtttatatgctctacctatgacaatatggcctggtaatgtagcgcatgttgctggagactattcaaactgtctcactaaagtcaaattctggatctaccactttcttgatatgtgacattagacaggttcttttataattttgggcctcaattcttcatcaacaaaatggaaaaataataacaccaatatcactaggcttttctgagaattacatgaaaaagtaaataaacaatgcattatgttacatagagtaatccctctgtctctatatatataattttagtatattatttttgctattattttctagcagtaatacacaaagcacatgtttagtagagtcaatgatgtataacatctagaaaactttaaaaagtttttcattcttatttaggtttcaggatatggagaacagaatggtttcattcacatctctgggttaaaataaatacggtgattaaccaaatgtatattgaccctacaaatttttcaaaagtgatctaaaaagtacagccaaaaatgtccttgtaagcttaaatggagtctaaggaaagacatttaaagaaaataaaaaccaaaagaatatgtgataaatcacaatttagcaacatacacgtaacaaagatgacagaaaaatcccagtggacaatggatgtgatatatgtaagaatgaatgtattcaacttttactcagactctgtctgccacacatgaatgccatttctttttgcttttcatctgcatataaaagtagaatagaattccagagaagagatatttcagttttcacaaagagaaatctttggaaataatgaaattccaatggtcaaactaaatgtctcatgtccacctacagacacccagtgatttcccattaacatatagcattacacagaatgtcattcagttacttagacttttaactccgaatgaaatttgtcagtttgatacatatgtcaataatttctaggtagtgtaatgggtggctcagtttctaaataaaaaatgtaagctcaaaaattctccaatctatataaaatcttcaaactagttaatgcaaggttcataaggttaattaacgactgaaattcatggtcccatgaaattatgttaaattacaggggaattattgatctgagatgtagaattcttttctaagaggactataattaagcattttccaactttgtccctttttagcaaagagttggtaagattatcctcatcattatcagttgtctttagaagatcaaagtagtagaattaagtgcaattcagctacattcaggagccaaatcttaaaatatttattttaataaatgttttcatcaattttagtggtatcaagtcaagacatacatatctctaaaaactggatcaacaatctatagagtactatcttttctattatatatttagaacactattttttctagatggtgatgtgcatatatcaacaatattgacatttttctgtagccaattataatatattctagttattacaaccaccagacattacgcgtaattttgtgatattgtagaatttctgagaaacatgttaaattattatgtagactaaaaactctccacttatttggaagttttttaatgataatgtcataatatcagtaggaatatatttatgtatatatttatttgtgagcttcatttgggagagagaaaggtagaaatatgtcattctcaccgacacaacattactaaaactcctatgtaatctaaaagtcacaaacttttttgtgaccatctaagagttggaattgcaaggcaagcaactacccaaaaatctaaggaaagaaaggtacctccaaggaaagatggaaacttacaactagaaacattctagaagaaaatatataaaaacattgctgcgatcttatcttacataaatttttttagatacagtaccaaaatcatgaaccataaaattaaatgtgaaaaaattgttaaatcaaactttaagattgttagggatgctctgattcttgaagaaaactgagaagaaaataaaaagtccagctgatccctttaaaaaaatatttgaaaaatcacatatatgacaaagaacttgtatgtagaataggtaggcaaatgtcaaaactcaataataaagcaaaagcccaattttaataaatgagaaaaatattccaacaaagatatctatcatctaaaacatagatgtcacataaacatatgaaatcgctgttagatgtagggaaaatgcaaattaaaactacagtgcactgccactaagtgcccttttaaaatgtcaataataataataacaacaattctgcaaaggccaagtattaacaggtatgtgtagcaacaaggattctcatacatttattgcaatatggcaatcattttggtaatgcaaaatgatataatttgaaaaacattttttcaatttcttgaaaattaaccacctcctatgtgacccagcattctgtagaataaatatcctgggtatttattcaattaatatgaaaacttatgtccatacaaaagcttttctgtaaatgtttatagcggctttatttgtaatagccaaaagatgcgaaaagaaatgttcttcaactggtgaaatgaataggaaactctttatagtcaatccatgcagtgggttgctattcacccatgaaagggaacaagattactgatgaatgcaagatggatgaatctcagaactcactgtagtagctgaatgtagccagtctcaaaggctacctactatatgattctgcttatatgatattctggacacggtgttgtcacttgccatataattaaagtaatggtacatcaatgtcaatacagagtataatttacaatcaagaatctgtccataatcattccttttaaaaataatctgtaaattaatttcatatagtaagaaattttaaaatagtagttaagggcttaggctctattttctagttttcatggagtaagtagtgcaggattcaaccatctgctgtaaaatgaactataactgagggtaatatacatttttggtcatggacaacaaaaaatacataaatgtgacatattaaaaaatgaaaactaatggggtgaattctacttttatgaaggttttctgcctgaggtactttccaaatgacagtgtaagaatgtgaacgccaaacacagagcaaccaatagattgaatgaaagagaatttggtgttgctcaggtggctggaatttggagtgcggcaggtagggtactgcacaggagggaactgcacagagaaagagcctcacaattctgcataagtcccctattaggtctgtagccaaacataaagtagcacatgcacagggccagtgctctgcaaaggctgtcagagaacagctactggagaactgtgaggtacagtcagatactgctggtagtgtaagttcagaccagaaggtggagagacactccactgaatacccagagtttagaattgagaccacagaaaagccaaacatgaagtctaaggctacactagttgtaggcttggcctaaataagcttcaaactaagactcaacaagatctatctgatctggcaggagactaacgtcctgcaaaaaccaaagccaacactcttgaagcaaggcaataaaaccctgactcttaacatcacagtactctgaatgtatggaaaacaataaaaactactacacatggagagaagcagcaatccatgatccatacccaggagaaaagctgagagttgccagcatatagtataagaaatactgaggaaagttctttagtccaaagagaaatacatggaggtttggatttatatgaaggattaaagtatgtcacatttagtaaatatttgaatgaatacttatcatattttacatttgttagttttaacagctatttgtttctttaaacaaaagtaatagaatttgtgggtttaatcaacataagaaacaatatgtatgcaataatatatgaagtttagaaaggtgtaaaactatactattggaaggttcgtaaaatacatacagacccatacaatgttaattcaaggtagactagggtacattaaacttgcatattctaattcctagagaaatcaaataaatatagccaaaaacctaaaagaggaaatagattaggtcactaaggctatttacttaatctaaagtaataaaagggggtcaaataaataaaaaaaattagacgaatttaaaaatacgtatcaaaataaaagatactagcccaagcatatcattaattacattatttgtaaacagatacaaaaaattacaagggaaaatacaaaatatttttaactgaataatttttctttttttttgagtcggattttcgctcttgttgcccaagctggaatgcaatggcatgatctcagctcactgcaacctcctcctcccaggttcaaacgattctcctgtctcagcatcctgagtagtgaggagtacagacgcacaccagcatgcccagctaattttttgtatttttggtagaaacggggtttcgccatgttagctaggctggtctcaaactcctgacctcaggtgatccgcccacctcggcctccaaaagtgctgggattacaggcctgagccactgcactcggccctgaatatttttatttaaaatcttataatttgaggatatagatatagaaagctaaaaattgagagaaatacagatcttaaaattgtatttaatagagaaaaaagattaataaacaatgttttctaagaagctagcaaaaaagggagtaaattaaattgcaaaataaatatatagaaataagtaattaagagaaattcctgaaagacataattaaaaaaagggaaaagtatcaaaaacagaagtatcttatttgaattatcaataaaattgataaaaactcccgtagaaagtaacacagaagaaaaaagagaaaaccaaaattaccgctttctagaataaaagcaaagacaataatatagagcacattaaagaaataataggagatattataaagactttcatgtacataaatgaatcaaattaggtgaaatggaaaaattccttgaaaaataaaaactaccaaaacctacataaaaagcaatagaacatctaagtaactatatctgatccatttaaacggctatatctgggaagaaagctcagttggtaatttaaaaccttatcaataatgaaaagtataagcacaagtcgctttgttgggaaactatttcaaacttttagaccaactctttcagaaaaaaaaaggagaagactttgccactcattttaggagggagaatgaatggtgataatacaactagataaaagtcttacaataaaatgaagttacaaaacattcttaccaaatattaacaaaacggccctagcaataaataagaagttatcttgatcaagtgggatttatcctaagaatgtaggatgatttaaatatttattgtgaattaatataattcataatattacagatgagaaaatgagcaaataaaaagattattttaatagatacagaaagataatttgacaaaatttaaaacacattcatgataaatactttccgttcactagttatataaggaattttcttcacagtgatgcattcctatgaaaattctactgtaaatatgaatatcatactgaatagaaaagactaaaatttccttttagattggaaataagataaagatatcttctcttgtcattcctattcaatattgtagtcaggcctcacccagcatgactaaagaagaataaaatacataatactaagattgaaaaaaactatttcatttgtagacaagataatttacagaaaaaattttacataattcccaacactacaattagaaacaaaagtgaacttaacagtgctataaaatataccatcagtatgccaaagtcaattgtatttctatatattggtaactaaaagtgagcaagaatatttaaacttaataccatttattacaacattaaaaattttatatactcagaacaaaatttcaacaaatataagcaggatctgttcattgaaaactataaaatatttctgaaaggaattattgaagcctaattacatggataaatgtaatatgtcaatgtattggatgacaaaatatcattacaaatgttaatgttcccacaaattgaccaatggagtcaatggaatactgatcaaattctaactggtgtgtgtgggtgtgtgtgattctgcagaaatcaacatttttatatggaactaaaaagaacctagaacagttcaaacagtcttgaaaaaatatttggatatcttatagtacttgacttcaatttcaactgtaaaacttgattttagaatctactactatcaagagagtattatattggtataatgaaagacatataggtcaattgaaccgaatccagaaaaagaccccaacttgtaacaaaaactgattttcaacaaagttgccaaagcaattcaatggagaaagaaaagtcttttaaacaaatggagttgagtatggaaaaagtacacatcaatcaccctcaaaccatgcacatcaactaaattgaaatggttgataggcctctacataaaagatacagctataaagcttctaggagagaacacggtagaaaatatttacaaatttcaggtagtcaaagttttctcagaacacagaaagcactgtctataaaagttaaacatgaaattggactttattaaaacctctgctcaaaaacaaacattattagataaatgaatagacataacgtagactcactaaatatattcacaacatatatatctgagaaaggatttgtatcaagaatatataaacaattcctacaaattacagtaggaaagacacaaaatccaataataatgaacaaaaatttaaaaatgcaattcacaggaaaagatatgtaaatggccagtaagcacataaaagagtgctcaacatcatttgccatcagggaaatgtgaatatctctgacaaccacaaagaaatcccacacacacttctttaaaaacctaaacagactaataatactaagtgttggcaaggttgtagagcaatgggatctctttacacgctgctggtagtattgtaccaaatacatccacttaaaaaaactcatcatttcttacaaagttaaaactatgcctactctatgaccaagaaatttatctcctatgtattcacccaagagtaatgaatttatatgtctgaagaaaaagaatatagtatctttatttattaataaattttgatatattcttacaataaaatactactcatcagtaataagtactgcattgctgaatgatcaaacgtggatgaaatatattttcctaagataaaaaatgcaagaatatacactatgactgcatttttacaaaggccaagagtaggcaaaattgatctatggttttgtaagtctgaagtgtttgaattgtaattgcttgggattggcagggtgagacctgcctgaagtgggctttaggaaatagcaacattttgattgtgatgtgaattacaaggatgtatagttatgaattacatgtcaaagttgtgtatttcactgcacatatatacatattttaattaaaaaagaacaaaattctacagctaaatacaggaaggaaggaaggaaaaaagaaggaaggaaggcataaagggaagaataaagggagggaaggaggaaggaaagaacaaagagagagacacggaggaagaaagcggggagaaaggaaggaagagagggagggaggaagggaatgaggaagggaagaatttaggtaggtaaagagaggtaaataaagcttgggttctgaagtcaatacagtatagttcatattcccaggtatgctacttactctatgaccttggccacattactaaagccatctacttttttattttgttgcctaaaaattttttaatagtatatgtaagattgttatgaagattaaatagcatgacataggtatggaaaggttttaaacttgggagtgcctcacaataagtaatcgctgggtggaagttatgagaatggtggtcgtatgagatcatatgagagtataatgtggttaattttgaatttccctgatgattagtgatgatcattttaaaaatttatctcttagccatacgtatgtcttcttttgagaaatttctattcaggtcctttgcctattttctaatcaggctatttgtttccttgctattgagttgtgtgagttccttatatattctggatattaaccccttaccagatgacttttaaaggtggccaaacaagagtagatttagaagataatgttcaagaaggaggtagagtgaagatgcagccagcctccaaccagaaaagatatagccagaaagctcgtatatatgagtaagattcgacacccccacttatgatgtgagaattgacttagaaacacaagaaaatcatcatcatcatcatcatcatcatcatcatcatcaattatccctatcctctcatccttgtcacctatttattagatgcctcatatgtgctcggtcaatgcatctagtttagtattaacatgtacaaccttccttgttgagatttacgtatctgattccccaatgtatgtattatttaagctaagagtctacatctatctctctttatagaatctcctcttcttcatggagctgatccatgttttctgataaaagtataggattattggagtttataatacaatttcaacctcagtagtgattcaaatcacaaaaaaaaacaaacaattgttgaaaagcctaacatctttactggagttaattataacatgatacctgttttacactcagattcaccctcgtcttagtttgctgttttatagattacacctttccaaatttcacggcagtcttttatgaaaggaacaaaatttcaaccttacaaattgacttacatgaaatctggggtgatagatatttctcagtcttcaactttggtttctctaatagaataactgtacttgccatcagtttattttaattaaaacccttattcattcaaggtaatatttatggcccaaacccatttgacaaaaggtagaaaaaggggaaagacagtgagaagaataacttgcaatttttggaaacatgaaactgactttaatttttacttatcatgctgtatttcacacatagtttttaagttatgactttatagtattttgttattcatctatctcttttagaaaatggggatttttaaactcaaagcaccaaaaaagtattttcagatgaaaaagataattttgtagctgtttgaatattttcaaatcgtgttttccaaggctgcctttcatttacagttcattgatgttttcccccaattatttagaaatatctgtcaacttctttacactgatttacaaagaatactttttcacacacattgtgacctaaaaagtcttctctttctctaagattacaacttaaaggtgcatgcatcactgtaattgaatcaaaatgtgggagaggaacctattatgttatattaatttttttattcaaatacacctcttaacaatcaaaaatcatttaatacaatttttcccaaaaggaagacagaataatataccctctaacatgaaatttaaacatttctgcaaaaacactggatatttgaaattttctcttgaattgattgaacacgtaatcttgactaatccaggtcacccttatataggtttactttttctatttattaaatcaagtgtattttatcaaccctgtgattctttcagagaagcttctatcacagacataaatgaatcaattttatatttatttgtttcatactttaattttcctacttctctgatggtcattccttaaagccatcttcctcctcccagaacatcatttccaagttctgacctacaccctctccgatttcactcaattgccatttactcagagagctttgactctgtccccatgtggctggctggctccttcatctgcccctctacctttatgatttactgagatttaatattccaaaggcctgccgaatacttctattaaaatgtctcactgggattcaagcttcacctgtccaaactaatactatattttataaggaagtacacagaaacaccgaccctaaatttttttccacatatctcatatttattctggacaaaactaccagatacagaattgtatcctaaatacaattctgatgacgtcacttaaatgctcaaaagagggctctctatttctcaggaagcaatatctgaattttcttttcaatttcattgagagaactaacatgaccccaaactttctttccagtctcagtcatattcgtgcttcttacactgagcacttgctcagggcctcctttgctctagcatgctgcttctctctgtgtgactgacatcttacaagacccaggtctaaggccattaacctcctgatacattagatgcccacttttacctgtgatagttggtgaaataaaatgtcataaatataaaagaaaataaacgtatattaaatttccaaacatgtcagaagcagtttctacagggaataatgcacctcaacgcatccttaaattaacaggcaaagcataataggaaatattatataagagaaaatagttaaccgtaaataaaacttgcatgaaatgaacatgaattacatgcatttacgaaatatgggaggttagggttactttgaagataaaatttaacttttcaccaatcccacaaaaattaaatatcaagataataaattatatatattacaaaggacatggatatctttaaaaacctgtactatacacacataccaacacacaagagttagatgttcatagactagaagtcctaggataaactcaaactacttgcagaaaaagacaaacattgcttcagtaaacaatatgtcagtggattcttacaaatgccaaactaaaatttctccaaaatattacaaccgaatgactctaaaaaacttccagcaaagcctaattcttcaatgatgacatcctgaaacaccagtgtcttcttggtttttagtgaaaatattagccaatttctaaatagcaaaatctctctctatatatatatagatatcaaaatatcaaatatctatctacatacatatgtatattgatatatattgtcacccaggctggagtgaagtggcgcgatctcggctcactgcaacctccattccctgggatcaggccattctcctgcttcagtctcccgagtggctaggattataggcacccgccaccaagcccagctaatttttctatttttagtagagatagggtttcaccacattggccaagctggcctcgaactcctgacctcaagtgatactcctgcctcggcctcccaaagtgctaggattgcaggcgtgagccactgcacccggccagtttgctattttttaataatggctttacatttgtgaaaaaaggaatgatgaaatcataaggccacctataagggattcagcattcctattttcaaatgaaaatataggtgctggatgttgtagctcccacttgtaattccagcactctaggaggctgaggcaggaggatcgcttgagcccaggagttcgagaccagcctaggcaacatggtaaataccgtctacacaaaaaagtaaagaaaattttaaaaaattaaaaaggccaggtgtggtggtgcacacctgtaataccatcactttgggatgctgaggcagaaggattgcttgagcccatgagtttgagaccagcatgggcaatacagtaaaactttgtctctacaaaaagtacaaaaattagccaggcatggtggcacatgcctgtggacccaggtacttaggaggctgaggttggaggatcacttgagaccagcggtcaaggctacagtgagtcatcatcatgcaactgcaatccagcctgggcaacaaagtgtctctaagaaagtgaaaatgaaatgaaagtatttttataacagaaaagtaaaataaatatcgctcaggtttatgtagctttacatgccatagctatggtaatgcattattcgtggaatttatttcacttcctgaaaaagggatcaaagtatttagtaaatattctctgtggctacatttgaaaactataaggctattttaactgtgtaaaatgaaaactgaaatcattcaatggtaattccagaaatagcacacctagttttgcattaattatggatataatttggttacattacagcagtaagacattgcctaaagtagaaaataaaacagaatcaagcttcagaggtgtgtagacttagcaaaattatcaataaattaaaatttggggaagataagactatgatgattacatgaaaatctttaatattaattgaattgagtattgatgtaaacagcatacatggggcattacaatagtattgcttaacttacagtgttttaatatgtaaagatggtagataaaatagatttagtacatatcttattttactgatattcattttaatataacattaagtcaaatgttaagtctttatagggcaatcaatgtaacaaataatctaccaatataactatcatatgaacaacaaaacatgaattcaaaaggatgaacaatggttagcatgacagatgccttacaattaacattaatgccacagaaataacattttttgatatgaccacagcgtgcaatatttctaatacttataatgcttattttaaaactacgggaaggcatcaatgtccctaaaccaagacttttcaaaaatctcaatgaggtttcatgaggtctatatcttcaaaagccattcaaaattctgttgtaaatgtggaatagcaaaaatctagaaattttatttgattttgaatttcaaaaataaaattaatcttattaaatttaactaacaaatgttcactcctttaaaaacaaatgcatacaatcatagttcagtctgtcagagagagtgttattactaaactacaaaataaagaaaagctataaaactattaagacaagaaataatgatagtctttgtggtagcttgcaaatttttcccatcgctgtatttccctttgcaaagtgactttactattcctccagtcagtaagttgaatcaatttcttatcacttaaatccgggctcaaccttgtaacttgtattggtttatgggacattagtaaacttgcccctaagcaaaggattgagaaatactttcactttgggactcactctctattgccgctgggcaccattctgccaccacgtgttcaagcccggactaacctcctactggatgagaccacatggagtgccatttcaaccatcataccgacttagacacttatgttagggtattctaggttattcagccccaggtcactttgtgtaaacaaggaaaactgcctactaaacaaagttgacaaaatgaatccttgtggttttaagctattaagttttgggcaaaggttttttgttttgtttttcagcaaaagctaactgaatccatcattacatataacttttagaaaattaaactatttccataaccatcatgacaacaaaagtagtttacaaatctcaccatgattaaagcaaaatattaaattcaataacattatagatggacataaagtacttaatcaaaaatagtattttatatatttcctgctagaagctatgtagctgtccataatactcattaattttgaaataacataagagattaggtgcttgattaactatttagccaatttcacattattccaaataaaatgtaaagcactgggaaatattgtaatttctctgtaaaatcattctactagattggattattttccagtttatctctttgataaactctgttacctggcatgagcaggagtattttgattctacttccctggtttaatttttgatgaccaaaagaggaccaccaacatggcaaaaacaatatgcctgaaacaagacatgacaagctgatggcaaatcacagatacatgaggaaggcaacaatgacactgtgtcatatagacactgaattaagaagaaaaaataagtgtcattgtaaatttgcatgcatttgcattatttgtggtcaatttctgttgtcctcctccctgatcaaataaaaaatgtggtaaatatcagtattaaattcaggaaaacttataaaaagaatggatgcaaaagtaaaagaaaaataaacatgtattaatacattacttctttgtgctccacaagtactagaggataaaaagcagacagaaaatgatactttatagcagcttgtttaaataattcacttcacaaatagttctcagcaagaaatgaaatagcagtcactaattatacctaagttaaattgaaggagaatatttgcactaatttgcatttcaagaaatgggaaagagaaaatgaatttaacaaatattttatcagaaaaagagcaagtactgctataataactttaacttaagtgatcataacaagagcatctgtgggaataaagtaatgaatatcagacacatgaaaaaataggacatttaattgacttttcctcttattgttaccttccttattttccagtcattcaaatttcaaaattaatacttttgtaatttggttcaagactagaccatgtaattcagtttcagagtggtgccagggtcaaagaaacagttcagctacacaaagtaaatttcaatagttcaaaacttctatttgcatatctgaaaaatgatgaaaagaatataaatgcataattcctttcccgtccatattcacttttccaggatctggcaaataactacagtacattccagtttttctctccctctcccaatccctttcctttccttaattatgtaggttgacctaacctttcttcagcaaaaaaagaaagggtctgtaactgagggacagggcactaaaattgcggcattaaagtggatcacactttggtcctatgacagatgcttggtataagaattttgaaaacacagaaatgtccacataaaatttgtgatctgtcccatgttttattttattatctgatataaattttattaacaaagtggtgatttttttcatcttttttaatataaagacatacaaacatatagatgaaataattttctcatcgtgaaagcaagggcaagaaaaagaggtcataggcaagatggcaagggtgatttagcaatgtggtaaaacaattttaaagagtaagtggtctattttgcatttcaaattatttgcataccaaagtttaactctccaattccttaaaacggtagtcagttttgtgtgtaccttttagggggtgaagacattaagcaaatgacagagatctgtatttgggtggatgccatgaccaaggaaagaactttcatacgattcgggggaacaatatcttagtaaattagggataaagattattcattttgtcaaaaatgaacttgctatttcaaagcaagttcttatttataggagactacttatttcttcaaaggagatttcaattgctggacatatagaacattacaagaggagattatacctaaatctttcaattattttattaatgcaaaccaaaggaaaattagagggaaactataatgaaagcgcacggaaaggtgaagtcatgacaataagtgataggccttattgttatgatgacaataaacaatgagcttttacagtgaggaagaaatgtgctgtaaaaaaatttggatagagaactatctgcagtatttgtgagtggatattcttttgattagtctactgagtgtacgacaagaaaagcacagaatgaccgagagatattggtcaaaggcagggttcaagcttcaatgcagggtaccaagggcattgcaaactcgtgccattagagaagaaagacccccttgcccctggcctttatactgcttgtgtttgtttttctatgattttatttaagaaacaatgccacgtctaaaaaaaatttataaaacatccatccagacaataaaaatattctaatttataatacataagagggatggattttagtatgaagataccgtgtgtttcaatttttaacaaattacttatctttgtgccgcggtaccatgccattaataaaatttgtaacacactatttctcagaaatatcagaaacagtgatggtctaatgcattaaacctccataaacaaaactaatgggaaagaatgaagccctttcttcagttaataaaatgtctgtttgatattcgcaaagaaatacattttcttaatttgaaatccagtagactaacaaagtgtaagctgattggcacttcagagtttcagtgtcttgaggatgaattccaaaccgcacccggcctcagcctcacttttaccagaaaatgaaaccggaagcctcccctactcttaattccccaactacagaagaggagaaaacggaatctcatcaggaggttgctaacccagaacactatattaaacatcccctacagaacagatgggcactctggttttttaaaaacgaaaaaagcaaaacttggcaagcaaacctgctgcggctgatctctaagtttgatactgttgaagacttctgggctctgtacaaccatatccagttgtctagtaatttaatgcctggctgtgactactcactttttaaggatggtattgagactatgtgggaagatgagaaaaacaaatggggaggacgatggctaattacattgaacagtcagcagagacgaagtgacctcgatcgcttttggctagagacacttctgtgccttattggacaatcttctgatgactgcagtgatgatgtatgtggcgctgttgttaatgttagagctaattgtgataagagagcagtgtggactactgaatgtgaaaacaaagaagctgttacacatacagggacggtataacaaggaaaggttaggacttcatccaaagatagtgactggttatcagtcccacgcagacacagctactaagagcggctccaccactaaaaataggtttgttgtttaagaagacaccttctgagtattctcacaggagactgagttaagcaatcgagatttgggagctgaaccaaagcctcttcaaaaagcagagtggactgcatttaaatttcatttccatctaaatgttactaaggtataagagaagtctcattcgcctttgtcttgtacttctgtgttcattttttttttctttttttggctagagtttctgctatcccaatcaaagaatatacagtacacatccccagaatccataaatgtgttcctggcccactctgtaatagttcagtagaattaccattaattacatacaaattttacccatccacaatagtcaaaaaaaaacttggcatttctatactttacaggaaaaaaaaattctgttgttccattgtatgcaggagcatattttgctggtttgaaagattatgatgcatacagttttctagcaattttctttgtttctttttacagcattgtctttgctgtactcttcctgatggctgatagattttaatttatttgtttccctatttgatagtattagtgattctgatttcagtttttgatttgttttgcttttgtttttttcctcatgtaacattggtgaaggatccaggaatatgacagaaaggtggaataaacattaattttgtgcagtctttggtaatttttttgtttcttataactacaaagctttgctacaaatttatgcatttcactcaaatcagtgatctatgtttgtgtgatttcctaaacataattgtggtttataaaaaatgtaacatcataattgcattcctaactagaattagtatgtctgtttttgtatcttttttttatttttattatactttaagttttagggtacatgtgcacaatgtgcaggttagcaccttgtattacttaggttattttgctttggttaaaaatggctcaaggagtaaagcagtcccattcatattaagacactatacaaaactgtaaataaaatgtgtacagtgaattgtcttttaggcaactagatttgtccttttattcctccatctttatagaagggatttgtacttcttattgcaagacagtctctgtattatgtcttcttttgtggtgtcttccatgtgaacatttttaaaataagggaaatatggtggtaatagaaaattcggaaaaaccagtagtagcaagcttcagagtctcagggtagaccaaatttcagacagggtgcccttgaaacttgagaatttcagataaaatatccatgtctgtgtaccccgtggaaaatcttggaacacacttaagggtatgcttttctgggtttgagactattgcttcacaggatttctcagatgaaaccaaactgacctagtcacagcttcctggacaaacgatgtcttttataaataattttttttcttacaaacatcaagtgattttgaattccaatccaaccattcctcatagcccgattcaaatttgtccatatagaaacatacaaggttgattcatgcacagtaatttagtgtagaggacctgatttcattttaaaatattgtcactagtaattgtttacatgctcagttcccaggcctgacttctaaagaagagtaactttaactgatagaaacaacttcaacaagcaccaccatagttccacagtcataaaaaaacatagaacaatatcattctgcagctgaagtactaccatcctgtccctggttttctgttatttttggtgcatgctactgacaggaggatatgggtgctgagtcagttacatttacacagataggaacacaataaagccataaagcccagaaaattcacagctagatctcttcaaatctttttggatcacataatctccataactattgaaagaatatgactactatttttagacaatacaatttcattctacgatctaatttacccttgtttatattggtaaaaacttgtgaaacaagaataaaacatcaggaataatgaggtcagctcttacatatgcaaagcattctgtttgtctaaagtgatggagaagtatattttcaaagatttaatttgtattctttgaatatacgaatcattcattcacccagtaaagtgaatgttcactgaaatgtgtatttttttctgtatgtaaatacactgtaataaaaagtttaaaaatgtcactgggcacttaatatataagaggcagtgttgtatgaagtgatcaaaacataagattgctgctctatagaatatacatattttgcactttgttctttggaataaacaaagtgtttcatattttataatgcagattccattacatatgtgacactggaaacaaaatatcttgccacaaacttactgaatgagttattttagtagctattagtggggacaatgtttttttgaagctgttgatgaaacatatcaaagggtcatgaaatcatttagttggttgcaacaattctttatacgtatatgtatacatgcctataattaaattagaatagatgcacttggctagaatagatttgaaacgttcagaacgtgtaaaatgtgtttcttactgtggttcaaattcaaaaaagattgaaaaacactaaactagtttaagtactgctaatatattttttgtggtctgctcctagagttttggggaaaaaaagtaattttttagtaaatctttctcttcatcgtgacttagaggattctatatagcagtagtcagcccacgtacatgcaaatatgtgattttcgggtagtgaaagaatatactagttggagaacaatttcttttggcttcattataagaaataatactgttggtgcttgtaatcctagctacttggaaagctgagtcaggagggctgcttgaggccaggaacttgaagctccagtgtgcgataatcacacctgtgaatagccactgcactctagcctagacaacatagctagactctgtctccacagaaagaagaagaagaggaagaggaagaggaggaggaagaggaggaggaggaggaagaggagcaggaagaggaggaggaggaggaagaggaagggaaataacactgatacttctttaaaattcctatccactggagagtggcatcaatatgatatggctccatgtttctttatgcaaacaaaaaaattatagagtcaaaataccaatttaaagaaaaactacacagcatgaatctgaagaaaactattagagtaagtcaagaatgtttcccagaacaggaataataatagaattctatagacattcccttcaccttcttactaagaagactgcggattcctttcactattgtaggaatttcccagtggttaaggacataaggatcaaagcttgacagacctggacttgcattcctgctcaacaacgttttttcatgatactcagataagttacataactacttcgagccaagttctctttcgcagctgtgagagtattctaatgagtatgctaatgtctacttcctatggaatgctgttagaactggttgagaatgtgacccaggcccttcagcaattaatacttgaaaagtacttaataattggtagtaggaactatccaagatgtagtaaaaggtttctgttacataattttgtctgctaccccagggctgattttttaaattaattaatttatttattttgagacacagactcgctctcccaggctggatcacagttgcgccatctcggctcactgcatcctccgcctcctgagttcaagtgattctcatgcctcagcctcctcccaaatagctaggattacaagtgtaagccaccatgcccagctaatttttgtatttttagtagtgacaaggctttgccatgttggccagactggtctcaaacacccgacctaaaatgatctgcctgacctcaagtggtccaccttccttggcctcccaaagttctgggattacaggtgtgggccaccatgcctggctggtctgataactcttaacactggatgacactgttatattagattattttaaggaatttaaagatatgtaatattgactagcatctcagcgttacccttttcttaatatttccctgttacagattctctgaaataggttgttattcacacaaatctggtactttatagaatagcaatctgagctgatatgtgcttcctgtttattctaggtctgctatgtcatcagctctcatctttcttggggaaagacaaaagtatagggttatatcatctctctgtgtgtgtgtgtgtgtgtgtgtgtgtgtgtgtgtgtgtgtgtgttggtggagagaaagatgaaaaaccacaggtaattcttaaagcatttgtttataaaggcaattaaatttgaggtgatgaagggatcttcatttttttgtaaggcttcagtagtgtctgagagacctcaccagtgacatacaatggtgtaatctgtagaaaaaaatacgcagtaagaagaactccttttaaagctgccctaacatgcttttttgtttgtttatttttaagtccaaagaatgtcgcacctctgcaaccaagtttgcccacacatattatttagcaacttcaaactgtctcccagttttaatgagggtcttctatcatagtattattttttttccccactcttaacgtagtccaaagagctgaaactatctcatactttcttctaaggttgcagtccagcattcaaccaatataaatcaaaatacagattttttttctgaatatgtaaaaaagatatttgtagagtgtgaattgtcagaaaacaatgaatcagcattgaaaatctcgttccagtcatagtattgacttttaggttgcatgatttgaggcaactgaattgccatatacaagacaatatctttcatgtctagcattagggattaagtaaagtaataagaataaaaatgctttgtaaattgcaaagtttaatgttaaaaagaatttgaactacaatcagtaggtaagtgaatggtttcagtgttttcatcagtgggtacatgggttggttcaagggcatatctgagccacacaaatttgcataaagatttaatttacttatgtttgtatttacatattttcctcagcttttagtggacccagttaaagatgtctggctctaaaaatattaaaaagcattttattatgcaaatgaatgctaccgtttctatgttcaccactgggtgtctcttaaccagcaggatgcatacaacccctagaaggaggtttagatgaattatttgcaaatgtttgcaaaatggaacagaaaaaggctaagttcatcaaaattgcaaacattcaagtcccattatgtctaatgctgtcagaaatagtgtaaatatttgctacggattaattaaaagagtctgtttacaggcacacaatgcagaatctacttttatgcagatgaggtgtatagaggaagaagtgacttgaggtttgaattctggctcaccttggagtcctgaaactttggatgcatcacttatatttcctaagtctccagtgagtcatctgcaaaatgggaataaaatgacctacattgtccacctgacaggattgttgtgaaatcaaattcaaatccaactgaagcttagcaaattacgttatatagaaatcattaacaatagcaaatatttgtttttgattgccttgctataggttaccggctgggtaataatttggtaaccaaaacagacatggcccctgggttatttctagttcagcactatagtcaaatagcaaactaaaaagttaaaactctaaagattatgaagcaaatggaaggtgtgtgtgatgcaaggggataaggataaaaaacagtcaaagcaaagttaacccacgcacaatttaatagtaactcccttttacaactacttttgaataagaagaaaatcaaagtaaatattagaacttacttataaataaaaaaagtcagaggatattattagacacatgagatgtggcctaaacacttgataataacttcaaggcctaagatagatttacttgaaacagaaaatattgaaaacagaatactcaagcattcaattcaataaatcagaaaaatgacaataagtacatataaaaaagaaaagcagaaaaaggaatttaaaaatataaaaatatttaattgattcaaactaaaactggttctaagtaaaataaaaaaaaatatagtaggaaaacaaatgactgttcagaatatttaaataaaaaagaaggaaaaacacaaaaaggcaacattaggtattaaatgatatgtctatgtaaagggaaaattttgtacgaatacaaaatgtaacaaaagcgagttctgttgatttagaatattagagaacaattttcatacaaaaattagaaaattagtcaaatattttgagtcagaaaagtctccatgactaggcaatttcatggtggaattaaatcatacctttaagaacaagtaatcctatgttattaaaattgatgtaatgtataggaccaaacttaaagtctctcaatgaatagatttaataaaatattaagggaaaagtgagaaaaataaaatgaaatatagggagaaaaaacctagaactgagcatatgcaataattcatagtaaaatattagtaaacttaattcaacaatttattaagattgctacctcatgaacaaggaaagttcatctcaataataaaagaatacatcaccatttgtatatcttttcaggtcatttactcaatatattaaataagaaaaatgataaaatcatcttgatatctacaaatatgtgaaaaaacataataggcctgactcaactgtaatttacatgataacaattatgcctgactaaagcataatcgagttaatagaaggaaggatttgtagtctccatgttacttgacctatcagaggctgttttgcactctttcaacccggaaacactttcacctttcttctctctttccaggatatcatattattttggttttttgacctctcactggcctttgtgtcttagactgtgattggctgtttcacttcttctcaaactcttcaatattagagtgcccaacgattcattccacggaaatcttataattcccatctattcttacttccttggtattcctgtccaatctcatttattatagacacacacacacacacacacacacacacacacacacacacacgccctgcacttccaacatgaaatctagactcatatgtccaccagcatgctcatctaacagacaaaattaatagttccacaactgtgctcctaacctacccccacccctacattcccaattcttctttgcagtgattagtggcaattgctcagaccaaaaaatcttgacatcatgttacatttactcttcctcttaacatcccatatgcaaatttgccatcaaatcctttgattctacttttgaatcatactctccttgacaataatgcctatcacatagtaaggattaaatgagctaacacatgtaaaacatttagcgcaatgtttggctgggaataaaaataattaaaaataatattccttgagttggccactgtggtaaggttatattgcttttatctcatctaacaactataacagtgtagtcattaaaatattaggtgctactatgaacttcatcttgcagatgataaaactaaggcaaagaggggttaactaaagttacaagtgccaagatttgaaaccagttattggactccagagctgtagtgtatgctgaatgttagctattattaaaaatcattatctgtcagatgagccacagaaataataaaatttcaagaaaattgccagattatatacacaacacccaaacaccccaaataatagcttttccacacaagcacaggggtctatgacaaaacggaattgaaaatctataaacttagacaataaaaacattaaatgactaacaggaaatatgcaatgcttataaggagaagattgttaagaaatgtttctgaacaacacgaaagaggtttagaaagaaatgagagaagagccaggctcctagataaggggactcaatactgtcaggttagtgcaaaagtaactgtgatttttgccataaaagtcatggcaaaaactgcaattgcttttgcaccaacctaacacaaagatgtcattctccaaaaattaaatgtaaccataattagcttcccaacagaaatttttatgaaacttcacaacggattattaagtttattttgaagacaaaatgcacgataggcaaaagcctttcaaaaatagcaaaaacaaaggaatcactctaccaattagaaaaaaaaaaaaacttcttacagctagactttgggtttcttgcaagtatatcagtagaacagcatagagttactggaaataaatctatgtatgcttgagaatgcagtgtataagaaaggttgtatttcaattcggtaataaaaatatgactattccaattatggtattggggactattggtttttcaaaagaaagaaagaaagaaagaaacaaggaagaggaaaggcgggaaaggggggaagagaaaaggagaggaacaggaggaagagggagaagggcaagaaaaggaagagatagaggaagaaaggatcctacctaatactatacatcaaactccagaaaagtttttacaaatctccctcacgctttaacaattacttctttaaatttttttgaacaaccaacaatttcataatacaagtttatgatataaaacataaaaagcagaagtcaaaaaaaagattatttcatagcaccacagaccatgaatccctacccaaacctaacccatatctccagaaacatattaatgaaagtcaagcccagataaactaatgtggatagagaaaaagcagacagtacatagagagtgctagaaaaagctcataagtattgagcactgtgtacaccattggaagtattctacaggagagaaagtgcagctaagaaccacggaattaaaatccaggtctggttggcacaaatcatttagaaacacctcaaaacctcagaagagacagaacagtcacagtctgcctttccctttccaaccacaatctctctagcaaaacaaacagaagagctagacagtaactcatcaggaataatcaaactaagtaagtgcttcaatcattaaaacttcagcattatataattttaataaaaccaaactcatagacagtaaaaaatcgttataagataaaagaagattgtagaccaaaggaaaattctgagattcactattatacaaaaaaaaatatgaattagagagcgtaagggcaaaacttatttgaaaaaaaataaatgaatggaatcgtagaaaaactctagatgacagtcacttgtatttagaggaatcatataaagagttaaaaattattcatgaaattatgatagctgtggggaacaaagatgacctaacataagaattattgctttctctgaagtagaagaaaccaacgaataaaactgaaaagctattaagtggcaaaataggtaaaatttctctgaaatgaaaaaagtgaaatggcaaaaatatagcaggcatccaagcagaacattcatgtcatcaaaaggagaaaaataccaaggtgcccttggatttcttccggcaatattcagtgcttggacttaatagtgaagtgtgttcacaaatctgaggcaaggaaggcatgaaccattaataacactcccagaaaagcataaaggcaacagtcagacacccgaagcatgaatgatttcaaggattaaaaaaccaactagcactgttacagttctttcagaatctgtctagcaaattttctggcttttccaggaaaatcccccatgcaggtaaataaaacaaatcaaaactagcaaacaaaactaattaagaatactaggagggaaggaatgattggactaatgaactgagaaatggaaaatccataatataaagaagaccacagacgatgagtaactgtagccatttatatgtagaatcaagaccaaagacccgaggcagttaaatttgcagaactgaatgtaaatattatgaattctgacaaagttaaagtaatataattatcaacaaactggaaatgaagagaagtgaggacaaactggagagcagctaatcatctccaatcacactgcagggagttaagaaaagctgtctgaaattaaaacatggagctaatgcattcagcttcttaatggtatttataatcttttattcttaaccataaagacaagttttattttaaaaagttcttgtggtgaagaaatatttaagttcagccatttcctaatttatttttattttttcgattaaattacatatattaattacagttcacatatgtatatattttatccttttatttgtgcaaatatataattatataccggtgatatgttcatgaaatgttaacagtatttttttttctgagtgtaaagactttggagtggtttgtgtttctttaaaacttgactaaagtgattactgattaatgtaaaagcataaactttatctgcattaaaaatgtaaatataatatgataatgataaccatgataatacaatgattatgaaagccttcagatatctatgtatatgaattagctagtatgaaagaaagaaacctaaatagaccagatttgccgtgttacctgaatgaaagaggtaaggagattagcatgtcatgtaatcaggaaagacatttgctgtgctcgcctggccccatggctttgtgactgaattcttttattattataattattattactattattattatattattatactttaagttctagggtacaggtgcacaatgtgcaagtttgttacgtatgtatacagctttttgtctgaattctataaagaataattgaacacacaaggtgcagaactggtggaaccaagaactgggttaacatcacagtgaaagggacatgatgggaaaagcagagccttattcacacctctgctaacacgggcatcctgagaactcaagactgatgtgcttaactgtggagttactggaatttgaattatctggtagtagttcctctgtcaccacttccagtctgtcatgtaggaagctgggatcagtggcagtggtgagataccacctcacctaagagtccttgaacaggaaacaaacaaaccaagagggctgtttagttcgtctcagataagaggttctgaagaactacacgatgcaaattttgctggttagaagtagttaaatgtatgtaatttgacaacatgactaccttggactcgtgtaaccttgggaaacatactccaattaagtgttttaaaaagtctgaagattaggtgtcctaaattcccgatatttgaaatgttttggcctaaagttggaccaagtgccttgaaaagagatgcagaatgttatcatcattaccatttatataaactagcccagattacacatcttttgtattgttcttgtctgaatagtattatatatttaacttcacaaatgttctatgagtaatcttccctgagaataatgttaattttgaaaaatacattgaattctaagatatttcctggatacactatgatatgtttttctgtttactttttttgctggactacttgggttaacttttgaaaagcctgaagaagggtgtgaattgctgaggctaatcatagaaccttaaaagtctgtagatatttagcgatggagagagggtgagaggagcttgtaaagttggcccagcccatagttgattaggttaggtggctagatgtgtatttatgggtgactgcatcttctgttcaatagacatctctttattatctttccatgtgtaggactaaaggcctgtacaaccacaaagtaattttaaataagaaaattctgtatgtcagagtgaaatactggctaaatttaaagagagcaacagcatggcattaatagaggttaaacatacacaaccacacacagaaatcaaaattattctacccagcattttttttctctcagcttcactgaatcttccaaagtgccttttagattttctaatagatttccttaccttagaactacacgaactttggaattttatcataaaattgttgactatatgaaaatccgtgaaaagattgaaatgtttaacagaatttttaaaattaaaaacatcatttctgctttcattattgaaatgtttgtgttcttccttaacctaagagttaagcactttgataactttctaccaaactcacttaataatgaacaaactaaggctaagagaaattgtggctggctttatagaagtaaatagtaaatgacattcatggacaagtgaatcataatgtgagaggtgcttataaaatacatttttctctttattttaaatatttatccaacttttaggttcataaaatagttcagccactgtggaaggcagtctggagatttcgttcatgtttatttttgaagtgtatgtgcagagaattttccaagaagtgtatgagtccactcctatttctgttcttgcaccagatttcctgtctggctaccaatgtgcctgcccatgcttcctagttatagggagacaaacaataatgaaggaagacacaggaaggaccagcatcagggctgggatatgaagcggagcatatattcttcagtcaatacagtaggttttggaaatgcttgtgaacatggagttagctttctcggggatggaaactaggaagcgcaagtggctccacctcacacgttaatgctataatgttagtggactccatcctctatggtccataggtggaatccacacatactcctgtttctcaagagaatcctaatttgacacctgttgttatgctctcagaaatgtcctggctgagaagataaattctacaacctgcctgctggtagagggtttcacaatcattaaaattttgttcccacgtagcgactacaaatgaacctaagtgactttagagataaatcatttctgctgtccctggacttatcagtaaggaggcattttcagagaagttttggcctatgcttagtttcacttgcttcctatgtttagcagtttcttgatttccatgtataagttttcattccttcaaatactgcattatttaatagtgccaaacacaaggactcagtaaataactgtcaaagatggtgactatcaatgaaagtaagacactaacatgtgtaaccaggctttttgtttccgcttttcacaaaaacaaaataaagcaaaagaactaaacttttcattttaaatttaattctttttaaaagtttaattatgtaaggtcaggtattcatacatctgtctactgtgttacttgtctgaacgatacccagaaactaaaggagtaccaaaataaaatttctagtaccagagtagagtcaatacagtatattagaagctgtatcagtttgcatattttaaaaaagaaatttaaagttaatatcctaattaaatgttttatgagaagcaatcctttgttctgttttcattttcatacttaaggaaaaataactttaatacaaattatttaaattatggctcactatgcaacccatttgctaatcttctacattgattaaaatattaaaacattattttagcctaaaatagactttcacatttatgaaaaaagtataaccttttttcccacttttatataacacaatttccattacttctctcttaataaacttatttccacaaatacacatggaagaaaaatatctcagggggaatgtaatagatatgaaaaattctagtaagtttttgatatatccaagaatatttactgccttctgagaggtaatgtacataagccaaaatgaacaaaatctaagctacaatcttaatttttagcatgcttctaagagataaaacacaggtagcacatgtgaacacactcatatttgaaggataaatattctcgcttgttttacatcacgtacatccagaaattaatttctacattaaaattctttgtcatttcttttagaaaatgcatgtctattaatgctgatcagatacatagtatgttgacttaaaatcattaattcaaatcagtgcctttttgaaaaaattattcaagacatatcaaatgcccccttgggatttactgtaactttatattttaatttccagtgaaaatagagaggcacattttatagagtagaaaagctacactgcaggttagttcaaaatggttctctaagatttgtcgggttgaaactaacctccactgattttcaatgatgttatcattttgatttctaaacataggtgtttagcttaaggaaactaaacacatgctgaagagataaggggattctaccctgctatttcaagctaaaacataacctctaaattatcttttagagtaagccaaagccagtatcacatacctttcgagaatgaatttctttcacatacaatggaagtagaaactcagatataccttcaagtcggattcccttcttggtgactctcagatttcccataccatcctacaagcaatgaaatatagttcacttttaggttaattggagaatgaatatctggccataattttcttaggcctaaattgagaaaacagtgagctcaaatcagtgatgatttaaggaaaatgagagattgaatctacttaattaatgtttgcagccctttgcatgcatatagagggctctatttaaaatgaacaggaaaagaggatttaaaggactgtgtcttcttcgagctctaccagggactaggatttgcccacgaataaatcctttactttcttcatgcatcagtcagttcaactatttattttgtataatgatgcttgctacctgactgttggaaataactttgtttgcagagaaatctagtaatatttttacattacagttatacaaataactctaaaatattcagagtcacattgatacaataattttaacaagtaattaatgattgtctgatattagtaaccatgatgttccagtgttcaaaccatgagtaggtgtctgtcagatcctttagaaaagagcagtttttgagaaggataaaacaggtacacaaataatgctcatgagacagaataaaattactaaacagagtgctactgggaattaaagaaaggaggttttatatctgataagatagtaaaccatttctcatggaagagattgactacgataaagttgttaagaatgtggaatttcaacagggaaggtccctggagggtggaacaaaataaacattctggcaacatttagataacagcatctgatctcactaatgtatgagatttctatttttgaatattgggagagaaagcaatggagagtacattttggagccggagaaaggaaagccatacatataatttaaggagaatgtacttaagtcagattccaaaagaagacactataaaggttcttacatagttcaatagcttgaaatgattggaggcaggcttcaagaagattaatctggcagaagtactgtttagggctaactgatacagtattactaataatgcataattgcgtagtagtttgaggaatatggtggaagaaaaatttacagacttgttgactaattttatgtatagacacagaaaggaagaactttcaagattcatccaaggtttcacaactaagcatgaataagaaaatatagtgactttaaaaactgaaatagtaaaatttgtaggctcaatcccaaagcaaatttagcttttcactttctaacattatatctccattgtaaaattggttatatatatataaaatcatatataatagattatatataatcataatcatatataatagatatataatcaaaatcatatataatagattatatataatcataatcatatataatagatcatatataatcacatatagttgattatatataatatatagttgatcatgtatataatcacatataatcaatgatatataatcatattttaattataggacaatacataatcatatataattatatatacatatctgtatacacacacacacacacacacacacacacatatatatatatatatatatatatatatatatatatatatatatatcaaccagcacatccacagaaagggatgaggacgtgggcccggcgcggtggctcatgcctgtaaaatcccagtacttcggaacgtagaggcgggcggatcacgacgtcaggagatcaagaccattctggctaacacggtgaaaccctgtctctactaaaaatacaaaaaattagccgggcttggtggcgggcgcctgtagtcccaggtactcggaaggctgaggcaggagaatggcacgaacccgggaggcggagccacaaatgagccgagatcgctccactgaactccagcctgggcgaaagagtgagactccgtctcaaaaaaaaaaaaaaaaaaagatgaggacgtgtcaagaaatacttgaatctgtcactatggataagcaagcccaacgtagacagatgtttataaaaccaaggataaattcttggatgatgtcaatgggttgggaaaatatcttttatgtgttcagggatgttgtgatcagtatcagacgaaagttgagggaatataatggcctaacccctccaaaagagaaagccattgaggtagaattatataacattatgatatcagcaacagaaaatacgttatagaaaaattttgaagagagaaaaaaacgaataggatttaactaagaattgaaggactctttaaattttttaaaaagccagactaaaggataatgaccacagagtaagagggacatttggaggtgacgaggtctggattgccccatagaaggagaaagtaagagatttgggttaaattaaaattaggatgagagtgaagaaatttgttccttgaggcaagtgaaaatgtcaaaactgatgctggaaatgccttacaggaaaccaacccaaaatgaatgaacgatttcaagtggaattaaagagttattcagatgagaaaatacatacatttctgttaggatgataatacatcctggtttctctgagaaagggctgatttacaccagttttatagtatcctcttacattttcaaaaataaaaagtggctcagatttagacattcaattacattaccacccacttactggctctaataagtgtggttttgcagcactgtagttatttaagaacagaaacagaattgacagtgagagaaactcaaaagtgaggatttgctagacaggaatgacagaaagtcataaagatgtggtattcttaaagtggcaaaaaaaaatagatgttttcaaatgactaaccattatttttctcattgaagcatgacaaggaaagtcagaagtggggttgggttaccaaaatagtgcatagtcaaagaatggcaaatggtgataaactaatgatgaaggtcaatggatgttaagaaatatggcaattataatatgaagacaggtttatcaccagaaagagtaattttggatttggagatcttgaagttcagagcattttcaggcatgataagacttacagaacaccccaggggtggaggtagatttaagaagacagagaattatctggtattcaggaaaccaagagtattaattagaacctataacatgacatggggctttaaaacactattttgtataaatggaattttctggactaaatttcacacagtgactgtccatatatattcttaaatgcctgctgggagaaaatgttctgaagtgcgctccttggagttgttacagaaatacctaatttcactgggagactatttcagagcaatggaaactagttctaacacaattgtaattcccatttcaatattaatactaaaaaatgttctgatgagatggctggaaataagaggactgggcatccacagttaagtgtgttattacttatgctatgtgcatctttgattttggagttttcagtcttgagcttcgtgtgttttcttcttatattttctacttaatatatgatttcagatataccatcacatttcatttaaattagataaaacagaattcccctctgtaaatgtaggactgtttttgcttgtttgttttgagatggagtctcgctctttcgccaggctggagtgcagcggcgcaatcttggctcactgcaacctccacctcccaggttcaagtgattctcctgcctcagcctcctgagtagcagggactacaggtgtgcactgccacgcccagataacttttgtacttttagtagagacagggtttcaccatgctggacaaggactgctcttataacaccgtgttgtaaatctaatcgcacttcactgtgtctatttctccctttctttttcctgtcttgtatgaaaaaacgaattttcaaggttttccatattacctagatgaaatgataaaatgtataaagctgtataacatatattccatatataatcaacctgactctcacactcaggcattaagtccagtaactatttatgagttgatgaaatttgcttttccttctgcaagagcattataaattaaatttatttttagtgtctgatgattttcctgatcccttcattatctgaaagggagaaaatgatttgttaattttctgttcaggaagacattgttaccagaaggtaacagactctaatgtactacacctagaccttgtcttggttctgccacttcttccctttgttaagtgccaatcacttaactaatcactttgtgtcttaattttatcatctgtaaatggaatggtaacataagttatgtgtctatgataaagattacatgaggatgtagaaagcttaaaatagtgcctaatttatgtcaaactactcaatagttttaactattattaacattttacttaaatttttagtttttgtcttataaaaactcatgttattttaagagaaactatctttgaacttcagtataatctacaccaaatttcatatcattatagttatgatactcttgttcatcattgctatggttcaaatgtgtcccctctaaaatttaggtgttgaaacttaagggccaatgtgatagtattaagaggtggaggctttaagacattattaggccaggagggctcctcccttgtgaatggaactaaggcccttataaaagaggtaaatgaagcttcacgcagtgtttcgacctcttgctcttctgccttcccccaggtaggatacagagcattccttccctctggaggacacagcaacactgtgccaacttggaagcaaacagcagccttcatcagacaacacaacctgctagtgccttgatcttggacttcccagccttcaaaactgtaagaaaatattttctgcgtttttttttcttctaaattacctagtctccagtattttgttatagtagcaaaaactgactagggcacatgtgatttacctattgttcacagacagtatagtgtcattttagaaggggatatgaaatcagacatttagggtttgaaacttgacttttttatttattaactgttgactttgacatgttgtctatctaaacccaaatgtgtattttataaacatcagacaaataacagtattcctcacagggatgttgtattaatttaatgagacactatgtaagtgaattactattggacctggtatatttttaatagttattccctttacttgtgggttattgaaaattaatattttaaaaagtagattgtctaatcaacacatttaaaaaatatcaacttctcttatttttatttcttctttttcatttccaatgacactatgacagttcaagatcactttatctccagcttggagattgccacctaaccactgtttatattgttattttattattttagtattatgcttgctcaaaagcccaaagtgtcaccttagcctctgggtatagatctgtgtcctccattttgaatatttactatgctttctaaataatccactgtgatcatcatattcttgtttaggggaaatattataaaacagactcttccagtgtgccccaaccccctcctttagaatgaatttctagatttgctaagtgtctcctccaatcctgtttgtttttagctgtttgttggtgttggtatttgttttttgttttggtttgtttgtatttgcttttttttcatcatcactcaacttatacttccactaaactgtactgccagcagttttttgtttgtttttcagaacagctccacgttttgccatcaaaatttcttgatccatgcattctagctgcttgagataatcttcactgccatttccttttaatgctcttaccgtattccaaagaattacctgtccaaagaaggccatgattaatatcctagtcagaaataacattgttttctactttatatttagaaaatgctctattagtatttcttataaaatgtatcatattctgattctaattttagttaactgtgtatacatttttacctcttctttaaaagtttatgatcaatcttatttatcttcatgttcatttcttcatcttacataatccttccaacagtggatatgaagtatgtggttagtaaaatgcttgattgttgaattgaatagaatttacctctttacttaaataacaaaaactccaaaactaaattaatatgcttgtgaagatcacaattactaaaatttatagaatttgtctttaaaaactgaaagtaatctttagcataattttcttttttttgacaaagtagaggattatttgttaagaaatacttattggaatttcttataagagaccgaatgaaaaaataatattctctttgttgacattcaaacctacgatttaagaatatttaaatttaaatttaaagtgactgtttaaattttaaatttaaatttaaaatgactgtttaaatttaaatttaaaatgacatttgaaatttaaaatccacagccagaactttgcaatgatctcatggtaattcactccctcctcttgagttacctgaaattagaggttaaataaatgttttctactccaaagatttaagatactgcttaccagagaaatgtaatggccatagtgctgagcattttggcatgaaattaagaaaatattttaaaatagatgtatcgattaaaaatagagaaaatctgatgaatgatttatcactaaaaaagcttttcaaacaaaattgaaggactccaagagctgcaagagaagcaaatatacattttagacatcttttctggataaaaccaaaaatcccctttcaaattaccagtattacacatttcaaaacaaattcaataggaaggaaggtagatacatgtgtttttattattttgaatatctaaagatattatttattatatatttaaatttgtatgaggaaaaaatcttaaagacacagtttcgagacaacttggagtttggtatgacaaatatttgtaagacattaagaattaaatattttcaataaaataaaaggaatacataaagaatggaaatattaaattgtttcaatgaaattaaaaaccatatttaaacttcattttgctattaatttttaaatctatgttacatcagtaagaaaaaattaacttcaacttctaattaaagaggaggaggttctctttaatatacctaagcaaagcatgtggtttatgctgtgttttttaatactttatactgagctgtttttccccaagcataaaagaaaaaacaaacaaaacataagttgatggcctgctttatatgtgtgttttacaatgttgtttgctgtaagcttgtattttattttcattttaattggcctccctgtattcctgcatattatcaggaaataaactctatagtggtaacaattgacagacctaggaatttgacctctaattcaacttgtacggaaacatttttatagattgctgttaataatataacttttaccatcctgaatatgatttatcacctttgttctttgccaatagttgttcaaatttcataatttatgtaccttcagttgtcagggttataaaagaaagtttttaatatacttttgtattaaatataatattaaatattgtattttgtttctcttaagtgcactggtgttcctttagatatgcaaatgcttttttaaaagcatgataaaaaaattttcatttgttttccaaaattttctctactgataatacaggaaatatgtatcagggaaatatgtattcatacttatgaaaagacacacatatataatacatttatacaatacatgtaatatatttatgaataaatataaatacatatttcccttatacatatccttattctaagtattacccaaatacatatttttattttaactatccacatatcactagcctcaaagaacatatataattgctccacaaaaaaatgcaggatgaaaaattaaaaataaaaatatgatgaccgtgcacagtggctcacgcctgtaatcccagtactttgggaggccgaagcgggcggatcacgagttcaggagatcgagaccatcctggctaacacggtgaaaccccgtctctactaaaaataaaatacaaaaaaattagtcgggcgtggtggtgggtgcctgtagtcccagctactcaggaggttggggcaggagaatggtgtgaacccgggaggcggagcttgcggtgagccgagatcgcgccactgcactccagcctgggcgacagagagagactctgtctcaaaaaaataaaataaaataaaataaaaaataaaaatatgttaatttgacaaaatggataggatcatagtggcctatgatggagtaaaaacggacgcacttaataaatccagtgaggctggtctgaaggtagtgagttatctcaattgattgttcacagtcagctacagatcaaaatccttctactcttttccccttctcactacggtacttgaatagccttacataaataaatgaataaatccaatgagactacaaataaggaaccacccagagtattcagtaacttgatatataaatggtaaaatcataacatttaattatatttaaattataaaatttggtttgcaatagagtatagagtatgtagatatatagaatatacttatatgcatatatatagtgtgtgtatatatataatgttctcctatataggtttgtatatattatatgtgtgtctatatatctatacacacatatatatacatatatatacatatatgtgtatatatataaaatgttcacatacgaaatggagaacggaccatagctattcaatccagtaggaacacttggaacacatacatattttaaattcaatatttttgagaaaaaaatatatttttctacaggcaattggaatcactgtcagcaaaaatcaactggtatagctcagtctaatattagttacatgatgcagatttcaatgtgcatagaaacaacatccactttaactggaagttaaggttacctgctgggaaccaaatcagtggttgtgggagagacttgctgtaaaagaatactatatcgaaaagccaagggtgctatcataaacaaatcatatttcttgatggtaaatggagacaactgcaaagagcctcaggcatttaacttaaggaaaataataagtaatggattaataataatgttttgtaccctaaaaattgccatctgtaagtagggggctgagggacttccatatgttaatcttttaacaaggcaataaagactaaaggttcactattagcatgcttgtctttcccaactgtgcttaatagaataccagaattaatgacctggtgaaaaaaaaaagttactttttcaaataaatttagaaaaccattgcatgatatactcctactcagatattcatagtacacattagcatattaacattcagatgagtttgcagtagagaaacacactgtgtctaatacagaggtctcctaacattttggtcaatgggtcctcccctcacataacccaccttttagagtaggtgaaataatacccctttaaatacaccagggaaatactttaaatacaccagggaaatacagggatgaattattcatattttaccaactctgaagaaagaccatttaaaatggagttatattttttagcatggagtctcaaaaataggtgattaaggagttataagctcctgtctccacagatgtttaggaagtctatgtaaagattcagttgcgtcctaatgtgacttcctagctagttttaaatactgaacatggctagaaatgtgatctgctttacgggtgtcacttcctattttcagtaaaaaatgagccagggaggtaatcctgaatacacctctgtttttgcaaatatttgtctgttactataatttatttcctaaaaggagaatcacctcttgacttgaacaaaatcacatttctagacccttaagttaaggataagactatggggtagggtaccctaccaaagcactccttagggtaaagccttttataggaatttcttctagactcataagacaacatctttaatttccaccctaactatggcactaaatatattaataatagctcagttcatacagcacttcagcagatattgagcctatgacacatcacaacaatcctgtaaaactgacatatttttttcctcattttatgtaacacagaaaataaattaggttgttagttttgtgcacctagttagctactcatccagaacacaagtccagtcctctcactcttagtcggggcaggtactacaggtatagaacatgttacatttattgtattatgtaatcccaatatagcttccctaatagtcttcattattagtttaactatttctgagttaatttgtatatcttcttaatttatttgtgcttttttgtttgtttccctgattcatttcccagcacaaatttcttatttgcctcaaatttgcattgtggtattctgaaaagagagttctgatatgacaaaactctagtttggagtgcttataaagtcctccatgaaaacgaagccatctgaacaaactatggttatttgtacacccatagactgttttaaaggaatctaaatctatgttttctggaaataaaaagttcacttttttacttcttcatatatacttttttgtaatacattcattatacagaagtaacttgtgtgtgcctgtgtgtatttccgactgtgtatttagaagagttaagtggaagaacaggtgtaggtaagattaaactgctgatcttaaaagtacagatatccttctgagctgggactgaggaactattaggtaaatgtcaacagagaaaggacagaaagcacatgaagacacagatgagcaagttgactctccttgggattaggcagcaatatgattgataacagttttctgacgctgggttgctttatggttcacgaagctcctaatctccatggtgatttaggatgtgctttattgagtttataaaactgtaacatttagcctcttagactaaagaagtcccttggagttttagtgtctgaagatccttccaaacatcaaggagaacctttcatgcagaaatgcaatgggtcatctctcaactgaattttaaaagaccctataagcttctttgaagggtgctgtagatttctatctatctcacccttgaattccaaggatgaattttttttcctaaaacatgaagtcttgcatctcttcttgaatctggttaatttcattacagatgctggtaatcacccatttggaaaatatgtaatattagcttctttttaacatcttatccgttataccttattatacttccacatggcatactttctaagttttatttgtttatcagctgtcacagacagacatacctttagctaaatcaagctcctgccacaggggaatggcatatattattgtctctctccaatccttttcctccttgataattatctctgtctcatcctttgtatagaaattcagacaaatcttgctgaagatatcttccatacaagctcagaactttcgagttacagcgccatacacatttccttcaacagtcttcccagagcttgtgccagtctctatttgtttgtgtgtcagcttgtcattatacctgcatcaggttataagcttattgcaggcaggtatacaacatctctttactcaatgttaattccaaaatttatttttacaaccgtattttttaaaaaaaacttttaggttcaggggtacatctgcaggtttgttatataaactcatgtcataggggtttgttatacagattatctcctcaacaggactaatcctagttcccagtagttatttattctgatctgctccctcctcccaccttccatcctctagtagaccccagtgtatattgtttcccccatgtgtccatgtgttcccatcatttagctccctcttataagtgataacatatagtatttggttttctgcttctgtgttaatttgctaaggataatggcctctagttccatccatgttcctgcaaaggacatgatatcattcttattttttcttggctacatagtattccatagtgtataggtgccacattttttattcagtctacaaatgatgggcattcagcctgctattgatgggcatttatgttgattctatgtctttgatattatgaatagtgctgcagtgaacatacatgtgcatgtgtctttatgatagaatgattatattcctttgggtatatacccagtaatgggatttctagatctaatgacagtcctgtttttagctctttgagaaactgcctcactgctttccacaatgactgaaataatttacactcccatcaacagtgtataagcattctcttttctttgcaacttcgccagtatctgttatgttatgactttttaatcatagccattctggctggtgtgagatgatatctcacggtggtttacaaccagagttttaaaacccagatttatcttttgaatttgagacaaagggattcagctgcttactgcctactgttttctggatttcacaggtatcccaaaccaaatgtgtctcaaacaaagtaatcatctctcaactggaactgtttcttctgttgtgctccttacctcaaagaattactatcatctctatttaatggaaatctgtatctcatcctggactcttcatttctaatcctcataatggaccagtcaccacatcccacacacttgttttcaattgttctacttgcctttactctggcactgttccaggtgtacagagggaagtgctgtccatatggccattaaaggaaggacctattttcccaattactgggaggactgtgagtgagtattctctgtctgtaagccctttcaagtatctccatagttccctaaaatttatacacctttagaagtaggccacccctcccaatatatggctggaactccccagctgattgatggaagacatgcagaagccttccacaaaaaagtctgcaattgtccccttccttgtctatctttattcacctgttctcctggccactgtctacaaaactagggcttagttgcaacacaaagctgtgtatgagttggccctgataaggtggaagagactattatctatttagaaggagtgacaagcccaatcagcaggtatcagcaagacgagggagagaaggggtgagattattttctgagggtgcttgatcaggtggtcagaacataagattagattttgagtactctcctgggataaagaattttactattggaaaggactacaggagacgattctaacttgttactagaatgactcccggaagtatgggaaaagtgatgacccagttaagtcaggttaaaataccagaattgctatggcagatggtgaaaaagagaatgaaagtctcaggaaagtagatatagtggaatgaacatactgggtagggtcggaaaacctaccaaatgagtatgatctatggaaaagcacagaggacatgccaattatcaaggccattaaaaattctgggtgagaatgatacaagaatcaccaagaagtccagtggtacctcccctgcatgggtcagagctgataatagaaaagatggttataaaacagggcccacttttagcaatggagatggcagagcattgacacaacagatataaatagccagaagccggatgaacagaattatggcaatgaggggccaggtcagagggacaaccagggtgtaacacatagaaggttataaggagatgcttaataactcttgctgtccatggaggctaagaaaatgtttcttcaacaaaggtcctgttcaattggtagcaggcaagatatcaaggatggatgcacaggagacttaaggcagttactgcaataaagaagtcaagattccttgcccaagtttgatcagtttttggacccagaagctattgaccttcttagcaaattttgacagtaaatggaaaagtgcagtcgtcttagcctgagaaaggctcagactcctaagaaaggaggagctgggtcatgccacaagatgggccttctggtctcatttcaatgaaggatttgccccaactattaggagcaccaacaatagaaaacttagttggcatccttgtcagcagaataaagccatctttccaagggtagacacccacgtgggtagcttatgtaactgaccaaaaatgtgagaatgtatagacccagctgtcccatctcacctttggacaattctcaagagccattctagctcccaatatcctgcttgggggcaggtggtgcttattcgaggttgcaattgctctgtcacagcttgatttctctctctgctccatcctgctccctgatggaatgttattctcttgtttattgaggaatattttgtattgaaatgcaataaaatgcctaatactttttaaaaattaaattgaaactcattaaaatatgcatctactttgttcctcatacattatttagtgtttatttttgaaaactttcttatgaaatagagtgaacaaactggctttttttgcctttacaataagttttacaggggttttaaattgccaatttgaaaattcaagtattgatgctacaaatgtgtatgtaagtgccctatgacaagagtgctcatgttttaaggagcaggtaagaaaaggatgtctgtcatttaagccacatttctgcacagtcattggtcctcctggcttcagcctggacaagtgcacagacattgttaaggcaaaggtaaggctgatgctcaaaaatgaaattgaactttaatctatgttagagaaattagtacattaatatttctgccaagtgggaagaaaattagtaaaaaaggatattcatgttgacaactataacatattatgtttttttttctccagagtgttctattaaagaaaaatcagtgctacgaaagcactttacttctactgcaaactttcttctacagtaattcaattatcatagacttccttaaagtatttgtaaacaacagtaattgtgtgtaatcgctcaaggccagacaaataatgcagatctaatttggtttacacctgcctaaaagccagagaaagaacacctcttctctatgtgaatgttaaaccaagttctgaaaacaattgctgagaatggttgttctctaaatgtttaaatacagaaacattgacaaaactcttaggacacaaattatgatgtttaatgggatattaggataagttattgcaggtaatgacctcaccatccatgctcttccaagctttcagtacaaaattcagaatcatcgtcaatgttttctttttattccacacgacgaatcagttgccatatcctatgaatatgtttgataataggcttgcatggtttatttgtgtgcagccatgttaggaggttggtacttgaataaaacctaagcatctattagtggaacacttgctgagtaaagtatagtgcatgaacaccacacagtatcatgcagctacctgaagcaaaggaatagatctagccaaaaggatggaacttaaaaagacgagtacatagcacataagaaagtgagaactaaaataatatatgtaaatttaaaatatgtgcataaaattgacgaatatattggaaaaaacacatgggaatgaaataattactaaaaagaatagaatactataaagagagaacagatgctaataagagaaatggaacgaaaatataaaaaatgaaatgaaagaatgaattcaacattaatagtaaagcataacagaggaacactgaaggaacaaatgatacagacactatttcatcagctgacaaacagaatgacgtcaatcttctacacgtgaagttaaaaataaagcaaaatctgctgaagatatggtcaattacatttcccttttatcttcactgctgttgtttcaattctgtttttttctttcatctccagtctatgatataatatcatttttctaaaggttcttattgtcattaatgtatccagttaagatttcttcccatgttgctaacactcttatactttcaaaaagccaattttgtcagtatccaaggaaaatatgaccaaaaatgcttttcatactctaaaccatactctggttagttatgatccaattacagcaacagttttattgttttacaagcattcccttaatgtgtcctgttccatcttctttgcttctataacagcctatttttcttttattcacgtatttattgcaacacattacagttcactggtttgctgaatactctatccctgtggtcttattttaataagggaagagataatgtcttccttgtctttttatctccagaatttatcgaaatgacctttatgtacaagcacaagtacttgtaagtacttgacaaacgttcactgaggttgaaaaaatgagtttatagaatgttcaaaagtaactagagagcctatgacacagtagcttatagcagactaatgcatccactgataatagctagaaaatctctgataaataataaagtgcaaaaccaattctttttggaggtaacatgcttttttattgtggtaaaatatacttaaaataaaattaaccatttaaataatttttaagggtatggttcagtggcattaagtacattcacaatgctgagtaaccatcatcactctccatcttaagaaatttttattaaccccagctaagacattatacccattaaacaacaactcctgaatcccctctcccccagcccctggtaactgctattctaccttctatttctctgaactgctcgaggagcctcaagtaagtgtaatcatacaacaattgtccttttgtatatgacttatttaactgtgtcttcaagagtcatctatgttgtagcatgtgtcaaaatttccttcctttttgctgctaaataatattatgctatctgtatataccatattttatgtatttgtttatctgtcaatgagcacttgggttgcaaccttcatttgaatattgtgaataactttgctatgaacagggtgtacaaatatctgagactctgctttcaattcttttgagtatatatccgaaagcagatttgctgcatcatgtggtaattttacattcaatattttgcgtaattgtgtactgtattttcacaatgcttgtaccattttacatctctctcagcaatgcacaagacttccaattcctccacatcatcactaacacttgttaccttttgtttgtttttttaataatagccatcctaatgggtgtgaagtggggtaacatcattttgagctagctaggtttgaagtgacaagacgctgaaaatcagagatgtttatctttcaagcccttgttcatttttttctcaaactgcttgccaactggtatggtttggctgtgtcccctcccaaatctcaacttgaattgtatctcccagaattcccatgtgttataggagggacccaagaggaagtaattgaatcatgggggccagtcattcctgtgctattcttgtttgaataagtctcatgagatctgatgggtttaatcgggggttttcacttttgcatcttcctcatttttctcttgccaccaccatgtaagaagtgcccttcagctcccgccatgattctgaagcctcccaactatgtggaactagaagtccaattaaacctctttttcttcccagcttcaggtctggctttatcagcagtgtgaaaacagaataatacagtaaatttgtaccagtagaatgtggtgttgttgaaaagataccctaaaatgaggaagtgactttggaactgggtaacaggcagaggttggaacagtttggagggctcagaagaagacagaaaaatgtaggaaagtttggaacttcctacaaacttgttgaatggctttgcccaaatgctgatagggatatgaacaataagttccaggcttattccaggtctcagatggagataaggaacttgttgggaactggagcaaagctgactcttgttacgttttagcaaagggattggcagcattttgctcctgccctagagatttgtggaactttgaattttggagaaatgatttagaatatctggcagaagaaatttctttttttttctttttgaggtgcagtctcactctgtcgcccaggctggagtgcactggcgctatctcggctcactgcaagctctgcctcccgggttcatgccattctcctgcctcagcctcccagtagctgggactacaggtgcccgccatcacgcccggctaattttttgtatttttagtagagatggggtttcaccatgttagccaggatggtctcgatctcctgaactggtgatccacctgccttagcttcccaaagtgctgggattacaggcgtgagccaccgcgcccagcctggtggaagaaatttctcagcagcagagcattcaagaggtgacttgggtgctattaaaggcattcagttttagtcgggaagcagagcataaaggcttggaaattatgcaggctgattatgtgatagaaaagaaaaacccattttctggggaaaaattcaagccggctgcagaaatttgcataagtagcaaggaacctagtgttaatcaccaagactatgggaaaaattatctccaggccatgacagcgaccttcaccgaaggccctctcttcacaggcctggaggcccaggaggaaaaagtggttttgtgggctgggcccagggtccctgggctgtgtgtgcagcctagggatttggtgccctgtgtcccagccactcctgccctgactgaaaggggccaaggtacagcttgggctgtgacttcagagggtggaagccccaagccttagcaacttccacatggtgttgagcctacaggtgcacagaagtcaagaaatgaggtttggacacctctgcctaaatttcagaagatgtatggaaacacttggatgcccaggcaaaagtttgctgcatgggcagggccctcatggagaacctctgctagtgcagtccagaagggaaatgtggggtcagagcccccacacagagttcctactggggcactgcctagtggagctgcaagaagagggccaccatcctccagacccagaatggtagatccactgtcagcttgcaccatgtgcctggaaaagccacagacactcaacaccagcctgtaacatttaattccaggtctgtcaaggcagtcagaaatggagggactaagatcctgggaaaaagagagatgaagagagttataacttggactctacgtatgttttccctcaagtcatttgctgattagaggctaaggagctaaatttaaatatataagaatttcaagaaaatgttcagaaatagcatagtgctgcagaacaaaaattaaatactagtgctcagtcaggggaaggggttctagtaaatattgcagtgttcatttcggagccatagaggattgtatcttagagacagaataatctagattcagaggagactcacaatatctgaatcacagtgtcatgtcatcgccaaccttaattttatttagtgagcagagggtaaatcctctctaagcaaagataacattatagagagtatttatcatttttttcagacactaaatctagagtttattcagaaacacctatcacaccaagaattagtactaaaggggaaaaagaagcagtgcaaattaaaaaaaagaggtgatccaattgaggattcacatattggttcaaaataattataattcaagtattcagaaaaatatataagaggatacaaaatttcatgaaggaactgcaatccacgaaaaagaattaaatggaaattccagaaatgaacaattcaatatttgatgttaagaactttattgatgggcacagcgagagattgggaactgctaaagacagaaccattgaaatcaataagatgtttcattcacaaatgcgtggatagaaaccaaaaacaagtgaataggggtacagaggaatagaggagaccagtagaccttagataaggaaaatatctaagctattttaattgaagaataatggatactaaatttaacaaataactatccagtaatagattcaagaagtctatgaaactggaaccaggaaaaatacaaaaaaaaagctacactatatacagtgtggtaaggctaatgcaaatcaaaaagaaagacaatcttcaaatcagtaactgaaaaaaatacattaactatagaataacaacaataaaactgacagctaacttcttaaaaaattataagaaacagagcagataaacaacatcttaaaaacctgaaagaaattaacgaccaacctacaccttataacaaataaaagtaaatctctacacaatgcaaaagagaaagggaaaaggggggaacgaaaggcttagaaaagcagaaataaaatttgcaatctgatggtgacatgaatatgtatgcagaaaatgtaagtaatgcacaggatgaataactagaattaatataacgacttgagttaaattactgaatgaaacagtcaattgtggttttatacatgagaccagctacaaatgaaaatataaaccacgatgatatagcaacataaacccatcaaaattactaaaactacaatttttttttaataatctcaagtttaggagagaacgtgaagtaatgagaatttctacattgcagagggtttctaatgatagtggatttctacgatacaactaatttagggcaaaattttgacagtaatttcacttgtaggcatacacactggcaaaataaaagcataaatacaagtaaatgcaaatgtacgtgtgcatatacacacacaatttttttcatattctgtagagaattcctattaaacagtaagataaccaacacaatggaaaattaagccaatgaactgaaatggaaacttcatagaaaaggatagtaaaatacccgtaaacttatgaaaaggtggttaacctcattactcatcagcgacatgccaattaaaccacaagttttcactacacatccattagagtcagaaatcttaaaaagaatggcactatcaagaactgctaagaatgtgaaacacgtggaacctctcatatactacccggtgagaaggcacatttggaaaactgtttgcagatctacttatgctaaattctgggatatatgtatgtcctctgacctagaattcaagtcctcagaatacacccagaaaaaaatgtgtgaatgtttcttacaaatggcaaataaatgtatgggtataggttatggagaaaagtataacacaacaaacacattatctctgcagttatctgttttccttacgaagagaggtctccctaatctccattgggtttagaagctctgtttaataacgtgagttaagcctaagtctagtgctattgaaaacttatttcccagctttcccagaagtttgaattccattgctcagttcctaaagatttgtttaaaaagagaaaaaggttcaactctagcctgggctaatctactaggcattccaaagtttaatatcattgacttcaatggaaagaaaatagctattgcagtcctagatcatgattctagaccaaactccatcccttcctactgtgtgacttgatcaaatccctctgaactatatgacattctggaaaagacaaaatcatgaacacagtcaaaagatcagtggttgccaagaattcagggtagggaggaagggatgtctcagtagaacaaagggaatttttagggcagagaaactatttcacattatactgcagtggtggatacatgtcattgtatatttgtcaaaccccctagaatatacaacacaaagagtaaattctaatgtgaattatgaattttagttaataattatatgtcaatatcggctctgttatgtatcagtattgactcatcagttgtaacaaatgtatcacaataatacaatacgttactaataggagaaactggggttgtggagtgagttgatatatgggaattgtttgtacattctgctcattttcctgtaaacctaaaactcctcaaaaagtaaaatctattaattaaaaaattctactgtagtattttaatatctttgagataaaatatacattaggaaacaaggatcatgcattatataggaacaaaacattctactgactttgtcttatttggggaatttaattcactttgagtgatttactaaaattctgacataataaaatggtgaaaaagaactatatataaatgctaattaggatactaaggaggctggttaggtgaacccactcattatttcaagccatagagttacatagtgcattttgttagaaatattttaaaagtaggcatatgtcaaatgcatataagcaataaatcttatattcatttatcttatcacaaaataaaatatcacatggaaagttttacaataaaacaaaataaaactgaagctgttttacattataagggaagaataatttgagttgaaatataaaatcagatacagaccatactttaatatatttaataatttttgtagttaatgttttagaaacaattgcattttatccttctctgtgatacataaatatttgtgtgcgcgcatgtttgttatttttattttaaactaagaataaagtttagggcgtttcctttttttctttcccatcttataaacatttcaatcaaaattattatttcggacagtggctttgataacatatttgtaaataagtcttccattacatttatttccttaattttcataataaaatgcttatcctaacatttattatccttatcaagaaaactaatgcatctgtccttaatcagccatagagaatattagccctcgttagttgccagaggctacaatttcccattaacattctagctgagagacattatgttatgttaaagaaaaaatctatgagaaaaactactcatttttcttagaagtctacgatctaacatttgatagagcctggcatcagaaagacttcatattgagctaatacgagtgtggcctctggcagaattcctacactgaagagaacttcagtgcaatgtctggagcttttactgaggattcctacaataatttgctacatgaattctacttcttaaattgccacaaaactagtgttgagaacatttttcattaaattattaattgttctccatatgtgattaattgcattagaaatttagtaacaggaaaaaagttatgttcttcaggaaattgtgtgacttttcttttcacataatagtttagtcactgcattaaaattttatgttttgtcataaaattaccacagactttgtatttaatttttttctcccacttttttttctactttatgaatctacatatactttataaaataaaaattataattataaaaaaaaatacatatacacataggtaaatctcaagattaaataaaattattttcatcaaatttttagagattatttatttatttaaaatacttaccatatgtcacgtatgtaattcactttgggaagccatgggaaagaacatcaatgagatttctatttacactgtctgtgtacttttaggtctataacttgaaataattctattcatacaccaaagaagtgaacgaaatacatgtactcaggttgtaaccaagtgcctcagctttaaaatggattttaaaactttattttctctaaactgagaatatagcattaaaatgtactttgcaactccctctttctcttcctttcccaccagacattcccttgcatcatgcacgcttctctacatactttcttagaaattccaggggtacatcttacaagaaaccaggcacggagacccagctgcagacttctccccaacccaaggattacttcaaggtggttcatctgcaactcagctgtaaccaatatggtatcaattcacaccccagacaaactcaagatagccattggaacaagacatgcagacctttatcctgcaccactcctgcatgtttcccataccaagattccccttttaaatctctccactcacaccaaaaatttgagatggtttctttgcagcttgaatccagacatctccccaagtgctggcatttggaataaaagttaccttcctttcaccacacctcacttcttgtgtccctggcttttcgagcagtgagcaactgaacctgagttcagttacaggatcaataaatgtccacaaactcagtagacatatgtaactaccattatgcagtatatttgagtcatatatattcgttcgtctctaatcccatagattgaaatggttttgaatataaattatatcttgttcatcaatgtatccatagtgccagccgaatgctggcatacaactgaaacttggcatatattcgctgaaaaaaatgatagccattaaatataaggtatggcttattctcccaaggaacgcacattatagttggaaagatatctaacacacatgaaaattcaaaagctgatttggtgtaagaagaacataatctatattctcaagagactttatggctaagaatatatcattcagcatttacaaaaggttaaagtactgctttttctcaaccaaatacattaaatacaaacatcattttctaaactttacaaaactcttcatttaatttttaatttttacctaaaacacttttaggatctctacgcagcaatggaaagtatatagaattttacaaaatttatttactggactcatttttactgtgttacgtaaatatataaaacttagtagagtcatgttccaaactaatagtaatcatccaaatcctttttaatactaagaggaatgcattttccttagagacaacattgtaaattgtgggtagatttcagactagctcactaatctcaaatctattatttaacattcgtatgttgtcagtaataggaaacacatcctaaccaatatgcatagtaatgtccatatggaaaaattaattcgcattaccaaaatcggttgcctggaactatctttgcagggagaaggtactccttcaattccctttttctcccaactcctcacctataaactatgtgataaaatgagaaacttctttaactcagtgaagaagacatgggtagttccccacaaaaatgttgtgctccccttttatagtatatatttgtggattggtaaaaactacctagacagggtctagattctctgcaggctttcccctatgtcaacatgggattttctaactaattcttgccatggaattttcgtaagcaataaggcatgtgtcaatttaggatttttaagaagcatatgtgtcatctttacctattctcccatctccaacattgggggtaaaagactctgagatcctagtggaggacagattaacaaggaggaaaacccctgctcttctgtttatcatatgcaggaaagccacttaccaaataaaaacaagcccacaggactcttaaatgactgagaaataaactgctgtgttaaatctttgaaattgtaagacttaattctcagagtagcttatagtaccttaatatatttactatgtctcaaagtgtatcttctggaataacagtccaagtagacatgccataaaaaagttctatgaccaaataagttagaaatcatatatcccttttacagacacataatagatacaggataatcaaaagctcaggaaagtcgtgtagctttaaaaaatgtttaactgtgtttaatctagcaatttccaaatttactggcaaattaaatcctttatggcataagaactattaatgttgtatataaatgctattaatcagaaaactctttggaaactatttccttggctaaatgattgataaaatcccctcgtgacttggaaaatgtctttggaaggtgaacgatagagaaagggcttagagcttaaaaaacaaatgaacaaacaaacaaatactgaagatctggagacattaatctgtttatgatgggaacagtttatattcaataatcttaaggagcaaaactttttttttttttacctaagtatgctttttcaagtcctgaagatctggggatatgcatctgtttgtgatgggaacaggtcatattcaataatcttaagaagcaaatatattttttacccaagtatgctttttcaagtattttagcttggagttgtattgaatactatggtatgtcatcctaatcattctgttgctactgaagcattcatttcccatgctatcaggagtgttaggggctggtgattctctgctaaatccctttccaggaattgcctaagctgaagatgtgataccccatctatttggagagtgtgcacccagtgaccggtacatacagaggtgtaaggttctggccctgtcgcctctagaaaggcccactctgaaggtcaattactgctccatggctccctgtggaagagctgaggtctttgtggaattgcatgacagttcagcctctccctctgtccaatgctccttctttccctctctccaatcttgaaagccctctctgttaatcctcctgaacagaaaactctctctcagtaactattttctagtaatcgtaatctaaggcaagtgtataccatgaacttgcattattattgtatcgtttaaacatattttgctgaaataacttaaatgattaatattatttggttacaggtgctttaaatatattcactgctaatatttcaggagagttttccgtgttggataaaacctgaggttccattgctcatgtctatgcatgcgtagggtcagtcctctcagcttttgctgtacaacttgactgcttgttaacacttctgcaatacttctgtagtggcattttgtttaggtatgtataactttcctcttcctaattttcattaatgctgttactctgaaacccagaaagtctacctatgaaaataaaagtactgcgtctgtaaaagagctacattcttattactggtattaccggtattgtaagataagccttgctgttatttcctagttaaacttattcagataaattgattaattttacctcatgggcatgtaaattattattttactcctttgcattaactgttagaaaattaatgacaattttttggcctagtctagcatggatagaaatttcttcttgcagtttggctatcaacttcagccttgtcttcaccttctcttacctaccctcattttttatctgccataattgcttcatgatcaattttaaatgtttactttgtctgattgcattattttacccagtgtttgaatacctttctagaaaaaagtggcttactataaattatcatataatttagaaggatatataatatataatgtatatattatataggaaattgtgacaaaattcaaatagaacatgatgtcattttagtacccacaaggcaaatacaaagatagatgataacacaaagaattttagattacttttacataaaaaaagaatttgcttgtaatggtacaatgattaatttctttatattatgattttgaattctgctgactgatttgttcaaatgtcttaactatttggcaaatgggtctcttttcagcttttgctttatctcaagaataggcataaaagctaagcattgggcttttaagtagataaagctggaatgaattcccaaacccatgctttttatatgaacacggacactttgtttaatttcatttttcacatatataaagtacaaataataccgtcaacctcgatgtccttttacaattatttagatatattgtatgaaatacatagcacggtaccttatttatagtagaatagttgtaaacagtagtattatttacattacatattctttaatgaaagttagcttctttcattaaaattcactcaacttagattaagaatgaaatgcatctttcagggtaaatttgaagtaaaagagttacaaaaacttgtgtgaagactcaattgaaaatataactttaggaatttccaggctgaagctaattgttagatctaggaatcagtatcagctactgagtgaggaaggtgcaggaaaagaggagagaagtaacgtataaggagtagagtgtaaggatgatagcttatattaagggtaaattttgtcttgggaggaaagggcaagagcacacaagaaaagaaatacggcacaaaatgtgtaaagaaagggaagaaataagtttgtgtagttttataaaagccaagaaaatttgacgtaagcagagacatcaaagacagaaaccaggattcaaggttactcttctgtctcaaatgacagcacactgaatattaccaggtgcaaaagatactgggattctctagtgcctctggcacaaacaaccaggaagagaagtagacctacgtgtcctctggcttgggtaacaagcccgtagagcttgttcccaaagacaaatggatcaagctttaaaaccctagaaactttcttttctcaactagggcaaattctgaaaaatatacctgcctatttttgccttggtcatataaaaacattgctgatatctgtccattcatggctcagtcctatccaggttcctccctgtaaacaacacatgcatgcagtcatatttttaggtgtcttttaacacctaaacagccttaattttaaaccaatgaataattttctccctaccctaattgatctctgcatacatatcatttgacatttgatttcttttgcttttgaaatatttgatttctgtaccaaaatactctcatgattttcctgtaacatttctggacaactttctgggcgttcttacctctatggaccaaccaaaattagaagagaattatgttgcacgttgcatgagtttgaaatcttgttcttacacatacgatttctatgaccttgggcaagttacccaacttctctgtgactaagtttcttcatttgcaaaataccatctgttcctcttcatggagttggtgggaagattatgagtattattatgagcaaagcacttgagacatttactagtagatagaaactaacacaaaaatattagttatctgtgtttttattttatgcccctctttaaaaggcatatttctttctgattctttccttggccctcttctctatgaatttcacatacctgtgtagtgatttaatcttgattcatggctttaacaattatctcccttctactcacataactctttagaacccagaccactattttcaactatccactggacagctccactctgatgctttacagatatttccaatttaaggtgtcttccccattccaagcctgtgtgaatcattctgcgaatggataggtactaatgtcccaattcacaacggtgagacttacccttgatgtcttcctttcactatgctgtttcttctacgttcttatcatctctataattttttctgccctatcagacaaaaattacctgaaatattgtgataaccttctaactggtcttcctgtgtctcttcttctgaaatttatcctgtaatgtgcagccagaaacctgtttattttaccaacctgtttaaaatctttaaaatgttctcctagagacctaaggatgataaataattttaaagatgaaaaaaatcaactaaccttgatttcattatgttcatctgctttcagaagtttattcctataaccacccagattctaagagctacttctctggacttacagaaataatttggagaagtctagcttattcctgaatctagttctcataagtagaccctgaatctgaaatgtcattctctcaacaattgtattaattgtctcctatttcattttcagttattaatgtagacatcactattccactaagtatctttgtttttcgggaaaggagtgttctacatctgcttataaaagtgcgtatctctgtatatattgtaattgccttattatttccctgtttctccaataaacactgttaaacttgtaattttagtgcctcacacagtgcctaataaagaaaacatttaataaatattcattgaatgactgattagtcagtactgatttttactagaaataatctgaaattaatgttattagaaaataatctttatataaatgtaataaactgtataaaacaagaaaagcgtagaaaagaattttttaaaaaactcctataatgataccacttcgatgtgaatatagtaagatattttctaaggaaaagtgggtaaaatacaacaaaaattagtactcttgtagattaaggataagatcttacttttaggaaagagatgatattccaacacagtaatattccaatatatatagtatactaatattgtaatatactacaaagacataaacataatacaagagtaaactagagagtttacaacataaaccatcgtgtctacataatataaaattcctaagtatataggcattgttgttaaatacacacacacactcagagacaaaactatgtatctctaaacatgtatacaaaagacacgattttttaaaatttctaaaaaatacttgctgtgaacatctaaagctaaaaaacatgactttaaattctcataatttgtatttaattatgaattcttcacacatgtttaattattctgttagtaaagcaacacaaattttatataaatttataatatattgtaaaattttattttctcagaagttgacataactgagctgtaaggatctggatgtattgctaagcagttttcttagttcaatattaataaatatttgctgaatattttcaaagattacagaagtttttcaatttcaatttggcaagctagcaattcaattcttacaaataagacatttgccccaacactatccttaaattcaaatatgttattactatatctaactgatgataccaatctcttcaatctttattacacattttgttcattcccaaagtgtttgtgtactttgtttataggccacaagcagatgtttcattataactatgtcaggaatgcaacataatttatatcttcaatcagcagtaaaacaggagcacaatttttatttgtatttaaaaactcaaagtctatattctctcttttctagattccacataaattcataatttaattgttaatcatgtcaacagtagtagctagattgatttatctcccttttgaagacaaattgcacaaatctaacagagactttcatttattctttaacaaatactggcctatttatatgagctacatgaagactttttgaatctctagagacatcattttaaaatcttggtaaaaattcacttaatctgacttaacttgttaatttgtaaaactcaataataacgtatatgctcattctgcttgacagagttaattaaaacaataaaaacgagataaatcaaagatctttggaaaacaccaagtactgtaaaaccttgggaaaatgataaaaatgaaaggactgaaggtcattaacaagtttttaattaaaagactctctgtggaacttctgtgtcaatcacagtgtctggcatactcagtgtacccagttgtgggattatccaaggaaataggcatattaaatacaagaataaaaaaacagcaaattccctggtctagtgtcagatcttctatattttgacatctaagaaggtctgtgagttatctagataattgtatattgatgttcctccacttacagtggtttcacttacacttttcaatttcctcatggtgtgaaagtaatacacattcagcagaaaatattcttccaattttgcattattttcttttcctgggctagtaatatgcagtttcatattctctcataatgcttgggcaggggcagtgagaccacagcttccagtcagccacacaaacaccagagtggacaagcaatgctgtactgtattgcaagattttgcccaactgtaggctaaacataagtgttctgacatgtttaaagcaggctaagctaagccacgatgttcggtagattaggtgcataaaatgcatttttgacaatgatattttcaacttaacagtgggtttattggaacaaaaccccgtcgtaagttaagagcctctgtgtatcagttacccaaaatcctttacaagctgctggtgtttatcaatggagtgagctattttaaaatatgacctaccaaaaattcctacatgctagagaaaaactacagagaaaaatcatgatgaacaaatggaaatactgtatattaatgaaagagaaataacatgaggaagaaataataaatctagaggactaaaatgtcttcaagaataaagtagaacttgtttaacaaaatgtgtgatataaaaagtgtagatgctcctgatgatgaggtataatcaaatgcctttttagcccaatataatagaaataatatagaaaaaaatgaaaatctttacccatatgaagcaaaccaactcaaggcataattttgaacatttgatagaatttggaaaaaattaaacctatttgattatatatatttttaatattgtcttttcaatatcactaattcaagaaaatacgattgcaaataatactaggtagggccaataaccacttggtttttaataaaagttagctacttaagtaaaatagtatattttttctaattgcaatttgtttttagattcagaaataaaacaaaatattttagaataagtattataattttggcataagtatgccgattaagaatatcaaattctaaatttgagaaaaacactcagaaacacaatagtaaaatatgggccaacaaagtgataaatgagaagcaatataattatttataattgaactaaaatattttatgcaaaagtaaatgaaatattaaattgtaaaaaaaagtaagtttcaaatgaataaaatactaaggacctacacacaccttgatatgttgatatttttcaaaagaattaaaacaatataaaaaccacagatactttcaaatactgctaaatcatataacgaatctcatcagtgtttgatcacacatgctggaataccatcaagaagtatgtatttcagtagtagcttcattacttagtagcaaagcatactttgataagcatctcagtacactgaaatctcatttatatcttcaattaaaataagatatattccatgttatttttgactgaaaattcttcgcaacataaaaaaactgtgtagcaatgacaatagttataacattgacaataatcagtgattcaaatattccattttgtctcttagaatgctatcgcagtatgcagaactatatgctgtacctttgaattgaatgaagtagatcaggaagtaacaaaataggtaagacatatggcaaaagggactcgctacctccacgtaataataacaactacttaacatcaactttccctgggaagtataaaagtgataaaatgtcaaaggcattgactgttgattaggggccaaacactttatatgtattatcttattcaattctcacaacgttagcaaatgggtaacattatgatctctaatttgcagctgagaaaattgaggctaagggaagatgaagaatatgcctgaggtcatgcagtataaagtagagaaactggtattttcttgctaactccaaaacttgatcagtcgaccactgtaccctgcaagcaatgactaataatcagctaaatgctagctgaattttccccagtgattccatgacaaactttcttgagcacagaagaaaataaccatgaaatcaatattctgccaacatttactgtgaccatattagcagtccctaaattgacaatggcccgtgtttatgcatgtattcgtgcactcactcatttattcactgacttccctggcaccaccaaagtataagctccataaaagcaccccttatgtatttgtgtgtttgtgtctttaattccatgtaattggttacatgacagtgcctgccgtgggctaaacattcaaggagtgggctaaatgactagatctataaactataaatatattatcgcattttgtaattataatatttttagattgatattttctttttgaaatggggtaatcgatgcagaaagggtttagtgagttttttccatattgcacaactaagtggcaaatgtaaggatacaacctatgtcatcattatctacaaatcatgttttttcattatgttgtcatcaatcatctcattacgtaagaagtcttactgtcaccagatggtaacgcaatgtatggctaaacttcagttactatataaaatatgttatatgtcaaggaaactagttattaaacaggttattaaaactaaagatttaaaaatataatgctataaatattaacttaggaaaataattaggttagacaaatatcctgtaaggtatatatatatatttttttgagatggagtcttgctctgctgcccaggctggagtgcagtggtgtgatcttggttcactgcaacttccacctctcgggttcaagcaattctctgcctcagcctcctgagtagctgggattacaggcatgtgccaccatgcccggctaatttttgagtttttagtagagatggggtttcaccatcttggccaggctggtcttgaactcctgacctcgtgatccacctgcctcagcctcccaaagtgctaggattacagacgtgagccactgcacctggccaggtatagtattctttaagggcaaataaaaatggttatttttatatagtaaccaactttggacctgctcttttgttttttgaaaattaacgtaattctaaaatacatgactttcttttaattaggatttttcttccttaaaaacaattctttgttattttaaaatatattgatatctattggtaattataattatgatattcaacctagagaaacaaagtacaagaagactatagaacagatttaacccaaataagagtacgtgaagataatttataatcaaactcccaaaagtcaaggataaagaaaggatcctaaaatcaccaagagaaaagaaacaagcaacatacaaaggagctccagtatgtctagcggttgacttcaacaccctgtgttcacattgagtacactatccagacagaaaatcaacaaagaaatactgtacttaatccacactatagacaaaatgaatctaatagatatgtacaaaacgtttcatccaacaactgcagaatatacattcttcttctcggtgcacacattattctcaaggacaaaccatacgttatgccacaaaacaaatcttaaaacattccaaaaaactgaaataatatcaaggttcttcactgatcacaatggaataaaacttaaaataaatatcaagataaattttggaaactctacaaacatataggaattaaacaatacactcctgagattaaggctgtaagtctctcagcaaagaaaagcccaagacacagtgacctcactattgaagctggagaaacatttaaagaactaatatcgattctactcaaactattccaaaaaaacagaggaggagggaacacttctaaatttattctacaaggttagtacacggctagtattgcctaatacaaaaaaagaaaaaaaaaaaaaacaaatatcccggatgaatactgatgaaaaaacatcaacagaatgctggcaaatcaaattcatcaatatgttaaaaagatcattcatcatgacccattgggatttatctcacggatgtaagcatggttcaacatatgcaaatgaatgtgatatatcatatcaacagaatgaaggataaaatttatatagtcatttcagttaatgctgaaaaagcatttgataaaattcaagatactttcttgacaaaaacactcaaaaaactgggtatagaagaaacatgcatcaacataataaaaagccacgtgcaacagactgacagctagtatcatacttaatggaaaaaactggaagccctgcccttaaaatctggaaaaagacaaggatgcccactttcaccactcttattcaacatagttccagaagttctagcaagagcaatcagaaaagagaaagaaataaagggcatccaaattggaaaccaattcagtttccaaaaatttgtaatttttttttttttctttttgagacagtgtcttgctctatcacccagactggagcatgatctcaactcgctgtaacctccgcctcctaggttcaactgattctcctgcctcagcctcctgagcagctgggattacaggcacgcatcaccacacccagctaatttctgaatttttagtagagtcagggttttaccatgttggccaggctggtctcgaactcctgacttcaggtgatctgcctgcctcggcctccaaaagtgctgggattacaggtgtgagtcaccgcgcctggctgtttatttatttatttatttattttttatcgctaagtagtacccatggtatggatgttaaaaagtttgcttagtctgtttaagggcatctaaattgtttctaggttttagctattatgaataaagctgctatggacattcacgttcaggtttcctgtgggaacattatttattactctgccataaatgccgcagagtacaactgcatgtttagtattttttgagaaaccacttttttgttgttgttttctagagtggctgtaccattccacattctcaccaacaagggacgagtgatctagtttttccgcaagctcagcagcatgtgacgttgccactatattttatattagcattctgatacctgtgcagtgatatctcatagttttcatatgtatttctctgacagataatgatgtcgaacatctttccatgtgcttttttgccatctgcatatcctctttagtaaaatgtctcttcatgtcttggactcgctaattggattgtttctttgttaagctgctgagttttgaacattctttacatattccatttattggtcattttatcaaacatgtggtttgagaaaatttgagtgtgggccagccttgctaggttggtaaagttctcctggataatatcctgaagagcattttctaacttggttccattctccccatcactttcaggtacagcaatcaaacgtagatttggtcttttcacatagtcccatatttcttgaaggttttgtttcttttcactcttttttctctaatcttatcttatcgctttatttcattaatttgctcttcaatcactgatatcctttcttctgcttcatcgaatctgctattgaagcttgtgtatgcttcacaaagttctcatactgtggttttcagcttcaagaggtcatttaagctcttctctacactggttattctagttagccattcatctaagcttttttaaggtttttagcttccttgcgatgggttagaacatgctccgttagctcagagaagtttgttattaccgaccttcggaagcctacttctgtcaacttgtcaaacccattctccgtccagttttgttccattgctggtgaggagttgtgttcctttggaggagaagaggcattccggtttttggaattttcagcctttctgctctggtttctccccatctttttagttttatctatctttggttcttaatgttggtgacctacagatggggttttggtgtggatgtcctttttgtagatgttgatgctgttcctttctgtttgttacttttccttctaacagacaggcccctcagctgcaggtctgctggagttttctagaggtcaactccagaccctgcttgcctgggtatcaccagcagaggctgcagaacagcaaatattgctgcctgatccttcctctagaagcttcatctcagaggggcacctgcctgtttgaggtgtctgtcagcccctactgggaggtgtctcccagtcaggctacacgtgggtctgggacccccttgaggaggcagtctgtccattattgatgttcgcacaccatactgggagaagcactactctcctcagagctgtcaggcagggacatttaagtctgcagaagccttttgttcagatatgccctgcccccggaggtggaatctagagaggcagtaggccttgctgagctgtaggggctctgcccagttcgagctttcctgctgctctgtttacactgtgagcatagaactgcctactcaagcctcagcaatggtggacgccccaacgccagccaagctccagcatcccaggtggatctcagactgctgcactagcagccagcaaggctccatgggcgtgggacccaaaagccaggcacaagagggaatctcctggtttgctggttacgaagactgtgggaaaagcgcagtatgtaggcagaagtgtactgctcctccaggtacagtctgtcacagcttcccttgggtaggaaagggaaatccccagaccccttgcaccccccagatgaggcgacaccccatgctgctttggctcaccctctgcgggctgcacccactcaccaaccagtcccagtgaggtgaaccagtgcctgagatgaaaatgcagaaatcacccatcttctgtgtctatctcattaggagctgtagaccggagctgttcctatttggccatcttggaagctaccctacacgattccttatacacagaaacttttatctacatatatatgcaaatatagtattattgagagcataaatccaataaaatatttggagataactaatatatagtacaatgtggtaagatgtgagtttttaaaatgactttacagatttttttcaacaaatttcttacgttgctcaatatgtggatgacaattttgtatattattttcaaggccactttcatggtaatagtctggaggaaagagagaatgtaataaaatattcctaatctggggtctaaatgcaaaatcatcctttgcctttctacttccataaaaactaaagacattctgaaaaaagcaatgtgacttttgatgcagacaggtcctataatgacactttgaaatacatgagacttttcataccgtgctatttttctgtcattccttattcactggcagtcatatactctgtgattgtccacagcctggtaataaggggaaaatactgactttcagactgagactagactactatagttatggtctagagatgacatctttcacattcagaaactacgatatggcactatttaattttgaatcagttgcaagcagcactttggcattttgttttatgcccgtaggtaataagcccaagacaggaggtgagaacagaagggtatttgcatccagatggtatctttcttttcttttcttcttctttttttttcccccaagcagcagtttacttttaacaatataaatggtctgacacattggtgctttgacccaacttcattataacaactggctaagaaaaagtaaggagcattcaatcctttattcagttttattcagttaacagttatgcacagtggtttgtggcagctgctggagtagatattgaggccatataagcctcctttacaaatggcagactgcttctcctcttgcaacatttcctgtcgaaaaacattcagatttatctaacactctcatttcataaatcacatttttccaacattgctcatgttgacagatttatttcctctttaattattggttattttgaaaatgtgtatccagattacatatcactgtttcctcctttgccttttattttcctttgtttttcaaattgagtgcagaagtaacatactcccactcctcattttatgcaatactgtcaacacccatcattatttccccttttacctataatctctaattattttcctctctactcaatagatactctaatttatttactacatggctgttcaaaatatatagtgtagtttattttgtgtataaaatgtgtttatttctatgaaaatcctatttttaacactagttgttgagatcattcaataatgttttaagcacaattaacttagagcttttaatgttatgtagatattgtgaaaaatctctaccttattttatttctatatttacctgttggtggaccccgatggcttctcattgcctgctatcaaaaatgatgctgaacattttgctacatccccttctgctatttttttctggtccacatacatataggaattattaataaatcatgggaaatgtatattctttgtctcactgagtactgcctgatctgcaagacagcactgcctgctttgattcttagcagcaatgcattgaggatttttatacattgccattcttccatgggatgtgatatattttttttctttctaatccatgccaaacctctctaggtaaactgctatatcattgcttttatttactatttatctgaccacttgagagatgctatgcgttatcatattgtcattcaccacttaagttttccttatataaattccctttttgtaccatttgcatctaaaagtattagatttattgtcattttctcattggtttgcataagttcttggtatattttagtttattatcatttgctcattttgatattatacatgtttttccacttgtcaatcgtttataatctttgcccatggtgttcttcattgaagaataacttaaaattcatatagtcaagtctaacacataaaatatatagttcttctgaaacttatttaagaagttcctccccaccccaaatgtcacaaaataattcttctacattccttccatagctctcatgtttcatctatcagatttgtttttatatccatttgattttcatcactttctatggtaaaatgtacatatataatgttgacattttaagtaataagcaattttttatctctatattgtaaacagcatgcccttttcacttttgtcatatatgttattacagtgatatatgctttagattacagggtacatccctttttgattttttattcaagctggacttacctacttacagattttatactttattatacattttaaaaatgcatttattgtctcaaaaacatacattttcttagttccttctgttccacttttgtccatttcactaatagttaattactttagttaaataatttttgtattgtattacaaaatattttctgcattttgctttattcattgaacaatgccttcagtccctctaaactcagtcaactaacaaaggtttgatgtatcatctcatttacatattggttgatttaatctgctaacatattgtgtacagttttgttcattgatttccatgatgcaaacttttagttaattttgtttattatagtgtttgtctcaggttttggcaactacttgtaaaacaaatctgggattgtttcacaattactattctcttgaaaagtttaaggttaatgttaagtcttcttaaacatttggaataattcaccataaaatctatttgggaaggttagaaataatggatatactttaaaaataggaaataggtttttatcttaaggcttaacagggattgttccacttattttgtccattttgtttttccaaaaatttagtcattttatttaaatgtcaaatttattgggataaggctgttaataaaatcatattatcaccttttctctgtatgattatattgatttccttgttttgatacctgatactgctgttctgtatttttctctattatttcttcaccaatactgaaaatatgttatcaaatgcattaatctttccaagaacctatttctgtctttgttatttttctctatttctgattttctttctacatttttgaaatttgataaactttgtactttcatgcatcttgagttggaaactttgatcatttttatcatatttttatatcaataaatgccactagagtcttcgaaatcaatgatgaataaatgagtctttgtctctgtattagtctgctgtcatctggagaacagactaataaccaaaataccagagactggatatttcataaagaaaaacagtttaatggactcacatttctgcattgctgggaagcctcaggaaacttacaatcagagcagaaggtgaagcaggagcaaaggcccatcatacatggtggcaagaaggagagcatgtgtaagcacaggaaaaactaccatttataaaaccatccgatcttgtaagaattcactccctatcatgagaacagcatgggggaaaccacctggattatccaatcacttccaaccaggtctctttctaaacacctgtgggttacaattcaagaaaaaatttggtgggggggacacaaagtataaccatatcattccacccctggcccctcctagatcttatatcctcacatttcaaaaccaatcatgccttccccaacggtccccccaaaatcttaaatcatttcagcattcacacaaactccatagtcaaaagtcccatctgagacaagacaagttttcaaaactaaccatgccttcccaacaattccctgaagtgttaactcattccagtattaactgaagagttcacagagtaaagacaaggcaagtcccttctacttatcagcctgtaatatcaaaggcaagttaattacttcttagatacaatgaggataaaggcacaaaaccttttttccctcctaggcctctgggcctgtgatgggaggggctgtcatgaggtctgtaacataccctggagacattttccccaacgtcttggaagttaacatttgggctcttcattacttatgcaaatttccacagagggcttaaattttcccccagaaaatgggtttttcttttctactgcattgtcaggctgcatattttccaaactttaatgctctgctttctcctgaacactttgccacttagaaatttcttacgccagatgccccaaatcatctttctcatgttcgaagttccacagatcttcgggacaggggccaaatgctgctagtctctttgctaaagtatagcaaaagtcacctttgctccagtttccaagaagtttctcatcatcacttgagactacctcagcctggaattcattatccatatcactattagcattttggtcaaagccatttgacatgtctctaggaagttccaaacatccccacatcttcctgtcttcttctgagccctccaaactgttccaaactctttgcctgttagttccaaggtcgcttccacattttgagctctctctatagcagcaccccactctctgtagtaccaatttactttatcagtccattctcttgctgccatgaagaatacccaaaactaggcatgttataaagaataagggtttaatggactcacagttatgcatttctggggaggcctcaggaaacttataatcatggcagaaggcgaaagaggaggaaaggtacatcttccatgatggtaggtgggagagcatgtgtaagcacaggaaaaactaccatttataaagccatcagttctcatgagaattcactccctatcacgggaatatcaaggggaaaccacccccataaaccagtcagttaccaccaggtctctccctaaacacttggggactgcaattcaaaatgagatatgggtcgagacacactaatcatgtcattccctctccttagcatgcttattattttttgggaaagaatgtcacttaataatgcttgcccaccagagcaagaaaagtctgatctctaactacaatgaatggaatgataaatccctgaaactgatctcacttacaaatataataggtggtagggatgttactgggagttttatatctattttaatttattcacaaaacagaaaggtagaattatataattgtcaaggtatttaaatttttgaaaaggtaagtaattttcccagtgtaacattttttttaaatgtgtacactgggttttggacatgagtgtgcttctaaatggttctttcaatttaattatgcaatatttgcattgatgacatatattgtcttcaagaatatatgtgagtgtatttcaataaaatggcttttaattgcatgttataattcatatgttctaactgcatttcattaatcttgtctgggcatcatacagctgttttctaagaaaagatatttagaagagattcatattagcggtaagagaaaaaaatgcagccagatattggaaaatggcatacattatccgttagatagactaagggttttacggcatcagcaattagatgaaataagtacatgaattaattagtgaacttataattaatcagcttaagaccttagtcctccatactaaaacttcaacttgaccatatgagacattttatttctttagtacactcttggagggacgttgtacattaaatagaacagtgctcacaatgccaagcagagctttgcattataaggcagagagttttttgaaagagcactccagtaaaccagtgaataataagagacattgcattccttatgatggtaaagtgaacagatacatcctaagtctgcagatcctggtttgtttctgtcttctgagcactgtgttggctgctacaaaatgcagcaccatgtttgtaatgtgataaactcaagtggccaaaaaacatctggtatacaattgcagcaaaaaaaagttacatatacttgttgcaagaggggaaatcaaacaccatagaaaactatgggaagtcaatataagagtacattacaatgggcttttaactaggactgtgctgtctttctgataggggttaaggaagcaggtacatctgtcctggattgtctgctgtcagaaaacagaggcaaatgtaaatgtgtgtgtgtgtgtgtgtgtgtgtgtgtgtgtattacatttacctgaaacaatattttcttattaaatatagtacaaatatgaaaattgggaaattaacacctatagtgatattatataatgtacaaatcttatttgtattttatcagttgtttcaagaatgtcctttataacaaaagcaaactcaaaatcagatccagaatccaatccaatccaatctatgatcatacattgcatttaattgccatgtctctcctttgactctcagtctggaaccttttttgtcttcatgaccttaacattttagagagtaaatattagctattttgtagaacagtcctcaatttgagcttctctgatatatcctcataataaaggctttttttggtctttatcaggaatgccaggaattcagactgtgcccttcccagtgcatcatagctagaggcactcaatggcagtttatcccattaatgaggttaactttttcattcgtagaaggcagcatctcccaggtttctctactgtaatattattttattcattgtaatttataagtattttatggaaaagtcgtttgggaatatgaaaataccctgtttctcaacaaacattaacaaacattattaacatattaatgattgttcttttaattaagtaatcaagtatgttacaaaaagtaatgatttttctaacaccattttttcttctgcatttacttcttgctattctactataaatacaattttttcctctcttactgcttaaattgcccaattaattaaatattaagtaattacatgattatttagaatataaaggacttagcatataattaggcaatcaactagtgagagaaaaatcaaatcacaaattattaagtaattaatttctatttctacaggctaatgacgtctattaaatgggttaaaatccatttactgttaatatttattctgatgatggaaatatcccacatctggttcctgtgtcttttcaagatgtaccaattcactctttaaagatctacttacttctgattcttattatgctggagctctgtggatgtagtggtaagatgaaggggtaagatgtaggggaggatatgaggtgactagtttgacacaaaggagaagaaaggagagttttaaataggaaagactaaattggtatagcaatacaaacttctcagttctctgtaagttaaaagaataatagagtacagtactcaaagacaactttcatcacatggctattaaatataggaaattgttggcttggtcagccatcttatattccttcatgtaaacagcctgtagtatattgctttagttgattcattaatattttcataaatataacaactattgaatatcagatactatgccaagcacaacacggtaatttatttatttcaagtttctgaaacaaattggttatatgaaattgactaaactctaaatatgaaaagtgtgttgtaatccaatcacagtaacacaactggtaaacagatttgatacctaaatctttatattcttactcaagttctcttttcagcactagtgttaagtattttctatttatattcatatatttatattgaaagaattaaattttagtttttaatatttatgtggttaatgaaaagcatcttggaagctattaagcatactagttacacagcgagacttgatttttttctgtctaatgagtaagcaggatctagctcaaaggttagcatatattatccactgaataagtatacataaaatcactacaatcattaataaaactcatagtttttggtaaaaatttaaattgattaatacaatggcagcttgcatttttcttactgactgtgtaatacaaatgcaataaggaagccccacagaatgtggaatttcacagtgcatgtctaaatatttttgccacctgcagtcacgaatatatcattctatggagattataaatgaaacacacaaatgaataagttagcattgaaaaaagatgcataatttttaccctataaaagccaataaaattatttttattgttcttttgtttcatatattttaaatattcacaaaatagcaaaattcctcccagatggtaaacaccttcaggaaatctctgggttttattaaatttggaatttaaagtaaactctgccttcaaagaatccagatgtccaaaaaagcttataatttgccataacattcttatgggacaattagtgactcagtctcctgaataagatatcagaaataagtattattagaatcattaaaaaatctttgtgtatgcaagccagttcagttaaatgacaacattttctggtattagagttcagttaagtgataacattttccggtattagcaataacctttgctgtaacaatgactttaaatctgtttcttatgactatatccattaaaataaaacactctaaatttctaaatacccacactaattttatcctaaatttcgtatgtaaatataaaaaaaagtgtttctatatttttggggcattctaagatgatctctgaattgaactttcagtcatctttccccaggggtaaagaaagaattcctctgagagtctactcattctgaccctggccctattaattaatcaatcaaaaatcaatcagttaaccagccagtcatttactcagttagctaggaagtcagtaacctggaggttatgcactgccaactataaattcataatagtgacaggtttagggtgacaaataaaaattaggaaacgttatctttacattatttgttgtacacatgtataaataagatgtacatatggagaagaaaaaagagctaaatttatagaataatctttatatgccttgagggttaaagaagatggagatcaatataggctggaataaactagagatcaatatgggctgacataaactggagaactagagaagaaaacaaaagctaaatttatagagtaatctttatatgccatgaagattcaaagaagatatagatcaatatggactagaataaactagagaaaattaatggaaatggagaaactctaaggaattgaaaggattttaggatatacaataagaaaggaaataagattacaatgactaggttttagatcctaagggtagtactcatggaactctctcacagtaagtaggtccaatattaacattgagaattatatgaagactaaatttgcgaaacagaagtctcttagtaacgaccttgtgctataggttgaaggttttatggagaatgtgtatacccaaccaacagtaactattataaagaaacatcagaaaaataattccatcattcattcttttgttgaacaaattctgagtatttattctgtgccagataatcttctatgttctcaagacagagaagtgagcatgagaggatttctgtggcttcacagaacttacattttggtgaggtgagaaagaaatctcaagtaaattatatagtatatgggctggtaaaaagggccatgaataacagaaagtggacaaagggtaggaagtacaggtgggttaagtgcaattttaagcagatttgtaggagcagcctcactgaatagatagcattttgaacaaataactgaagagggcaagggagtgactcctgtagaattttggagatatctggagaaaacacagtaaggcagataagaaatgcgaagactcagatacagcagcctgcttggagtatccgagtaatagcaaggaaaccagtgggaaatgagccaagagagtgaggcacaaggagaaacaaatgagacccgtgaggtgatgagacgtgttgtagagaagcagtagcagttcacgagggacttagtagttaattgtaaaggtttttacttttatgctaatgaaataaaaagccactgtaagattttgagcatagatgtgacattatgatattatctgacttataataaagacagtagtcactgctactgacccaagtattgataataacctgctttagattgcaaagaacagaaggagaagatcagtcaagaggcttttgcaataatctagaggaaagaaaatgaggctaggaaaaggatggtagcaactgatttaataagaaatcatattctagaggttagtacttgctgattgagtgcatgaggttaagcaagaaagagtggggtggctcccagattttgagccttagcaactggcaaaagaccgttggcattcactaaatggaaaagatttactggaacatcgatgcataattaacagtttcattttggacatgttaaatctgaaatatggatatgatccctaagtggttgagaccaacttggatatataattctaaaattcaaaagagagatatgggctagtgataatcatttgtgactactcaccataaatggcattttaaggaatgaaatccatgatattcagagaagacaataaaaataagtgagctctcaagactcctcacccaagtctctacaaaattattaggttcaatcaggtagaactagtgatggaagactagaggtagaaattaaacaaagtatagtaccctaaaaaacaaaatcaaaaacaattttgaaggaaagaatgaagaactgaggactatatctggtgaatttgcagtcactaaatgatttgaaaaaatcaattttggtggaatgctgggggcaaaagatagaacaaaaggcataaagaaagattgagatgagaggaattgtaaacggtaggtttacggaaatctttcaagaccttttcgtatgaatgatagcagagaactggaatgaaaactggagataagaaagctgattctagatctctgagaaatagccacacctggacttaatatctagttgatggttgatgggtgcagcaatccaccatggcacacgtttacctatgtaacaaacctacacatcctgcacatgtgccccggaacttaaaataaaaataaaaaaatacacagatatattaacgattttaaaaaagaaaattgatgacacatgagaagatggagacttgctagtttaaagttctcaagtaaggtaagaaacacaaagcctaggtgcaatggctcacacctataatcccggcactttggaaggccgaggcaggccaatcacttgagtccaggagtcagagatcagcctggacaacatggcaaaacactgtctctacacaagtatacaaaaattagctgggcgtggtggtgcctgcctgtagtcccaactcttcaggaggctgagatgggaggataacctgtgcccaggaggtcaccagtatgggtgacagagagaccctgtctcaaaaagaaagaaaaaaagatgatttggtacataggtagatagttttttaggaacaaaagggaaaacacatatgaaagttgatttataaatatggtagtaagaatttgatgtaattcttaactaattgaatttttttttccagtgaaataagaatggtcatcttctgtgaatgagactaaaagaagatgttaggtgaataaagagagaaaagtataaaagagtcatttggttgagaagaatgtattacacagttgaacacgaaaagcctatttaggactgatggccataaatacatagggaggccagaccacatactgccatgttttccttcagataagctcattggcttgggagtagaggtgcagtagtcagataattggtctttttctaatggagaacttggaaacgagagaaggataaggcaattgagggtgtatgaatgaaccatataatttaagccaggaatggatgtggaaaaacattatggagtcctgagggctgaaaatataactaaagggtacatcctgatgaagtctaagcattgttcaaatttcagaatgagagggagatagcagcaaagtaggagatggaaatcaataaaggggatgattgcagtagagattatgtaaggtttcaggttttggcaatgggacaagttctaggtatgactatgtggatgaagcactgagtttggtttaaagagaaagtcactgcagaagagctgagggaattgagaggccagaaaagggggacaatcagatagatagatagacagacagacagacagacagacagacagacagatagatatttggcatggattgtgataagaagtgcaatgaaaaaagtatgatatttaatgctgaaagctacaattcacaatggagatataacagttgtgcactgaataatacggtagctgtttttaaagcaagaaactattggaaatgcaaagagaaataggtagaaacacattaacaaggagatattttaacacaccactctgagtataagaaaggtcaagtggccaaaaatatatgtgagaataaagaaggcctaaatcccatgatcaagaacataattattaggaaggttgactaactacctatttatctatttagatctttataatatattaggtcacaaagaaagcataagtagcataaagtcgaataattaaaataaaactctctgattgcaatgtaataatatttaaaattaataacagaatttttaaaagacttcaacatggaaattttaaaaaaatcctattaaacaatacctggatttatggctgaaacagaacatatatatgaaagttacacaactgtggaaaataacacctcatacccaaacatatgggaaacatttaaagcactgagcaaaataaagtttatagccttcagtatgtttagtacttaaacagaaacaatgaaaatgaataaattaaattcccaaattaaaatcagaagcagaacaataaataaaccaatggaatccaaaacaaaggaaataagataaaagcagaaattatgagatagaaaacagaaaattgaaagcttaaattatcatatcaaaatgctggtccctgaaaaatttaatactgcatacaaactataacttaatgtattcaggtgagaaaaaagcataaataagtacaatgatacaaaacgtaaaactacaatggaaagccaggcgaggtggctcatgccggtaatcccagcactttgggaggccgaggcgggtggatcacaaggtctggagttcgagaccagactggccaagatggtgaaactccatctctactaaaaataaaaaattagccgggcatggtggcggccgcctgtagacccagctacacaggaggctgaggcaggagaattccttgaacctggcaggcggaggttgcagtgagccgagatcgtgccactgcactctagcctgggcaacagagcgggactcaatctcaaaaaaataaaataaaataaaaaataaaataaaaaaaatacaatggaaaaataactattgtaacaacacaaacatacaaaatgactttattttgaacactgtatgcagagagatttgaaaggttagatgacatttaacctttatccttaaacagggaaacacagttcatgaaattaacttcttcatcagagatagaaagcttagatgaacttatacagaagaaatagactttgacaaaataatcagacccagatggtttttcaaagactctacccaaccttcaaaaaagatacttccaaatgctacataagttgttccagagcatagaagctaaaaaaaaggagagaaaattccaacttctttttagcaacaaacacataatatgaatatctaattcagataaaggtgccataaaagaagaaaattaccaaacaacattacctacaaatatcatgtcaaatgtcctagataaaattttagctagcagaattcaacattacatgaaaaaatgataatacataaacaattaggatttatttatgtaatgcaatgccagttaaatattggaaaacccattaacataatataccacagtgtgataataagaaatacatatttagtctttgttcctagtttctaacacagaacttctaagccctctgaatttcctgattgatgaggtgagaggaaccccttttgttatacacaataaacccctttccgccatatctgagctcatgataagaaggtgactcttgatgggcccctatatagccccagcatagaccgggttgcaagaagaacgaacaatataattagagagttggaactttctgccatactccccaacctccagggagaagagagggacttgagattgagtaatcaccaagagccaatgatgtaatcaatcatgcttcctaatagaacttccataaaaaccctacacagtggggttcagagggcttctacattggtgaacacatggaggtttgggagggtggtgtgcatgcagaggtaccccttgccacataccttgccctatgtgtctccttcatttggctgttcctgagccacataatttataatcaactggtaataggaagtaaactgctttcctgagctatgtgagttattttataaaatcctggaacccaagaagggtatcctgagaacccttgatttttttttattatttttattttttttgtttttatttttttcttttgttattatactttaagttttagggtacatgtgcacattgtgcaggttagttacatatgtatacatgtgccatgctggtgtgctgcacccactaactcgtcatctagcattaggtatatctcccaatactatccctccccactccccccaccccacaacagtcctcagagtgtgatgttccctttcctatgtccatgtgatctcattgttcaattcccacctatgagtgagaatatgcggtgtttggttttttgttcttgcgatagtttactgagaatgatgattaccaatttcatccatgtccctacaaaggacatgaactcatcattttttatggctgcatagtattccatggtgtatatgtgccacattttcttaatccagtctatcatcgttggacattaggcttggttccaagtctttgctattgtgaatagtgccgcaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttagaaaacctaggcaataccattcaggacataggcatgggcaaggacttcatgtctaaaacaccaaaagcaatggcaacaaaagccacaattgacaaatgggatctaattaaacttaagagcttctgtacagcaaaagaaactaccatcagagtaaacaggcaacctacaaaatgggggaaaattttcacaacctactcatctgacaaagggctaatatccagaatctacaatgaactcaaacaaatttacaagaaaaaaacaaacaaccccatcaaaaagtgggcgaaggacatgagaacccttgatttatagctggttggtcacaagtataggtagcctaggatttgcgattggcatctgcagtagggacagtcttggggactgactgagcccttaacttgtgggatctgacactaactccaggtaaatagtgtcagaattaaattaattgtaagatgcccagcttgtgtcccagaattggttgatgtgggaataaactctgcacactgagtgtcagacgtgtgaggaaaaacaagtcatacatattaacagacctaaaaaaaatctttatttgacttataagagctttttacaaactcaacattgcttctttagaaaagttaaaaattaagaattaatggatgctttcttacgtaatataatacctttaagttgatcattatcccagaatcttaattaatggagaataactaaagtattttcacttatatggggaaaaaatagtatgcacactatttttactaccactgataattcttcctgaggtatcagcaaatttaagtaggaaaaaatccattagaatcttaactgcaaaagaaatattaaccaatttttatttgctgaagatattattatatacctaggaaacccaggagaatcaatgaaaatttctcaccattttaagtaacgataaaaattcaacaaggtagcaggagataaaactaacttacgtaagtcaatagccttcatagatttcacaaataataagtagatagatgatataatgatagagaaaaccccatttacaattgcagtgcacaagataatgtagttagaaataataggaaatttgcaaaacctatatgaggtaaactataaagcgctactctaagtcacaggtataatcttgggcaaatggacatagcccctgctcccaagggaaacaactcaatatcatgaagacattaaattttcttatgatcatttataaaattcatgaaatccacagaaaatatcaatagactatttttagacacagtcaaccgatactaagtttatataaataagcatgtaataataggcaaacactattatagatttaaaactacaaggattgcaggatgggagctcctaccctacaatatattgaaattatatatatatacatatatattttggagaaagagtcttactctgctgcccaggctggagtacagtggctcgatctcagcacactgcagcctccacctcccgggttcaagtgattctcctgcctcagcctccagagtagctgggattacaagagtgtgccaccacgcccgcctactttttgtatttttactagagatggggcttcaccatgttggccgggcctggtcttgaactcccgacctcaggtgatccacccacctcggcctccgaagtgctgggattacaggtgtgagccatggcacccggccaagaatgttgttttaatcttcacttctgactatattaatattgctgatcttatcagggcatttatattttatcttctgtaagccagtcatattattttagtggggcatgagaattttccccaattgatatatgcaagctttatatagtactttaacattcacatgtcaacttatttgtgaatattttttcagtctataggttttggttattatagtacagacactgtcacatccattgatgttttcctttctttcatttctttgatgctttttctttttcttaaaggcattcttcaatcaatattagataatcacctatatttttctagtgttgaatgtcatagataaacttatactctgatccatctggaatttattttgatatgcaatatgatgaaaggttatcaaaatatgttttccacgtggctagtgactgttctaaattcaatgtattttaaacactttatcaattcattttgccttttactctcatctaagaaatacaggcatcaaagttcaaataaagaattgtgcaatgtaggccaggcgtggtggctcatgcctgtaatcccagtactttgggaggccaaggcaggcacatcgtcaggtcaacaggtcgagaccaccctggccaacatggtgaatcccagtctctatgaaaaatagaaaaattagctgggcatggtggtgcgtatctgcagtcccagctactcgctacttggaaggccgaggtaggagaatcacttgaacccaggaggcggagcttgcagtgagttgagatcatgccactgcactccagcctgggcaacagagtgagagtctgtctcaaacaaacaaacaaaaaaaaaaattgtgtaattgtgtaaagtaaaaagtaaaactacctttcatgttcttaattccaatatcctgagataaccattttaaacacactatgcgtattcctaatcgttcttagcatattctttcctgcacatacagttatttccacccttaactagggtcaatttctgactcacattatcttttcatctgacttgatcataattagcaaaagtagtaaaaaaaaaatacctttgtaaaatttgataaaatttgaaccagcctaaagatacaaaggatttagatatatggatggctgtgttaattattaatggtcaagtaggaattctaatgtttttggccagaggccattacaaagcttcttgaacaaagacatatataattcaatccttagcaacagctaggaaggttcagagagagtagagttagaaagaaattctgaatataaaaacatacaaccttctacaatcagaaattattcaggtccagccatcctgatattaataatggggtgtcataaaagatgataatccatattttaccacttcctgccccctcattcccatataactccctgtcctctaagaatacttccaaaacatattaaagccccatagcagccaggcacggtgactcatgcctataatcccagtatggtgggaagctcaaccaggcagatcgcttgagcccaggagtctgagaacagcctgggcaacatgatgaaaccccggttctacaaaaaaaaaaatgaaaaattggctgggtgtagtcacgtgcacctgtagtcccagctacttgttacttgggaagctaaggtgaaagggtctcttgagcccaggaggtcgaggctgcagtgagccatgattgcgccactgccttccagcctggggaaaaaagcaagaccctgtctcaaaaaaaaaacaaaaaacaaaaaacaaacaaacaaaaaactttaataaagccctaggctttatgcacactaattcattgtttcacagtcatctttccctcaaagatgcttctatttttctgctatgatttttagctgcttcttatacttcaccagccttctcagcttatgaggagattagttccttgttggtcaaatttgttccatgtttagctttgtcatttccggagctttaccttgctaactcttgttgaaatttattgtaaagagtattcagtgaaagcggcaggaaaaatgaatacttcctctaacatttttcactacacactgatgaaagggaccacagggatgtactgtttgtggaacaaattttttctgctaaaccagtagagtttctgccaaactgacaatgaaattagatatcatcacccccttgagctcttctgtgtagctggagcagaagaggattctaactaaagaatatttacaaaacttctttacatcctagagatttcggtctgcaccagtattgattgtttgcgtaaggcccaaagcctgtgggaatgaactcagactcaaaactgaggcctcagaaatatacagacctgtctgatggtcactaacaaaaaaatttaaaaaaaaacacaataccatatcacagaacatagaccatcacctggcacagagcaggtgcaagctaaatgtgggatgattatatatgagtcagcaactccctcccctaaaactcctaaggcacataccagctcacataggacccttaaagtgatgaaaaatatgtgccacacaatcattattggggacgttcgagaatatttgagattgagggttaaagaagaacttcaaatttttgctaggtgataaggtaagtgctcagaacatcaagattaacaaatatgccacactagtgtgaatgggcaaagtattgaatacttgggtgattttaatgaaagagttttgtaatgtttgcttatggctctctcattcctttgaaaaacacaggagtaaccagtggtctttgtcagagaacaaattcaaaccaaactgctagactcttgtactccaatggttactgacctccagtaactaaagctttggtactaggtatagttaatcatacctagttatttcttctcttagaatcacttctctcccgcaaaaagctgctctgtcccctgagagaaaacatatgtggaagcatgccaccacttcacacgcctagatacagcccaatagagatacagctcatgttttgttcccaaaattgtccccaatcataagaagaatggcatctgttgggtctggcccagccattcaccaaatacaaagtctgcagtagatatcagaaggctatgctataaatcaagctgaagttcctgttctatatgaaccatttcaaaactagttatataaaaccaattaatgtgaataattaattaaaatgtcaagaatacaaagctctgattttgaagaaatactgataagagacattttgctaaattatcattcaataaacacacatcgaatttctatgctgattttatcactacttaacgaagtttataattatgggaaagaagtctaatgatggagtgaccatatgtcccaatttgccctgtatataatctcaggttacatatgatgttccaggctaattagtttcatgcttcaaagtgtcccactctggatagcaaataacacgactagtaaaaagacatgtagcctcacaataataccaatggtagatgttaaacagcaaaaaagaacatgtgaattaaatgttaaggtgctcccaggaggtaaagatcacttcacactaacgcatttccactataattaaattttgagaagtgacaaaaaaatgtgctgcaggtatagagaatgttaagagcaaacactggttgggaaagagtgaaacatattcagcggaaaatggtcctctagttttagaaacaatttagtgaggttgtaagatcagggactgtacagttgaatgtaggccagaccactgaggaccttcaaaactcagcgaagaggtttgagcattatttggcaggaagagtggagaaactacagaacttacaggcattaagtaacacgctccaaatttgttttgagattttttttttaacagaatattttgaattttcttttttttctttttttaaattttattattattatattttaaattttagggtacatgtgcacaacatgtaggttacacatgtatacatgtgccatattggtgtgctgcacccattaactcgtcatttagcattaggtatgtctcctaatgctatccctcccacctcccgctaccccacaacagtccccagtgtgtgatgttccccttcctgtgtccatgtgttctcattgttcaattcccacctatgagtgagaacatgcggtgttcggttttttgtccttgcgatagtttgctgagaatgatggtttccagcttcatccatgtccctacaaaggacatgaacttatcatttttttatggctgcacagttgtttattgcggcactgctcacaatagcaaagatttggaaccaacccaaatgtcgaccaacgatagactggattaagaaaatgtggcacaaatacaccatggaatactatgttttgagaaatttaacttggaaagaggttttagaatagattgaaagataattggttgttatagggaaatattttatttaaaaaataatcctttagctatgtctaattacttgtattatgattactttatttatttatttatttcttgagacaaagtctcactctgttgcccaggctggagtgcaatggcaccatctcagctcactgaaacctccacctcctaggctcaagcaattgtcctgcctcagccaccctagtagctgggattacaggcatatgccaccatacccggctaatttttgtagagacgaggttttgccatgttggccgggctggtcttgaactcctggtctcaagtgatccgcccgccttggcttcccagagtgctagggttacaagcgtgagatactgcacccagcctccttgtattatttttaattggcaattcttatttgtaagtcccagttgagcaaaattaattaaagcagtcctaactgaaaatgttacgtcagaggacttgtgctggcaaaaacacctttataaagactcctgaatcttgcttggggaatgaagatagcaagaactaatatatcccatagttttcatgatgaagaagctatgtagagttgagtttagtgatgtgctgatagatgattaacaactgtgtgtaggaattggggtgactggtttgtatcgtttggtgattttcctgtaaatgctctcacgataggggatttcaagctctcttcatagattagtgaacatggagttgagagagatgcgcacaggtggactcatgaactggtgtgaaccagctccagtacactattaagagaatcctcccaagtagaccaaggaggcaatttctagttgtaagttaactaagaagccccttttgaggaatatgcaaggtgtgtgtaaataaaataaaacactctaggatacatgccactagggtcaagcaattaaaaccattaattctagggtagtagtggaaaagtatattataatgatgccctcactggccacttagtctaccaggtggttgtgctatggtccacaccatacctttcaaaatgcaccaagctgcccaggctatcgatagaatgaagttagaaaacacaacaaagtgggtccatgaacgaaaccaaggctaagtcattctgactttgagtgtagagataatagtccatggggtcttggtacagtgattttgtaacttatactatgaggtaaatcaaaacttttatttactttaaaagtaatacattaaagaaagaaaaaagaacagagaacaaccaaccaaacaaaaacaaaaaaacaaaatccaggaagaatgttaaggaaacctaaaatgcatgtttaataacaaatcgaatacactcactccttagtatctgacagggattggttctaggatcctccagaatatcaaaattcacagatgttcaatcctttatgtaaaatggcatagtatttgcaaataacctacacatatcctctcctatactttaaatcatctctagattacttataataccaaatacaatgtaaatactatgtaaatcgctgttatactctacttttaatgtctattattctttattgtttattgtggggttttgtttttattttctaaatattttttccaaatatattcagtcttcggttggttgaatatataaatgcagaatccacaaatacagaggcccaaccatattacacttgcatttctcaggaaagtgaagggagaacatggagtcaaatcaacacttattgaaggttgaatgcctgatataattgcacctgctatgataaattttgtttaaaacttcagtatcaatgataaaaatcttttgactgcatcatggtaaaaaaaaaaaaaacattcttagtaattgaaaagtctatgaaagagaaatacacataaaactggttgtggtccacacaaaattaatattttaatccaaaaagctctgaagttctagaaagcggattagaagctgtggctgcaacagttgtatatttgtacaaatctgatactgaacacacataaaaatatacttgctccagcagttcacattttctttctttttctctaatcatcaaacagtttttagaaatgtttcaggcactgtaaagtggtttgtaactcaacttctatgttgtatattttcaaaaactttgtaaaataaattatttctctaaatttggtttacattttgttcaaaagcaattataaagctttaatcattattatagaaatgggctgccagaagttcatatttcaaaaatcttaattacaaatcttaaaaaccaagcttagaaacagaatactaaaatcaatgcctatacatgcaagacagaattagacaagaaaaattcaagttgtgtgtatattttaatattaaaattctataatggtattttggagtatcttgaattctagttagcatattttgatgaatcttgtattttgaattaagttcatattgtttaataatagaataaaatggcgaaggctagaatttcatagaatctagttttgttgaaagatttgatgtttgccaaagtaaagtacttactgaggaaggctatgctgaatggagttaaaaatgtgaaaacacatttatgtttgtttgcttttttatagagacagggtctcactctttggctcaggctgaaatgcagttgttcaatcataactcctggcctcaagtgatcctcctgcctcagcctcctgagtagctaggactacatgtgtgcaccatcacacacgactaacctttaaatttgtttttcggaaatacagtgtcttgctctgttgcccagactggcctcgaactcttggcctcaagaaatcctcccatcctggtctcccaaagcactgagattacaggtgtgagccacaatgccaagtcacatgtatgtttctgaacaaaaaactaaaattaaaaatatccactatgtagtataatttaaatttacctcttgtcaaaaacctttacttgtcaaaaatattactatattcagaatcagtttaaagtgttcacattcattcactgtaattacaatttgaagatcattgctggtaattttattttaaatgttgcaagagttattattctgcttttaaggtttttaaatattaagacaataaagatgtgatattttgctttattttaaatgaatatttgcaatttttatatttttggatggcactttaaaaacacttttctgaataaaaatattttatatgttgaggagcacaaaaagtacattaatcaattaatacatattttaaaaatatataattttattattgttatttaccaattactcccattaaggttctatttaggttacaatgagttttagtcttcatctggtctttgcatttttagctatttaacacaaagatcattctagaatacaaataataaatgtatcaaaaccctgaaatgagagataatgaggatagaagagagagaagtggaatgaaagaaatggaaagatgaaagtggcttaccaaatgtagaatctgtagaaccttgtgattaatcatacacaatataaaattgtaagaaaaacacacaaggtgactgtgcagtatggtctttagtaggagtaagatattcaggaaaaggaacaatttgatgtaaaatggtaaatttgaagtgaaatgcattattaagcaactggaagtttggtcctagagatgaaaagaataaaacatatcatttaaaatatatattgcctgatacgaaaaaaagttaaaaaaatcctaatttccaaggacaaaaagagatcaaagacaaaatttcaaaaataaaatatcacagttgcagccatgtggaacaggaaatgaagatataggtgctgaggcctaggagctgggcatctggcacacccagagaaaagagaattggtcaacaatgcctgtgactcaaaacactttgctataagaatgaaaaaaagagagagagacagattaggagaatattttttctgttggcctggaaaatggtgagagattataccatctatctgatgattttaattttaaaataaatatgcacatacactatgagaaataaaattcactggtctcagcaacgaatgagtaaaatatcagaatttttatggtacgagaacttcaacctgaaaaataaatgttgaaaccaggccaggaaaataaaagccctatagttcagatagaataaactccaattttagctttccaaagtcaaagaatgggtggcaaatccttgaagatgaacaagcaatgatggagttattaatgatgtaacagtctgtacaacaaacctccatgatgcaagtttactatgtaaaaaacctgcatatgtactcctgaacttaaaataaaagctcaaaaattaataaaaaagaaaaaaaaaaagaaaatgaagcactgtgaaagagattgaggttatttgaaaaacaaaggaattagcattaaagatacctcaaataaaatactttaaaattatctgaataacattgtacaataaatatcttttaaaatctatttcacagacaagaaaaaagcataatataaataaaagacactatgagatataaagtaggagacattcaaaaccaccaattttaatttttagatatgaaaaatagattcattcatagaagaaaactcagtggatcagctatgtggcagattaaatactgttgaggtgagtattagaataccggacaatatacttggagaaatcactgacaatgtagtacagagatatagagacatattaatataaatgaaaaggcaaaacgactgagagtataatttgaaaagtttccagtaagagtgtaggagaaaatagaagaaaagtaatattttatcaataacatgtaagaatttttcagaaataaagaaaaatataagtactcagattaaaaaagtaaatcatgttcaaagtagaaaataatataagcatactgaaagtagacatcatgctgaaactgctaaacatgaaagacaaagagaaaatcacaaactaacctgacaggaaaaaaaaaaaaaataggctaacaaaagtcatgataatcacaaacaaaagacttttgtaatgcctaaaacaacggaatgtatcaaacctgaaactctaatcagggtgaaaaataaagatcgtcttagacaaaagcttagagaatttgtctttatagactcttgtagaaaattagtacttaagaatatgttttagtaagaagaaaaatatgcccaagaagtgttaagcggcaagaggaaatgagaatgaagaaactcgcaaagagcaaacatctggctaaaactgagcaagtatttttcaatttaaaaaaaataactatgactaatatttgagaatgtgtttgttattgttgtctagtgtcttagttttctcaaaattgatctgcctaaagccatatgaaactaattgtaaagcactgaccaagggtatcagaacttctcacagtatgaagtaaatgacaagttaaaaacggtgtgagtattgagaaacgaagacgggggatttttgtaagtaggggtttacagttattttcttcctgcaagactgaagaaaaaaacaaaatgagttatccgtttgtagaactttaaaataactttgatgataaatagactatgaattttattgccattaaataaaaattccattcccaggacatctatttatttaggacatagaatttgtagccataaaagcaaatcatattaataaaattgatgctgatttttattttattctagcaataagtaataatcatccttggatacatggcatatagaaagggcaataacatgttctcattaaaatttgtttctaataaaatattattttgtttaataatttcatattaaaatacgtactatatttacattgctttaatcaactgtgttctaataattgtaataataaatcagttcataagaaaaaatcatgtttagagcactaatggtgacaaatattagtaatttaaaaattaaatttgcatatatatgtagataaataaaagacttttaaacacagaggataaattccataaggaacatgaaatttacatgaaagttcaaataaaagaaacactgaaaaattctgatttaaaatttttttaaaaacaatagatcatggtaagcattgaaacagtatggcatgtagattttactatatacatataaaataagattgcagtcattttaggttgacacaaagtgcaccttttgaagttatttaaattatatgaaaatatttagatgctgacttaataatattctaagtatgcataatttttcacaatttcattggcagtatattagcaaaatatctggtgagcaatattctaaagcgtgtatatttttctagaagattatagagatattgattaactttaaatattttaaaagtatttttaaaatagtaaaatgtccaactttgacaccactcatgagaaatcagagaaataaagtttacacgttcatttaagaaggaagaataggttggggggatatccaatgaaaaagcatagcaaataaaataaacttctgacctacttccagattcagaaaactaaataaaacataacattaagtgactcctatctcaaacacaactccatagtaagtctctagggctaaagcaaccaacccaattacatatgtccttaattaaggctctaggggtgatctgaaaatggattgatgtaatgccaggtttgagaatggaaaaagtaagactggccaaacaaaatgatcttctgtcatcatcaatgaaaacatttattcccaaataggttcagtcttctgacagttaaaacttctttaacttggatttttttttccttcttataaaagttgtatacaattattacacatataaacaataagaacaaagaaacaaagaaaaaattcatgcataaagataaagtcattgttaagactttggtctatgttgtatacctatatactaagagattccatatgtatcaaaaaagattaatgttgtaacccagattttgtattccggcccataaggactactgatatttttcaggcagggagtactatgttcaggggcagaagtaggaagtgtggctagaggagaagccatattattggacaaggcaccagttaggaaatcagcccagtattgcatagatgggtatgaattaatgcattaaaaggcagagaaaacattattatgtgatcgcttggatttagggatatagtgacgaacgggagtgttttagtttgttctaatattactataaagaaatacacaagactgggtaatttataaagaaaagcaatttaattggctcacatttcttcaggttgtacaggaagcatagcagcttctggggaggtttcaggaagctttcaatggtggagctttgcaactggttgtttttaagttgtttaaatgctcctgccatgtcctgctcctgccacatcctctttagaaaattcactattgcaaggacagtacaaacggggagattcacacccatgctctcataacctcccaacaagccccatctccagcaatggggattacaatgtgacatgagatttgagtatggacacagatccaaactatagcaaggggagatggagaaagcttaaatgatccccaggtttctgtctttatttaatctcttaaatataatatttcagataaatcacaaaaaaaattatcagttattttaattcaataatagctacactttaatgcatagcttgttctctttactcacacttcattctattttctcatattagaaccaattttctactcaaagtttactgctgaaattttttctcatattgtagctaaactaaaataggtggccttctagcttttagatggtatgaaaaattgattctcaaatttagtaagattctctagatagcatagctagttttaatcatcactgaactgaggagcccatggtaatcaaaatgatatgaatgagtttaaggctggttattgccaaattaagacaagagtagaaatacggtatttgctgatgtggaaaattggaatgcccagagataacaaagcagattgtactatattcatttcagatataggggtccatgtacatacaccttagaacagtcctgctttgcacactggtaccaggtctatttttattcattttataacataggcagataaactatggttacttgaaatacatgaataaatgaatactatatccatataaaaacagaacaattatttttggacttagcaaattataataaaactatatgtgatttaataatatgcatatttatcattaatttttctttggctaatacatgcatatttaagacttttaacttgaaaatatcaaattctaagtgagatttgcacatgagctgtagtttgtatttgttatctttatgttctaataaaatattaaaataaagttagagtttatatttttacccttttaaatagaaaactgttagcttactttttattacactttgtacttaattaatttttataattttcaggagatagaactcaaactgtactggtaataccctcagtaattattccaggtagtgatttctgtgggagccatatgaaaggcacgtataaagaagtgcctatgaattatcctttaaaaaatatatctatgttttctgaagtccaatatgcttgtctgatacgtataaaggataaagtagtgcgatattgatataagagttaagaagaaatcactttggcagatagtaaatatatgggagtcctcagtaaggcttttctctttaatgaaaaccagccccaatcattttctaacaaaaagcagcctgtgaagtccagctgcagacatagacaagcaggctgggagcttacacagatgaatgccagcaggaactaggactagacatgttcaagatggcgactccatcttcccttgtcaaccacatgtactataaagagcagacaaaatggcgctgatcaactggaaagccaatttacataataagattacggtggggcgaccaaccttccccactcactatgtaaatgtcaaacttgatctaaccaacctgtgagccctatgtaaatcagacactgcctcctcaaactagcatagaaatttcggtgcattcaccatcagctggtcctttccactgagagacctttttctccatagagaaagctgtttctctttctcctctcttctgcttattaaacctctgttgctcaattcctcctgtgcccatgttctaaattttcctgacatgtgacaacaaaccccagggtatacaccctagacaacccagccgcttcaatatcctatatttataaacaaaagcaaataatccctgtgctcaataaatgcattgacttacagattctaatgaactctgaacattctacaaagcgcagcatcttgggagagaattttctattgccacctttccataaattagctttcaaatttctgaccatattttaaaatatatattcatttctcagctttgtgctttgatatgtgtactttaaagaagcaccttttcttgaaagtaactgttaatatatccttaaatgatgagttttatttaaaacattttatgttcgcaggaaaacagatgtagcatacaaatgactactgctgtgtcctgaactacttcatgcactgccctaccgccccccacctttttttttttttttttttttttttgagatttagtctcactctgttgcccaggctggagtgcagtggcatgatctcggctcactgcaacctctgcctcccaggtttaagtgattctcctgcctcagcctcctgagtagctgggactacaggcatgcgccaccacacccagctaatttttgtgtttctaacagagactgggtttcaccatgttggccaggatggtctcgatctcctgacctcgtgatccacccgcctcggcctttcaaagtgctgggattacaggcatgagccaccgtgcccagcccacttccctaccttctacagcctcaaaatgcatactgacatctaagaaacactttttaatgatgacacatgtacatcttgagacaaagtttgattcctgagatcatggttggttttacgagccttttctagcattctcattcatgcattcattcagcaaattcatgttaactgctgatcctgtcatagacagtaatccgtgggtgaaatgaaatgacaaaggcctaaactaccactgtggtagtaaagataaagtggaaataattggaaataaagaaagaatcaggattgtattttcagcgattgggtggaagtactaattgacaaaaaatcatgaaggtaaaaaaaggctaaataatgaacatattgtgtctaagttgcctgttggaaaatgttggaaccattcatgcttccaagcattatgtcagtgcatgggtgatattgtgcagatatcaagaacacaattgtctgactacttggatttgtatctagatttccattacttactagatggtgacatggacacgttccttaatcacttgggaactttgtttcctaaattgtaaaactgatgtagtgataatatctacctcagacaattctgaagattaaatcaaattaaataggcaaagtacttaaaactctaaggaacatagaatgtgctcagtaaatactctataattattctgttcttagcttttctctcatcatctagataatatctctgacttcttttatgtactgtaaaatgtttccaataccacttggtgattcaaaaatctctatattaaacatagcctttgcccttgaaaattcagatgcatgtattcaactagaagttactattgtggtaataaagaaataaaagagtaggattctgaaacagaatagaattcagtgtttatcagtcaagttagcagaagaaaaaacatgacataggaagtatagcatatttaacaggaaggatttaaaaagagactattgcaaagacaggacactttacaaagggtgggttcccatataatcagcaatggcagaatacacttgggctaataacaacagagtccaaaggtccaaatggactaggtgaaggtacggctactctaaacaagaaagaaagatagaaggtgtaatattgaaaggagtattgattttcaattataagatacagccagtcagaagtgaccccacaaaaagttaccctgggaatcaatactctaaaataccctgacccattttccaaacttcctcacataacctaggtgggctacttgttgaatgaacataaccagacatcagatggcaaaggagctcagagcaagtatcaggatataaaatcgatctgcaggggcaacccaaagttatctggcacataatgcctaaatgagtggcttccaatacatgtggaatcactacttaaagttactgcaaaaagtatctgttcgcttctcaataaattctgatgcctttgtagcagaggacaatttcagtttcaagaggatcaaactaagagttaaagtgaagtcatcatttacatctaatgtatcctcactgtatgtgcgtttatgatcggagagagggtacgtacaaaagaaatcatttttaaatgtaagaccaaggtatgggtaccatttgctccctcttcttggcaatacttagctctgccatctcatgttctcataccttgtcagtattctaatactctttagatatgactgggaagattatttaagtcctcagtaaataactcttatatctgcttcttattttagttcctacgcaatatactttcaatttagtgtaaggtaaggacttaaaatgaacacattttctgagccaaaaaattgtatattcttgtaatatttccctttattgttctaacttcttattgccactaatatttgataagccctgaggaaaagggagtgataactgaacaatggttcagatgaaattcctgatacctaatcctcatggaaaatggtgagaatttgatcacttaggcgtgaaggattttgtgatgttattcagctcattccctatgcctcctaatactgtcacatttattcattcacccaatattaagtacataaacatgtaaactttctctttactagggtctcggtgctagggatataatggacaagatagacaaggccacccattctaccacatattgcatctagacaacctggtagctaatataacgactgattattaaattctcccttcaaattcttcaggggttttctgagagcaattttcatggtctactgagggcttatttttgagctcagatgaatagagttacgagatagtgagctttcagttgacgctagtcatgctgtcatttctcctatgcccaggttaagtcacaaccctaaggcacatctctaagagatcaaatagcattattgtgcatttaaaaaaagacagaggaccagattggcttattgcagggagcttaggttttaaccaatggaaatgtgctgaattgctttaagaataaattacacttctcctttataagattgttgttgaaaataaatgttcctatagcaaagttatttgaactttacaggactcaaatttatcatcttaaaatgagtaattttacctattcctctcaacgttacgtaaattttaatactggtacttaccactattctttgtgctttgctgttttctataattggaggtacaaaattctgactgacttttcacttcaccttgagagatgtttattccttattctctattgagatacattagaaatatgagatgaggctatttataatttttgtaaatttgataaaagttaaggatgttcgaatatagtatttctgatgtaaaaacaagcacgaaaattaaatttaggcaatttataattaggtctccttcccaattaaaataaatattaatgcttcttataggtattcaccatttaataattattaaagtaattgctttaatggcataatttctttttttctattttgtgcattaccataaaataattataaatcaagctgtgatagtgtccaagttacattttatgtgaaagacggaagtaactccctgttccactgtacacaaaagccagcaatattattgcatataatacatggtaaagcagtattttttattctcacaaataaagcataccattactttctccaagtcaggcagcgatgagcctaatctcatctttacaaaacacattcacagtttctcctgattcaatatgaagggcaggtgaatgtatctgagatctgaggaaatcttcccagtattgcaaaagcatactagagttccccttcatcatctgtcaccagcatcttcatccccttttagggtacatcgaaggtcttccacaaggtgcttcgtctaagattgtcaaccctgagcagagccatggacacttaagtttccttctttcatcaagacaaccttgccctgcatttcactcccctgagccctgctctctgattacaggcagctagacattctgatgaattcccttgaacgatggaattttcttcctctcagaatgctatttaagttaatggttcagaccatcaactcaaaggaccctttttgtgaccctcaattgacatcaactcaagggaccctttttgtgaccctcaattgacatcaagtagtctagattttccctgtctggaaaaacaaaagagtggaagggaaggacaggagcactgtgtgcctgatagacctgaattcagctaatgacaccgctgtttctcttagcttttggaaggtgggagagttattcgagcattctaaacttagttttctcagctttgaaatgagaacagtgtgacctattccttagcaacattgcttgagttacataaagctatacaccttgaaggtgtcctgattactgatagttctcactgttcaagcatcctttcctcctagatgtgaactccgtaaggttcttttcacttttgtcactaaaggcctatcttataaccatttattcataacgtggccagcctttggccaacaattatagaactttattttgttgaataaagaagctgaggcaaaattaatatagagtgtttatttggggtaaggttgaggacagctgtcctggacacacttccaagttgccttggggagtgctctgggagaacaaagaaaaggctcaagatttttattttttttaaaaactgaggaatcagaaaaggaagtaattacaaagggtgcttgtcagaaattcttcctgatttacagaaataacattatttattggatatgcattgttaaactacagagtctgagttataatgtccagcattgatgttttatggctacctggtgttggttagactagagctcacatagcaggtggctttgaggtgattatttagctcaaggtgggagtgagacatggctgctgtttcattccagtgtttctttgggcctgataatttaaaggggcttgcattcttccgttacaattttcttttctttttaaatttcaacaagtgtaaatgttccttgaaataaccttacttgaaattattaacaatttttcctaaagggaacatttctttttccaagctacagatctctcaggcctgttaagttcagaaaccaaacgtgatcattattattttgagagctgaaaagaaagtggcactcccattgtttttgctgagcagaaaggcatttcagaatttaaaatattgttgtgtatctttcatcagattattttcctgttaagtgtcagggttccttggagtcctttttattgagatttttgtataatacttattgtttgtcacaaaataatctgtgaccataattgcttagatgactagtaaatccaatttcacttcttaccagttttcatcttaccagtagaatctgacaggcctgggcatccacttgctcttcaatagtgcctgccatggatttattcagtgatgctcaatcacacttgacaggctggacttctgttttttaaaatgtctttctcatggtttgatttatttatgcctggatatataggttctttctcgcttcacagatgatttgttaaagaaaaaaaagtcccagtctttcttcctggaaattagaatcattttcctttagacagacattctgcagtatgtttttttcagtattttgcaaatgcaaaattgtgtgccctttattcaactgtataatgaatatttgaaaagaagataatattttattcattgctttaaacttcttcagaacatattatgctttgagcctaatcaatatttttcaataactgttgatgtattttacattttctaaaataagccttttcaaaggactaacaaatagctgataatattaatctacaatttgatttttaacatccttattgagctacactttatatgctataaagtttacttctttaaagtgtaatttaatgtttagtatacttccaaaattgggcaattatcaacatctaattttagaaactccaacctggttactactcacagaaagcctgtgctcattagctatcagttcccattttcctcccccgttaagcccctgttcccttcccccaataagccctaggcaattgctaatctactttatgtctctatatatttgcttattctgaacattttgcataaatagtatcaaacaacaggtgatcttttgtgagtagcttctttcacttggctattgtttccagtgttcatccatctaatagcgtgtattgatacttcatttatttttactataaaataatatttcattatttatatagcagattttatttatccattcatcagttgacattttagttgttaccactttctggctattaagaataatacacatacaagcatgcatgaacaagattttgtgtggatatatgtttgcatttctctttggtagatagaacatttaccactttgtagctattcacaaagttgctaccacttttgactataaagaataatacatatataagcatgtatgtataattttttgtgtggatagatgtttgcatttctctttggtatatgcctaagggtcaaattgttgggtcccactgggcattctattccaagcaagattatctataatgagatagaaacatcttttaaattatcaggttactttgctttataaaaatatattatgtgaccagaccacatactgaatacatgaactttgcatgtcttaaatattttatgatcgtactatcttgtgcaatttttctaaaggcctattcttgagtctgtgtttttaaaagtgcaaagctaagactttgtaatcaatagtatttttttttacagaaaagtaaaatatatgcacacatataaaaaagaattgaatccatagagtactcaacaattaattagcatggcagcacaagttaatttgcttgtggatctccaaagagtttaaattaatttatgtaactgaataagtgttgtggttgtgtttctgtcttgttttgttaaatatgtttcaaacaatgaaaatcaaaccataatatgtgaagtcctaacaatcagtggaacatggtttggaaaccaacaattcactataagcaggccagtttcaccctgtacgctgacctccctgtgtaattaatggaaggaaagcagtccacactgtgcaagatacagctccatttacacttgtaacaggcaactttgctagattaatcttgtccaaactaatgcaacagcatgtacaatttcttacctttctttgcattatgcatatcaataaaacacataggtcataatcaatacttaactcaaatatacatacatatatatagttttatttttatttatttttttttctttaattattatactttaagttttagggtacatgtgcacattgtgcaggttagttacatatgtatacatgtgccatgctggtgtgctacacccaataactcgtcatctagcattaggtatatctcctaaagctatccctcccccctccccccaccccacaacagtcctcagagtgtgatgttccccttcctgtgtccacgtgatctcattgttcagttcccacctgtgagtgagaatatgcggtgtttggttttttgttcttgcgatagtttactgagaatgatgatttccaatttcatccatgtccctacaaaggacatgaactcatcattgtttatggctgcatagtattccatggtgtatatgtgccacattttcttgatccagtctatcattgttggacatttgggttggttccaagtctttgctaatgtgaataatgccgcaataaacatacgtgtgcatgtatcttcatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacaacctctccagcacctgttgtttcctgactttttaatgattgccattctaactggtgtgggatggtatctcattgtggttttgatttgcatttctctgatggccatggatgatgagcattttctcatgtgtttttaggctgcataaatgtcttcttttgagaagtgtctgttcatgtcctttgcccactttttgatggggttgtttgttttcttcttgtaaatttgactgagttcattgtagattctggatattagccctttgtcagatgagtaggttgcgaaaattttctcccattttgtaggttgcctgttcactctgatggtagtttcttttgctgtgcagaagctcttgagtttaattagatcccatttgtcaattttgtcttttgttgccattgcttttggtgttttagacatgaagtccttgcccatgcctatgtcctgaatggtaatgcctaggttttcttctaggatttttatggttttaggtcgaacgtttaagtctttaatccatcttgaattgatttttgtataaggtgtaaggaagggatccagtttcagctttctacctatggctagccagttttcccagcaccatttattaaatagggaatcctttccccattgcttgcttttctcaggtttgtcaaagatcagatagttgtagatatgtggcgttatttctgagggctctgttctgttccattgatctatatctctgttttggtaccagtaccacggtgttttggttactatagccttgtagtatagtttgaagtcaggtagtgtgatgcctccagctttgttcttttggcttaggattgacttggccatgcgggctcttttttggctccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttttatcctcttttatttccttgagcagtggtttgtagttctccttgaagaggtccttcacatcccttgtaagttggattcctaggtattttcttctctttgaagcaattgtgaatgggagttcactcatgatttggctctctgtttgtctgctgttggtgtataagaatgcttgtgatttttgtacattgattttgtatcccgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctcactgcctgggccagaacttccaacactatcttgaataggagtggtgagagagggcatccctgtcttgtgccacttttcaaagggaatgcttccagtttttgcccattcagtatgatattggctgtgggtttgtcatagatagctcttattattttgaaatacatcccatcaatacctaatttattgagagtttttagcatgaaggttgttgaattttgtcaaaggccttttctgcatctattgagataaccatgtggtttttgtctttggctctgtttatatgctggattacatttattgattcgcgtatattgaaccagccttgcatcaatcacaatttatttattttagtgttcatcaaaaaacttattttcataagtcagtatttctcacagtattatacttctgggggttcaaaagaacaatttctgtcttttttcttccataggtctgtgccttactgaagtttaagaaaaaatatacatgcaatatttatataaaatgtatgtttaaatgctgtggtaactggagataaaactctgttaaggctgttaactatatattttttatttctcagagctttaaaataatcagtcatagacaagaaagtctaggtttcaactgggagaaatatttttatggtaatttgaaggaagagaaatgagtatttcagctcctaaatagaaaccatgtataaagcccagagaaacaaggaaagagagaagatggaggaggggggccaacaaatcatgtatcttacctgagtatcacgaaaagagagaatagacaatatgagattagagaaggagggtgccagaggtggagatgcattatcttcagctccattttaaattttactctcataacaatcacatacttagactaagctgtaattgtatctatatacatttgtcaagtgcaatttgtttttttaatcacataaaactttgccagtgttcattttaaaactgtgctagaaaatctttaaggattatattatgccaaataaattacttaataaatgccatgaatgtccatttttatgaaacacaattcttagtgtaaatgcaacatgtcctctttaaaggagactgtattcagagtgtttgggaatttttgagcattcaaagaggcaggggagaaagtaagagaattcagataatcttttcacactttgaaataatactaaatgattaaaatgacatttagaattttaaattaggtgaggaaattcagacttcaggttgtcatttcaaattagatgttgcgttatttttctttaacaatcagaaagaatctacctgattgggtgacactgggaattaataagggcatttgactttaattataaaaggaagtcaagattcttagaccagttctttctccaaagctgcagttatgtctctgtaactgacatacaggcctgtcatgttcctgtttgctctcagatctgtgtctggtttttgctctgctcttatctcaaggtgctgaaacctgcaaattacatcgtctaggcttcaaagcccacgcgtttccagttagttctggccaataggaggcactcaagtgagactgggagcaagaggagtgggagagtcgatctatttgctgtctcttctttcgttccctgtggctattgccggcagtggctttaaatcctccgggttgcagatctggccaggtggcctgtccttcgtgattgcacatccagcctggtgaggcagctgccaaaccctcagctgtcgtcttcctccatgtggcccttgctcctgaactgtgaccctgctaactactttccttctccccagactcaaatttggtaagggctgactgtgagtgttcactttgaattgccttatcaccttctaacattactcctctgtaatgagttccccgtgttaaatcacctccgttgaaatatatgacatagattcatttttatgactggaaggcaacaaataaaatgtagtttaatgggatagttaagctttatatgttattttgctatttaaagctatgatggtaacaatgattactttatgtatcttccccactattattttttctcacacacattccattaagatttaaactaaaatgcactcagaaaatataatgacatcagattatttttttacttctgaactgtttttattatacctcaatgtgcacatcatcggttatttaaataatatactctctttcacaggatatcaaatatggtaggcagaccaatttgcatttaatatagccttatgccaagaattatgcttgcctatgttgtggctgatttttgcatttcaaaaacagatgaagtacagaattaaatgtgatggaaatgttgaaataattctgctttgagattctgtgttttgtgaccatatcaaagccttaaaattactaattttcaagcctgtgatttcaaattatattgtactacacagctgtgatgtatgtcatataatttttcacttaaaatggttaagtattaaagttggcaaattagttgtttataaatacattagaacatttcggcattatcattagaataatatcttagtcatttgtgtttcaaaaaggtttttctctttagtgggagctgagcaggtatttttaaatggaggtgcaagcaaatatgcaatgagcaccctagttagtttacctttgtcatatttatttacattcatgtaaatacaagtagccaaatacattcagctattcatgaacagctgttgttaaatcacagcaaataacccatcaaatatatgcatgatctcatctcctacaaccctactgcttgcttaagtaaactacagtttcccatcttctgtgctttttgaacatatcaagcttatgctttctgcagagaaggctttgccttaatttctgcacttccctccacctgtatgtctttgcaagactggttccatcttccgatgtcgggctcagttctcatctcacagaggctcccttagtcagtcaatctgaattgaatccccatcatgccccactctattcactttcttatcaaattttcttgttcattttctctccatctcacagatggctgaaattttttatcagaaatttttatgttttaaattattttctgcttctaggatgtaaatttcgtgagaaggggaatatcatttctcttgttcattgctggggagccagatgcttaaatcgtagctggaatatagtgggcactgaaaacaaacattgttgaatgaatgtaacctgtgatttggcatcacattgagctaagaggtggaactctactgcccaggtggggctcgggcactagatcaaattgaggactagcaaaaacaagtacagggcagaagcgcctccccattagacacatgccatgtcagtttaccattgccagggcaatccctgaaaattactgcccctttctacgcaacaacatgacaaacaggaagttaccactctcattccagaaatttttgcatacgccaccctttaatttgaaaataattaaaagtgggtataaatatgagtgcagcactgattctgagatgcagttctgtgaaaactgcgtatagggtagcctcctttcgcaaggagctgctgctgtatactgctacttcaatacaatttgctatttaacatcactggctcgctttagaattctttcacgggtgaagccaagaaccctctaggactaagccttgattttggagcctgcctgtcctgcatcaatatgaatataaataagacaaattctataagttatgagttttccttttttttttttttttttttttgagatggagactcactctgtcaccaggctggagtgcagtggtgccatctgggtacactgcaacttccacctcctgggttcaagctattctcctgcctcagcctcctgagtagctgggattacaggtgtgtgccaccatgcccagctaatttttatatttttagtagagacagggtttcaccatgctggccaggctggtcacgaactcttgacctcaagcgatccaaggtttcttaactgtatgccacagctaaaaactacacttttaaaatattgtgtatcatattatacagataagaacactgagtttcagaaaattttaaggtggttgctaaacatcatccacctatgtgttgggtggtggattcaggatcaggacaaaggtctccctataagtagtttcataatcctacctattatatgacatctgttttaattgtaaaaaaattaaataacattagatgataaatataaatcaaagaggcattccaccactatattacaatataggtatatgatataaaaatataattcataactgttgtatgctaatcctgctaaataggttgataaaatattgttttcttgttaagaactgagaaaggctgtcaatatgaatgagaagattcccatttgttgtgaaaagatcatttcaaaaagtttcagctggtgcattttttcctatgcatgtatttccctaggtcaagcagagactttcaaatgatgaccttattcattctttccaaagtagctcctaaacctcctaaatacacttgaaagaagtgattgaatgctggctgtcaggagaaaaggaacctcttgagtctcacgtttttgcttttcacttatttttgtctcagatgaatgtgtcaaagtatatatcatacggagagatagttatttaatgatagactaatgatatgtataaataagggggaaggaaatagatatttcattttagggattgatttgaattaatgggaattcacttccttttcacattctctaactacctcttttacttcaatagcatgtgtagggcagagtagtagaaattaaaagaaaaattatgatgtttttagacattatggaaagaaggaaactgttaaaaggaaatcatcacgatatagggcaccaaagggaactgctgtatttgcagttttggtctttgcagaatcacctgtccagactgtttgtttaatccattttatgaccacagaatctactcaaacaaaaacagccatctccagatatgtcccaacgtcctagaaagcaccatctggacccctgggagttttctacacttatttcctcctctcgtcccacccctaatatccaataaatcatgaaatagatcatcagtcctaatacgctccattcccctgccctccatttacccaggtggccaccgtctctcccctgaactgcacacatcttctggttcccacacttccaaatttaggtcgcaattcttttccacagtggctagatgactgtttctatataaatcagtttatatcacacccctgtataatattctgcagcaacatttcattgcatttggatggtcccaggctgtgagttatctcacctgccactttcccctcatctagtcctgcatggcatcttatttatcaggcttctgtactcttttattatcctgaattttctaaatccctacatagaatttagggtattcataatttttgtttgtattcagttggctaatactttcctggtttcaggttaaatgttagctcatgattgagaccttctctgaattttacttcaaattctttttattctcttttatgaatatatatttttattacttcataaaagctaacacatttttaaattaagagagtgtgtgtgtgtgtgtgtgcatgtgtgcgtgtgtgtgtgtgtgtattttgtttttggcctcattaactaggttttcagttccaggatcatttcagttttgatacacgacacagatcccagtgttagcaaatgctaagttctcagtaagtgtaggattatttaagttgttgaactgattattacagagatatggtggcaaaaatcaattagtcactcatttatataaccaacacgttatttattaagcatttacttatactagaaaattaatatgagcatgtatattacaaggcctttagacagtgactctcaaattatactttctcctgaagattttcacatgtatgtataggagggggcctcttattctccctcaacctgaggatccaaaaatgagatttaaaaaacttaaaaaatgtagtttggaggtaaatattgatcgtatcattaagtaaatatttcaatatcctctattttggtcagcttagacactcagcgtttggtaatgctggctcagaatttgaaaaaaaaatcagaatattcacttttaaaatatgttttacatggctgcctcataagaacttatgggaattaaagacagggagagttgtcttttactctgtacaaagatgcaagatccaaaatttgcattaattatattaataaaatgattatttgagacactcctgctattacatgtcagcaaaaatagctaacgctaaccaccatatttgtgaaataacgtttacttgttgagaacattcattcaatccctcttgtagtcttaaataaataaaatctactgatatacatatatagcaacacatacttggaaagtagattaccagtttgaaaatattgctttcctaatataaacaatttggaaacaatttcatttacaaatatgaacagttatttatacacataataaatatgacacaatatatgggaggtaaaaatgtctttgaaaattagctttcccttaaaatcaatgagtttattagaacaggggtccccaactcccaggccacggaccagtaaccctccatggcctgttaggaacctagccacatagcaggaagtaaccagccagcattaccgtctgagctccgcctccagtaagaccaggggtggcgttagattcttaaaggaatgcaaaactcattgtgaactgcgcatgctagggatctagattgtgtgctccttatgataatctaacaaattcctgatgatctgaggtggaacatttatcccgaaaccatttccctcctccctttccttctgcctgtggaaaactgtcttccacaaaacccatccctgatgccaaaaagttggggactgctgaattataagacactggtcttaatatccacattctgagcattctgagtatgtaagtttgaaaactccaaaaggtaaaagtaacttactttgttcaataatttaagaaaaaaaaaaacagaaaaggctgattttcaatgacccaaatggatctccaagtagaagtgttctatttcaaaattcacagaaggatggaattctatttttggactgtaatgtgaaatgctgtgtaattctaagttaatataaaaaaaaaaaaacagaagttctacacatggacacagggaggggaacatcacatactggggcctgtcgtggggtggtggacaaggggagggagagcattactacaaatacctaaggcatgcaggccttaaaacctagatgatgggttgatagctgcagcaaacccccatggcacatgtatgcctgtgtaataaacctgcacgttttgcacatgtatcctagaacttaaagtaaaatatacaaaaaccaatgaaacgaacaaaaataggagttctaagagtgtaattaagctttcatttcaaccactcttcttttcaaatggaacactgctatctgagggaaaagtttaaaaagcagaaatgtttagtttgttagtttaaactaaacaatggtgataaattttcttcaacgttttttcttttaaaaaaatttcaatagcaattttaaaaacaagattcagaaagttcttgtgctctttgaaacaattacaattccagatagaaatattttaaaaagctaaagaacatttagatagtaaacaactctactatgaaattaaaatatcattatggcgccaaccaatgcgttttgtttctgctattattgagattaagttttcaaattagaaataattttcattaataatatttataagaccataagcatgttctctccttagaaacagccctacaactcttacatagtatgaagagactctaagtcattctatttgtgctcttaacaaaaacaaaaaacgtaaaagtttttacataaacattcgtatagaaaccattgtttttagtcatcagatatataaaacatattagtgttctgttacttatggaaattcttaaggtcatgcctacttcaatttagaaaaatcttggttcattacacaaaatgcctaattatgctgaaaccaatatcaagtttataatgacattaccgagggaagattgagaatgtgatacttcacttgctgcctacagcatataaagttcaagctgacatagagaaatatatacttccaaagtacctccccaaacctctaggctttctgagggtatgagccatatttattactttagagcatcatatacccaccacctaataaaatgtctagcatataatttaaacctcattaaatatttgtttcatgtgtaaatactattataatattagtattctgtatttccatgattatatataaagacattcaatattagtcatcaataaaactcactgacatgtttcattgaattcatgacacttaaaaatgtgctctttttccagtacagtaaaaaacacttccaaacatttctatttgatggaacggaaggagaattaacaagtatttcaatcttacatgacctctgaagaaatgctgaaggaggctgacaggaaagaggtaaacagctgggaagagtatactgagtaaaaatacactgctctcttcttaaatgcaagggcgtgcatcttctttgttcacaacaatatgaccatccttcccataaagccagtgttgacctcaaaattgccattcaaagattgatttgcagaaaagaacagtatgtgtcatatggtattacaaaattctaattgacaatgagaaatagtaatgtaaagataactatgggctttagtctcacagaccggaatgcaaaccttaactctatgatattgagaaaagaagcctcagtttcctcttttggaaaaaatcaaacaatattttagaccctaaggtatttttataagggttacagaaaatatgtgtaaagcatttagtagactgtgacacatagtttgcatccaatctacagcaactattataattatgtgtttccctttagatcactgggtatgcgtacatttgaatgtctagttcatatgaatggaattatgtggtgaaatattcaaatgaattgcatttccaattaaaatagataatctcagcataaatgctgccaggccttgccttttgcagctgttctgtttaaataattcatctagtcatcaggtaaaaacacatactctgcattaactttaaggaactacacaacagcgaacatcttaatgagtaacctaaccttttaatctgcctcattttcttgtgctattcatttcaataaggaattacaaccaaccatggtggaaatctctcacaagggctaatgtattcaatatgcacaatatgcatattaaaaagctcactaataatgcgcacgtgacaaggtatcaaaatagcagcaactataaggatggcataactttaattaaaatagttgaacttgaagagtatttgacattctgaaacttgatagatatggatgcaaataataaatatttgtctggtatgaattattatctattcaagtagcatttaaataggtgtattatgtcagaaaagtaaaatcataacaaatagctagcattcataatttgtatattaaacttttgttataaaggacaacagttagattttgctccaaaattttaagacaaaaattttaagaattgttatgctttgcataaagatcaatgcattaaaaaaattgaccaagttcgcatcattaagtttaaacttcttatcaatatcttttctgtaaatcataaggtagcgtgagatagtaacaccaactagagcaacacagtaagacaaaaatatactttcatgatattacttcgacaatctcttaggtaatgttgtaattattcaatcgacaaagggtacaggttattctcaggaagttcagaacacacgttgtgtcagcaatattagctcacctttcatacctcaatgatatccttactttttaagctatttatatgtagttctctgcccaataagttcaatttttttgttgctttattctctttcttctatctttgcaaggaaagagttctttcctcttttaagatttctgtcgtaagtggattgtcctaatggatcctgctgagtgcaataatcttatacaagctaaatggatgtttcaggattacatattaaaacttgttccatctctagaggtcattatattacaacttaagtagtttttgaaatatatgctgataatgtttatatcttagatttcactgtcttgaaaatgctcaacattttaaaaataaagcacattttacctctttgcctatttccttttttgagagcactaaaattgcatcttctttgtctatgcttgcttgtcatctgtcatcctataaaaacacacccacattctaacgaagagtctgttttacaaacccattcatacatatatggtttagatagaacataaatcctaggagaacagaatctttctttgatttgttctctgatatatccagtcatctagaactctgtaagtttacaataaaagggtgttaaataaactcatcatttacttttctgcaagactggttccttctcctattgttctttagattattaatcgagactgtttctcaagataccccatgaaaataaataacattatttgaatttatacctttcacaacagttgagatccacgttagttttaacatcagataaatttagcagtcttagctatataatgtgacttgcacatgaatttaagagattagaaaaacaaaaggcaaaaaatagcctaacacagaaatgaacgcacacactcgcgcacacacacacacatacagacacgcacacgctagagagagacatcttttaaagcaaaaattggttttatattcctaattcattatcagttgtttatctagacgttacttaatttagatatactatatacgtatgacactatggtcctcatgctcttgaattagtgtttcttaaattgagtgtgcataggaactccctggagagtacaagtaaaattcctaggtccccaccctcagaaatgttgattatgtaaatctcaggatgggtctgaggtattttaaatgttatgtttggaacctgcttgagataaatttaggcaaattaaaagaccaacattcaattaaacttataaacctcttcaaaagtattaacaagtcatggaatttaaaaataacttagtttaaggatagctgagaaaatgtgtgatatgtcacctccaaccaatgctatagccacaagcacaaaatgtaattaatctatcataatagcataacaataagcttggccaatcatgattcaagcatgtgataccttaaggctctttttggaaatgggaaaaatggcttctaattaggacatgaagagacaggtaaataaagccatatgttagtatttgaaacatttaataacaattattaaacaccatgaaattgtgatcataaattcaaaattggaagttttaatgtgagtggtaacctactttgaaattattgttgctagaaatgctgattagatacttaaaattaggaaggcacttcaagaaaatcacttttattcatttcttagttcatttaataatattttggaaaattgtgcttaatgaggtgctcgaagattttacaaaattatcctgctacttatatctttttttattaatgggagagtgtttttacaatcccctgaagtaaaactgttctgtaatttcagtgactttcaaagaaataccccttgattcattgggtcctttgatattaatgaaaaacagaacattaaataatgcttcacaagtgttcatgattcatttaaatataaatacatgttttcaatcatataagttccaaaattgcataatggattatccaaattaatacaaaaattgtttatcacaacagaatatgagtgctttcagaaataaatgcaaatgtattatactttttctcactgtaaaaattatatgaagaaaagacacagaaataagcttgagccaatgagttaatgctcctacaaaaagggaattagtgtgaatgatgaatgcatattttaataaaaagacaaattgccataggtcctgaaaatatcagagatgaaataaagcgttaagtcagaatgctttattctgtcatcatggaaatcatattgttctactaaacaagaacattacagtaagtgagacagttgacatctttcacaggattttagttcctttgaatcagatctacgcttaacacttttaaataactccttaagaaaaaagtgaatttattaaagctgtattttgttcgtttagatatttccttggaataacagttgagaacatatcttgaaagttcaaaagactcagatgcaccacctcaaatttgtgacagcaacgaaagtgtgcatgaaattggctcacactacatattacagatgatcagtgcattgaatacacataacttggccagtgtggctaaaagacttggaactgcactggttaacaaaacttcatctttttctgacctcctttaatataagaaaacctaattattataataatttctctataataatggaaacatgcttatttattgtatggtttccaaaaggccatttaaatttatcaccagaaatagcctgtgagttagtgagggcaacttatgttaatattcaaatgctacttgaggagactccatagcatgtctagagagtaaaaataagcagaggtgctggctttaggccagatcttccaattaacatgcatgtgtgtgcacacgcacacactcacacacacttttatatcagaatgaggaaacacattcttgccagaaggcctcctttaaggcagacatttcctataagaagtaacatatctagaaactgaattacagatgaatgtaataagaccgagcagctgttgtcctgtagagaaaaactatacagtatttctatttaatgttgtatgtcaatgtagaaattttatatttttaacaaatgatcttattatattaggagtataagcaagataatagtaaagaacgaaagagtattcaaaattatttagagcctacaactgcacccatgaaagctgccttcatagagaatctgtatacaattagcagagtgaaggccccagatgcctccgacagagaaatactgagaaaagaatagagcatgaaagtaaaatttcacttgttttacaatgttactcagggtatttgtcaatactggtaaattttaaatggatattaaccatctccttacttggattcagaaataaagttctgtgttttatgttagaaaagaaatagtttactgtaggaaacgtgtggcagcaaatctggccactctgctagcttgcagatcttattgatgtcatttagtctgcctgggactcaatttattttcctgtaaattggagagagcaatatacatctcacagtttattgaagattaagtagaataatgagtataaaagtgcttactaaattctgtaatcctatgcatggattattattatgaggaaaaaaagagcatatgtgtgacagttttcgtgttaccagaaagatccaacataaggcagggttatgtgagaagtatgggagttaaattgttatctttgatacttcttcccaggatcaagcaggctctttgaaatacctaaagaagaaaataaggccgggcaagacatatgaagggacgttattctatgctcaacctgtttcttagctgtaagagcccgtcttagagacttcttagagataaaactgacagtttctgctgggaaagtaattgtaacatggaagaagtgtgaatgctgacctaagcgatcttcaactcagttcgtagtgcaataggcaagtatagtccaaaatggagcacacagtcaatttcttccttcagtagttctaggcagtgaggcatacattcatttctttatataaattttaaattgttcaagtatgaattcttctgagggttaggaaaatagacttataattcaatttttttactctttgattacacctaagattattttttcactctttcctccaattatttccccagtgattattatttttgttcatcagttgattacttggtcaaatctggaaataaatacatagtatctggggattgttccatgaactgtaatcattatttcccccccttaatttcgtttcttacattctaaaattacctaattgtcacatagaagtaatatttacaatattttgaataaacataaaaataacgatacagcatgatgactagagttactaataacgtattgtactcttgaaatttgctaagggagtagatagcaagttgagaacttgttttacacaaaaaaggtaactatgtaaggtgatagatatgtaattaatttgattatggtaatcatttcacaatgtgtatgtatattgaaatatcacattatacaacttaaatatatataatttttatttgtcaattatctcaataaagttgggagaaaaaagaaccagattttatttatattaatcaggtttttaatcagagattcacatatttttatcatgaatgtcatattatttgtcgaagcgtatctttcttcctggtcctgataatgtacaaaaggagtcctgatccttttgtaccagttgtttcataggctatgtctgtcatgctaggcagtttgctgggtgttgtgaattcaaggtgaatgagtaaagacacacgccctgccttcactgggctttcattctaggatggaaagttctgggagaaattttacatattaagaaaagcagttcaacgggatgtataccactgaggcatttgttgtcactttaaagtattctatcatgacttgggctattagaagttcttcctgagggctggagaactgaggcctaatgtttaacaaatgtgaagagtagaaaatgggttgggtctaaggagtggctccttaaagcattagttttaagaattcacttattcaagaaaggggattcctgagagataaccaaaagatagaattagtttgtgagagaaacggacttctggtagtatgattgtatttgtcttgctgtcaggaagattacacatttctgaaaaactgcttttatagaaaggaaattatattttatcacgttttacttataaaatggtttgtctcattgttttacctaatattcttaaaagtagttctcagtttggtgtcagttttcaaagtctgctaactatcaattaattatcaacaacaaggtaaatacagcaattgaaactaaatatttagatacttttatagaaatgtaaacatgccacaatcaatttatattttataaaatattggtctacaaagaattaaaaataaacatacagaaaataaaaagcattcttttccactgatggtttcgatagctgaacactattgctatacatagtccaaaatgtattaaaaatagataaaaccagtcaacagttttgtggaacccccacattttattttgaaatttatcagaaaaacataattggatgtcccaaatgtacacttcataactgtaggtttcgaatagtcacctgtatcttcatgttaactatctactagcacttttgaattcccttcatgacaatctcacctgtgtgttaatattacatatctactaacacttttaatttcaaccacatggcaacataagaagcctaggaacagacctacagcaaatactttaacatttgggaaaagtataataaaaatatttaatatattaccaaactcataaaatataaaggatgatctaaaatttaccctactcaattcagaagctaaaagaaaactgaaagttaggcaagttagctaatgtggcaacatccatatctgggttattagaccagaaaaaaatgtcctaacagctagataatgggagttacgtaaatcatcttattttcattgctttgactcataagaacttaagaatttacgtctttcctcacttagcattgttgatataattttctctcaacctatgtatcaattatttcaaatttatcctctatgagattttttgtctcattatacttttgctatcctctatgagattttttgtctcattatacttttgctatgagtttttttactaagccatttcatcacctttctataactagtcagcagacaaaaacaatattcgtaaacatttatatctatccttgctgacatgctacaaaaaaggcctattttaaattatttcttaatttaatggcaactataatgtttgatgaaaacaaactcccaatcattcatttctatattaccccaacttacagcctgcttttaaattaaaataaactaaacttgcttttgagtaatggtgtgcccaatttccatgtctgttaaacttctactttaagaataattagtatgtgttgtaataaatttagtggaaataagcatacggaatactgaatttgctgacttgaaagtccaatctttatgccgaaattattagcgtttgtttctaaagcgacgagaaagcatgtacctttttcatcccccatgtcattacagaacaatggtttattttctgcttcacaattccttgggctgagcaccaaatgtgatttgttgaaagtatattttcttcattttctgttaacgatcctttccagtatctccactgtacagactatattaatctcattctatttattgcattctatttttatgttataatccagcctgttaaactgcattgaagggcttatgattcttgtcctataataattctatctgttttttaccctatattacccagtaatttgactctcccattttttcagccttttcatttttgtttgttttaatgattctcctaaagaagactaatagaaacaaaagaaaaataaatctttgcagccacattttatattataacttactcaaaaaagggctaataaccatcactaattattgctattcacaattgccccattgctatttgcaacaaagtctgtgctgacgtctcaactcttataatcttagcttttgttgtggatgtttattcagttttttctttattttgattttactgttgttcggtattgcattctatatttgctgtctattgctcaggtgctctaacattttcaagatttttcttatcatctttaatatactctttattcctccttcagttacccaacagataccaaaatgatcccgagctctgaagttctgagctcagaaatgtgtttgcacagcatagatgcattagatcctgttcagcaatagaactggagaaataccacagtaaagcagatgtgacgagcccaccagacagtaacaagtgcaaacttcctcccaggttcctagttgagtatgtttgtgccaggtcattacagtatcacttcttttcccacttaatatgtttctttcctccttttatctttgttaaaatattttggtacttcattgtaactctattagaataaaggaatacttgctttatatttgtatgcagttctttccagatttaacgaaatggcctgtagatgttcctgataattttctccactttacaatatgtctttagagagggatcacactatttcagaagatatttgtaaagtactttaaggactttgaaataaaggtgccccaaagataatgagatgattttattctaaactactctgaaatgtgatttttccattctttccccatcaagtgaaaatcaaaatatgtcttaacaaatttgtgagaggattatgtcagaatgccttcgtatgaccagtctaacattcttgtacatggaattgtatcataaataccaaaaaggtaaggggctattgatctcatgttttctttccttctcctgccacaccttctctttttagatgaatttatttactcttcctttagtcttccttctctttattatataaaacaatatgaggcaatttgtaacattttcaaaaattttactagaagtccccatgtcagaagaatcactgtttttgtaaaatgcatgatatattcactgattaatgcatgtatataccaggtcttgggatcccacagcaaatgcaatgttgtgatctccatgacaactccaaggtattcttatttcagtgtccaaatttgaaattcctggacatgtcttatctaagtcatctgcatcatataagacaaggacacaatcaacctatggtggaatgctgagaaaaatatgaagtttgctcatatagaaccacagatgtggtttactctgctgagacttcaacataatgactcctaaaaattaagatgtaagcacaagccctatcttgtgtaattatctggtttaattcatcccaagcgctatcttgtctatcttgtgtaattaatcccaaaagctcaaaatagggcttgatatatactaggagtcaataaaatatatactaaattttataatcgaaaggaaaaatagtttatttaaagaggaaaaaaatactttgaatccagaatcctgcaatgtaacattttaagaatgttagtgggaagcttatgggccaagacttttttggcttttaacaaagaaaatgttagtcatgctttaatagagcaatacaagatttttttatattagcgaagtctccaaaatatgcaacttatatgggtttaatttctttttaatactcaaagttccttgatatctaaacaaatgcaaagtcttaacaaatgtggttttaacagtgggttcattcaaaattttagaaacgagaaaacacaaatctatctaaaaatctctcatgaaaatataatccaaaatatgagaaaagtaatgagataaacattttattcagaaatacaagattaaataaagcaaattttctcacaagacctatttaactaacagcaatacaaggagtctggatctttgtttgaaaagtagaatctgttaggatattttaagttgactatacaatacatatatttactagtatgtatatttactttgctgacttgatagacaagacttgaataagttctgtgacttgccttcatggaaactgtattggagacaattttagactacttaatttaaatagtgaaaatctcgtttcaaacttcaggttcaaatgtgccacagacccctcacacactcattggtgaaattctgtaattggaaactgtaaagaaaactcacatttatgtggagcgacttttctgcttactgtaaaacaatgccttgtataaaaaagaatgctctaagaaaaccagcccagacttactggatttgctgaacaaagaaagcctgtggggagatgtagatgagctagcatagtttttaggacaagtctagaataatttcaaaatacagaaggcttgcttttgttaccccagatctcttttagttattaacactactgtcagcactttggaagggaggatctcttaggctcagaaatctgagaccagcctgggcaaaataatgagacctcgtctttctgaaaaattttaaaaattagccaggcatggtgatgcacacatttagtcccagccacttcagggactgaggagggagaatggtttaaactgagcaggacaaggctgcaatgagccatgatcatgccattgtactccagcctgggcaacagtgtgagaccctgtattaaaaacaaaacaaaacaaaaaccactaactttcaccatttgttttgaacccatgagtgttcataggtaaacctttttttcttggcagtgttgtgtgctccagcattttttaaaagtaaactctggggactgttgtggggtgggcggaggggggagggatagcattaggagatatacctaatgctaaatgacgagttaatgggtgcagcacaccagcatggcacatgtatacatatgtaactaatctgcacattgtgcacatgtaccctaaaacttaaagtataataataataaaaaaagaaaaaaaagtaaactgtatcctacttaattttttaaagatcttatccattaaaaaataaatttttcaataaattcatagctataatgataataattattatttttttaagatggagtttcgctcttgttggccaggccagagtgcaatggtgcaatgtcgactcaccgcaacctccgcctcccgggttcaagtgattctcctgcctcagcctccctagtagctgggattacaggcatacaccaccatacctggctaattttgtatttttagtagagacagggtttctccgttgatcaggttggtcgcgaactcctgacttcaggtgatccgcctgccttggcctcccaaagtgctggtattacaggcgtaagccactgtatctggcttatcattaatatttcattttgcttctcttaattttctgtcctttcttccttccttccgtccccccatctttctctgcatcatttttaccactctccctctctcatttactttctctctcatttttcccccttccttctttctctgccaccattttttcctttttttccttccttcctttctccctgctaagtaccaaacatattcaggtaactcatgaatcattaaagtataataaatgcaaaaacagaagaactaaagtgttaatgacaggaaagaaagtatatgagttattgttggggaagaggagtaattgaaagcttcaaaacacaaaataatttagatagatcttcaggaatatgtaggaggtcaatgagtctgctgatagaaaattcagccagggggaaatttttaaagtcaaataggtgtgaaacattgaagctcattacaaagttgagaaaaataagctgtgaagtgtaaggagggcgggataaaaaccatagtagtagaagacactatgattaatttatgaacaggcttctctgcaatgttaggtgctaaagctagtttttctcattataataatgaaggtcatacttgtacaatactcaagtattatggattaaaaaacacaatatatccaaagctttcaaagaggtgattcacagtaacactacataaacattgggtcttccatctatgtgctaattagaaattaaacgtcctatcaaaagaagtggatcttctccaccccattataaaaagcttatttttctctgtgagtatattgcaaaatatacacaaatatgtgtgtgtgtatatatcccatatggtaccataatgtacattatgtgtttggaactactatatcatctataattcatatattttttacttaacagcttttgttgtcatttttacgtcagtgcatatttacatgcatgccgttattttcatatatcatttaaccaatcatctgttaatgaatatctgaatcatgtccaaatttttactattttaatcaatgtcacattttagttttctaatacaatgaaagacaataagcttttcaaatgtttgctaactcttccttcatttatctttctacattatgctgatgttgacaaggactgatatcctggctgatttgaacggctggtaaaataaatgagcaattttagtattaatatgtattatcagtttagcctctcatactaagtaaatacaatatgtttccaaaatatttatcagggtaattgagaaaaatacgtaaatatcattgaaattttcatgacttcgttattgagcttgaaatatattttctgttagcttgcctttctacttttttattccatttttaaatttcgttattttttttctaattgatttgtaaacactctttgtccagcgacaacattagccagagctttctaaacagtgaagtgaagcactccagggtttcatgaataccacgggatgccaagaaatcgaatcagagttacagttcagggtttctcactaccagctgagagtatcatcttctgtttatcctagtctgacaggtgatataattccaataccacttttatctgtgctgtgatgtaaaaaatttcaaaaagtacatcttggatggtcgtgatggctcacacctgtaatcctagcactttgggaggccgaggcaggtggatcacctgaggtcaggagtttgagaccagtctggccaacatgatgaaaccccatctctactaaaaatacaaaaattagctgggcttggtggcagccacctgtaatcccagatactcgggaggctgaggcaggagaactgcttgaaaccacgaggcagacgttgcagtgagccaagatcgcgccactgctctccagcctggttgacagagggagaatccctctcaaaaagaaaaagaaaaagaaaaaaaaaaagaaaagtacatcttacaaatgtattacagatcatgtttttatttgcagatttaaacttacttatacaattttgctatgtttcttagtttttaggtacatttaccatctcttctataacttaagaagtagtaaaagtggtacagactataatcccaagctaataaaatgtcagtattaaataaagagtaaggaccaagtaataacaaaactaaaaaagatattactaataatgatcatttattaaagaaggttcagggaagtaaagaaaaaatggaaaaggcagctaaagaagtcaaatgaatccatgtattccacaattttaaagcacttatgtacctaaatattaattaacattaattaacattaattgcaatttaatccatacaagaattcattttttttctagtaagaatagtgaagacacattatttgttccttcaacaaatgtttattgagtgcctggtctattccaggtaccattctggaggtaagggattcagcccctaataaaaaataagcaaatttatcttccattaagcttaatttctagtaaatggagacatactatacaagtctaagaaataaaatttgtggtacatcagatggcaataagtgttataaagtgaaataaaacaaggagggtgattaggaataattgccagagtgaaggaagcatgtagggaatatttttaaatagggtcgtgagagtatttcccctcccccaatttggttaacagaaggtagttactgatcttcataaaaaaagtattatgatgttggtggtgcaagtcaatgcaaatatgtgtatgccactagagaagaagcagagaggcagagaactagagcaagcagaaaacacataaaagtgtcagttatgaccaggagagaaatgacgacagagatgaaagcgatcatacgcctaagggagaagttttgtttgttatttttgctttagtttaatttgggaaaacttcaaaatgctgttcagctgaaccaagagccagaaaatgaataattaatgcaaactggactctggatgaaatgtgagaagaaaggataaagagcctgaaactctcacagcaggcaactggaagtaataaaaagtgtatgctgagaaaaaggtacaggtgttttactaaaataaatggcttaaagtgagttgcaaagattggaaatatatcatgaagggattgaatggatcaaaaaagaatggaaaaaatgtctaagatcaaataaagttttcagttgtctctaagaactcatttcaaaattgttattatttattattattattttactgggcagtcacttaaaagctgattctttattatttgttttggaagtcctggctcagtagcctgtttgcagcccagtaacattaaatgaatgaatgaatgaatgaatgaatgaatgaatgagtgaatgaacgaatgaatgagtgaatgaatgaatgagtgaatgaatgaatgaaatacaccttaatgtgctcattcaagtagaagcaatgtgtacactaaattctctttgccaaaggaacttgcctaatataggataaagaggttcaggaaaaataactaatgactactagccttagtacatggatgaggaaataagctatacaacaaacccccatgacataagtttacctgtgtggcaaacctacacatgtacccctgaacttaaaagggaaaaacaaaataaaacaaacaaacaaaaaagaaagaaagaaaaagaaaaagcgtgaaggcattttgtttggaccatgtaaattctttgaatactttagatcataccacagagacccaaagatatttttatctttctcccggtatattttaggggggttcccactccccactcgttgcgtttccatgaggaaactctactcgtctccccaggagattagaatctttgtgtggtaacttcaaccctactagacccctccatcttttgaggctcatctttccttgtcattaccaagagggctttacaggagttaggcggtaattgcttccagcagctagccagaaagctatctgcttggcaatctccctattagcaggtaactatcacaaggaccaaacaaaaaggcaaattaaagaaggctgaacctggccacatgacagtaattcaacttaaacagtaataagccacacagttggccctacttactcatgggttcagcagattcaaccaatcatggatgaaaatattttaaaatgaaaataaaaataatgcattaaaaaacagtacaacaaccatttacatagcacttacattctattaggtattataagtaatctagaaatgatttaaagtatacaggaggatgtatctaggttatatgcaaatactatgtgatttcatatcagcgatttgagcatctgcagattttgctatctgcaggggtcctggaatcaaaccccgcagatactgaagaatggttgtatatacacacacacacacacacacacacacacacacatatatatatatatatacacacacacacacatacacacatgcatatatatttatatgcacataagcacataattacctatattatatatactattcatatgtaaacctatataatatgtagggtaaatatattaatataataaacgttcatatacatttatctatgcatttttatcatcactctaattccagtagtaaatatttttcaattgcttttcaactcagacgggatgcaaggagtttgacttacattaactttattattacattttttcctttcattcatatagacaagccaaaattcacggtaattatattttgtacctaactgtggtggtatattatttttaaatgtgaaaagaaattagagttgtatgtatgcaacataattttactaacgattggttatgaccatcatatcattcaacattttatttaaaattgtttctactgatccgtgaaagtttactttgaactttagaaaatagattcacaaagaaatactgtgttcagctttaaaattcagcagaatcggttacgtgcatccaaccaactgatttatttggaaatgcatggatggtcatgttctttaagaaggctctggtagttcatacatagaggaagcttgttgaggaggtcagaagccacactttcacttattgatttcctgcacatggatataagttcacatgtagatataagttcacattaagatttcaagattctacatgttcatctaaaatgtttacaaagctcacaacatgctttcatagtttcaataaattatttgtgaattagtatagaaatatggcccttattttagtgcattttggtaaatcagattacggaagaggtattttacttctaaaacagctgatttatttcattactggcaaaggtgttgtgaagaacctagcacgttatacaaacttggcactgaagaaacttgctgtcttagaatagatcacagaacattatagtcagatctctgtccctttgcagtctacatccttgtgggctgatacatacagtaaaacataaacataacaaataatagtattttagaaggcaataggtttatggaagataaaaatgtagcataggttctgttaaaaggaattgacaatgctggatgtgaggctggggtttgaggagggttgtcagggtagaaggtgaggtttggtcaaagacttggaggaagtccaggcataaagcctgggctatcagcagaatgttccaggcaatagctagggcaaagtcacaaacgtcaacacttacaagatatattactgaaataggaggaggccagcagcaaggctggggcagagagaaagagagtgagatgagatgaggttaagagtcaaccagatcacatagggttttttaggtcagttagtcagttgaagagtagcccccaaagaaatgtccactcacaacctctgaatatgaccttatttgtaaatatcttctttgcagatgaaactaagttaaggattttaagatgagatcataatggatttagagtcggctctaaaatcaatgactagcgtggctaatcgtccttagaagaagaggacaaaacacagttctaccatttgatagctgtgtgatctcggccagcatatttacatttgtaaacaaagttttcttggacttgttttttttttagtggtaatttatttattgccatttcaatcttgctgcatgttactgatctgttaagggtatctaattcttcctgatataagctaggaagtttgcatctttccaggaatgtatctatctcctctagttttctaatttgtgcacataaaggtattcatagtagtcttgaacgattttttgtatttctgtggtgtcagctgtaatatctcccatttcatttctaattgagcttatttagattttctttcttcttttctcggttaatctggccagtggtctccaagaccagacagattcacagcagaattctgcaagacattcaaagaattgatatcaattccattgacactattcccacaagatagagaaagagggaatcctccctacatcattctatgaagccagtatcaccctaataccaaaaccaggaaaggacataaacaaaaaagaaacctacagaccactatccctaatgaacataggtgctaaaatccttaacaaaatactagcttcctgtatccaacaacatatcaaaaagataattcaccataatcaagtgggtttcataccagggatgcagtaatggtttaacatatacaagtcaataaatgtaatacaccacataaacagaatcaaaaccaaaaatgacatgatcatgtcatcagatgcagaaaaagcattggacaaaatccagcaaactttatgacgaaaactctcagcaaaatctgcatacaagtgacctatttcaatgtaataaaagccccgtataacaaacccacggccaacataatacggaatggggaaaagttgaaaacgttccctctgagaactggaatgagacaaggatgcccactctcgccactcctcttcaacacagtacttgaagttctagtcagagcaaccagacaagagaaagaaataaagggcatccaaatcggaaaagagaaagtcaaaatgtcgttgtttactgataatatcattgtttatctagaaaaccccaaagactcctccgtaaagctcctagaacttacgtaagaattcagcaaagtttccggatacaaaattaatgtacacaaatcagtagcttttctgtacaccaacagcgaccaagctgagaatcaaatcaagaactcaacccctttacaacagctgcaaaaaattaaaatacttaggaatacacctaaccaaggaggtgaaagacctgtacaaggaaaactacaaaacactgctgaaagacatcatagatgtcacaaattgaaacacatcccatgctcatggatgagtagaatcaatattgtgaaaatgacctcactatcaaaagcaatctacaaattcaatgcaattgccatcaaaataccacaaccattcttcacataatgaggaaaaacaatcctaaaattcatatggaatcaaaaaagagcctacatagccaaagcaagactaaagaaaaagaacaaagctggaggcatcacattacctgatttcaaatgatactataagatcttattcacccgaatagcatggtaccagtataaaaatatgcacatagaccaaaggaacagaatggagaacccagaaataaatccaaatacttagagccaagtgatctttgacaaagcaaacaaagacatgaagtggggagaagacaccctattcaacaattagtgctgggaaaattggccagccacatgtaggagaatgaaactggatcttcacctctcaccttatacaaaaatcaactcaagatggatcaagaacttccatctaagacttgaaactataaaaattctaaaagacatcagagaaactcttcttgacattggcttaggcaggaatttcatgacaaagaacccaaaatcaaatgcaataaacataaagataaatagctgggacttaattaaatgaaagaacttttgcacggcaaaaagaacagttagtaaaaagacaacccacagagcgggagaaaatcttcacaatctatacatctgacaatggactaatatccagaatctacaaccaactcaaccaaattagcaagaataaaacaatcccatcaaaaagtgggctaaggatatgaatacacagttcttaaaagaagatacaccaatggccaacaaacatatgaaaaaatgctcaacatcactaatgatctgggaaatgcaaatcaaaccacaatgcgatatcaccttactcttgcaagaatggctataatccaaaaattaaaaaaaataatagatgctggtatggatgtggtgaacagggaacacttctaccctgctggtgggaatgtaaactaatataaccactacggaaaacactgtggagattctttgaagaactaaaagtagaactaccatttgatccagcaatcccactactgggtatctacccagaggaaaatatgtcattatacaaaaagatacttgcacagagatgtttatagtagcacaattcgcaattgcaaaaatgtggaaaaacccaaatgcccatcgatcaacaaatagataaagaaactgtggtacatacatatgatggaatactacttagccataaaaaggaatgaaataatggcatttgcagtgacctcgatgagactggagactataactctaagtgaagtaactcaggaatggaaaactaaacaacctatgctctcattcataaatgggaactaagctatgcatatgcaaaggcataagtatgacacaatggactttggggactcagggtaaagggtgagaagggggtgagggatactgcaaattgagtgcagtgtatactgctcgggtgatgggtgcaccaaaatctcacaaatccctactaaagaacttacagcagggcgcattggctcacgcctgtaatcccagcactttgggaggctgaggcgggccgatcacctgaggtcgggagttcgagaccagcctggccaacgtggtgaaactctatttctgctaaaaatacaaaaattagccaggcgtggtggagggcaactgcagtcccagctacttgggaggctgaggcaggagaatcacttgaacccaggaggaggaggttgcagtaagccaagatcgtgctactgcactccagcctgggcaaaagagtgagactgtgtctccaaaaaaaaaaaaaaaaaaaaaaaaaaaagcttactcatgtaaccaaacaccacctgttctccaataacctatggaaacaaaacaaaactaaagaaaaaaaacattgtttctcaaacttaaaaatgaaaagcaaacaacaaacaaaaaatatatggctttcttcaagtataaataaaggaatttcacaaacatgttacatatgtggaaaataaaattgcagttattcttattacaattagtatgcaacaaaaatattaacattttattgggaaatgctacctgggattaagcaactgcaaaaaagttgcagctgcccaaagtttgcctgcaatctgaataaagataacatttaaacaatacaattgttttattacttgtccgtttaacacctgtagtgattaagtgtccactctgtgctagatattagtgatatacggataattaagatactttgcctttcagtaggaaccaccacaatgaattgtttattgcaatcatttggtaagaactaaaactaggttatatgcaatgcatattggtgagaaaaaggaaaaaatcatcaactctactgtgctgagatatctggaaaacttcactttaacaacaggtagaaatgtaacttacaaaatgagttgaccaaggccccaaactaatctgccattatgatcttccatcattgcatctaatttcttgatggataattcacttaacccttttcctatttagaaaaaaaaataaaaaaggtgcagcttgttgccaatgctcacataattttacataaacacgctctctgagggtgaagcaaatctgattttcaatgtgaaaataaaatataaacattgttcttggaattatttctaagcagtactaacatcagaattgtctgaataaactgaaatgtccgttttggaaaacactggattcatcaaatgaatcttcaggcaacaactgtttgagaatgatgttaatgtcacccataggaatgctacattttctaagagttgacattttcagtgatcaagaattactatattttaccatgcaaaagctctttcgtttaagtcccagctatttatttttatttttactgcatttgattttgggttcttggtcatgaaatccttgcctaagccaatgtgtagaagggtttttccgatgttatgttatagaatttttatagttttaggtcttagatttaagtccttaatccatcttgagttgatttttgcataagctgagagatgaggacccagtttcattctcctacatgtggcttgccaatgatcccagcaccatttgttgaatagggtgtcctttctccacttcatgttttgtttgctttgtcaaagatcagttggctgtaagcatttgggtttatttctgggttctgtattctgatccattggtctatgtgcctatgtttatactagcactatgctctttgggtgactgtggccttatagtatcatttgaaatcaggtaatgggatgcctccagatttgttctttttgtttagtcttgcttagaccatgtcggctgtttttgggttccatatgaattttaggattgcttttcctaattgtgtgaagaatggtagtggtattttgatggcaattgcattgaatctgtagattgcttttggcagtgtggtcattttcacaatattgattctacccacccatgagaataggatgtgtttcaatttgtttgtgtcatctatgatgtctttcagcagtgttttgtagtattccttgtaggggtcttttacctccttggctaggtatagttccaaatattttaattttttttgcaacagctattgtaaaagaagttgagttcttgattctcagcttggtcactgttagttagctaggcacggtaacgcatgcctgcagtcccagctactatggagcctgaggtaggacaatcgcttgagcctaggaggtcaaggctacatgtagtgagctgtgatcgtgccactgcactcaagtggagagcaagtcctcaccagacaccacatcttttggggagttgatcttagacttctcagcctccaaaatggtaagaaataaatttgtgttcattatttaaaaaaataattaccaattttgttaatactaaaaccagaatgctataattagaatgatgtattttgccctcaaagtcgatatactagagcaatgcaaaaatattaataaaagcgtgatattttgtgacaaagttatctcagggcaaacgctgcagctgcaatcaccaccgatatggattctcaggcaaactgtaaaacggttaaatttaatatcttgcatattgccattatattattcatgatgttccctttgccttgaatgttcaacatctcctcactcctttgttcacctattaaaatcccaatcatcatttagggttcatttcaataatcccatagtcttagcagaatctattgttccagtctttgatctcccaagcacttgtgcaactgaagcaatagtcacatagcattagttttaattgtttacacacatggctcccttctcttgaatttttttcactcctgtttgttcttatatccctttaccccaatcatgcgatcatatacttatgttaaagtgagatcaatggaaattttttcaataaagcaacttctgagccacgatagtaagtcagcacaaagatagcatggcctatatctacaatactataatatatatgtacagattcaaaagtattctttatgatactaaacattcaaaagactggcattagatgctggaatatggtgaagtgttttataaatctcaaagtagacatttgaatatgattaatgaaatacacatatgactaaactgcaaatacgtgaacttgttaactcattgatgtgctacacaatactcaatcatcgtatttatttaacagggctagcccatgctctagccaacataaaaaggcttcagtttattgttataaatatgtatcctgttgggagcatgtagtacactccaaagggtaactgaacaaagaataatgaaaggaaaattgccaaaagtgtttcaatgctcctaggaccagctaggtatggggaaacataaaggaagtaggattactaagcaggtattatttctcctaaccctgacctatagccatgatgagagatgtggcgttggatagagaaatgcagtggatgtcaaacttctgtctagcaggaagggagcgagagaataaacaccgtgatgtttcgatcctctgccccgacctcttgccagtgttcctattggccaaatccactggaagccaatgagccacggaactcgtggcacagaccctggcgatgagcctcttgaatcacagagcagggaggagaaaggagaggacagatctgtaagagcgaagaataatattcagcgcatattaaaagtagtgaaatttaaggtttgtgttctttgttcttcgcatgaactttatttttttctgagttagcaatcttctccaaaattaataacaatacattcaggataatctagcccactgtatgcaaagtgtgggccatacacttttaagacacttttaagggatttgtgaggtcaaaattatttttatagtggtagtaagaccatatttatcttttacttgagttgtcatttgcacggatggtgcaaaagcaatgctggcagtaccaaaggcacaagcactaaccgtcctagtagccattacattcttcactgttaggatcctgcaagatgaagtgtttctctttagactgtcattcgcactgcagtaacagttactaatttcattaaatcttgacctctgagtacacctgttttttaatgacaagtatggaatatttgcaaagcatttctgctttagtacattggtggtttagaggaaaagcacttgtgtgatttagctgaaacctgaactcaccacttctttgttggaaaactgacaaaatatggttattcaggcttgggattttattagaaattttctaaagaaataaagcttttccctttgagctcaaaaactggcagtatttgttgatgaagatgaaaatccaaacttttaagcaaaagccagaattttgaaatagattcatcctttaccaggagcgggttagactcccagaattaaaatacttttcaaatgagacttttggtgatattagcatgtgatttttatattataaaatagaatttgtcaacatttggaaattctgcatgactcggaacactgatatttacaaaatttttaaaatttccagtgaataggattacaaaatcatgattatgcaatggatctggcagaaaagcaagacagaccaacggattttaacgaaaccaattcgaaaatatttaatgaaataatttcttataccacattgaaagaaaactttaataaattaccacttgtcaagttttgctgtagtatcacagaatatccacaattatctgaaagccattccttccttttccaactttcttcaaacacttcaaacaaaacatcatattgcaatagaaacaaatgtgtcatctattaagcatacattaaagaaatctgcaaactgaaaaacagtaacgttcttctgagtcaatattttcaagcaatacatttttcataaaataggttatttatgttagtatttactgggtttactattatttttcaacaaagaaaaattttctgttttaatttttaataaatatcaaagagcataagcaaaagttcttcagaatcctcaataacattaaagacttcaaaagggacctgagaccatcatgtttagaattgataaataaaaatttatatttcatataatattgtattaaaatttttattgttgcctgactaaaaataagtgtaattttatttttacattttgtgcattcaacatttcatgcatttaataaaaatttataattttaatataaggatttgtggcttttgtataatatcatatgaagtaatatctcaaaaatcactgacctatttcatagatgtaaagctagatgattaccgatttgtgttgtaaatagtttggcatataaaatctagaatttattcaaatagcctccgagaaattttatgagcattgtaatttagaatcattaagccataaactactttctcaaatggttacgcatggtaaataaatctttcctatcatataattgatgggtattttagagccaacgctgaataatattaccaaagattctaaaggaacacaatagctgttaatttcaaactttagcatgttgtaaaaataaggtggatgagaagtttatacctgcttaatcactaagaatcagttctagatgattaagttctaaaaggaatcatggaattctcttattttatatattcataattttagaagaaaaaggtcaatagagtgtatttatcacaaattataagtattacacacattttctgaaatggaaatctttagacatgttggtcttagacgtcataattcactctttgttttcacacccaaattatgatacttattattaattttctagggagagaaaattaatattatgccttactaactgaagagttcaataactgtggctctctctattcaattctattctagacttgtacatgcttggagaacctatggagtcaaacaccatgaaaaagcataaaaagtgttcctagagggaattaggaaagaaaaattgatttgtaatggaaattactgttgaataatttggataaattttgtattaaaatgtaaaccagtatcccatcagatatttcatgaggctaaaataagatttttcagtaatacttaattttaatttttttaaatctgagaaatagcttaaaatatcactgtaacattatattaattaataaatagaaaaccatgataattttaattataccttaacatcatattcttcgactcaaagccctattagcctgtcattttcaaggaaaataacattcttttaaatgacagagagtatattataatgatcttgtaagagaagtattctgttttcctttttaaaacacctttagaattcaaaaataatttttgtaaatctttgaagacatgagatgattataatgcaggatctttcacgaagcttcctctgcaaaggtttattacagatgccaagtactaaccctgcctagtggcaatattagcttcttgataacatcaaggaggaaaagattcgattcccctatgggctctgcctttgaccgtgatacatttgttaaagggaagaattatttgtagtaagaaaatgcatttaaaaatactgacttaggattttttgtaagatcattaggactttttattatatttttaggagtttttggcttggtattgttgctaacagtcccttgattaaagaaaatatatagaagaaagaaatatatatatatatatatatctcctcatggattttctggaaatttctatcaaacattaaaacaattaacaaattttacacaatttctactagaaaatacaagagtaaacattccccaattttataaatttaatattactcagatgccaaaatcagaccaagacagtacaaaaacagaaaacacatatcaatattcctcataagtacagacccaacaatctttcccaaaatattagcaaagggaattcgtaatatataaaagacattcaccattaataaacagggaggtttccatgaatgcaagcttagctccatattaaaaaaatcaatcaatataatccgtagtataaaccaaagaagaaaaattacattatcatatgaactgatagagaataaaattgacaaattaacacaaatttgtggtaataactcttaggaaacagaaattgaggggaactaccttaccatgataaacagtatctataggaagcctggaacttatattatgcttaatgatgaaacactgctttctcatcttttgggcctcctcacataattcagtcacattttcacagttaactattctgtgtccaatccattatattggtaactgacttaaactgctttccctaatatttggttcacggacttcttgagattacatattagggacaaaaaaaattttaactaaaaaaaaaaattagcctcataaatttaaccttaaaaacatttagccttgttgcattttgccataaatatgatttaggtccaactgtgttcttataagccagtgaatgtatattactttattttactcatgtctcattttttgataaaaactacaaggtgtttgtttttgtttgcccaagaattttttaaaattttttgcctatatgtcatagatatatgatatttttctatcaaaagatataaaagagctctatttgacttgggaaaaattaagtgcttcaacaaaatattttcttaaaaatatgctaaataattcacttctttgttcatgtagcttaaggaaatcttagataaataagttaattttgaatttggtgataaaacaaaaataaagtggtcttcaacattattacattttgtcacacttttttccgcctgggtttgttggccagaacacaatgaagtttccatcgtttcctgtgtgtttaccacaacaatttaactcttaggtttttattttattttaagagaaaaataaaatcatcactagcttcatctaatatctctattttcataagtcacctatgtgtaattgttaaaattgttaaataattgtccaaaaatataaaggcaaaatgattgttcatatacatgtatatatgtgtctgtatgtatatacatacgtatacacgtatatgtatatatgtatatacatacgtatacacgtatatgtatatatgtatatacatacgtatacacgtatatgtatatatgtatatacatacgtatacacgtatatgtatatatgtgtatacacatgcatatatacatacatatatgtgtacatatatgtacacacacacacacacacacgcacacacatacatgagtaagactaggggtttacgtaaatttcattagatctcctgttagtaagtctaagaaagtcatggagactttatgaaggataggctttgaaaagggggttttgtgtgtgattgcgttgactgagattgaagaagtatgatttatcatttttttctaaaaattaagcagtcacttcaggggtgcactgatacaggaccgaagtctggtcctctatgcttaaaactccaagattttcttccaatattcatctgctcttagtaaaaaatttacaatcagtttttattttaatttgaaaacttgtttctgtaaactttaaatcatctcccaaattacagattttcctctttttagtttctacctaatttccagttgtaggtgctgtctccttcatttaaaacaatcattttggccggggacagtggctcacgcccgtaatcccagcactttgggaggccaagacaggtggatcacgaggtcaagagattgaggccatcctgtccaacatggtgaaaccccgtctctactgaaaatacaaaaattagttgggcgtggtggcacgcacgggtaatcccaactactcaggaggctaaggcaggaacatcacttgaacctgggaggtggaggttgcagtaagccaagatcacgtcactgcactccagcctggtgatagagcaagaccccatctcaaaaataaaacaaaataaaataaaagataaaatgatcatttcatttctggagttagagttctcctctcaaggcttttcagattcatatctcaagggtttggctttgtacgcatctcaccacatgtaatttgcagttaatacatcaatgacttgtgctcttcttacttctctccttaaaacggtacatcattttgcttaactcaagtggtgactttctcctttaacttttttgtcagtttctatagctttttttaaccccacctctgactctggtattctgacctgacactgagaatgtttgtcttaaaggcctgggagaaaaatgtttttccagtatgatgtaattctttactcttggcttttctgacgtatctaaattgttctatgtaaccaggccatttcatattctcttactttttctgaaagccatacattcccctgctggggataacactgagtaaactgcccaaggccataaccagagacattcgaattacaaattgctgacttcatgctataaatagcttttcctgagatcactgaaacttcataataaaactcttcccccttgatatggtttggctgtgtcactacccaaatctcagattgtagctcacaaaattcccatgtgtcatgggaggtacctggtggcaggtaattgaatcatgagatccggtcttgcccgtgatattctcgtgataatgaataagtatcatgagatctgatggttttataaaagggagttcccttgcacacactctcttgcctgctgccatgtaagaagtgactttgctcctcctttaccttccaccatgattgtgaagcctcttcagccatgtggaactgtgagtccattaagtctctttttctttataaattacccagtatcaggtatgtctttaatagcagcatgaaaacaaactaatacacccttcttaatgcctatgtttcttacttgacagtacctgacactaaaataaaattaaattcacctggtgggtaagtttgacaatatgtaacaaagttttgttcaaattatgctaatggtcccttatatagagttgatactttctgctttaatccaacccagtgatctcagtgataaaatgctagttaatgactacagtaagtctcacccagtttctccaacatcttctgatttgtttcattgattgaccttaggttttggctcttcattcaaagccactgcacaaactaaatttgttttattgttgttaattattttttgtatcattatctttaagctctgttattattgtctgtctaatcttaatgaagcctgtttgcagatgacatgattgtatatctagaaaaccccatcgtctcagcccaaaatctccttaagctgataagcaacttcagcaaagtctcaggatacaaaatcaatgtacaaaaatcacaagcattcttataaaccaataacagccaaacagagagccaaatcatgagtgaactcccattcacaattgcttcaaagaaaataaaatacctaggaatccaacttacaagggacatgaaggacctcttcaaggagaaccacaaaccactgctcaaggaaataaaagacgatagaaacaaatggaagaatattccatgctcatgggtaggaagaatcaatattgtgaaaatggccatactgcccaaggtaatttatagattcaatgccatccccatcaagctaccagtgactttcttcacagaattggaaaaaacgactttaaagttcatatggaaccaaaaaagagcccgcatcgccaagtcaatcctaagccaaaaggacaaagctggaggcatcacactacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggatttcctatttaagaaatggtgctgggaaaactggctagccatatgtagaaagctgaaactggatcccttccttacaccttatataaaaattaattcaagatggattaaagactgaaacgttagacctaaaaccataaaaatcctagaagaaaacctaggcattaccattcaggacataggcataggcaaggacttcatgtctaaaacaccaaaagccatggcaacaaaagacaaaattgacaaatgggatctaattaaactaaagagcttctgcacagcaaaagaaactaacatcagagtgaacaggcaacctacagaatgggagaaaatttttgcaacctactcatctgacaaagggctaatatccagaatctacaatgaactcaaacaaatttacaagaaacaaacaaacaaccccatcaaaaagtgggtgaaggatatgaacagacgcttctcaaaagaagacatttatgcagccaaaagacacatgaaaaaatgctcatcatcactggccatcagagaaatgcaaatcaaaaccacaatgagataccatctcacactagttagaatggcgatcattaaaaagtcaggaaacaacaggtgctggagaggttgtggagaaataggaacacttttacactgttggtgggactgtaaactagttcaaccattgtggaagtcagtgtggcgattcctcagggatctagaactagaaataccatttatcccagcctttccattactgggtatatacccaaagggctataaatcatgctgctataaagacacatgcacacgtatgtttattgcggcactattcaccatagcaaagacttggaaccaatccaaatgtccaacaatgatagactggatcaagaaaatgtggcacatatacaccatggaatactatgcagccataaaaaatgatgagttcatgtcctttgtaggaacatggatgaaattggaaatcatcattctcagtaaactatcgtaagaacaaaaaaccaaacaccacatattctcactcacaggtgggaattgaaaaatgagaacacatggacacaggaaggggaacatcacactatggggactgttgtggggtggggggatgggggagggatagctttaggagatatacctaatgctaaatgacgagttaatgggtgcagcacacccgcatggcacatgtatacatatgtaactaaccggcatattgggcacatgtaccctaaaacttaaagtataataataatgaaataaaataaaataaatgaagccagctcttagatcaaagttttgaaatgactgttaatacctgtgggactaataaaactcaacgctggattccaaacaaacctgctctgaaaaaaatttccttctggcctctttgttactcaaatttggcccaagacgcttcactgactccattactttcccctgatgtaggaccagagaccactaggataggtccatctcagcacctaaggccaattaagcttgacttcaagacagttgctcagtggtgatgctttcagagaaatatcttgatccaaagggagaaatgtgaaaggtgattatattaattgtgagagtggcaggaggtagacaaatgcctaggcagattaggacgggtccccagtaaaactccaccttcaagccaaagtagcctgaaactcgcagcccaaagtggtaacttctattcctctttgccttctctctcccagttggttcattctaaacaatgtatttttactaatcgaatgttgccttttccaaaactacctaaggcctaacccacacctatcctttgcctataaagaccccagactcacttggtagagggaagagacagcttgacttcagaggagagacacctggactctggggaagagggatgatttaactttgaggaagtggtgactggactttaaggagaagatgacctgactttggggaacactacttaccccacctgcccccttctccagctgccctctccactgaaaaccatttccaccactcaacaaaattctcccccattaccaccctttgagaatcccatgccacctcattatccttggacatcgaacaagagctcaggacacattgactgtgggtacccaaaaatgctatcacaccaactattcatggtcactggcagagggcagcctccccaggtgatgtggcaaggggtcaactgagctgttagtctgcagacagtggagttaggagagtaatggaatactccctctggttctagccatgggttccacacagatcttgctcctgctggtgcccagagctgccagctggatcctgcactcactaactcatgcctgatctggccatcagccccacatgaagcttgctcctgctggatcctggagtggctggccagatcccacacacatttgctgatgtgctccctcctgcaaggggttgagtgaagcgagacaagtaaaagtttgtccctgtcatgagtctgaagaaggggacaagaaaaatcctgaatcagttgtgccattttttcgtacccaagtaagtcatagtcaataagtcagggagaaaaagcactcaggcatatataccaccagctccaataactgaatcttcagcaagcccagctgctgaagcagcctgctgtatccctaagaccaaatctacctagtagctactgaagtgacctgctgtgactctaacactggttttacctactgctgtcactcaccaaagcttaccagctcccaaaatcttctctagtgtcagtgagctttctttcaaaacaatatgtaacatttctgtttctaataaactcccaatcttctctttgtgggtctgatatatcaaagaccaccctggttggcaactttgttccaaatgacaattctctgattcccaaataaattgtatagagattcatttctattttgacttgaagagtggtaataaattctgatacaatattcagaagtttgttttccataacaatactaagtcaatttagaaaggcattttactgtgctacaaaatgcttaacttttctccttcaatgacattatgtacaattttgtcattaatttatatgcacttaaaaatcctgtataaggtttatattagatataattttgtgaggaagataaaagctcacctttccatttgcattgtgctgattcagactgtaattgagtcttcatgcaccctggtatatactaaagtactaaacaaatggatagtaaaaactaatacgtatatggaccattatagtgttatttttaaaagcacaaagaaaactattttaaaagatcacgaggagattatagcagatcaatcttcatattcattacaccaacgaaatataattcaacactagtttcaatatattttaccaaaagattaactttcaagcaaaagctttagatctttgaaagtaatataaacatgaaaatagcaaagatgcataattcatttcagcagttttccgagaaataccacattttccagaaaatatatgttcttagagtacatgaattttctttagtcaattaaaacaccaaccttctacaataggccaaacaattttcaaagcactaagcttatgttcactcaaccagtctcatggaacaaaaactgagattgagatattctgtttattgcagttcacacatttatcaagtaaagaagtcatcagtcaaaccaagatcttttcttgctaaagttgctgggatttccatggtgtttaatgcatgtttttttatttaattatgaaatcaaaaaaatacaaatcttgagccattttaatatgttacttgggtaaaaaattcaacttaatctttccaaacatctaatggaatcccaggcatagtgatttattaaaataccaagttaaatatttaagagaaaattaaatcactaataatgaaatgagttgattttctaagaaaaacaagtatgtaattaaggagtcagtaggagacaccctcaaaagcattacaacatttaaaagcaatcaacattacaactcttacgctgtgctttaaactccccataacctaaacacatacattcattaattatttacttgcatgatccacaatgaaggatgaattagaaaaaccagagtcattattttttaaatgacagtatttggtactgcagcaagaaaataagtagccagtggaatgaaagactccatctggctttatctcggcaatgctttgaagtacatgcaataaatgactttgcattgtttgatcttcttaatcctttacagccatctctttgagatgtcataatgcacaagttcattcagacaaaatcacattatgaaatgcaaatcacctcatatgacttatatggaaaatgtgcttgtacttacttgtaccatctcaagctctaagagcccaaacggaaatgtacatagtggtgaatttcctttctgaagttaaaatagtctgaaatcggggtgaaaaaatgatacaaataacaaaaatgtgtattctaaatgaaaattggaattttcatcgaaatagtagcagtaacaattaggagacaggagatggaatgtagatgctaagaagatatccacaagaaagcacaagactctaaacgctcttgctactaaaagagagattcaaggtttaccaactgcaatattctgctaccaagtacagcttgtacgtggccactggtaccgtctaaaatgaggatacatattaagaaatcatcaaaacgaactgcatggcagaaacttttctgatatcaagagatcaatttaactacagttatttacaggtgccaatttcctctggagtaaactgttacagtgggcctcatgcaccagttagataatacaagccacactttactgcacagaatcctggactatgcattttggctttgcagaattgagagcagaaatgtaaaaataggatagtgatattacttttgtctatgggaattgctgagtcaaataacaaaaatcatctatttgggaaaaacctaacttcatgattacactcaggcacaccgactattaatatgaatgaggtaacaaccataaatacaatcataaccaaagaacaacagtaattcaagtttcctcagttcataaatgttcttagaatgttttcttagtatgttaggtgctgttcccaagcctcagtataactccatgatcgccgttgatgcaaaggcaaacaccacactctcctcagttcaacgtctgccctaccagtctttctggcctctgactcttccctatactactatatatacatttgatatctacactgacatagctgggcgctgtacttgttgatgagaatatctcttccctcttagactaggcatgaccaaaaaagttaatctgggtccaaagattaatgagaatgaccactcagtttttattcaagatcaattttatttactgtgcaaacacaagttacattccagacaaacagatagaagtgaaaggacttatgctctgatgcctccttggctcttcaggatgcaaaacaagtcctgccagcaagtccctgcagcccaggcatagcaaaacattcggggaggaattgtgctgtacaaatgattttaccaaccttatcacattaagcagcattcaagggttttctgaccacaacttaggcaaatttcatgttatgctatagtaatgaacttacttgttctatttctaaacaaaacattgggttcacattggcctggacaaagctttccactccagtactatttacttgtccacttattctcaaaaatacaagatgaatgatgtgcaataccatggctgtggcacatgacttttctagacctggatcatttgtgtcccaatatttgactgattttggggtgggatgaaagcatgccttcagtttgtacttctatcatgcccattgctaccatacacttaatgacataatcatgttccaatgtgtcctcagaattactattcctagctggatatactaaggctttatatctaggtcagttcattgagtctgtgtcccctctactccctccatcgtccctccacagtatgaagcatcctcataggaagccttgtaagtagatctaaagatagaccccgcttggcctttcaccctcaaagatactcttcatgcattaaagtaaatttttgtcttccatttctgcagttgaccagatgctaattgtggccatattctaggcttaaactgagaacacctctactcttttggctttgggaacaaagtacctgatgtaatggaaggtccaagaactgcaactgagatgaattagtattggattcaccccacaaccttcttcaccatcgtaaacaaagtaagagtgaacaacatcatgtacaaaacttaacaatatagacaatataatgtgaagaatacaatgtagcatataatggtgcatatatttaatataatgcaatgtaatatgatccagaactcttttacagaagagaaaaaaactgtgaaagtgaaaatgaaaacaaaactacatattcaacatattcattaaaccagaaagaaaacaaaaatctgccaatccttttagacagagatgccatcgtgaatgtcccataaggccatggctgtgtgatgaagccaggctacacagaacccaaaccctcaacgagggtctctactgacaacttaattctctgtcagtgagtgcaattcatttcacaaccaagcatcgtgattctttctacaaaaacactctcatgaattcctaatcctgcaagtattgcggtatgcatatacgtgtttcatttcagcctccacaggagaattaacagaatgaaatgtagaaattggctttatagtcagcacagcccaacataaagggtcaggagggtaatgagcagtattgaattaacttgaaagtgtaagagaaaatgtctgtgttgaagtacagtcatatgccttatcgagagtgttccagtacctttggtaataattttaaagtagctataattttagttaaatgtatcatctggaaatcacaacctccagtgatcactgctattttatagaatcagaccaattttttaaaaaaagtatgaggatgtgtgccagtcagtaaaaccataccatagtgaccacttagattttaatttaacctattttaagattcttagaaagtttaaagctctcatctctgtcattatgatggatttctgtgccattgctacagggcaaaatcatttggaggagagctctgaagtacacactaaggacagaattacctgggcttcagctctatttttcctgatatgtgtattctcttcaaggatactacaaaagtggtatttcaaatccctctagcaacatccactgaaatcatcttggggcagacagaatatggtagatttatgaatattcataacagcacatggcccattatgattcaatgtgctgtgcaaaatacagctgctttgctccaaaaccaccaggagagcagagggtacttgttttaagtggtccccaaggtcaaaaccagttagcaatttcatagttaggaaattattcatctcaccttacacgttaaaagcagggtttcctttaaagtattcagggatatataaaccagcctctctcttttctgctaaccgtaaaccatttgaagagtgatgaaaacaaaaatagactctgtaggaaatgtagctacctttatgttctttatttttctgtcctacgttcatttttgatgaaaatttatatcatgaaggttcagtgatcttagaatagaaaagatgcagtctgtcatcaatctattgttagcagtgaaatccaatcttatttcagggtacagtgttactgagtggaaatttcattaaactaagaaacagacggtctccttatagtttacatttttgcttatgtttgagaaggctaccttttcattttaaatgtggaaccgaataatgatggcctgttctttagttttaaaaagagacaaaatcaagagattgagaatacaagccacaaactgggagaaagtatttgcaaaagacagatctgataaaggactgctattcaaaatatacgacaaactcttaaaactctatgctaagtaaatgaacaacctgattttaaaaatgggcaaaaggtcttaatacacattgcacactgcatgatatacaagtggcaagtaagcatataaaaaatgtccaacattgtatatcatttaataaaatgcaaattaaaacaagttacatcttattagaatggccaaagtccagaacactgacaaccccaaatactggtgaagacatggaacaacagaaactctcattgattcctggtggaaattcaaagtggtgcagccatgttgaaaggtagtttaatagtttcttacaaaactaaacatagtcagtttacgatccagcaatcatactccttgttatttatacaaatgtattgaaaacttatgcctacataaaatcatgcacatggatacttataacagctttattcacatttgccaaaacttggaaataatcaagatgtccttcagtagatgagtggatacacagggacacatccaaacaatggaatgttattcaacactaaaaagaaataagccatgaaatgaaacggagacaacttctactaagttaaagaagtcaatctgacaaagattacatactatatgatttcaactatatgacattctgggaaaagcaaaactatggaaaaagtaagattagtcactgtcggggggtgaggggagggacgaattaacaggaagggcacagtggatttccaggacagtaaaattattctgtgtgatatcgtaacggtggatacatgtcatgatatacttgtcctaactcaaagaatgtgcaattccaagagtgaatattaatgtaaactccagcctgggtgacagagcaagactcgatctcaaaaaaataataataataataataaaataatgactctcagtaaatatatacatcctgggcatgcatatactttttaagtagttttatctttaaagatggtttgtaaacacaaagattttattttgggtggttatgatgttccatggcatgttcactgattgtaacaaatgtacaactctggtaaagggagaggttttatgtggaggccgggagatagggtgtatattggaactctttttgtgttcaaatttgctttcaatcaaaatattctgttaaaaataaaattaattcaaaaggcaggaagcatgaaacattccgtataaaaagaagagtaaggggccgggtgtggactcacgcctgtacaaatcccagcaccttgggaggctgagacagctggatcatttgagatcaggagtttgagaccagcttcgtcaacatggtgaaacccagtctctaccaaaaatacaaaaattagctgggtgtgatagcacacacctgtaatcccagctactcgggaggctgaggcacaagaatcgcttgaacccaggaggcagaggctgcagggagccgagatgagatggtaccactgaactctagcctgggtgacagagcaagacttggtctcaaaaaataataataataatgattctcagtaaatatgttatatacattatatacatcctggacatgtatatatttttataagtggtttaactttaaagatggtttgtaaacataaaaattttctattcgtcttcattgtgagcagcctatgtctgaagctctgtctaacattaagatacattatgcactctaattaaagtttatttaaagtcaataatttcttttcaggaaaaaacttccttattactttctggaatatttgcaattgaaataatcaatttcccataaacgagaatttgaacaacaagacatttttgtttattttgtctttttcttgtttgggtactaagtgtctcataacacattatttacaaataagttggattccaaaactaaaagattgacataaaatctgcctgcagggagaagaaaaagaagcccaaattgtcagtcttcttatcggtcccccagtaagaaaatgattgaaggtggtaacagaagaaagaatcttaggagggaaactgcaaatattacctgctttacattcttagtcaaaattcagaatttaagcagcatgctaatccctacagatttttcagtttgggcaaaagcgagaatgttctcatctttaacaatgttcagaaatgtcacaagactactttcattcaaaaatctactttgcaatggttttctaaatggtttccaaaaattctgtcagtttttaaaaagagtgattcttaaatacacagagctttaaatacagaactgtctcctaaaattattttctcttgatttgacattctgagtgtcaaaatgatttaacataaattaccagaaatattcttatattgtacttggttatttacacattaatgacagtgacacaaaaaaaaaataattgtttttaatgaatctttgtgaacagacactaccccaaaaggatattgaccttccagttgctatctacgatgacgtccgcagcaagaatttggggaatggccatttccttaaactctggatggccttaatgcaccttcagatattctgtgtcagatagtaagagccaaggtatggtggcaggatttctaatatgtaggttaagaaggttgattggtctgctttaccagtaggagaatctcattttgggtagtggagcatttaaaagcaaaacaaatctggactttaggaactgggaagacttcattactgtaaatgaagccaacacgggaaacatgctaccttaatcctgctgaggttaaacacttctaacaaactgtatttagttcaggaaaaaaccttcactgaaaatatttgatagtcatttcttaattgtgcctcttctcatccgttagataaatgaagttaacatttaattcatttaatgaattaagaccaataccagtaaaataccaataatctatattagggagttaaaaaaagtagatagtaaagttcatacgtaaaaacagatacgagtagctcaaaaacactgtaaaagaaatatgtgaaggaaaatttgccctaaaaggtaaaaacaaatcaatttgtataataaaattagcatggtattgatacagaaatagaccagtgaaatagaatgggaagtctctaagaagactcatgtgcaaatgtacctttgtataaaggataagtgacatttcaaatcactaacataaagaggagcttttaacggagggtgctggagcaactaagtagccatttaaaaatattaaggttaaatatacatctaacatcatacacgacaataaactccaaatggattaggcatatacatgtaaaaatgaaatcatacaagtgctaggagaagagatgggtagatttgtctttgaagttggtgtaggaaaagtattcctacggataactcaaacacagaagcaatcaaatagaagattaacacatctgactacacaaatcttttaaaaatgcatgccaaaaacaccacaagagcagtcagaaataacttaataagagggagaaaatatatgtaacatataccatggttgaagggctaatattcccactatatagggaattcataaaagttaagggacagagtagtaaagcttacatagaaaaaatggaaaaccaaacatgatcagacaatttataaattaatatttcaaaatgaacttcaaacaggtaaaaaagtaaaaaatcatagttaaggaaatgtaatttaaaacataactaaggtactgttttctatttattatataggcaaaaatttaaactgtcctagttggtgagtctggataaacaggccctctcacatattgctggtagaaatgatcatcagcctcaaagtgttgaagggacatttgcatgcatacacacacacacacacacacacacacacacacacacgcatatacacacttctctttcctttcaatagatagataatacacagacagattaggtagatagatagatcgatctccattcttgctttctgacctggaatcccacttctagtaatctactttaaaagcataccccaataatatggaaatatatatgcatcagatcatttgtgttttatttgcaatcacaaaatattagaggcaatgcaaatgaccatacttaggaaagtggttgaataaattatggcacatttacacaaaagagttcttggcagtgttaaacaagaatgaggacaggctctatggactgacatgggttcatatgtaggatatattattgtgaaaacaaagtaaagtacaaaagagtgtttgcagtatgctacctctcatgtgaaaaaggagtttacatgtttatggttcaatttacatgaaatgttcaaattagtcacatttatatacctaaagtagatttgtagttacctacagttggaggggaggggatgcggagtgactgttaaatggctacaaggccattttggggggaaggtgaaaacgttctaattagatcatggtgacgcttgcacaactctgctaatacaccaaaacctactgaattgtatagaatttgcagaggtaggacacgcacggtggctcacacctgtaatcccaggactttgggaagctgaggcaggcaaatcacctgaggtcaggagtttgagaccatcctgaccaacatagtgaaaccctgtctctactaaatatacaaaattagccgggtgtggtggtgcacgcctataatcccagctacttggggggctgaggcgggagaatcacttgaacccgggaggcagaggttgcagagagccaagactgcaccattgcactccagcctgcgcaagaagagtgaaactccatctcaaaaaattaaaaataaataaatagaatttgcagaggaaaagttcatgacatgtagatcatataatactaataaaggtattaaaatttagaaaaagaaagcagaggacttaggaaaacatgcatgtatctgatcatttgtaccaaagaaacacaaggaggacaaatcagactttaacgagattggttacctattgaggggatggagatatatgagaagagtgaaaagaaagggagaaatgaatataggacagttggaatgaaaaggaactgtatcgcacttttctgaatatacatgggatatagtttgaatatatgtcctcacccaaatctcatgttgaattgtcatctccaatgctggaggtaggacctgttgggaggtgtttagatcagggaggtggatccctcgtggcatactgctgtctttgtgatagtgactgagttctcataagatctggtggtttaaaagtgcgtggtacctcccctccaaccacactctctctctcttgctttttcagtgtcacatggctgttctcactttgccttctgccatgattgtaagccttgtgaggcctcccagaagcagatgcttccagtggggctgtgggcgacaagccacccaggcaccgaggcaagagacagagaacacgagctgttccagtataataaaatataaaacaagaatagttataccagatatacctctcagatatgattatatatgaatatcattaatcattagtttgtagcaattactttttattccagtattatgataatcctcgctctataatcatagcctaggaaaaaccaggccatacagagataggagctgaggggacatagtgaggtgtaactagaaaagagtgcgagccttctgttatgcccacacagggccaccagagggctccttggtctagcggtgacgccagcgtctgggaagatgcctgttaccaggtggatcatggtccagcggtagcaaaaggtgtcaaggaacaacacccgctacttagcagaccgggaaaagagggggtctccctttccctgggggagtttagagaagactctgctcctccaactcttgtggagggcctgacatcagtcaggcttgcctgcagttatccggaggcctaaccgtctccctgtgatgctgtgcttcagtggtcacgctcctagtccgccttcatgttccatcctgtacacctggctctgccttccagatagcagtagtaaattagtgaaaatacaaatagtccctgatatgcagaaataatggggtaagctgtctttctctttgtctcctctccctctctgcctcggctgccaggcagagaagggccccctgtccagtggacacgtgacccacgtgaccttacctataattggaggtgactcacattttttaccctgccccttctgccttgtatccaataaataacagcgcagccagacattcggggccactaccggtctccgcgcattggtggtagtggtccccggggcccagctgcctttcctcttgtctctttgtcttgtgtctttatttctacactctctcgtcaccacgcacagggagagacccaccaaccctgtggagctggttcctacaggggcctgtagaaccatgggtcaatcaaacctcctttcttctaaactacccagtctcaggcatttctttctagcaatgtgagaaaagactagtacaatgtgtttgtatagttatgacttttagaactatattactggttcacatacttgaaaaatgaataaataaaatcaaccacaatgtgtggggaataaaaaattaaatacaaatattttaaaaaatgaaactagctatattacaaatgaaaaacgtaagcacacaaatatttgggaaaagagtgaactaccctaaataacttcaggaagcagtactttttactggatatcataatgccaaagacaaaaatgaccgtaaacaaatattgaactccagtaagtaaagttgtttctcacagggttatgcgtaggtgatgctgaaaccacatgtatattaggattaatcaaataagtgaatgtattacagataatgagatctaggtgtctcaatagtgaggaaagaaattttaaaaagggaaagtcaaaagaaacaccatgttggtggattctaagtagagttgtcagtatggactcttggttttaaaaatacagataaatacatagataaggaaataaataaagctgtgtagcaacatgtggactaggatctctatctagcaacatatggagtagtatctctatctatctatctatatatctacctacctacctacctataatctatctatttcccagctctgtctgctaaaagggcctagtagcaatgataccccagaagcaatgaggacaccaaacacagagctcttggtttaaaagtatcattctccaactcaaaacaaacaaacaaacaacaccattaaactagagcttcttggagaagttgctgatcgagacctagggttaggaaaatatgagatgagcctcgaaattaaggttcataaaaggtaaggaaatgtcaaaaggacatagtggccaacttgacagagatttcatttgtcaaactgggcaccctctcatcagcaaaattaataaagacagtattggattataactcataaatgtccattagttggttataacttgcataaataatggaatagatgaataattctacatggatgaagctggaaaccttcattctcagcaaactatcgagaggacaaaaaaccaaacaccgcatgttttcactcataggtgggaattgaacaatgagaacacttggacacaggaaggggaacaccacacaccggggcctgttgtggggtagggggatgggggagggatagtattaggagatatacctaatgttaaatgacgagttaatgggtgcagcacaccaacatggcacatgtatacatatgtaacaaacctgcacattgtgcacatgtaccctaaaccttaaagtataataaaaaataaaataaaaaataaaaaaagaagaaaaagtgttctaatacatatagaaggcagaagggagatacgaaaatcaagtatcgttaatgcaggcaagatctattgatagatgctaatgtgagtaaacagaagtttgaggagaagcaagatatttgagtagtctgaaagtatctatctcaagacatttattaattatacaaggacaaaaacagtaactttatagtagagaaatgtagccaacaaaactgtaaggaagtaatgatgcttaacaacactagtaataaaacatgtatattttgtaagtcctaatatgatacactgaaaagggaacactactatggtattctcacatcctcaccccaaccataagtaaataaataaaagcaaggaacataaacgcaatataatcaaaagaaaacatcagagaaccccaaattgagagacatattttacaaaataactaaacagtattcctaaaatgagtcaagccataaaaagacaagaaaaaactggagattatgccataaattgcagaagactgagacacaactaaacagaacatggggtatggatttatatcctggtgaaaaaagagaccttagtgggttaagtgaaattcaaataaggcatgtcacttggtcaacagcatagtacctatttaattttgctaaatgtattttgattatgtaaactgctaccattaggagcagctaggtgaagtgtatacatgaattctctttgctaactttgcaacttttctgtaaatataaaattatttcaaaataataaacaaaaatatgaggtactttttactacacattttgacaatttaaaagttaagcaaataaaagggaatgaaaactgtccaagctaaaagagttattcatccatgattgaaaactcaaaagcctaaattcagaaaccactgtcctaaaacattcacacgatatttaggataatgaaggcatttatcaattaaatttatcaatatacaagaaattgtatattaactggagagcagttttcactgggtgtcagtgctcacttgcagggtatggaaaggcagtgggacgatttgtggtgccccaaaattactttaaacattgacagtgggagagggtcaggcatgcaaatagctcttcagggcatagaaagatgtgcataataacaagaaatgtatctaaagaccaattgagtaatcaccaactgagaaataccaaagaacagagagacgaattccaaatccaaagaagtagattttgtccctgctttgccttgtgtattagatcaagaaagacaagtgtgtgtagtgtttcaaaaggtacaatagcaagatgcctaactttagagctaattgtcagatgctaaagttgggagtctaaaatttgtattcaatttagatacttgtttgagacagtattgttaattattttattttaattattccttaatatttaataaaatgatagctgatactttcatttggcccatattctcctgttaaaatcagacatctataactgaatcagatcctgaacctagattttgattatttaatctgaatatgtttcccataggaaaatgttactttttcttctcatcccatagcacttggagaaagcaccacaccaccctgagaaaagatatgaaaaggaattcagggtgccttggtgattcagaatgctatcctcatccaatcaggttccttcgcagggctgctgtctgtaggattctctgtcagctcccatcaaaagcatctcctacattccttgtagacacttccctcaatagtgataacttgttttggcagtagtcctatgaacagctagtcccacaggaaatatcctcttcaactgaaatggcttctattcagaacaactcttagttttagcattctgttctatacacaatgaatatagcttaccccagttatcactccaaccaacattgcaatatccccaatgtctctcacctccttacacatgtgtaatttctttcacagttaacacttgctgctcaaaatgggtactgtagagccttttagaaatgcagaatctcaggctctatactagacctactgaattagagactgcactttaacaaaatctccaggtgattgatttgaccattagcttgacatgcactgacctagacgaatcagtatggcagtttcagtaccatatttaaaggccagctcatatccctgaggagtttttcagtgacagcctgctgcaaaactcttctacaaaccatgcagaaagactttagactagcaagatattcaacgcaaagtcctacaaaaataacttacatgtcatttaaaaaattgctttttaggccattataaaaatatttatgatttcacttcttataaaaaaattctgaaagctgccatcacaaaacgtagttgcttgcagtacactctaagctctttcaggaccaatgcacaggagttattgagacagctggacataacatattgatttgggaatactgtcaaagatgttgttatataatgcttccactttctgaaaacgttttaatacttagtaggcatttggaaaagactttcaaaaatttacctcattcaattattaattatttaatatatacaacagatttacttccaggcagccatacttttattatctccttaaaatatcattctatattatccagaataattgactcttctcatagacatgttttaaatatttaacattgtgacactcaattgcactctatccaattggaataataattaggatttgacattaaggaatttgcacttttgtgaagaagacctaaatataagcaactaactatactaaatggaaaaaacatatagaggtgcaagaaaaaaaaatggaacacacaggtatttatgcatttacaaaaattccatgtaatttgtgttcctttttattattttagtaaaatttactatcttaaatatttttaaccatactatttagtgttgtttagtacactcatacggttgtgctactatcattatcgtttgtctctataagtcttttcatcttgcataactaaaactatacccattataaaactatgcctcattcgacccaattttttgacaacattcatctttctgtaccagtttttaaaaattctgtattctattccattggtctatgtgcctatttttgccagtaccacactattgattactgtagctttaaagtaagttttgaaaccgggaagtatgaacgcttccactttgttcttctttttcaagcttgattgtgctctttggggtcccaggacattctatataaattttaggattttgttttctatttatgcaagaaaaagtcattgggatttggataaggatcgcattgaatctgtagatcatttggggtaatactgtcatcttaacaatattaaaccttccaatccatgggcatagaatgtcttttaagaatttttttttgagttttctttcattgtacaaatgtatcacctccttggttaatttctatttcattatttctgatgctattgtaaacttaattgcttttgtaactttcttttcaaatggtttatttttaatgtataaaatacaactgattttttgtgttgactaatattctgctactttgctgaataggtttattaatcttaaccatatttttgtggaatctttagggctttctatatttaagatcatattatctgcaaaaagataattttgtttcttcctttccaatttgtcatttatttttacatatttctctggttagaatttctaatattatgttgaataatattagaatggaatctcatgagagctcaaatagccaaaaaacagcttgaaaaagaagaacaaactgggagggctcacactttctgattttaaaacttattataaagatacagtaatcaatagtgtagtactggaataaacacaggcatgtagaccaatggaaaagaatacgaagtttttaacaagtggtgtaaaaaaaaaaaaaaaaccctggatatccacatgcaaaagaatgaagttgaacccttacttaataccatatataacaaaattaactaaaaattaatcaaagacccaaatatgaaatctaaaactataaaatttttttaaggaaacattgggcaaaaacttcatgacactggatttggtaatgatttcttgaatatgatactaaaggcacagacaacaaaacaaaacacagacaaactgtattttgtgaaaatattttcaaaaatgtgtaacaaaaggcactatcaggtcttgttcttgacctaaaagtaaaagcatttagtcttcaaccattaaattgatgtttgctgtttttctagacagcttttattatgttaaggaagtttccctctactcttagttttttgagttttttattatgacagtgtgttaagtcttgccaaatgtttgtttgtttctgcatcagttgagatgatcatgtgtttttctgccttcattctctttaggtggtgtgttaccttgattgacttttatgtgttgaaacatccttgcatccaggaataaatcttattggccatggtttgtaacctttttaatatactttttaattcactttgctagtattttgttgtggagctttgtatcaatgttcataaggaatacttgtctctagtttttgtatcttgtatttttgtcttgctttgctatctgggtaatgcttaccacataggctgatgtaggaaggtttccctcctcttcgacatttgttaaagtttgagaagaattgatgttagttattctttaaattttgggtagaatccactggtgaagccatcaaatctggggcttttctttgtcaggagatttttttttggttactaactcaatcttcttatcagttataggtctattcaaattttctatttctttgtgattttgtctttctatgaagttgtccatttcattaaggttatccaatttttagttcacagttgcatgtaggactcttataatcctttttataactgtagaatgggtagtactgtctccaccctcaattctgattttggaaatttgagtggtattttttttttttttttagttcatctagctgtttgccagttgtgttgatcttttcaaagaacctaatttgtatgttgattttctttattttttattctttattttgtttatctctgctttagtctttatgatttcttcccttctgttacttttgggtttagtttgttcttctttttatcattctttaagttataaagtttgtttattgacttgaaacatattttgtcttttaaacatttataactataaatacgccatgtaacactgattttggtgtattctttaagttttgctatatttctatttccattcacctctaaatatttttatatcccttgtgattttatcttttgatcattggttgttcagagttttttaatttccataaatatgtgaattttcctgtttctcttctgttattgattcctaatttaatgccattgtggttggataacacactttttatggtatctatattttaaaatatgccaatacttaatctgtgggcaaacatatggtctatccttgaaaaagccccatgtacccttgagaagaatatgtattctgcttttgttcagtagagtgttccatatatctctattatatccagtttattgcattgttcatgtcccctaattccttacttctgatgtttctccctattattgaaagtagagtactgaatcttcacctatttttgtacaactgtctgtttgccccttcagtcctgtcaacttttgcctcatatgttttgatgttctgctattaggtacataaatgtttatagttattaaatatttttccagtattggacattttagtagtatataatgtccttttcttgtggaaccttttcttaagaatctattttgtctgatattagtttaactatccgtggtattatttgcatggaatattattttccacctttcactttcaatctatttgtgtctttggataaagagggagtctcctgtacagttgcatcatttttaatccatgtacatttaagtaattactgataagaaaggattaatttctaacttctgtgattttcttttctatatgccttgtagcttttgggtcttttctttcttgtattactgtatcttttatgttgattttctgaaggaagacatttaaattcatatctcattttctttcatgtacattatttagccattttctttgtggttgccatggggattatatttaacatcttaaagttatagcactttaatttgaatttatatcagcttaacttcaataacgtagaaaactctgctcttttgatgcctctgtctccaattatttcagttgttgatgacacagaattatatctctatacactgtatatccaaaaacataaatgatttttaatacattagtctcttatgaggaaaacaaaatgtaagttacaacactaagttacaataacaccagctttagactaataagtttttaatgtatttttctcttaaatcatgtacaaaacaaacagtagagttataaaatattgttaaaataatactagctttcataattgctcacagtttatctttactgatatctttatctcttcatacggctttaagttactgtccagttttcttttattccaccctgatagaatcccttgagcatttcctgcagagcaggcctagtggtaataaacttattcaccttattcagcttttctttatccgagaatgtcttaatttctccttgactatcaatggacagtttgttggataaaggattcttggttgccagtttttttgtttgtttgctactttaaatatatctgctcaatgcgttgtggtttccaaagtttctgaagagaaatcttctgtaatgttattgagcatcctttgcatgtgaagagtcacttgtcttttggcttccaatagtctctctttgtctttgtcttccaaaggtctagattataacatgtattgaagtgagagtcttttagtttattatacttggagccactgagctccttggatctttatactcttgaaaattcagtgtcattatttccttaaacataatttctgtccactgtatccctcttcatctgggactctcacagtgcacatattgctctgcttgatggtttccctcatgttccttaaatttttttcacttaacctccatcttttttctttctattcctcagactcaataatttccactgtcctgtcttctagtttgtggaattttttactctgcctgctcaagtctgcttttaaaatcctctaataactttttgttccagttaccgtagttttcaactctaaaataccttttgatttcttttaggtttctatattttattaatattttcattttgtttatacattgttttcttgattttctctatgtcttcctttaatactctgagcatcttgaagaccagtgtattaaaatctttgtctcgtggatctgtcatcagattgttttcaagaacagttttttttatttgttcttctgaataggtcatatatttctgtttttctgcatccctttagattctcctcacttcctcgggttttactggtttttgtttttgcttatttatttatttatttttaattcttatagactcttcccttttagtgaattagtcttgaggtgtaaacttaatgttttcagaagtcatttctgaaactgtgacttctcctggacattcataataactttgtaatttttcccatatttgaggttgcttctgaagatgctagtctttaatacctggattccaaaagtttaaaaaaagagaaaaataagtggtggggcactggcccttttaattccgtgaaagtcacttcagctagtggggaagagctttcaacaatgggggcaagtgcaaaaacaatggccattgtctctttatctgtacttctataatcagaagcaataatcaccaatctgagcacaaatctcttatatttggaggacagaatcctttttgccactctggttccctaaaactgtgtgcaaactgcttcaggaacatacaggtgcctgtcatgtgttgagggctctgagatgggtagttgctactgtgctacgaggagcaatcgactgaaattaactacaatttaccatccaaaccttgttccagaaattgcaagtctttaatagacatcagaattccaaagtagtaacagattctgacagtgtaattattctctagttctgaaggcatattttcggtccttcctacacttccatctttccagaatcctcctcatgtgcttgcttatgacatataacactcctagagcaagttacatcatactgtaatagtatttaaataggcttttgatgaaaatgacatcttcttaaatcagatcctactgatgcaaagtcattctctgagagtaaactgcacacatgctaaagattatgtaattcccttttctggaaaatgtaaaacatacttaaatattattttgaaacaaataatatattagaacacaaataatttaatattgaccatttaatatgggtcaaattagttcctaagtgttaataaaaaatgtatggcaaagacatgctaaacatacttaattcacaacacattttcacttacattttttcaaagaggtggcacatcgcttatgagtttgggtttaatgatcattccagttccatcactttctagctacattactttacataagttgtaatgtgattttgattgagttcatcagcataatacagatagaatgatatatacagattgggtgataggcatcagcagtaatctatttcattcactagatccttcaaataaattagaacaaaaaccatatgaaaatgactacccttatctttagagcacaagcataaagaagtaaacttttatgatatggctaatatcaatttattttaaatatcttgctctaataataagatgttacctttcaggaattattttgcactctcaaaatttttattcaatgcctctttttaaaatggcttatagctgtttcatacatgtctgatcttatcttctagtttattagatcttgagagcaaaggtggtgcctcatctaactccacaatattgaatgtgcagcaaataattgacttaacgtatttaaattttgagttaaatgaggatttaaataattatccattttatctttctaatgccacagataaaccgtagacactaacaccttaagtaatttattcaagttcatgcaaatttttagagaaaaacataaaaatcagtttctcctagactttcaattcagtaactctccataaaattagcctgatgattttcaaagtacattgaaatataacaagcttattgtgcccaagtaacctcagataaatcaagctgcccatcatctaacaaataatgaatataaagtaataaattgcattatgcttaacatgtattaggcctcatgtatacactaactttacatacattccattgccatcctaattgaatctactgttatcctgccttgtttccactataataacctactcacttgtcctcttgcctcctcttggcctgtttctttctaattagttctccatgccacaaccaaaatggattatttcaaaatgaaaatccagcaagtcaccaccaccacttttcctacccctccactttttgcttcaatggtgccctatcatttctaaggaaaaacatggcttttaaacatccttatgacagattttaaatttcaccatcttactactacctatacagaaagacaacctcagcatcattgacatgttgggctggataattctttgttgtgaagggtttttgcattttcctatttaacttttactttcttcagatatgaccttaaatacagcttgctctggagatctcagtctggtctacttgttgtctcaaatccaatccctctcacatatgcatggaacataccaggaatctctccttcatagcatatgtcataattgtaaatctatatttgtgtgattatctgataaatgattgtctccatgagtgtggcattataaaatgcatttgtccccatttcctggcatacaactcctaaaatccttggaatctttgaagtggtgtctctttgtacgctactgatggaatgatggccagtatcccttaggtagcttcaggatgggacttgtcaccagaaagaccaaggcatgattagagggttagaactttcaacctcacccctggctttcagggaggagatattggctaaaggttaagttaacggccaatggctgatggtttaatcaatcgtgtctacataataaagcccttataaaaacccagaaagaatgtcttaggagagcttctgaagagctgaacacatggaggttcctagagagggcatggaagctctgtgccccttcccatatatcttgtcctgtgaatttatctaattcttttgtaatatcctttataataaaccagtaaatgtgtttatctgagttctgtgatccactccagcaagttaattgaacccaaagatgggttgatgggaaccccagcttgaagctgggttggtcagaagttctagatgtctggactgatgtctggcatctgaagcagtgcagtcttgaagactgagcactcaatctgtgaggtctgatgctgtctccaggtagacagcatcagaactgaattaaaagacaactggtgtccactactttatatgtgggaaaaacttctcgcaacgtttggtaacagaaatctatgctaatttttgtgtaagaaaatagaaaaaaaaatgctgagttttgttttttctgcacacaatgaggttatttctttgttttctcctcactcttttataatctccagtgcctggtcaatttgttggcacatagtagcacttaatacgtgtagtaagaattaagagatataatttattcatctctatgaggtagatgctattattaatttcattttaattaggaaggaacaaattcttataaatgttgcaaaatttgtcaaaagtcacaacttaaaaaaatagcacagcaagaattaaagttatttaattccagacccaatattcctaaccccagttttcttggagaattgcttgaaaaaatcatgtttaggaaatgatttttatccatttattttctgtccaagtttatttctgagcacacaataaagactaactatatgacggttggagataatcagtaattaaactaagaacctttctgatgcagaacggagatgaatacataaaggtatgtataaaaagtgccaaatgtatgaaatcactctcttggaaagacctcaaaagaaagtcattcgaactcgagttcctagaaaagattgctttgccatagtcctccactgatatcaaaataggcagttctttgtgtatttagacactggcactgagacacaataagtcgtgttaacaattttacttgcttatcagatctttagtaagcttggccccaggcacaatcatcacttcatcagtaccagtaagaggcgctaccctaagttaactgaaggagtgccatcaagaaaacctgctttcatttatttgaatactttggaaaaaaacacattctcagccagacactttaattacatctaattaatgttattttttctaatgcttgcctttaaaaactcaatgttttataacttgggctttcttcctaaatgtaacattgactaaagcatggcaatttaatatttgtcaaaactactaaatggttcagaatatagacaatctgtgtcattgtagaatgttattgtttgactcatgtagtgtactcattatcacataatagtgaataatttgcagtgctgaaaaatacattaattagcgtatgcttataaatcatacttatagaaatagtactattgtactaaagatgctcattaaacacctgtaatatgtatgccacttttctgataacagccacacataccattccaatgatatattttatatatatatgaatgatacaacatccaattattctgatgacatatacaaggaagacatagtctctgggttgagtttctcagtggagactgtgttcccccatatgaatttcctcaaataaggattccttttgctaagaaattattcaacgtatcctataattattaccaactccctggaaaagtaatttaccacaaatgtcacatcagctacataaagctgaaagccaatttaatatttactaaatattatgaagctattcaataaataaaaataataatttccgtgcccatttaacagcactgaatttaagaaatcactccaagtgttaatttaaacatgaaatacatatctgccaataattgctattatgacgattctaaataaatgaatagattcacttctcaggcattttactaagggttccaatgaatatcgtatctatgtcaaagaaataatgacaaataaatacatcatcatctgagatactgagacatacccacagttatataagctgaatttccgaatctcatttgtttacctctgtggcagttaataaataataataaaatcttttattatttctcctgtatctgtaagactgttcctaccaaactacatttctcaaataagaaatttgcttctctggtttttgcaattcagcatttgatcataggtcttactatatgaattttaagagttccaattgtaattttagaagtgacctttagttggtttgtgcagcttaaattgtgaattaaattctcagtaatctttttgaaatgatggaaaaacatgaatcttgtttaatatctttatttaaaggtaaataaggtttaattaaaggcttatattttatttaagaaagctgtttgttcatggttttaactagattgaaagccagagaggtatttacccaatcaatacctctgcagtaccattcacagacctaccataccattgtctttgagtctgaatagtggtgagttgatgaactcaaggcttgatatttatatattcactttgtacttacttttatcacttagaatgtgatacttttaacacacagaaagacccaaagtagtttcatgataattatcccaaccatatactgggatatcattacattataagaaaactcaatattgatgtttaagcgtgcagtggtaaatgttttcccatattgcaaggatcctcttccattctactggtctcaaaaggcaacatgtattgccctatttaactgggagaaggaatatatcagtattaaaatgttcctcctgtatacattcaaactttattctatacaaatttgtttgtgtatgtagaatagtttaaaaactaatattgtacctataaataactctttataaaaatgtttagtttttatttcaaaaacaaaaaaaggttatattatcaatgctaagttatccctgaagacaatttaacaaatagttctcaccctaaaccacaaaagttacccccatcttcttgtgcagtttttcaagaactgcaagacccggttggtgttaactgatggtgaagtggtaatccaagagtctttgtaaaatataaatagtattttacatttcatgggtcttgctaattctgaatgatacctaggagaaatgctcagttaaaataaataactaactgggtcactgaacattaaagaggtaatttagaatgaattaaaatctataataaaattcacacctgttcccatacttattaaaatgtattacaaaggtttatgaagtactctctttatgtattagagaaacagataaaatcatattttactaaggtaaaatagtttaaaattgtaactattttcacatttcatttttatgtataagattattaagaataagaaaagctttctcctccatatgctgttgcattcagattaaaccaaagttctttaattttgttatcacattatacatatgaaataacttcattaaaatatcatgaatttttcaccatcaaccctagaataaatattaggcaagaaagtatacataacattaaaaaatgaattcaatacatcaacaaatgtttctaccaaaaactaaaatatcaattttgacccagaattgtcaactacataggtgttagtgataggtattagtgaaaacatgtggtgaaaattcacaaatgaatagaactgaaatcttatatgtcaacagaagtaaaaaatgaaaaagcggccgggcgaggtgtctcaagcctgtaatcccagcactttgggaggtcgaggtgggtggatcacgaggtcaggagatcgagaccaacttggctaacatggtgaaaccctgtctctactaaaaatacaaaaaaattagccaggcgtggtggcgggcacgcgtagtcccagctactcgggaagctgaggcaggagaacggtgtgaactcaggagacagagcttgcagtgagccaagatcacaccactgcactccagcctgggcgacagagcaagaccctgtctcaaaaaaaaaaaaaaagtttttatgaaaaataatatctttaagtaataccccatgggtactagttttaattgccaaattttgcataagtcattctgtgggaggacaagattggggaaagttataggggaaagaagaagtctcttgtcaacagaaatagaatctttctattgatgaatggctgcctgcaactgggaagagtgacttgcaacaacacaatttaatattctctaaataaacaaaccattttttgcactcacaactgatgtactaaagatactctgctaaacacatgaaaacgagaataaaacacttttgatttgcattatcataccaaatgatatgcatatgcaaacatccaaatttctgaatcatttttaaaaatcttaaaaatccatgcagttgattaagatgcattttgggtctatagacttctaaatctacagaaacacacacacatatatgtgagcacacacataaacttgtgtgttcacacagaaagtgatgctaaaaattagttcttaaacctatttgattagtatcagatgcacattttgcagcaatagtcatcataattattcctcaatgtttagtcatggttttactttgtagagcgctccatgaattaatttcaagaataaaaaaagaaattatactaggtagccctgtataaaaaattaaaacatacaggtccattaaaattttttaaaaatacttttctaaattacatattgcagaaattatcctccaaacaactttgaaaccatactcaaaaactaaaacacttaaatttactgttagattttgattcacactaaaaatcaattacttgtccttgacaaaaccttttattatatccaaatgattttagccaccaaagagatattggattttttttaaagtcacagacagctttaatcttgcaaatgcatcattccaaaatgtgtgagataaatttgaaaaggtcaaatctgctgtaattaaagccattctttggatgtctttatagttgaagcagccaaatgtctgtactgaatgccagaagaattaagtattcagatacatattttttcttctccaatctagcatcaggctgtggacttatccaatgagttattttgttgttgttttttaaggaagtggaatatttcaaaccatacaagtagattctgatacagctctaaacattgtaacacaaagtgaaaagtttaatgtttaatatcatactattaaaaagcaaaagaattatatttcaatatgagtctaatgaaaatgtatagttttatttgcttttttattccagtatatttcaatatctaaatattatcaccttctagaagtggtatgttttccaattcataataaaagaattgtggagttgctgccagaatacaagtaaagcaactaataagtaattgtaaatataaattttgtaatttgtatatgaaagtagcagcaaacattattaactataaaaaggtttttaacaaaagtccttttttaaaggatcatatccatgcatgattcatttttcattccagtgattgttattaaagcaaaagagaacccatgtgactcaaaatgtactaagattaaattttcattgttggctcacaatagagctaatatttcagcttgttttatgtctttattggttggattttatttacaagacaactttgtgctataaattgttggagataaaaccaaatttctatccaaatctttcagaatcttttaatgagggtcttacagctagaggataaaataatctgaagcaattccaaattaaggaattatatgacaagttccatatcaatgatatatatatacacacacacaacaagcaatatattagttcaaatagtacaatgttgaatatacacattgtgatagttattttattttattttttacttaagacagggtctgtctgtgtcactcaggctggaatgcagtggtgtcatcacagctcactgtcacctcaaactcctggactcaagatatcatcccactacaggtttgcgccaccatgcctagctatttttttttttttaagacagggtctcactatgttgccctggttgatcttggctcctggcctcaagcaaatcttctaccttacttcccaaagtattgggattactggtgtgctggcctgatggttattcttatgagtcaacttgcctgggttaaggaatgccctgacggctgggaaaacactatttctgggagtttttgtgagagtgtttctgtattagcatttgaatctgtagtcaagaatcaggagtaaaagaggtcccctctcaccaatgttggtgggtatcatccaactcactgggacctgccccaagagaacaaaaagcagaagatgggttctccagcttacagacagaacactggacttgtgggcctccataataatgaatatgagctgattcccatcataaatctttccttatatatttctatatgtcttgctgagtctatttctctggagaaccctgaataatatatatatgtatgcatgtatataatttattataataataaaaattaaagtaacaaattattagtgagctagtaattttaaaaagcccacaatgatgccacatttctctctctaactcttgagaggacatctgcttatctatggctaatggtcaatcagagtttaataagattaatgattcatttattgagcaatttctatgtttcaaattctacccaagtcccactgtgtatgctaatacactgattcttacaacaacttggtgagatagctattaagattcatactttcagatgacatgatgaagttgtgacaagttggctgccataagaactaaaatccactacggtttgacttctgcatacatacttttcgccttgtgcttcattgtcttagacaatcagtccccaacctcctttatacactttcagaaagagacagacattcatgtactctaaaccaaactattacattcccctcgttgtgctttccaaaaggtacaaaagcaggctgtaaccatacttgctatccacactatatacctattttgttcccattgggaaatatttgaggactgcctactggttgcaaatatttttcacctaatttttgatttaattaaaccctacttattctactttccttaatatttccttcctttcaaattcactctatgtgtcttttcatttttgtgactaatttacagtaatagattataaacatcaatatttaactgtgtaaaatacctatttataaaattattcatatgaattttcactggcctactaccgttgtattaataaggagaaggctgttggcaaaacaacaacaaaaaccaccaccacagcaaaaccctttaaaaccaactttgagatacttactttggttttaagtgtttgattttatgagctcattaatgaatgttaatattcttcactgaaatttgctacctatatttttatacttcttaccactgtgagttgttttacatactagtgatttttattatcctattagtattctaaatggagtgtgggtagtagaaataccacaattgtcttatttttattagatacctcctcaaagtagccttaacactattttattctccttcagtagtttatcatctactaaatctgtctaaaacaatatatacaaaaggttaataaatggctctatttagctaagtctagtctaattaccatgaaaacgttaggtctaactttctaaacataaattttttgaagtgttctgcttttcctaagaatatgctactccagactatcttaagttcacacatgtaaaagagaaggaaatgtaggaaatgtgtctgaaaaatcatacctctgccttagatgataaaataatttttcagctgaggttttatatcatcaccaacttaatatcactccttggtcctgtcaccttcagctctcaatatacagttaacttttatcttctggagatttttagactttaaggaactcactaaagattgtttaagaaatgatgcaaggaatgagttgaagactttaattttccaagtaagtgcagaataattatgaagaaggaacctgatgaatatgaaaagcagagagcaccaaattctggtgaggatactggacaatgtgcatcctcattcactgcagaaatgaaaatgttacatcactttggaagacagtttggcagcatttttacaaaactaagcataatcttatcatataatctagcaatcatgccccttggcatatacccaatgaagttaaaaacaggtcctcgctaaaaccagcacaagaatgtttatagcagctttatttgccaaactggtaagcaaccaagatgtccctcgttaggtaaatggataaactgtaacacactcagataatgaaatagtattcagcattaaaaacaaatgaccaatcaagacataaaaatacatgaaggaatctcatatacgtgtttctaacagtatgaagccaatcagaaaatgctacatactgtatgattccaactacatgacattccaagaaaggccaaactatggcagcagtttgaaaaaatcagtgattgacaggtgttatgggggacagagggatgagtaggtggagcccagacgatttttagggcagtgaaacgctactgtaaaagactgtaactatggatattgtgttcagattttttaaaaaatgaaactgaaatttaaaatagagtaactaagagggaatctggttgatttgtttcagcttaaattcatgattgcaaatctcgtgtctttatatttcccccaaaaaattaatattccctgctccattcactatcacgctttttcagagtaacagttcttatttattttctctacttcccattttcactcttgttgacgagtttattttctgtttcacttgtaaaaaggtagtaatctggcaagaacttcaaaatctctggtcgctacatctgctcaccttcctgtatctacacctacattctgttctctctcgttttcatacggataaactgtctgcttctaatgcccacccctctaactgtgactaggtcctgtctcctgttgtattcgggttctccagcgggacaggattaaatggatagaggtacatataaaatagagtttattaagaagtattgactcacaggatcacagggtgaagtcccacgataggccatcagcaagctgagaagcaaggaagccagtccgagtcccaaaacctcaaaagtagtgaagccgacagcgcagccttcagtctgtggctgaaggccagagagcccctggtaaaccactgttgtaggtccaagagtccaaaaactgaagaacttgcagtctaacgttcaacggcaggaagcattcagcacgggagaaaaatagaggcccggagactcagcgagtctcgtatttcctctttgctccgcctgcttttatttcagcagcgttcgcagctgattagatggtgctcacttagattgagggtgggtttgggtctcccagttcactgacaaaggttaacctcctttggccataccctcacagacacatctgggaataatactttgtatccttcaatccaatcaaattgacacgcagtattaaccatcacacctgttatctatttagagctatcatccctgcaattttcttgctgctgcttctgcaattttaattcctctgctaagtccttcacatcaaaaaacaacaaaatggagttaatttaatgtgataaaaactaacaactttctttacccccaggtcgcatacctccagaattctacttcttttttttttttttttttttttttttttttatttgagatggagtttagctcttgcagtgcttggagtgcaatcgcatgatctcggctcactgcaacctccgcctcccaggttcaagcaattctcctgcctcaggctcccaagtagctgggattacaggcgtgcactagcacgctcgactaattttgtatttttagtaaagatagagtttcaccatgttggtcaggctagtctcgaattcctgacctcaagtgatccacccgcctcggcatcccaaagcaccgggattacgggcgtgagccacgcgactggccagccatttctcctttatagctgtttatttctaaccatttgtcttcaattactgtaatcccattctctcttgaacctatttcattcaggcttatattcttctacttctacactgaaacagttttcaagatgactaatataggtaactatttatacattggccatatactttatgtatgaataaagtacacaatgccaagtgtaatatattctagtacattacacttagcaacagcgtctacattctactcctttgacatctacaatcactgctccttgaaatattttttctcttttcttcaggacaccatattctcttattttttctccagcctccttggctaattcttctcatccttctttgccaaatccaccttatctccccacaaaatttgaagtttcctaaatttctctattatttcaatgtttaccctttgctacacaccaacagtacttaaatccactttcatgacttcgttatgcttataactaccacgtaattctttatactcaatttacaaatttattcaatgttcgtgtttaatcattctcatcatgctgactccttcagtaacagagctcggggcttgaaattctaaccttacaaaaaacttatgcttattccacataatacatagatataaacttcttgaatattaaagacatttcattataaagactatattctttataatgacaataaagaatatatttataataacataattgtattcttctatatttatttcaaaactgttaaagtttcaaaggtcacatatgtctttaattatcacaacaaactcccatgatacaagtttaattatataacaaacctgcacttgtactcctgaacttaaaagtttgaaaaaagaataacattcttataaaagacttgtaaagacttaatgaatgaagttatcttgaacatttgataactttaatattcacagtttatatttatcaatagatgctctcagaaaaataaaaaggcttccaacaaactagaagaaaatattaatataatcaacatataaacagcaaagtgttaatatccagaatatataaagaataatacaaataacccaattaaataatgcacaaatgatacacacattatacaaaatatgaaaacatgaatagttaattaatatatgatgcttaattttggtaaccagggaaatgctatttcaacacagggcaggatgacattttacactagccagtgtgaagaaaagttaaaattccagtcccaagtgtcagaaaagttatagaacaaaggagactcatacatgacttataagtaatgagatggggaggggtcatagaaatcactgcctcacaatcaatggggattactcaattcactaataaggaatgcatgcaataagtttcaaagtcatgaattttgtgctttttgtgacagtaatagtaaaaaataatttttatcaatctcacaataaatttgaccaaacattttgtgcaatttaattcctttagaccccattatctcattatggctgagtttactgttttattttatagatacatataactctagaagacacaaggattttgtaacatcacttgcctctggtagttaaagtggaagggagtttttttattaatatttattacctaacatttgaattttatactaggagaatggattattatcctgtaattaaattaaaatttaaaaaattaaaaacttttaaattgaagtaaaatgttcagtagatgagaggttccatctctaatcaagggataaccgattcctttataaacagctggaaaactagacaaactatatgaaacaatcattttcaaacattggacaattggctcctaaggactggttttccgcagttgagaagagaaacaaacaacgtaagatctacaatagcccctgatttctgcctggggatacctaccggaccacaccattgacagcagaacccagacagagcttggagaaatccctgagttaaagggacagaaatgctattgcaggaggactaagcgagtatcttaaatttaaggtaggaactagacaaagaaagagctccaaaaatcaacatagttttcccctgagtgatccagggactgactgactaactcagtgagcatccatccctggttctaatatctaacttcccctccttgagtgtccagggtaaccaccttgagctgtgttcatatctgcaaatgacaggttcatctctgcctctcaagactgcgtaaacctgtgcaacactttctaccttttacggaaagcatacataatttcacaagcaaacagcatttcctgtattttggagaattcagtcaagctttgggagtcagagttatgggtaaaacactttactcacttcaccttcctctttacacttgtgcctgatttttcctcctttaatctcccttaccgctctcagaaacaaaatcattttgttttcttatctgttaacaagtataacaactttggaagagtcttttcttgcttgattaagacgggtgtggtggttaattttctgcttcgacttgactgggttacaggatgcccagatagtggttagacattatttctgggtgtttctgtgagaatgtttctggaagatattagcatctgcgaaataagtaaagcagatggccctccccaatgagggtggggatcatacaacctgctgagggcccgaatagaacaaaaaggcagaggaaggtagaatgctgtctctctgcttgactgcacgaggggagacattgattgtctcctgcccttggactaggccttataccattgtcacttctcattctcaggccttcagacttaggctggaattaacaccactggctcccctgggtctccgtttgcagaccactaacagtggggacttttcaggttccctaactccgtaaacacgtgagccaattcttacaccatatatctttatacacacacacacaaacacatatcctattgcttctgttttctctagattgccctgacatacaacacaatttctctctcatttccacaggctctatctcttacccacacttaaacattgaaatcatctgtgtgtattttaatactcatgaagttcaggcttccctcaatagcctgactttgtatctctgaggcagatcagatttttacatttcaaaaaacatgcctttaaaacaaaatcttattttaagtacgcgtgacaatcattggcagaaggcaattgtagaacaaatgggatttgagggctggtgcaatggttcatacttgtaatcccaacactttgggaggcataggcaggaggatggcttgagcctaggactttgtgaccagcctgagcaatacagtgagactccgtctctacaaacaatttaaaaaattagctgggcatggtggtacctgcctgtggtcccagctacttgggaagctgaagcaagaggattgcttgagcccaggaagtcaaggctatagtgaactgtgattgcactcctgcattccaggctaggcaacagagtgacaccctgtctcagaaacaaaacacacaaaaaggtatttgatttcaacactaatttattcatttttggccatgtaaattacgttgataaagaaattcaaagagagtatattgtactatgtgaatgatcacatttgatcctgaactactaatgggtacgtcttggttacttgtataagaataacaggtttcaattaaggtaaattaacatatataaaatactatgtatatatgaatatatgcagcataaatgacaaagttattttattttcagtttagcctgaaaataaggttgttttgattatacaagcaatcttttaataaaatcaagtttactcctttatgtatcaccctaacatgtatgttctgattgctgactacatggattaaagataattttcttctctctacttggcatccagcccatgaaaatccaactttttgcagtttctacaccttaatgaccatagaagaacactggaaaatatgccactttattagacatcacatgttactttattatacctgaagtttctctaaagattgaaacaattcaattattacagcaagttatacatatgtacaaactggttatacactatatttattaagattatgaaactagctatacaactcaatgacgtttggatgtggaaatgtaattctgatattttttatttccatttctatcatagtttgctattagtatggctctgtataataaactttcatgaatatatcagagagaaatggtaagaagagagctaagtgcaaacgatgcaagttagtgactccgaaatagtgaccacagcaagtcatataccattgttttaaataacttttaaatatagaattatgttttgttatatttttaaaggtttacaaataaattttttaattcagaaacttgcattgatgtgatttttaaaacatttcattgctatcttggttagcagtttcccggtttttttacacacatagaacaaatgttacagtacaatgggagcatcctggtatggaaaaagatagatctggaattatattttatgttccgtttttgctgtggttttaagaaatatacattttttaggtaatttattcttctgaaagatgggaatattatatttaagcaaaagaattattgtttgaatcaattttaaaatattgtgcccatatttatatctaaaatgtttctgtcattcattaatatgattcacataatacaactacagaaaatcattgttggtaatgaaccatagagatcatttagctctaagttaaatgcatttcttggtgatacttctgttgcttcatagtataataagataaattaaatgctttacagcaaaattattatatataagtattactaaaagtcatcagtaatagcaacagtttgacattgagtcttaccctgaaataatacacttttgctcacacactgtaagtattttgtttctctttatggctttaaaggactaaaaataattatttaaagcaagaaagcaggaaagtcatggaaggcactgagacagaggctactaatttatgcagaatttcctctcatcttcttgttacttgtttcagaatcttgccttgagattttgtgggatacatgatgatccaactaaaaactacatttcctatcagtattcctatcttcctatctagtttaggatttatcccagaatttttctttttctcctccctccaccccctgcccccgctggaatgcagtggcatgatcttggctcactgcaaccttggcctcctgggttcaagcgattctcccgcctcagcctcccgagtagctgggattacaggcgtgcgccactatgccaggctaattttttgtgtttttagtagagatggtgtttcaccttgttagccaggatggtcttgatctcctaacctcgtcatctgcccacgtcagactcccaaagtgctgggattacagggatgagccaccatgcccagccaaatttttcatttttaaccacattattaatgcttacattaaggtaggccctgatgggtcctgtgcttccagattctccctcggtttcctctcatagtacatgagacatgcgtgaggacagggcaagaagggttctcactgtaacagaagcttatatctgaaagatgtccagtaatctaattggtctatctttcctcaactctcactagacacatgcaacacagccagcactttcctttctatgacagcaggcacaaggacatacgctgtttaactactttatattttctctagaacaatttttttttttttttttttgagacggagtctcgctctgtcgcccaggccggactgcggactgcagtggcgcaatctcggctcactgcaagctccgcttcccgggttcgcgccattctcctgcctcagcctcccgagtagctgggactacaggcgtccgccaccgcgcccggctaattttttgtatttttagtagagacggggtagaacaatttttttagatctactgatacaatacaaaataacgtcagttaataaatatttcaaaaaatatgtaactatgtttagcatgctcgtttttccccctcaaagttgttctggtttggacaataaatatagccacactatcttttggttgccattttaaagatcaaacttgcctacacttcctctcccccttgaaattgcctggaaaattgcattgttgtagttcctgtggaaccagatatagaggccatatgttgagtatgcatggtagtaagaaccactaaatacgggtgtctgggagaagaaatggagcagagcctcccactggccatggatccctcaactactcactgttactcaagagagaaatacagtgccttctctttaacacattgtatttggtgtcttgctggctgtctcctaagtaatatattccctaaataataaagatcaaacattatttgtaaacactatgctacaagccactcatggagaacttaggattaactgcacttcttgtgagtaatgagtgtgtgtgtgtgcgcgcgcgtgcgcacgtgtgtctttctctgctgcccaggctgaagtgccacggcaccatcacggctcactgcagtctcaacctcctgggatcaagcaatgctgcgcctcagccttccaagtagctgagaccacaggcttgcctcaccatacccagctaatttactcctgggctcaagccattctccaacctcagcctcccaaaatgctgggattacaggcatgagccaccacacttgggctgtgaatgattacgttttaaagttaattattaaggtgcaaatcatgtaaagccaacagtattagcatacatctctcatggaatctaacagaatcctgaacattggaacagagtaataattagtagagcatggaatgaagcagtttcatgcagttcaggactatgttgtctgaaacatgtgtgccacctaaatatcacaatcagaacagtgacgtgttcacactaggagtgactctgagcccagattcacagtcctcatctttgattcctccagggaatgtggttccataatggaatcatttgcctttaataggttatccaaactgtcctctctctttccttagctgtatgatcatggtcctttaacacttgacttgtgtagggtcagttatattccacctcatcatttcctaatgtaattgtaaacgctttatttttattggtactctaaataagaatatgaaaccatcctgtatcaagtcctgttaaaatacttgcaagtatgttgatttttaaaaaataataatatttgtaagctataaggaatataatatattatgagacaaatgatgtatggcaaagtatagcactttatgcaatatagataccataacattgcctctcttactttatgattacttgtttctcacctagatgtgctgatttgtgctatactgttccttccagattctaagagtttgagtcttgaaatgcttttgacttcaaaccattgttcttctgtttagtgataatttatttcaattatgtttcttaggggtaaaatattacttgaggatggtttaaacctataatattgctgaatcctcagctgattttatcttaccccagagagaaatttctttggccaggtgcctgagggaattagtaatctcagaattactaatacttaatataattttaaggtattcgtacctcagtgctactttttaaaaacagagattgtgtcacaaatccaaatctacatgtcatctttggacagggggcctgctagtgttgtctgtcttattccaattgtagcacatgtacaaccgaagtgagcgtcttaaggactggcgtttctactctgtagtaagtgttatgacaagtttaattctgttttatcttttctttcaggacacgatcttttggctttccaggaaacctcagtggttaatcaggaaccccacttttgagaagctttaaaaaacaacttttctcctcctaagtccctgaggctcccaaatgtgcagctcagacttttggtggcttctccagaaaagtaaattccctgacacgaaaagagttctgaacgctggattccccttttaacttcttctggtcctatctaaatcgtgacctggttgttccctactgtctcactagtttgatgatattattaataaaacaaacaaaaacacatttgttgtccttttattagaagcccaggattgatggattgatattaattctatattgtattatggataaaagtttgaaattctgcgtcccatcgccacggttaaagtaagctgttttcatccattgcttatgagcaagagaccacaatggccttaactcccctccagctagacaaaagtttaaagaggtttccttctgatgctaggcccttcgcttgtgcttcctaagattactcacttcaataaagttgcaattgcccctttgagatgtaaatcatcccctagcctctagccagttttacaacatggaaatgcctctcaaggatctcggagctaacccattgaaatgtaatcatctagaaagacagtgccccaatctttccatcgctgtgagaagttaggaacctaactttcctaaacttcaattagaaaacacatgtggcctaatcacattgaccaaccactctcctaacatcaagcagtagacttccctcgctaatgcaaactctcctgccttttgtttcagcagagttgaattcaatctttctctttattgcaataatcttgacctcttttgcaatagtcttaaataacattttccccacctctttaacaccatctcttgcaatttttctttgacatttaactaaagattaattagttctggaaatttaccctttttttcctccatggattcagcagcagtatctaaaagaaaaaaattcatcaaccaattatatatatatagatatacataatatatatgtatatatataatataaagataaaacactgcaaccagtggaactgaacataaagtaattcaaattcacagaacgcatcttttttttcaggcttttaattttattaaacataaaagggcaatataaattcctgtgcatgtcaccttttacttaagaattcattaacagcgaattagtttaacaaggctgttttgcaagaggctgtggttgcattcaaaaattagaacgggaacaacgatttgtaaaaattaaacattttaaactaccacttactacattcactgtgtctacaatttggcatatttctttcggtggccacaaaattataaaatggacacagaatagggtcttcaaaaaattaaggacgttctttcttcttaacaacattataaatataattcaaataagcatgacaattttaccaaatagattgacttttttgcttcaaagaacacatttgtacatgtaaattaattttggtcaatatgtgtgagtgcatgtgcctgtggatgtaaatggcagtaaaggggaaggtggaaaaaagggagatggtctggcttttttaacccactttttaaacgcccaaaacagaggtactaaaaaataatgatgttgtgaaaataaagtattgccaactagaaaaaagacttgaaattggcatatttctttcttatatattattaaatatatcgtaaatataaatcttacacaatttagctcccctatctcccagtctctgtgagaggttaggaatctaactttcctaggcctcagttaataaacacatctggcctaatcacattgactaacctctctcctaacatcatgcagcagatttcactggctcgccgaaaaattctcctaccttttttttttttttcctgagatggagtctcgctctgtcgcccagactggagtacaagtggcacgatcttggctcactgcaacctccgcctcccaggttcaagagattcttgtgcctcagcctcctgagtagctaggattaaaggtgcatgccaccacgcccagctaatgtttgtctttttagtatatatgaggtttcaccatgttggtcaggctggtctcaaactccaaaccttgtgatccacccgccttggccttcaaaagttctgggattacaggtgtgagccaccatgcccggccaactctcctgccttttatttcaacagatatgtcaacttttacatggtacaataattgtataagataatattagattgaatctcacaatcacactcagcttgattactaaactttctcctgcttcttgctcacctaaatttacctacgttttctatgaatagagtagtttagaaatttatgtcttctgtgcattatagtgtaagttattgtaagatagaaatatggactttctttgaatcccattttctgcctaggaaataccaatatattttgagtatgataagtgtttcaaagcattcaaaaatgaacaatgtaggaaacacactgcaaaatgaggtctgattctcatccccttactcttaattgctctttgtctctcgtctctctctgtttcattgatgagtataaaagatcactttcatatgatattaaaattcatagaaataagtgttgatttgatcatccaaccaatcatttattgagtgtccattacaagtcaaattgtgttcttgagaacagctcaggaaatgaatgtttgacactgatgtacataacagaaatgcaaacataccactaaaaacatcagacctcttatgacaatccagattctcatgtaagctctattaagctctttcaaggtgagaattgatcatttcaaaaaaaaaatcattttaacaggtcattcttgagacagaaaagtggaattagaagctcatatattgctgtttcaggagctaaaatcttaagtgctgtatttaatcaattgacagccatataattcttagttttatataccgatattcatcaaaaattaaaaaccttgaaaattattcctgtctcattctactaatcaatttaaacatttcatttattttgttatgtttcctcattttacttggccttgaatacttctttccagcccagtattaaatttaattgagatctaatttgtttacttggtttagttacttttgactatgtttggtacatgtcttatgaagcaggtatgtaggaatgtttacaaatttatggtcctcactcctccaaagccctaatggcgatacaccgaacagacacataccacaatgtaaacacacacacactcacccacccacccacacacacacacactccagtggatcaacacataaaatactctacaggcaaaaacatcacacatcagggatctctcagtgtattactcacttctgtaatttatcaggactgttcaaatgaggtgagtctgcagagatttctaaggcgatttgagtgctaagctgtctaactagtggttggacactatttgagtaatgtaccaaacataactctcaagactgtgaagaatttatgtactttccaataaacaaggagttacaagatcctaaaaaacacaagttttttatatcctttaatagataaaggaaagctgatatcaatatgaatatatgtgtgttaatgtttgcttgcttgtagtatacatttttatgttactgggagtaagaaacatcttacggaaaagaagacaagaaataaaattttctttgttacactgtccagtaactctccactgcacatgtaggctataaattgatgtcttggggaaccactttggtatttcattttaatagctcattctggagaatatatttgaatgaatcatgtattacaactgatttaaattttgacccattagaaatgagttctcaaaaatatgtctgaagcctggatactgtaaaatcctttatcatcacagaataataaattgctagccattagttactcagaaattgttcaataaatctaagacgacttagatataaatagttatgagcgagtatgtctcatcattaatgtttgtaaaaattaatgctgtcatttatgattgagaataaaaaacgagaaatgaaactttgatagaagtaaatgatagatataaactttacataaagcgagagaataatagatgtgttaaaatgtttattttatagataagatttatgatgaaattgtgttgaataacatgaatccaccagcagttacatcatcacaaccttttaaatattccattaacttcaaaatgtacttatcactgaaataatctgattaaatgaattgggataatgggtaaggattggtataagctgaaagcaatactggactttaaaaattatgtttctttgtgtattacatgagaaaatattgttgataagttaattactgcacagtgcttattataacacttaaacctggaagaaaatcagtaaatgtttagagaataaaattggtgaactgcttccattttatactatttcctgtttatttcagtgcttacccaaatttgcaactctaaataaggcccaattatttactcctcaaatagcacaagatttacgaagaaaagtgaaagcttttttttccactcaaatattctagtctctatctgctcaaatttctcactaacttttcttgagtctagtacaagtactgatctcaaggccactgctaccactttcaccatcttctgtgcctcaaggctcaaccttcctcatttacttcagtgaatttggaaaagttccatttcgtgatactttaagcaacctggacgtctcttcactaaaagtggtattcttcctgtgttcctatgatttttttccagaaaatgatatcaacctctacctacacctgacatctcagtgtaattcttgacatttccttcttcacatttccatttccaatcaccaagtcttttcagattttaccttctctatagttcttgaaataatttttctctttctgtcttcattgctatcatgggatctaaccccccaactctctaacctgggctatggtgaccacctctaaagtgctctccctgattgtctctccaaaaaatgtttctcttttctatatccagaatgacttactcaaaatgcaaatacaatttgcattgtaaattgctctgtttaaaaactcccaaagactttgcattggtaatcggatgaatatcaagagtccaaaatagtgttcaagcagtacaaaatctgttctttgtatttctccctcctctcctctgatgacatgaacctcctcaatctgaatgattcaataatattttattccttaaatgtaaaatacttcttgtcttctggactttggtcttcttattcacatacttttcccactatcatcctttcttttttttttttttttttttttttttttgatggagtctcattgtgttgccaggctggagtacagcggcatgatctcggctcacagcaaactctgcctcccagggttcaagcgattttcctgcctcagcctcccgagtagctggaactacaggtgtgcactaccacacccagctaatttttgtatttttagtagagatggggtttcaccatgttggccaatatggtctcgatatcgtgacctcatgatctgcccacctcagcctcccaaagtgctgggattagaggcatgagtcaccgttcctggccctactatcccatatttatataatcagctcttaatcttgttttggtttgctcttcagtctttcccaccaagggaagccttacctggaatccctaaatatgaaaggctttcataagagtggctttcataacagtgtgtaactttcctccgtagtgggattattttagttataatactgtttttatatttttattactatttataatagataaatccaagcacactctttggcaataagtctaatggacttttgatacaattactaattcagtacaagtactaattcagccatgattccagagattgagaaaaaaatatgcagcagtaatctgtcacaagtggaaggacaaataaccaagcaataatgtactacccattcatctcttaaaaacagggttaaaatatttgttcgcgtgttttcaggaggaagcatggacagagtttcttgcttcttatcctcccaactcactgtttctatgaaaaaagtaattaatctgataaacaacacagaaaaatttggtgtttactggcctgcattaacaagatggtgattccaagaagttgaaataaagagacttcagagcctgtctctctcaatcactatctttgggcttgtgaaattgcttgttacacaaaatagggagcacttgtgtaagacctgcatagggtggctcagcccggctactgttttcatgaattcaacttttccaagagtgacagaatgtcagaatcccatgagccaaaagttttatgatgagagaagaagaatgatatttcactccctaattttaaaattaggttttaaataaagttaataaagttaaagttgataaagctgaatacatacacacatgcacacacacaaacacgcacaccacacacacacacgctccttacagcagtttttcaatgtttaatcattcatgagaagttgtttgattttgtattttcaatttaccaatacttgcaacaggctctggctgcaaaacttttttcagtcaaatagtagcatttgagaaacaacgttgttgctgaaagatagaagatcagccttaactacaacatcagtagacttgtgactgtttgtaaccagagggaggtaaatggctttcagatggttgtgtagctggtttttgcagtagcctgcagtggctgtctgatagacataaaccttactatttattattagacttcagagcattaatattagattttaatttgcttatgttaggcatgagaaggtagcattatccttgctgccctaaatattgttccttgtcactttttcccattgaatttaaaggtaatttggggaatgtgtctaacgtaaccttatatccatgtgtttgccataggtttctggagctcccattctgaacatgctccccagttgattcttcatgggcataaatttaaatttatggaggattgtttcgtacctctcaaggaatgtggattcagtaccaagcgcttgtagagtttatcaaaaagaagataaagaggaataagagttcctgctttatgggaacatattatcttctttgggtaatgcctatcagtactccctgaaaagctggagtgttaaatgtttgtaaccagttcacaatgagagaagtagcttccactagaaattaaatcaatacattacttctttcattgagtaactattgctacaaaaaatatgtctgctgaataaattagcatgcttattgacataactgatttgcagactgtaatagcagtttacggaccaaacactaagccccactgaaaaatcaaatagaattatttgacagttaagtatcactgaaaaagtctggcttttgatatcaggaagcgatcagattgatcatatgttttcagcatgtagtcataatataactgtatatcaatagtgtacatttgaccctttatattatgcattttacatatattttctcatttaatccttcattacaagcacaagatacaaaatagatttggatttaattgcttcattaaggtgaaagaccaaaccctcattacaatgctaatgtcagaggttcttcttccaattaaaacagaaagttaccaaaggtaattgctcctgccataatgagacgacgttagataaacgtttttttgaaaaactgtatttttgaagccatccaaaagctatgggcctaaagtttcaggggactaaatttcagagaaaaacaagcccttcctgggtgatcacaggccagcagctgagtccatccctaaggacatttgttggatctagggacttgagtagacagaagaacaagcctgaaatgtacagagaaacagctggaacactgggaatacacaaaatatttaatctacagaacactgcaataggggctggaaattggaaagatcgtgtggtctcctagtacttatttattttcatttcttaagggataggctctcattctgtcacccaggctatagtgcagtggcgtgatcatggctcactgcagcctcaaactcttggcctcaggcaatcctcctgcctcagcctcctgagtagatgggacttcaggtgcacaacatcatgcctggctaatttttaaatttttttttggagagacaaaaatccactacgttgcccaggttggtctggaattcttggcttcttgtattctttctgagttggccccacaaagcactgggattacaggcatgagtaaacatgcctggcctcctctagcatttagatgctaaattctgctggaaaaaggagtacaaaatgaatacaagtagtaagtagtatcttgagtattttcttcccatacacccatgggagtatttggtgcatcttactacctcacgtacaccattctttcatcaaactatccaagctaagtatttaaatttaattttttccctacaagaaactctatgctaaagctcattaagtttgattttgagagtctctgtttttgtatcacagttgtagaaaattaatcacattctttattttttgagacattatcattattgtttcctagaagtttctctctggttttacttatttatttaattcttttattccttttccctagccatagacaggcactctcatgtgtttgatataggttctttactcttaaagaattcttacaaaataagaaagttgttttctcagtgtctgtgtgtgtataaacaagagtgtatacatttttcttaaagagtattatgatatacatctattttatttctaatttttttcacagagcataatgttcttcatacattcccacattgttgtaggttcttttaggttgtttatttccctgtagctgctgcatagttttcaataaaatgaacccaccacattttcccctatgcagtcttgcagtagaattaacactgacatccagctaccatagaattcacttctgtaaatagcctccttatgaagacatcttttggttacgcgtcacaatctgtcaggggttgtgttagtccatttatattgctatgaagaaatacctgaggctgggtaatttattttttaaaaacagaggtttatcttggctcacggttctgcaagctgtacagggagcatggcaacgacatctgttcttggcaaggcctgaagcttataatcatggaagaaggtgaaggggagccagcgtgtctcatggtcagagagggagcaagagaaagaagggagaggtccaagtctgttttaaacaatcagatctctcgtgaactaatggagcaagaactcacttaccactaaggagatggtggtaaatcaagcttgtttgactcacaccctgcaggctgaatgcagcccaggacagctttgaatgtggcccaacaagaaggtggcccaacacaaatttgtaagctttcttaaaacattatgagctttgtgtgtgcgtatgtgtgtgtgtgtgtgtctgtgtgtgtgtgtgtgagagagagagagagctcatcagctattgttagtgttagtgtattttatgtgtggcccaagatgactcttcttccaatgtggcccagggaagccaaaagactggacattcctgtgctaaaccgttcataagggatccaccccatgatctaatacctcccactgggtcccaccaccaacattggggaacgcatttcagcatgagatttggaggggacacacattcaaactatatcaggaatatacacccaacaataagacagttaggttgtagggcatgcataattttaaatgggtcctgccatattattttccaaaatgtttacaaccatttactttcccatccattgcccataaaggttgtttttcctcatatcctcatcacacaatatcatctataagttttatattttctaagcaagtggtgaagatacatatcacattttattcatgcacattggcatttgtcagagtgctgatatcatattgggattttggggggcccatttttctagtgagtttactatactctttgttgatttgaatgtcaataataatcacttttctctatctaggcattgtcaacattttctattactctgtcatatgctgataactttgtatgccagcctttgatggaatgaatccttaaaatttttatagttcttctagagtttaatttatattttaaatggaattttttggtttagtaaatcttttattaaagtgtaacaacacaccacaatttgtattttgttgggttccttcagacttagaattctgatacattttggttgatataccctttttatcataatgaagcatggctatcataatgcaatatgagtggatctaggaatctatattgacaaccatgacagaaaacattatttttgctttcaatcataaaaaataattttagaaacaaaagaataacccataacatttacttagatatttacctttctgttctttaattcttttgccttttcttaacttaaatattattcacttattccttatttccttttaactttttctacattcatgagctattattttagtggttatactagtcattatactgtttaacacttgttgattaaaattgaatatgttattacttatttgtgttactcataagttcagaatcttatttatattaatccctgtggctaaaaattaaaaacatatattttaaatctccatattattgtttaatttttgtgcaatattttgcatcgacccagatatttaccctcatatgtgttccttttgaatgtcttagtttcaggacatttcgatgtcttagtcatttttttttttcatgaagaattctttagtcttgcctatgacaccagcagtatctatgaatggtccagttatgctagaaaatacatgtattctctttaaatttggtgattatttccacctactatggttcccactggtttgatcttctccatttaatattttgacctcttattattttattttagttgatcattcatatcttctgttatttgcttatattgcttgatgtatcagtttctaagaatttgtgtgaaaaatctaattatagccatggattctttatttctacccatatctctatcaaattttactttatatatgcaagttctacttcatatttgtgaattgggtaaatttcttttcaaaactattacattttcttaacatattgttccttgtacatgtattagtagacaatgtcttaacttcaattatattttatcacatatttaggacacaacataaattttcttttgcatcatatatacctgtatttctttcttcatctttttggttttcaattctctgtattattttattttgtagattatttgcaacatatattgctgaaacttaactgttgcaatataatctgagcatttctgtttgtcattggctcctttaacttatttgaatttattacaattcatgcaattttatgcttaatttactgtattttcaagctaggcagccttcctcctttcactgactttcatttgacaggtcagaatttcttctgctagtttaaattttaaatactttatttttctttttccagtgtttgccttcaaatttttaaattctgtatttattttgcactataattttcaacacctgtatcttccccttatcaatttgtatatagatatatatcaactgccttcctttggcatcccctagcttccaattactatacatcactaaaattgtatcctcaagaacagctctcttcaaatagtatgctttgagaaacacataaatatttatcaaggggaacttggacattttttctagatcctcaaattctattggcattctttcttcatactctaccacctactgtcttacaaaaaaaaactttaaaaaatgaagggacatttaaaatcttttccttaacattacaattgcctctagtttaaaacctttagagcacccattaaaagggtacttgaaaacacggagaggggaattcgctaattggtaactcacaatcattaaacttgggctgggtaaaactgcttgaatttcttgtttcatacatactttgccaagtgtaaagaatcgcttaaaatataatatattttgacttttggtgggaaattctaaaatcagatgtaatgtagtttgagcacgtggagtaccctgcttttgttgttgttgttacaatctcagttctctcatcaggcgccattgtcagaaaagcattgcttttgagaaagtatctgagagcaggatggaagcagagcaaataagcaacaaggagagctaaaaatggctttttcacaaatctaaacaaaagtttgtctttccagttacttttttttttttactattcattagagaatgcctaattagctaggaagaaaaacattttaagtagacaaaatggttctgcaaataacaattttttcaagatacagcaaaaaaagtcaaccgtgagttttctgtgacttttgtggagatgtgggtatagcttactcactacgaaagataggatttaatttttaaagcatataaaatatatacctgtattattgacagttctaatcttagttgataatgtaaaatgttgattatttcccatgtaaaaattactatcagccactaagacaagtaaattttagtagtatatgccttacttgttaaaaattaactagacaggaaattgtggtatctatatccaacaagttagtggagtttttctggttttcatatgtaactcttattttatcttctcaaagacaaaaagtagttcaggaaaaaaacacatatttaaccaaagggaaaccatgaataattatacacctgtattagtttatcattgctggtgtaaaaaaaaaattacaacaaacttaatagcttaaaaccacaaatttattatcttaacagatcttgaggtcagatctttaaagggatcctcaatgggtcaaaatcaagctgttagtagggttgcattctttctagaagctcttggggagaataggtgaccttgccttttccagcttctagagactgcccctgtgggatcatggcccctttaattttaagccaggagtgtagtatcatagaaactcactgactcttctgcttgcctcttctacctattaacatccttataattgcattgagtctacctgaataatcaacggtaatcatcttctctaaatgtcatcagattagcaatcttcattccatctgcagcatcatttccctttcgccaaataacctaacatagtcacagtttctggggaagtcgatacaggagatgttattttgtgtacaatccttgataaataatttaaaattttaatacatactttatttatgcctacaaattaaatattgacatataccatataaatgtattttagctcttataatttacaaattagatgaattaatcatacaagagatctatatcgttgtaaacttgactgcttttcataatctatattatagatgaaattcatgatttagttatccaggtttttttttttttcaggtccctcaaaacacctaatatagcatgtattagacacttcttgaagaaaggtactctgatattggacaatagtgatgtctggccttgctgagtgatgcctggcttggctaatttggttgtatagcagactattccctccaaaatttagtattctaaatacaactccaaaattttaacccaaagataattataacatataataggatgaggtaagtgatttctattttaatatacatttgccaatataatatctttttattggtaaatgtatattgaaataaaaatcactttatatgttgaataaaaattacgcttagaaaagaaaatgaagcgaaaagtataatccataatcatttgacaggattagtttgggtacaaccttttttaaaaaagtaattagaaattaagaatgtcaattattctaataagtggtaacaaattcttttgtttgtcaggtagtttacaattctttgccttcaacacaattgaaggagaacctagaattgttagctagtaagtcattaagaattatttttcatgatggatccttgtattcttgtgaagcatctcagaaagatttcaaataattaagcggcatcaatacaaaaaaggatttttattccattttacttactctcgagactaagattctactgatcttagatcaataaaaatgaaaaatagaaatagaattgaagttgaaccatgtctcaatcaggcaataagtaatatttattcatgtacgcatgaatttatcaaaaagtaaagaattcttcatctcatttagggttatatctacaatacaacttcacttttgatacagtttatttctcagagtttggaatacaaacaatatattcatgttataaacaatgacacttttaaagtatactgctaataatagtgagaaaatttttgcgatctatccatctgacaaagggctaatatacagaatctataaggaacttaaacaaatttacaagaaaaaaaacaaccccattaaaaagtgggcgaagaatagaaagacacttctcaaaagaagacatttatgcggccaataaacatgaaaaaaagctcatcatcactggtcattggagaaatgcaagtcaaaaccaaaatgagataccatgtcacgccagttagaacggcaatcattaaaaagtcaagaaagaacagatgctggcgaggatgtggagaaataggaacactttatactgttggtgggagtgtaaattcaaccattgtggaagacagtgtggtgattcctcaaggatctagaaccagaaataccatttgaccgagtaatctcgttactgggtatgtattcaagggattataaatcattctactataaagacacatgcacatgtatgtttattgcagcactattcacaatagcaaagacttgcaactcacccaaatgcccatcaatgatagacgggataaagaaaatgtggcacatacacaccatgtattactatgcagccataaaaaaaagaatgagttcatgtcctttgtggggacatggatgaagcagaaaccatcattctcagcaaactaacacaagaacagaaagccaaacactgcatgttctcactcataagtgggagctgaacaatgagaacatatggggacagggaggggaacatcacacaccggagcctgtcaggggatggggggcaaggggagggatagcactaggaggaatacctaacgtagatgatgggttgatgagtgcagaaaccaccatggcacgtgcatacctatgtaacaaacctgcacattctgcacatgtatcccagaacttaaagtataatacaaaaaatgtataaaaataaataacacacaaaacaataacgcggccagtctcagtggctcatgcctgtaatcccagcactttaggaggttgaggcaggcaaatcatgagttcaagagatcgagactaccctggccaacatgctaagtcccaatctctactgaaaatacaaaaattagctgggcgtggtggcctgtgcctgtagtcccagttactagggaggctgaggcaggagaatcgcttgaacctgggaggtggaggttgcagtgagccgagatcacaccactgcactccagcctggtgacagagcaagactccatctaaaaaacaataataaaataaaataactcaacagaataatttttaagacttgctctgaaaatttaaaaatacattatttcatttatagacttatttgaagagatttataggtaatcatttaaaacctttgaagtttaaaatattataacaaaaaattgtgcagttgaaaatgaaatgaaaatgtaagttttaaggggaagaacagtgtaaaaattactgtattttacatcttatgagttattttaagtgaacattttatctgccctttatttctctaaagttatcattatttttccaaagagttcttccctctgtttatttttcttttttgtctcaattatatttttatttcatgactgatgacaaattatggtaaacaatgttatgtgttgatacaactgagatctatatctgctacaagaggaaaattcaatttgcctttaaatgtcatcttcagattgctttggttgtgcctgcattctgtttttaaagtataaaagattttaaatctctgaaatgacttcacaaatatcttttttaatattcaatctttaattaatcagggcccatgggggctagaaattctgattagttatctgctccaaatcgtgattaaggaaaccttcataaaaccacagcatgatggatttaaaaggaagtttatagttacagtgagtctaaaacctagatatgcattagtatcacctgcttcactctattggtttcttgatttatttatttatatttgtcatagacttttattatctacctgttgtcacattggcatgcctttctttcttctgcgttattgcctttttcttttctcttgtttctttgttttttctgttcttttatctttttattttctgtaatgtacaaaggtcaggtatctttatgtatttattttgttcacagatgcctgacattcttcaatagatatctgttcaattaaatacatatctcttacttctttatggcacttctgctttcttctggaagaggtcctagcctgtttcccctcagctgaaacctttttgtgatttatatcactcagggctgtcttcaattgaaccattatatttaaaaaacaatatttcactttcctctttctttataaattgtgattcctaattctttgttatcaacatctaccctttaccaatgaaagaaaatgtgttatggctatttataatgtctgaactgtctgttgcattgcttttttcggtttgttgcagttttgatactcctagatataaaatttattaaattataaaatatggaggctgaggcatgagaatggcttgagctcatgggttcacgactgtagtgggccgtgatcatgccaccacactccagcctgggtgttatagtgggaccccatccacccatcccaaaaattatatatatagaaaatattttttttcactgagttattaaaggttcttaagtactctgcatatggtttattgaagttgtcaagtacactttgaaatatgtgtatatgtgtttgaatgtgtttttttagtgttcctcctggtatgatgcaagtgtaaggacataaaatgccccagagtaaagagcgccagttaccagggcagagtgcttcccattttataaggctctgaacttctctgaagttattctagcaaatccaagcgcagacaatccattgtttcttttctatgttatggcagtagttgagaaattaaggatactccctgagaaatggcgtgataagagcaaaacatatattcaccattatacctatgtcaaaatgcaaatcacataatctcagctttgtatctttctaggttttctcatcttcctagtttttatgttaatgtcttatatgtatatctctcttcatctacaattgttctctaggacagaatttaaaagataaaccagcaggacatgccagttaaccactgtgttaggaaatcacaattactggtatccctggcctcaattggacccttagtatttccagacaatcatactatatatatttcctagtgtaatggttctcaaaaactggtccccatactataatggtgaacttcttaggccccatcgtatacttaataaatcagaaacacaggactcggcaatctgtgttttagcaagctcttcaggtgattcgaacgcaagctaactgttcaggatggtccaaagacatttactctctcatgtgcctatgtgatgctatgtccttcccaaacttccaaacatactttctcattcttcttttttttttcattcaatgaaaagcaatctaaaacaattttctgggccaggtgcagtggctcatgcctataatcccagcactttgggaggccgaggcaggcggatcatgaggtcaggagttcaagaccagcctggcaagcatgatgaaaccctgtgtctactaaaaaacaaacaaacaaacaaacaaacagaaacaaaaaaacgattttctaacaacaaactcccaccacatccaccatatgtttgtgcagcatggaaaacttgtgttcatatcctctatcttctctcttgttaataccacctggtcaaggtcaacctctccatttgtacattagctcccgtttcctcttagccactcaaagacatagctccagctccactatctcttctatatcatcatttcccctctctacggtattatcctattgccattaaataaccaaacaaataaacaaagaaacaaacaaaacaagttattaacttattcatttaaaaaaaaaaagtcagtctcctaattccacatcccttttcatgtatacctggacacctaagtctccctttcccttcacaggcaaaaaccttgacaaaattttctttttgttccatctcaaatgtctctttccccttctgtctggactttaatcaggctttgcctgcccttccccatttataatgctgtgatcaaggatatcaatggcttttatgttactaaattgaatggtccatctcagcgttctttttttatttaaaccaacgacagcacttgacatatgtgcatctctcttccttgaaaatcctgtttgacttcaggcagcccacattctcttagatttcctatttagcttagccagccctcagtgtcctttgcaggctcctcctcatccccttgccctttagactttgatgttgaccaggcctaggttctcaggtcttcactgttttccagtcacatctttccgtgatcttatctcaactcaaatacataaataccatctctatgctaagaattcccaactttcaatctctgtgattgcctgatctgatcttgacagctccacttggatgtcaaatgggtaactcaaaattaacatgccaaaaactaatcttccctatcttccaaactgtattcttctttggactattctctttcacccaccatatccaatctgcaaatcaagtcaactctgcattcaaatactgcataagtatgtagccattcgcaccagcactgctactgccaacttgataaaggccaccgtctttcttacactcccatagcattctccatcccaagcattccatcaaatacctctttgagaagcacagttttggggaatctgcctgtataattaaaatcttctaatacatcccttttctttctcctccatccactgaagtctacctgtaatttattagatacaatgatctacacaatatgtcacatgccttcaaaaattctccaatatctcatttaagccaaaatgaaagccagtaatcctacagagtccccacatcatcttgaacctttttattctctgatccagtgttttcacttttatcacatatttattgactttgcttctgcaacactggtatttttatacctggaacttggcagtgatgctccagtctcagattctttgtcgatgtactttctgcatggaatgcaattcttcaagttttctatgcttacttcctcacttcttttaggttttaatttctacattgctgtttttgtttgtttgtttgtttttttgtttttgtttttttttttttcgagatggagtttcgttcttgttacccaggctggagtgcaatggcgcgatctcagcttaccgcaatctctgcctcccagattcaaaggattctcctgcctcagcctttctggtagctgggattacaggcatgcgccactacacctggctaattttgtatttttagtagagacggggtttttccatgttggtcaggctggtctcaaactcccgaaatcaggtgatctggccgcctcggcctcccaaagtgctaggattaccggcgtgagtcactgcatgcagctcacattactttcttcgtgagatctaccctggtcactgtatttgaactgcaatcccttgccatcttcattttcccaagaacttaccagtacctaacatactatgtaatttacttttctattcttcactgtctccctcattagaattgaagtaccctgagaccaagaatattggactcttttgctccctgttctatgcccagcatgtagaacagtgtctggcacatatgaggaccccaaaatacatttgttgaatgaatgagtaaaatagaaaacccctattaaaaaactctaaaaatattgttgagggactaaatgtattttaatgctgtcattttaacagaggtaattctaaagtctgagaagaaagaagatccacctgccatgactgggaccccagagacagaaccctcggaggctttgcatgttaatcttgttttccagtctgccacttgaactaggcatgttcatttttataaggtggatgaattaatttctccatatcaatggggaaaatgaaaattccataaatgtgccttggtgggtcactaactttccccatcggtggcattccatcaaaaatctgtttgagaagcacgatatgaaataaagtatctgtctagctaatatgggttacactggaacagtagcaacgttggttgtcaagttttagactaaattagttttaataggctttaccgtttcacatgtatttatgtgaagaatattcttcaattgctctgatttaagaataaaatgaaaataggaccactctactatttggatgattacatttttgggtgcttaagtgaaattaggattaactaaatgataatagaaggatattttaattgcattactattttacaaacatcaaaatatgtagtacttattgatttactggaaacaaattatacaaattcaaatataaggttttttagtgttaatatcgaactttcaaacactctgaaacatttgttcactctcattagatcctgggattaacataatagagaaagatataaggctctttatgtattaaacaaaaactaggaaattagtactgcatcattaatagtaaatttagactagattttttgctgtatatgtggtcataaagcttctaaacttaataccattattaggaaattgattatttccaatgcttaagattgtacaacccttgttaattcaagcaaacatgtagtctgtaatttaaactttgctatttgttcagctaacgcaaataaaaacattatatgatcaaatatctctatcacaccatttgcaacttaaatgcaaaagtgagttaaaatgacagaaaatgatataaataattttaaaaccttaatataattgctttggatatgattcttacttttgcttccagaaaaaatatgatgtgcccaaatttatattaactgattaatctgctgaagaatcattactttgcactgctacacacaacagtcagctgttagaggtaagctaatagactagaaatgtttaaacaaaagcaatttcgcaccagaagaacatgaaccatcatctccaaggtgagatggatgtagaggccttttcactcccacagaacttcttaatgcctgtatttgtccactttcacactgctataaagaaatacctgacacagggtaattaataaagaggtttaatcgactcacagttcctcatgacttgggaggcctcgggagacttacaatcatggcagaagggaaaacagtcacattttacaaagtggcaggagagagaagaggggcaaagtggggaagagccccttataaaaccatgagatttcatgagaactcactcactatcacaagaacagcatggggggacacgtcccccatgatccaatcacctccctccctcaacaggtgaggactatgggtccctacctcaacacatagggattacaatttgagatgacatttgggtgggaacacagtgccaaaccatatgattccacccctggcccctcccagtaaaataattcccaatgcaatgaagaaggcagaacaaagactttcaagaaaagaaatttcctctgcaacactcagaaaaatataatttcgtatttacaaatacctaataagttttgagtttattattaaaaaattctcctttatttaaaattgttcttttatggaagtaaaataagaggcagactggtggagtagaaagtaaactgaaaatgagaagactgaagttgtagttcaagttctgttactagctagataggttctcacattccacctcccattggaattaaattaaagttaaagttattgttttgtaatgtataaaggttttccaatttcaaaatctattactataaaacctatctttgtcctgtagaaaaaaaaaacaaagaaactttctgctttgtaacaacagatgtcacagattttgataaccttgatgatctactggtaagctaataacagagaaaaaatggaaattaaactacagctgtctctagcccacctttgcttcctatggttacgccatcattcagattttgtgagtaaaatacattggtagaacatcatgaagtgaggcctgtaagggcagatatgaatgaaaaagaagacaaataaatatttctccttgattgacaaggaaaagaatctgtctctccttcccttgcctcagaacatttactttagaaaacttgcagttgtgaatcgcattttgctcctttgagttataagagaggtatgtaaataaaaagctaaataagccttttgccagttttacaactgagaaatgtcttcattaaggacttgggaagcatctttttgcaatataggcatcaatgaagatagtggccttctcccagtttctgagagaaggtgggaggctaacttcagctggtacccaactctaagttgaaaacctaactgttttataaagatagatagaagatatttatttttcttttggataaaatcaacgagcaaacacagatggttacccaaatcactaggtgaatttaggatgaattatgtgtcacaaatggtgctgtcaagtacccttacttgaggactagtaattgtttatcttgagaaatgtatgccatgggctctatctgcttgactatataaaactacgaattttctttctgtcttggcagtccctgtagggaaagcctgtgatatatatcacattctaatgcaatgattatttaataataaaaattgtctttttttaaatcttctactctatggctacgttttatggattgggagattttacttttaattatattttcccaataggcccactgcacagagagatgatttaacaaaatctgtatcttcattactgcctaagagccagagaaaaactgagagtaatttttaaaagaagaacaagcataagtggaccagcaaatgtggtacaatgccaaaactgcttaagaaggttggccagtgagagaagattccaatggaaggataggctaaaacaaaatagagatcttataattaaatattaagatttttggattttatcctatattttcacaaagtagctagaatacaaatatttctacactaattatattttagaagtgaaaaactcagatgaaatgtgaaagaatttagggaagaaaaggacgttaaaaatcctataattaaattaatccaagttgttaagtatgattgtatagccaaagttactgtagttcccaaattccccaccaactcttctggaatttcaggatatttgctaggttaggcttgttgtttttaactcttaaaggacagggtatcccttgattacatctgggtaccaccaacatagtctatagattattagtaacaattttttaatttgaaaggtttatagattttatataataaaggttggaaataatagctgaactctggaggataaacaaagctataaaattagggttttaaacatagggcaacattcttggatgtgaaattttctagactatcaaatatccatcaccacagtaataactgacaccatgaaaactaaaacttagccctatcagaggattttttgagctgagtattttctactctgttaggaaatggtactgaccacagataatctgagtaagttggatgcttggaaacctgatggtgggccttaaaaggaagacgctgaagtgcctattaacataagcaggtggaagctgagtgattaataatgcaaatataagaagatctatttataccttaagaagatcacaccaattacacccatgaagatctccagcttatcataaattcttccttgcctatcagtatgccttagtttattttccattggtatttttcctcttcatccatagctccttgtgtattaatgtagattacagctgatgccccaaatccatttatttatttatattttagagacaagatctcgctctgttgctcaggctgaagtgcagtggcaggacgatagctgactgcagcctcaaattcctggactcaagtgatctcctgcctcagcctccagagtaactagggctacaggtacaaggcattacacctggctatttttttttttattttattttgtggagacttggtcccattatgttgcccaggctggtttgaacccctggtctcaagtaatcctcatgcttcagccttccaatgggctgggacgataagtgtgcatcaccacacccggctagatgctcaaaatttaatatttagagttttagaatttaagaacctgaaggaactttattaattgtctaccctggtgcttctgaagtttcattgaagataagtcttctagtgtgcttgttaaacacagatcctcccagctacctcccctggggactctgattctgtaagtgaggaatgaagcctgataatgtctattgttagtaaagatccacactaattattcagggatatatgcgggaaagctgataaagttccaaatcttgttcgtgccttgctcaggcatacatagtaagtctcatagtctcacagtgaagagtaacacacaggtttatgcagtggtgcaatcaagctcagtgaagccttgacctcccaggctcaagcaatcctcttgcctcagcctcccaagtagctgagtctataagcatgttccaccactcccagctatttttctttgtagagacaggggtctccctatgttgcccaggctggtcttgaactcatgggcttaagcaatcctcccaccttggcctcccaaagtgctggaattacaagcatgagccacagtgccaaaccactattaccagtttaaacacgaaaaagtatttcattttactatactgttgtgttagagaaaaattgttttcaaagaccaaaataaaagagcaactcacaagtccatagagtttatttgtaaatttttatacttcaggttattttagaccaattgattcataaatatttctatttctaaactaattaataatatacattaaaacaactctagatctgagtgttcatctatagccctttcagtctatttaattatctaagaaagagataatccaatagatgcatatttgatgcatgttcttaaaacttgtccaattaaggacactgttagtgatttaataggaaataaatattaccagttccttttaatatgcttcagaaaactccccttcagaaatatgtggctttttcttcttgtttggcaacgtattttaattaaaatatgcaccagccccaatatatcgaaatgtatttgaatcttcctccctctatgaaaatgtcaatggcctaaaagacatttgtaactactctctgtgcattttttttgggggacaatgtgaactaaacaacattgcttatttctttaatggtcttgaaagacccagccttgagtcagttggaaagctgttgactaagaaccaactgagatatatttgcaatatttcaggggtttacagcttaaatattttggactttgatgagcataataagaacactgtaggagttgcattggtgatagcagcataggttagtcctttgagaagattttcttttctttttttgctggaaaacccagatatacagcagtgatattttacttagtgaaatgccaaacagaaaacattataatgataactcttctggtgtagagcactgccattagaaatgcattattttaagcaagcacttgatacggtatcagagatgtcttcaaatggagaggtaaattggtgcagtagaagtgacttcagatataaataggcttatttttgaagccagtttctgctacttactacttgaataacaaactacttaatttccttgacttttagtccttcatctgtaggataggaaaaacgacatctcttataacttagagaattagtgtaaaactcaaatgagaagaatatgtatacattaaggaatatggtaagaatttgatagctagtacatgaggtgaaatcaatattctgctttaattttatcatcagtgtatgaattttctcatgttccctctcatacatatatattacatttatataaatatatatctctcacatatatttatatttcagggttttacagcttaaatattttggactttacatatatatgtaaatatatatacgtatatatttacatatatgtacacacatttacatatataaacatatttacatatatgtaaatatatgtaagtatgtgtaaatttatatacatatatgtaaatgtgtgtgtgtgtgtgtgtgtgtgtgtgtgtatatatacacgcacacacacacacacacactgcatatatgaacccatagacagaaattacgaaaatattactttatttccatttgttctttctattatgttacaccataggggaatgactagtagaatatttcaagtgaacagcatccaattccgattataattgcttgttttctaagacaaaatattaaattacatcaagtatattttatagggcctgcaaccataaacatagtatgtgtaaatgtcaactttgctctagggaaaataggcctttcctcatccctccttgcttacagccagctctaggttaagacacctgattctgctccctgactgcattaccattgctttacatgtcactcctcctccaataaaactgaacttctaggctactgacattaatacatgtatccagggcaactggatggtttctgcactcactgacttatttaagtttgtgctcctgctgtatttttgcctcagaggttttcagatactatcctgtaagtcacaacatttatagaaaagctatttttaaatatttagcatttttagaaagtttcaatagcaggagggatatcaagtgcttcatatatccagaataagacaacatacgcatcaatatgtatcttggtttctaacataacactatatctttattattcaacaaatctgtgaatatttctatatagtcaagtaccttatttctttcacaatatctatttgaatagatgtaatttgtcttgttaatactttttagtttatttataactatttgaaatgtaaagcagaatgcaataaacatcataagtgttattttgtctatctgtaagtttatgtgagtgaaaatttctgggtctttgagacctgtgtcgtgctttaaaatattgacgaaagttgtccattgaaattcaaggtgaacactttgaattacacttccaataatggtagctgagtgagccaattttctagcacctttgcctacatcatttattgcataaagttttagtctttttcaattagataagtgctttgcttagttttattttaaagatgaatgattttgagtatatttcaatacgttgttatatcatcttttacttttcaatttgctcctatgatccagtaagcaataccttgttggaaataacttagtaagcaataattaggaagaaatagtttttttttaatttaagaattacatgttaaattcactgtctcatggattattgttagacatagtgtggactgatttaaaaatggcacttggcagtatgatcatgatgaaacttctctttttttttctatgtctgtggtttttttcttttttgtaaacattttactttaggtttgagggtacatgtgaaggtttgatacatcgtaaactcatggtaatcaggtttgctgtacagattatttcaacaacaagctattaatcgcagtactcagtaggtactttttttttgctcctcttcctcctcccaccctccaccctcaaggaggacctgtgtctgttgttccttcttcgtgttaataagttcttattatttagctttcacttacaagggggatacctatatggcataaaaaagggtgaaaatccaaaataaaatctaagacacatttatcaatttaatagcatcagagaataatttcctcaaactgtaggacaaatcaaatggatttaaaaaaatagttactgtttttttctaggtctatctacgttttctacatgacctgtttcttttcacaaacacctggaccactgcagcaattttaaggaagctgtgaatctaggtatcaggaaaatttgtttggtactattcctaaaaagcatcccataaagttgatttgctctaactgtttttcatatgaagtgagtttttcttgttcaccgttgacatgcgtctttcatcattagctgctatggagactgggaacaccttttgaaactattaaatctgtgccatccagaagtactgacactgagtaaattttgttcactgttaacattttataaattgagggaactttttgttgattattgataactattttatatagaaacaacaagctgacaccaagagtatatggaaacactgctgccttgaaatacttggaggatttgttaattgctattaaaatttaaggaacaagaaaatagatacaagggtggagccaggaaccaggaagtcaagaggttgtagtgcacagtgattctccccctatgactcgtaaattttcaataagtcttcgtaatgcgtgacggaaacagatttcttgtacaaaacaatgtatgataacacaattaagagattaagtcctgccttcagatcatcacagaaataaatgtgacatgaggggatgatggcgcttggaagacaaacaaaaaaatgccaaaactaaggaagtaagtcacaagaacttatcataagaacatctttgactctaagggacttaaaactaaacttgggcaagatctttaagggcccaagttaatgtaggagctacatgatctctttcattttagtgcagcaaactttgtaacatctaataaactacacttgagcattctattctttctatattttgagacataataatttaagtccatatgaagaaactttgtgaacctagaataatttccatttgatcgtaaggtagagtcattttaacaaagtgctaaaataggcctttaactttgtattattaaatctatgtttgcaagaatgtgctttagttttcttatatgccagataaattaagaagctttatattttttatagagtttagaaattattacaaaatatagaaattaactgctcgttgaaaatcttggtaaatttttgaaaagcttttaaaatgttttttggcatacgcatttttaggggatattgcttgataatattttcaattttgaccataattaatagtatattcatgcttttagctcttcatgatataatttttgatagctttttttgaaaagtcatgatttccatttatattttgatttaattgaacacattttatgtagtattatcatatttttaaatctctttttgatgacaattttatcccctatttttcataagtgtttgtttcttctcatatttttctctttaaataaacatttctatgatttatttgttgatttaactttattgcataagtttattgaacgtgtattttgatttttttatattatatattaaaactctgagaaaatagttttttaagcaataaggttattgttaatgaaagtgcatagtctacagatagcaatatatttgctcatagattttttcttctctctctaaaaatatatttcatcccagtaaggtttaaattttttaataaaatacttcgtaagggaagatttttaataaaataattacctattaatataaagcttgctattgttggatttcaaaagctaacacctgaaaatatgctaatcaacaaagaaaatgacatattctaatatttatatgtccctgcagatcttacattgtatgctagtgtgtatgtatgtgtgtatacatacactacacgtataaaataaatattacacatggaataaatatcggcctattttcatatatggaccaatctttattccatgtgtaatattgacaaacattttatttcaacatgccacttattataatgtgatatggtagcagattgcagaatttgggaaaatcagttaatatacattaaaatttattgtgaaataaaatagaactttgtctagaattccttactgggtttgaatggagacctacctacatccacaagtcttttctttcattgacttacttttggcagctttccatcaatcaggttacatataagaaaatagaacgttattaagtacagtttagttgcagtgtggtaaaagacatgctatcctaatcccttatcacccatcaagattagataggcagacagacagacagtcagagaaacagataatatagagagatatacactttgggaggccaaggcaggaggatcacttgacgccaggagttcgagaccagcctggccaacatggcgaaaccccatctctaccaaaaaaaaaaaaaaaaatacaaaaattagccaggtgtggtagcacatgcctgcggtcccagatacttgggaggctgaggcaggagaatcgcttgaacccaggaggcatagtttgcagtgagccaagatcgcaccactgcactccagcctgagcaagacagtcagactctgtctaaaaaaaaaaaaaaaaaagacagagatatatagtgcctgcattttcttcatgattttagttcttataagttactagatcaattaagcacaaaaatgaaatttaaatgaataaacagtgcaggtaggaatagaatgctgatttgattcttgctgctctggaagctgttttcttaaaccttacctacaagtaactacagttatgtgcagtatcaaaatggatctccttcctggatctattttcagcagagcagaagtgataaaatacatgccataccagcaactaaaataaaactttgtaatgaagaaatatggaaaagtttccttggcatgaaaaaatgaaaaatgtattactgacatatttctaattaactctctacttttaataagataaactataatataatgtcttatgaacatcaagagaaaagatacattgcaacgttcatgttaaaaaacactttatatatttaaacatattagttttctgaaaaatcttctacggtattagaaaatgttagtgatgggtagtgtgctaagaatcaatgaagaatggaagaatatttcctggcctctctacctttcttcgtgtatatttatgtcttgaaaactcagtctcggctgttcatttatctgcaataatctttctcatactccattatttatttttcaagttttgcatagaatatattggtttttgttgaaagtaatcatgagaaaaatgttatttcattgttacactttctaacattttaaaataaagcgtggcataccactgatcgtgttttgtgcttctacttgtgtgtcttacacacttcaaccttaacctctggtagagtggttatgtcgtatctcaatttaccaacataaaccatggtttaaattattaaatttattcaataagtgctgattgtaaaaatattaagttaattcatcttttaaaacttttttttaaaaatgatatatttaaccatgagaaatatattttcataacaaataaaggagtaacaatcattccacaatgacaagctatagtcagcttgatttataatacatcctgccaagtcctctaaggtatacaatacattagcaagttgcaatttggttcacactatgtaagaatgcattggaactactaaaacaaaatattattttttctcaatgagtacagaacactggggaaaggatatgctgaagtgctatctggcagccatagggtttctaatcatggcctcaacacaggaattttttgttcctggaagcagctattacaattcacaatggttgtagctcataccagcccagtaaaacttgggcatgttataatctgtggcaactgaaacagttaataacattaaaatttaatttggacagagtgtaagaaaccaatgctttagcatatctcttggcatactgctggctttaggaccccaaatatattttaaaatgtaacaattctgcaagggaaataatataaaacacatcaatttcctccctagatttaattgtactgaaaaaataattgccatataataatcacttaacaacatgaatgaagcagggataagggcacaatatatttctgtgtgaaaataaaagagagaagtgattaaaaaatagaactcagagtatgcataatacactttagaatggattattttccatcattgcagaagcaaaatctgacattcaaaaggaatcttatgctaattgtcaccttctttgaacattatcatttattatatttaaaatgagagagcattctttctcacgctctctaataacagtgcacatttttaggatgtacttaaaaaaatcaacgttatataacaagcatgtttgcatttgctataaacttaatcactaatcttagcaatagtaaaacatagaatcaagaagatagcagtatataattgctttaattacaatttttgttttgaaattattttagattcccatgcagtcataagataagagagaattcccgtgtacatcgtactcagcttcccccaattgtaacatcttgtaaatctataacagaaaacacagccaggatactgacattgaatagtaaagaggtagaatatttccatcaccagaaggatccctcacattgccctttgcagccacatctgcttcctgcctgattgcacccactccatgatccctgacaaccactaatctcttttctatttatatatttttgtcatttcagaaatgttaataattcaaatcattaaaatataacttcggggaattggatttttttcacttagcataattttccagagattcctccaggtccttgtgtgtattgatagtaatctgtacaacaaactcccatgacacaaacctatgtttacctatgtaacaaacctgcacttgtacccctgaacttaaaataaaagttaaaaaaatagttcattcccttttactgctgattcatattccacagtgccaatgtacccagttgtttaaccatcaatctattgataaacatttgagctgtttccaaaatttaacaattaccaacaaagctgctgtcaacattcatgtacaggtttttgtcttcatttaccaaggataaatgcccagatgtagaataactgagtcatgtgatagttagatggttaatttcattgaaaaaatattccaaacggctatatcaatttagaacggctgttccattttacattgccaccaatactccatgaatggtccaacactatgttgaataagagtgatgagagtagttatcattactttgtccctgatcttaggaggaaatcattaaatttttcaccatcaagcataatgctagctgtaagtttgctgtagatgctgtacgtcaatttaaggaagtttctctctattactccttttctgagaggcttaatcatggatgtgtgcagaaattttaaaatgtttttttctaaatatgttctttcacaaatatgatcaagcgatatttcatctttactcagttaacctggtaggttacatgattaattttcaaatattgaaccagttttgagtccctggtagaaaccttagttgctcatggtgcataatgctttttaaattttgctgaattctctttgctaacatttagctctaaattttgtggtctatattctataagggatattggtttgtagttttagtttttggcgctgtctttgtctggttttgttatcaggttaataatagtgtgttccctcttctattttctggaagtgattatgtggaattcctgttaattcttttttgaatatttagtgaaatcttcagtgaaatcactttggacaagatattttattggtgatatttgcaaattaaatattcaatttccttacggctcttcaaatatgctgtttcaatttgggtgaggtatgatagtttgagtttttaaaataattcgtctatttcaactaagttgtgtggaaagttgcttctattatttccttttttatccttttgatgtctgcagagcccagggtgatatcatttcattccttatattggaaacttgtgtcttcgctctctcatttttttggacagtcttcttagaaattttcaattttgtcattttttttaaaaaatacaactgtcttttcatttgttttttcttatttttttccattttcaatttcattcattttaaccatgttaaaattgattaaattccttcattctgcttctgtaggcttattttcctcttcatttctagaatcctgagataggagctgaaattattcatatgggatcttttttctaacctagtcacttagtattataaattttcttctcaatattattttaatgagtttcagaaaatattttatgttgtcttttagtttttattattctattttgatttatctatattaatttttagtgcatctctttgtataatattttggaggttactctgaaaactatatacagaacttaccacattctactactgtcagtattttatcagtttgaatgaagtgtggaaaacttacctccctgtatatccccttacctttccttatttataatgaaattgtcttaaatatctctcccgcttacatttagaaccactttagagagtgttgtaattcttgcttcatccataaaatataatttagaaaactctagaaaagatgggaaaatctattaaacttaccaatattattacttacagtgttcattcttactcttgatattttcatttcccttttattattttatttctacttagagaactacctttagccactcctttaggatagatttattagagaatatttcttcattttgtcctccatctgataatgtcttaaatttctctacattcttgagtgatgttttaagtcaaaacaggattctagtttaagtttttcttctttattcctcagaaatgtaaaaatactataccactttctcctggtcgtgacggtttctggtgagaaatctgtcattcatattcttcttttcttctacagataaggtgttatttccctcttattgcttttataaattatttttgtttggtttttactttctagaagcttgcctgtttgtgtctagctttagatttctttgaattttccacattttagatttgttcaacttgttgaatatgtaagtatatgttttttgtttgtttttgttttaccaaatttaaaaagttttcagccactctttcttccagtaagtttcagcaccatccactttcttctttcctttaaaaactagtgatgatacgaatgatagatctattgtttgaattgcatgggtccctaaacttctgttattttttccctactctgttttctttctattgctcagattaggtaatttctgtctttgagtttactgattaattctaatttccctttcattcttctatctttgagtttactgatactttcttatgtactcatcattctgctgttgaaaacattcattgagtttacttcttttattacatttttgtcaggtaaaactacacatgtaaaggcaaagttggtatctagtgattattttacattcagtttgacatcttcttgaatattcataacatgagtgattttgtactaaaacctgatcatctgggctagtatgttattggctacaaggctctgtttcaattttctgttttagttttttttttttcctctggcaccacaagagcaagagaacgggtatgtgctgccttactgattcctggcaggagtggaagtccaggatcctgtccattgaaacccgaggcaaagttctcactgctcctggattcgggtgggggaatctacgtccacactaggctaggtctccagtgacagcttcctagtggagaaggtttgaagttcttggctgctgctctttatatgaccctcagtgatactgtagtaggggtctccttcccaaaaggcaagaaagaaagtcccagtcagcctcctactcagtcctctacaaaggtacgaagagctcaattacatgggaaattataaacatacattttaaaaaacattatttataacaatgatacctttgaattacaatattttcaaacctaaagcacacatatactccttcttggatcatatttacttctaaccaattgataggaaattatttacctttgaacaaaccttctctgcacggtttttaatcgtacttagtggcaggaataaggaaaagtgcttcttctccatcttcctggaagcggaagtctgtataatggatttcaataatcattgcatatatctcctttttgttttttttaaagcaaataactgtagcatgtctgaaagtaatataattctgacatgtttggtccaggtctttttctgctccaaattctgggtccactgtcaagcttccttctcagagagttcaaaacattaattactatttcaagtgtctctttgcctcaccactattctgactagaggttttgtcctttattcacagatagaaagattgataggtagagagatagatgatgatgatgatagatagatagacacatagatagatagacacatagacagatgatagatagatagatacattgatagatagacacatagatagatagatagatagatagatagatagatagatagatagatagatagacagacagacagacagatgtttccactatcaagtgacaaaaataggttcatctttagccaggtgaaacctggaaattcaattgcctactttcctttgctccctgctctttgagatagatattcctgtcatcctgtgttcctggactaaaaataatgttttgttctgtcttctaaggagatgattccaagaatttggaagcaattgaatatttcttttaaaaaagattattatgtatgttatactttgttttcatctttcggtgacacttttaatatatcattattaattgaaaaatattaaagcaatatcattttcatgtaaagacaattgccatgatcatgagaaagattatatatttctcatttgagatcccactctctgcaatttcaatttagttgcacatacctccactcatatatacttcttgacctagtcacatcaaataaaagaaaacattaacacactaaaaagaaaatttaaaccaaattagtgggcctttgcaaagaagaagtattgtcttcaagcttatttcaaacgttaagcagatcaatcactgttaaattacaataaactttaagagaggtagcaggttgtaggagctagccagacaggcacaggatgtaaatgaacacagtgcactgcagaaactagacatgcagtcctggggcatcattattcacagaacaaaaatacgatgcagagtattttacttatttctcagtataagtatagtgaacatacaagtgccaaagttagagatagtctaagcaaaccttcagttaagaaaaaaaaaagcagtagtagtattaggtttctgtaataattgttttctgtaagatattttacctatccatattcgaaaaagtattttgatatcttacagaaactttgctgaaagtgcacaatagagtagttcttcttataaaaacaaatttaagctaattaatggtttttatcacctatacaatttagcaaccataatttctcatgcctgaagccaatattacataagtgtaatatttgacagcaatgttatgagaaatcataaaatgtttacataactttgatatgttgacatgttatgcctcttgtctatttctaggtctgtcagtatatggcaaaatttcactatcgatgtggcaatagtcagagttcttttctatttgatgacagccgtcccaaagattagaatattagcttaacaaaaatgattaggctactgttgtacgaacagctcaattacatgggaaattataaacataccttttaaaaaacattatttataacaatgttaagtttgaattacaatgttttcaaagttaaagcacacattgtatactccttctttgattatatttatttctacacaattgataggaaattatttacctttgaacaaaaaatacatatctatttttcatgttagtgcatttcttgatttcttataatctttttgttactcagggcatatttcagtaaagctgttgactgtttctagtagtttcattgttctgagagtgtgaaatgcatatcacatcaactcctagtgtgcgtacttcattcttctgcagaggtttatgtcttctctacttatcctgaaacaggagaatttatctatgacagattcgtaccacatacacaaaactgagcttctagcaaattccactatgtgatcaaatttagtttaaaagacggtcggtggctgcagggacttttgcaaagaagattgttaactagttatctactgggcacgacaacagacaactgccgacttgtaccaattaatatttttaaatatttaatattgagtcgctttctcaatattctgagacatctcgtcaatgccttcttaatataaaaagatcccagccctcactagcatgtgtatgaatttcacatgtgacatgaagttaagaaaattcgtggcatactcttccaaggttaccagctcttcttttcacacactatgcaaatcagactagaaaagaaagtattaatatgtttaatatgaaacaagcttcagtaaatatgaaattatcagtagatatgatgaggtatgtattttccatgctgtgtaattcctgttgggagcattttgtttttcagtttgtttgtttgtttgataggtggggtcttgttctgtcatccaggctagagcgcagtggcgcgattatggctcactgcaacctcaaactcctgggctcaagcagtccttccgcctcagcctcataagtagctgggactacagatgttgccaccacacccttgttaatttttaaactattttttgtagtgacaagttctcactattttgcccagggtgagtaagcatttaaaatattcacctttttttaaaaaaacatcaatagcccttaaaaatgccacgccatgatgtcattgtcattatgctgctggcagtggtagccacaaggtacacatgactatttaagcttaaattttaattaaaatgaaattaaaccaaaaaattcagttcctccatcatgctagtaacatgtaagtactcaataagcacatgtgttaattaccactgcgtctaacagccccagattagagtatatttcttcatctcagccagtcctattgagtaacccatgtccataacaattcttaggctctcatattgctgaggtgatcattgttgagtttctttatgagtattctataaattagtaaaatagtccaaaaaaagtgggaggtgggggagtaataccatgcaaaaacatactgtgagcaggaacacttgtgagtttatctatcatatgagtgaacttacatgtttcaaaattagctaatagtacagatgggaggtgatgcctcagtcatctcatatgttgatctaatttcttagtctcagcaaactagattcaaatgtagaccttacttgtacacataatacttctgtttagagtcctctatgttgtatgttttcatacagaacagaaacataaaaaaatagattgataccaaattatttactacataccgaagaatccattgtaaatgcagaatcttctcaagtttgggaaagaaggcagtatcaatttttgacaatgacaaagttacacatgaattataccatctgggatatgagaaagcatgcgacggattaaaaagacaggacaggacttcagtaactgtgtcatgtcaagattatactaaacaatatgtatgcgtgttcacatcactccagattactcctctcttagttcagaatctcaaaaacattaaaggaagcagcatggtatagagttatatgtaccaaataaatgccataaaaagtccaactttgttacacctagctttgtgacattgagtaagtctcgttggccattctgggccttagttttcttttatttaaaatagactttctctgtggttgtcagtttgatcctccaaatcccctgttccaacataaccaaactacagaatcaacttccattaatcacttatatgagaaaactgatacttgcagcgggaagaagctgaggttgtcctccctctctgccctggcccaatttctatttctgggctgcctccttcctcccagttaataaccacttaattccttgcactactgtcttaggtaataacacaacatcacggaccagccaaaaaaaaaacaaaacaaaaacaaaaaaagagaaagtgccaaaatcttcaaatttataaaagaagcatttttttcatatttagaagggatctcagacatcatccactgcaatatcctaattttacagatgaatcagctgagacctagaaaatgacaaccaactaaaccaaaaatggcttatgatcctattcaattctttctcatcaacatatttctctccttcatactgatctacatcgctcatcaaccacttttatgaccaatcattatttttataaagaaatattaagtccagcacatgtgtagttcagcatgtatgtccacttcatattcaacacatataaagtcataagtacttgcatgatttggattgaattatttgagctttagttttttccccttatgatcctacagccatatgctgaagggcaagtaagacacacctggggaaagcccatacctaactcattccagcacacctgcttgactccttctacttatatgccctgtattcctgctgactacaattttaccaatcctctgacctcataaagactgccaggggctggcatgcgtgatcagcatgaaagcaaatgtgccacattgtttagcatctgttcctaactccccatgaagctttctttgcaacaagcacagggctgtcaacttcaatcagcttggtagtgaactccagtaagatacattagccctcatctaggattgtactttccatgatcacacctacataggaaagcatttgggtatgcaatggagaggttttatgttaatgtacccatattacaaaaagagaaattccctagttttgccctaatatttctatcagtgtttcatgagatctgaaggttaagtatgtctctcaggacaaatagcacaattttagcaactactgtatgtctatcttcctccttaaaatgcttctctggagtccttgataaactcttttgacttaactccttaagcagccccttattctcatctttattgtaaagataataaaatttaaatatattagtgtgcatttgttgaaacacatttctaaaatatgcaatgcactttgaaattggatccatttgagtttatcaggcattgcaattaaagaaaaattactttatacattaagaatgcacaagtgctgcataatacacaatgactgactttaggcttttaacacataaacaaattcaaatatttaaacatccttaatctgccaaatccttaatctgaaagacgctaaataaatatttccacattttccagtatacaaaaccatgcatttgcgtattatggtattacagataatcatctgaactctcagtaaaattacatatctattcttaagaggcctaagctaaaaattatagggaaattttttttaaaaaaaatatactaccctaaaatagagtaatgccttttggtcctctagtcagtctcaaaatataagtgatcttatatgaaaattttttaacttatgactttctcacagatcatacatcaaacaaacaataacactattatttataatttaaactttatttttctgtcatgaagactcttatctgtctgatcatgtttttatttgataatactttcattagattgatcaagtattttctgagtatttctgccttcatattcacattttagagcattcttgaatgtctggccatcatttaaatgtatcacatacaggagtgctcttgtaacttctttgaaagtacaatgagattggcacacagcagtaacactgtatggttcactactgaatattttaaaagtaaaatgaatcatcaaaaaccagttaaatgacttcagaactatataagttaaaatatttttatcaagaatgattatatgcctggcacagtagtgcttgcttatagccccatctattctggaggctgaggctggaccatccctttagcccagaagctcaagtccgacatgagccaaatagtgacaccacatctcttttaaaaaagaatgatttttaatagttcttgtagtgataaattatcaggacaattcacttatatggaaaaatccattgcttgatcataataggtaagtgaggctctactacaggtacacaaatgatagcgataggaggcagacaagttcccaggtggacagggaggggttcctggtgaaacttgaccttcaagtcaaggacagtgtgaagtctgaacaccaaactacgagctccagatggagtccatggaccagactgagaacttccattcttgtttggtatactcagcccctgattagtaccgggatcttcacttcagccctgcattggttctttacactatcatacctctttctaaatgttgctttttccaagcctattcataaacctatcagcatacgtttccccattctaagcccataaaaaccccagattcagcctcttaactggcaatccactttcgggtcccctctcggtgctgagagcattcttcctgttgctcaataaaattctactctgccttactcattctccagtgtctgcatacctcattcctcttggtcacaagactagaaattgaaactcactgaactgcgggaatgaaaaacctgtaacattccctcccgcttgctgagctaccagagtgaagaaaccactgggcaccactccctcctgctcaccaaactgcaagggtggaaaagccacaaaggaaagacgcgagatttcccagtaggtggcagtccagaagtttccaaaaatgtaagaattctaaaataaccctgagaatttatgagttatgagaggatacacaggatagccatgaagataatgaagagtaacttgatatatgtcacttaatagattcttctctctttttttctacccctcaaacctaaatgctgtctccttccctactagtttattttctttcctattcaaatcctaaccatatcccaaacttctaagaccatccactaggaatgtctagtagattgtaatttgaataatgtaattaatgttatcatatgtaaggaagcaagagattaaataagtttgatagctatttgggtccttaagtaagaatttactaggacccatgaaacaagccttaatttaataggatatcacaattaaaattctacatataaaacataaattaaaacagctaattttgtcaaacaaatgtaaaagtagttgatttaatggtttcaaaatagaaaatcatttttctttagcaatcagtacattttaaatctttccatgtagttgttttagttaaagaactattgaaaatactgtggaaataccagaatggcattttatgaagacctagagattgaggtatgcttgtgtgatcaaagtaaggcactaaaaatcacagatgtatccagatgatagagaagaaattaatttgagccccagaatctgaaaaaaaaatttcaattgcaagaatatatttacttttcagcagcagaagctggttagagtaaaccttccagtaaagctgaatggagtcttggtaaagctaactagtggtctttagcaggtagaaagtggataatggtctttggagccaccaataacagaattcctccctgtgtcctcaatgattactacatagatttgataaatgaaagagacagacactgaaatgacttggaattttaaaactggtgtttcagaagaagaataagcgaataagcagcaagataaagagagctaactgttcttatgctttgtgggagcaagtggaatagcattcccttcctagaaaatgataataatgcaaaaatgtaagaggaaactatcaccatctgaactttgaagctggctcattgagagtttagggaaaatgtgtctagtatgccttacagtgaaaacttgctttgtgtgtggggggagggcgggggggaggagggtgttaccataatacaataagtgaaaaagaagactaagctatttcacttaaattgactacaaaaacgtaaagaaagtcccgactcactactaataatttgaatgatagaactctctttcattcttttgctctgagcttacttggaatgtcagataatgtcattgtgcaaacaactcagtctacaactttcaatcttttctagttcttacagcaagcagaccaaatacatttttccctctacaatcaaattgcattatttctttgttattattattatactttaagttctagtgtacatgtgcacaaggtgcaggtttgttacatatatatacatgtgccatgttggtatgctgcacccattaactcgtcatttccattaggtatatctcctaatgctatccttccccactccccccaccccacaacaggccccggtgtgttgtcttccccaccctgtatccaagtgttctcattgttcaattcccacctatgagtgagaacaaaattgcattactttctttccaaaatggtatttgtgtacatccaatgtacctttgtaaaatttaagaattttttacatttttgtattagcaacactaaaaaaattggaccttttcttatcaaattaaaatatttaaaggctcagtggaaatcttttattttaatttttgaagagtttattgaattatattcattattgattgagatttttaaaaacattctatgctaatgaggaatgtggaagaaaaacattactagatttacattatcctatgatagcaaatagaacatttagatatattctaaatgtggtttttgtttcaaagaaactcatgatgacatacttttgaagatctaagtgcaaaatttgaaagagtggagaggattccaatctaggatcagccaggctcttttctggtattcaagtgtactcttttatccatcaacagaaggtttttctacttttacattataatttctgtaattcatggcagatgataagtttaaacaccattaaccaaaatatatctttcctccaaacaagaataattattaattttatgtgaagagtgatcagaaaagttttggaagaatttctgggtaagatagggttacatagctctcagttttcatgctgtcatggtgactgaataccttcaaaatgaaagcatgttggtagagctgtgaaaacaaaaatgagagcaagcataatgaagaaagacagctgagaagtgacgtgacacagcagcaaggctcattctaccaggggtatgtgctcaacaaagggcaaaaactctacaggagctgcagcaatagattcaaggatgtagtcagacaaatgtgaattgggctaaaaaggtcccaatacatccttcgggaatctagccacttggagttggaaactggagctgaagtgttgaggccagagaagttttaagatgccaggtgaaagctgaagttatgaggtagcaggaaatatgaaggagaagagaagagctggctggcacagagaagagggaagcaggtgcagaaacagaagaagggctcattggtgttcagtgaaaatggtggggagataagctgttttctagagctctttctgtctaaactctctgaaacttttaatacatgagaggaaattagtgactatttcttcttactggaaagtttctaagtagaactgtatatttagtttctagcattgtcatcttgcattattaaccttcactctttcctttatccaatcagtaagtaaatatttgttgatcatctaatatatgaggagcattttacaggcatgggaaattaaccaaataagaaacagtcttgtttttgaggtgctcatgatctgggacaggagaccgttgagcaaatagctaattaccgcacaggagggaggaggaaccttaatcaaaactggccatctgccttaatgggagggaaagggtacaaggtaacaatatccaattctgtcaccttcaaaccaagtataaactcattgaaagaaagtacaacttttatgtctttttcaatatctgatgcacatcacggaatcctaaatattttaggctgatactactaatattgtgatttttgaaaatgtttcctcaggccatctagtactgtaccatctgatgaataagcataagggaaagaatgtagtttctcagatcaacattactgttcttagatatttcacacttaaagttaaatcgataatgcaagaatgacgtatctcttcaataaagtccctggaccttctaggtttgcttaatcatattctgtgattttttattagttagtataaaaacttcatctaataatttgtgcctgcttttctgcatctgtttatgcactaactgtacacaaacatttgattcaactaaagcagtgtgaacattttgttcagggctcaactgatattattaaaattatgagttatttagatttgattacttaaatttgaatagtaaagatttcaaatgttctgtgttttgaaaaatgcactgttttcttatttttaattgtaagacatctatgtgggctaaaagaaagtttaatatatttccatgaacaggaaaaaaaaaagtctgcttgctttctcctaaaaactctatgtgactaaaaatgcatctaagaataacattagtaaagtaaatgcaatgggccataataagaaaaaaggttacatctggtaaaaggtcacaccatggatttcactcgattagcaatgacaatctttattatttcctcctatttgccccacacaagctgtaattaaaattatttcatctaccccaaaatacaacttaaatgtgtaggaaacaaatcctattatcattaaacttcttttgcagtgttaagccttcataacttttatgaaaagggaaataaaatttattagatttacataagtcacttaatttttgctttcatttataaatatcatcttattctatcattccaagatttcacacaattttattaagaggagtgacactaaaatttctaaagatgtttctggaaccattttggagaatggattagggttgtagggaaacaaagcaagagataactgtattttaattatccaagttagagaaaaattcatgaagtaatattaaaaaccatgacggcatgtaaaatattaacattcagggaatctgtgtgagggtacatgggaactctatactattttacaaattattgatgatcttacatagtttcaaaatataagttaataaaatgattaatcaataagcttaggtggtaaatgagagctttggcagatacaagtttaaaatgaacaaaactggggaaatacactcatattaaacacattcaaaataaacactaagtctcaaaatgcctagaaattctgcattttgtttagcatatacatatgaaaagtattttgaagtatatcacatttttgtctttgcaattatactctaatgaaaaggtacatttccagacaaggatgctgtgtcaaatatggcatagataaaagaaacaattcattcatgttgataagaaaatacatcttgtaaaagtaaaaggaattattaaattacgctcaaaattgctacaaagtcagaaaaatgatctgaaatcattgattttatgatgacttctgtatcgcactgtaaacatacaacattacaaaaaccaaatgctatctaaatttgatctaaaattaaagttatttgaacgagatctacttttgatttcttttcatgcttcagatcaaataaaaccatttccttagcatatagaaattattactaaataaaattttaatgaaaaaaaaacctgaaaggaattttagaggaatttctataatttaagccaactgaaaatctccaaaaaggttttgactggtgattttttttcccttgggtagcatagaaatagaagcacttaaacataattcctttgaccctggtatatgctgctcaaagcagtctgtgtgtccatgtataagtgtagaagatcatgaggaatattttaacaaaactaagggctttccatttttttcccattcaaccttaatttcatcatgagttaatgtgaagatataagtgccacaaaaaagaaaatagcaactattattttaatacttgttagtcttcagtgttgagcagagaagtgacctgctataaagcattttcatcactaggaagctataaaaaattaagtaggtcttaagccaagattctataaaaaggaaattcaaaataccttctttagaactacaaaggaaggatgaattgcatgagttatgattttaacacaagccaggcaatgcaattgttcctgctgctgacacagccccatcatgactctaacagctcttctgaatacccagcagtattcactatccatctcctggttaaagatgtccactctgtaagctctgcaatagagttatctcctgcaggacttcagaagtctaatcagagtctactgactctcattataactaatttctgtcatcttgggagcacacatgaactgcatttcttcactatcacttcattttcaagaccagggtggggggtcgtctagtgcagtatcattgcatatctctgtctaaatatgacaaccacatttccactcagttttggggcaacctatgtcaatgtggggactctctacaaggcactttgctacaaaagatccaaacaagacagagaaaaataattacaagttataagctatttcttcaataaagataatatttcaatatttggcctcattcttcccctagggaagtttgagaaccctagtatctgactttcttctcttctctttctttcttttctttttttttcacttcttgagctcttctcctggaacagttgaatgtctctttactttctccttcccatccatcagagatttaatactgttctctatctctcaccatgacttactaaaagaaaacatactaataatatgagctttatcatgctcaactgtgtcattgaatgttcccccctcatgtaaggtttgtacagggaaattgctgccatgataaaatgtgtttgtgaacgctaaagagctgttatactttctatagagaagatataaatgtgaaagtgtgaattccatatccttatcaggaggaaggtgcatggagaaatgaatcgataaaaatagaaagagaccctctatctccaggtacaactctttcgtttgctttgctttgttttatccatcacatatatttttaactgagtcatacatctgattgctgtactctccattctaaatgattcaagatgaataccactaacgttaattaggcccactggacatctttcactgtgagagaatataattttaaagtatatgtatagatgttctatctggtgcatatttcgaaatatccattctctgctgttagaataattataattattgaaacatgtcagcttgtccccatcctacatttgtatttgctattttaacttatttttatcatgtctctgaatgcttttgatgtttagtgaaggcaacccttaaaatggattttttgtgcacaactttatgtcaggctgtatttaaatctttgagaatagaaatataaataacacacagggcttgttttaagaaactctacagtcaagtgggaatgaataaaacatcaacacatgtattcaatatgatgtaaatgaagcaagagtagaacattctagatgccatgggtgaaccaagagaaacttaacccaacctgtggaagtgaggactgtggccctcttctagggtttctgtggtgaaattactaacataagaaaagttgtttgtgaacctaaatagctgatatactttctatggagaaagtgtcagagcaaatgttagaagaataattataacttttctccttaagcataacacaataaggcctttcttgtaaaagcaaaagcatctaccagcagctgttcattactggagcataaaatcttggctattgagtggtgtaagtgaggcagaagagttaggcatgaattaggttgtaaaagatgctatatgctgtgttaaggagccagctggactttatctgttaggcaatgaagagtcttacatatattttaagatagaccaagtgtgcattctagatggttccctctaattgcaataggaagggtggatttgaagtaggtcaattagaaagctatttaaattacgtgatggttaatttcatgtgtcagcttggctgggccaaagtacccagatattttgtcaaacactggtgttctggtgctgaagaaacatatttcagataagatcaacatataaatcaacagactttgagtaaagcagattatcttccataatatgagtgggcctcatccaatcagttaaagaatttaaaagaaagaagactgacttccccagaggaagatagaattcggccagcagattatcttcggactggaactaaagcatcgtatcttccctgggcctcccgccaaatggcctaacctgaagatttgggacttttcagcctctaatacaaaaccatgtgaaccaattctgtaacatctctccttgtctctctctttctatatacatcctattgcttctgtttgtctggagaaccctgattaataaaaagaactatagaagagaccatgtaaatgtcctcaataaaattagggaactcaggggtcagggaaggctagggagaaaaggaggcaagttttattctgggcaacttccaaacaagaggatattggggaagattggtggggttctccagcaactgtttttttgtttgtttgttcgtttttcattttttgcttttttttaaacttattttaagttcaggggtacaagtaccggtttgttacataggtaaacttgtgtcatggaggtttgttgtagagattattttaccctccaggtattaagcctagtagttgttatttatttttcttgatcttcttcctccttccatcctccacgctctgaagtccccagtgtgtgttgttcccctctatgtgtccatgtgttcacatgatttagctcctatttataagtgagaacatgaagtatttggttttccattcctgttagtttgctaaggataatggcctccagttccataccagcctggaatgcagagatgtcagatagaagtcctttgttggcttgtttgctttaatttaaaaatagaggtggaccagtagatgagatcacctaggaagaacatgtacagtgaaaagagaaacaggtgaacacaacacgctgagacaaaatttaagaagcctgacaaggaaaaagcctataaaataaactatgaagaatttaaaattcaagggaaatccagaggaaatgacataaaataaactaatctatcctggcagagaaggtcctttgtgtatgtatactatgactctgcagtgcacaatgcttttcgttcaaagattggtgctatatttttactcctggaaaataatggctattttctctgcttaattttttttttttttttttttttttttttacaaatttctgtctttttgttaggtttataaattattatcaatctctgtcttggtgttgacctttttttcattagaggtatcatgagtattaatatctactatgagaatttttatggctgaatattacctttctaatacaaactttcacctgcctttgagttttttgctttgtttcttattttaaaaatttatattctagactggatatctgttacattatatctctatatctttcgtctttacaatttttatcaaacccttccactgattcccagattttgggggttgtttcaatggctttatttctgtcttatttatttaaattttctccaaaaatagctatattttagtgtatgcaacttgatcacattttcactttctgtttaactactttgattaatttcataatgtccttatgttagtgatcacatatcttattacataattcctttgattttatattgaggatagtagtcatttgtaaggcgttctgcttcataaaataattatattatctcatggaaagaatttttatcctcataagtagtacattattcttctcttgtaaaataaactttttacttgtcacatgttcaattttggagattttcttattcatgaacaaagaaatatttatatttgccttaactgttctttactgcttgttatgattgtttagttgatgttaacttcattttttcacagttatatcaaaacaagtaatgttaatgttcttatgtatatatatgtatatatagagatgagaacatatatatgtatatatgtatatataatacataagaacattaacatatgtgtatatacaaaaacacaacacatacacacacatatattatatatatcagatataaataaacaggtgtaattttctctaattttattttttaagttccgggatacaggtactgaatgtgtaggttcgttacataggtatacacgtgccatggtggtttgctgcacctatcaacccaagatctaggttttaagctctgcatgcattaggtatttgtcctaatgctctccctcccctttacccccacgcccggcaggccttgatatgtgatgttcccctccctgtgtccatgtgttctcattgttcagctccgagtgagaacatgaggggtttggttttctgttcctgtgttagtttgctgaagatgacagcttccagcttcacccatgtccccgcaaaggacatgaactcattcttttttatggctgcatagtattccatggtgaatatgtgccgcattttctttatccagtctatcattgatgggtatttgggttggttccaagtcaatgctattgtaataaacatatgtgtacatgtgtctttatagtagaataatacataatcctttgggtatatgcccaataatggaattgctgggtcaaatggtagttctgattctagatccttgaggaattgccacactgtcttccacaatggttgaactaatttacactcccattaacagtgtaaaagcagtcctatttctccacatcttctccagcatctgttgtttcctgactttttaatgattgtcattctaaatggcatgagatggtatctcattgtggttttgatttccattttccaatgaccagtgatgatgagcttttttccatatgtttgttggccacaaatatgtcttcttttcaaaagtgtctgttcatatcctttgctcactttttgatgaggctttttgtttttttcttgtaaatttgtttaggttccttgtagattctggatattagctctttgtcagatggacagattgcaaaaattttctcccattctgtaggttgcctgttcactctgatgatattttcttttgctgagcagaagctctttagtttaattagatcacatttgtcaattttggcttttgttattattgcttttgatgttttagtcatgaagtctttgtccatgcctgtttcctgaatggtattgcctaggttgtcttctagggtttttatagttttctttctaatatcttaaccctcatttataatccccaagaaatgcagagattacatttgcctctttcatttcatccccaccaggagaaaagggcactatcaacaaaattgcagaattatggaataaagaagaagatgaaaattcttttattcactaatgactatttagtatattttggaaaaggaacagagaaacaaaaggaaaccttacagagacactttaactaaattttctatcctgtactaatatttggccttaaaagcataaaggagatttgtccatcctgttacttagagcaccgagctatttatacacagattctatttcctatttctgaactaggggcagtaaggaaatagattgtggactctcttaaaccaaattggtgttcctggcacatagttttaaaagctactacatcacttctctccattaattaggataattgtagaaacttttgcagtgttttggtttatgtgtttttatttgcattattttgggttgttatcatggattttttattggtgtatttcatattttaaaaaaaaatctgaaacagccatcatttttagatctctctgctaagggtgctatttacgtttaatcatcaaagtatccaatgagttagctactattaccttttttttaacaaatgaagttaataacactgacatatatagggccttaaaaacttcttcaaattcattcagctagaaagggggaaaaccagtgattgtaaacaagcttaagtacaaaaactgagctattacactctgtgttatattgactggttttactttaatctgtctgttctgcttggatattttatttaggaacattggcaccattatatgtaatataacataattatatattacatgtattttcacaattgttctaagtatgattaaaataaaactatgtaagtacttcagaatgctttggtttcttgctcctaatactgtactagtgtgattatatactttgacttctttcagactttctctattcagactcctcctagaaatttgttcaaatattctttctaatctattatttaactttcaaaattgtgatgtatattaattatggtctggacatttctaagcatcctgtaactctgctgagttcttaaaacacagtttgcccttcactaaaatcattattacatgattgggtaaaaatgaagtctagacagcctccatcattatcctggaaaagtaatttaaaatacccagttcacccacaagtcacaagggcacaaaaagtattgtgtaaagagaccaaatctccttccttgtccatggtgctgtaatcacttaagataaatttctcaaggccatctttaggtttgatcacaacagatatttactgtaaaaactgaggaatcacggatcctacttggccatcttagttaagaacttggactacactggttatttagtacgggcaaggcaagatctttaaaattatcacctctctataaaataataaatgaataaataatcttagatctatccagtaaattacacacaagtaccatagtaatatagcattttcggactgagttcaaattctgtttgactacatatttgactacttagtagctgtgtgcctgatttgattacagaatttgaaagacaagatgaattactgttaaatactcttagagatgtgttatggcccatcaccagtgtttgtgagaatggagtggttacctaccccaaagcttcacctatcagcagatgtaaggagccccgagcacagagtaattatttgtaagagggctttaatggtgatttcccagaaatattaaaaaacacttgttgtgggaagtcagggaccccaaacggagggactggctagagctgtggcagcggaacataaattctgaaaatttcatcttaatatggacatttatcagttcccaaataataattttataatttcttatgcctgtctttactttaatctgttaatcttgttatcttcataagctgaggatgtacatcacctcagaaccactgtgataactgtggtaactgtacaaattgattgtaaaacatgtgtgtttgaacaatatgaaatcagtgcaccttgaaaaataacagaataatagcgatttttatggaacaagggaagacaaccataaggtctgattgcctgcggggtcggggaaaaacagccgtattttccttcttgcagagagcctataaacggacgtgcaagtaggagagatattgctaaattcttttcctagcaaagaatattaatattaataccctgggaaaggaatgcgttcctgggggaggtctataaatggtcgctatgggaatgtctgtcttgtgcagttgagataaggactgagatacaccctggtctcctgcagaaacctcaggcttactagggtggggaaaactccaccctggtaaatttgtgctcgaccggttctctgctcttgaaccctgttttctgttctttaagatctttatcaagacaatacgtgcaccactgaacatagacccttatctgtggttctgcttttgccctttgccttgtgatctttcttgggcccttatcagtagtcctgcttttgccctttgtcctgttccctcagaagcatgtgatctttattagacccttattagcggttctgctttttgccctttgaagcatgtgatctttgtacctactccccgttcttacaccctcttcccttttgaaacctttaataaaaacttgctggtctgaaactcaggcgagcatcaagtcctacagatatgtgatgtcacccctagcggcccagctgtaaaattcctctctttgtactgtctctctttatttctcagccggctgacacttatggaaaatagaaagaacctacattgaaatattgggggcatgtcccccaataaacactgacacagactgaaaactaaatttaattttcataaatggtagaaatacttattaggtctgaggatgagtttaccaactggcaatagaaaggacagtgatgctattattattcaaaataataaatcatagaaattcttgcccaataagataatttttattaagataatattatctttgcttggaaacaacaaataagacaatatttcaattatacttttgaaaagcaaatgcttactttttttttttttacaaaatagcgaaaacataaacccttcttaagattattacttttatttcattttaaaacttaaaattctttttctaaatgtcctactaaaagcatcatattatttaagatatactatatgctattacttgcaaaaataagtttacatatggagatgacacacatatttcataaagttcaatgtgtttaatctactttatgtcctggctattagccatccacaagggcaaatggttttaattttctggacttctgtcacttcttatagataaaaaagggcactaaactaaagttccccaccccctcactctagtctattgtacaatatatcaaacctatcaactaacaagtctctaatttctgtatttttttattcaacagctaattttcttaatccttctttttctctggcaacatttctagtactctaatgaactttgttttgcacttgctatgtatgattttgtgatttatcttatgccacaattcttgtagtttacttcaggaaaaagaacttatcacttggtagttgtttgcacttggataaaaatgactgaatttttctttataaagtcaaggaaaggaaatatactgccagctaagactaagcatgaaagatttcatctgagagggacaatttgtcagaaaatcatgaggagctgcatacggaagggtataatggaagcagtcttgcaacattaacgatatcatttactctcatcaatcctgtaataaatccacacacaccacactgaggggcagtgcggtctctgctgctggtgctcgcaggcagagctgtagtcacgccctagaaggtggagccctgtctcatctccagggcaagtgccatgatgtgcgtgctgaggaatgaattcggaaaatggaaatggcagctcagaaaggcgggcaaaaactacgggcttaaatcacctccagagtgctttcttatcgtggacaatgagttactactcagcaaaatatagtttaaccagtgcgaagactaaactgcaatcacagggataaaatagctttctgaaaatcattgtttcttttataaaggtgccattaataaatgtcattgtactctccagaaattaaacctatgcccgctctgctaaactcataaatgtagtcatacttggcacttacagatcagttttaaccattctaattacacactaactatgagagattaggtacattcttccatttaattaataaagtttgagggtattaagatatcttttgcccaagttcaaaagataattaataagcagtaatattgtatttatatatttaatggtgttatatgaaagcacggagttataccatgtaaaggaagtaaaccattttttgaagaatatttttaaaaagaatttaaatttaaatttagtagcattaatacaatgaaatgcggtggaatctcagaaactatacaacccatgcttttactcttgttcatcagtgtgaccttgggaagtttatttaatttccctaagtttctgccttttcatctgccagaggggatacaatatttgctttaaagtgttattgtgaaactccataaagcctggtctataatgcatataatcttgctggaaaaaaaaaagtacctaatatgggctctctggcatcttaaactttcctctcatatttaaatggctatagcctgaacgttataattcagggtattttacaaaataattcacaatataatatcttaatcaggtaataatttgacactctgttcattaaagaaactcagcatatttagaatcaacacagaaattccaatttattatccagacaatttgtaagtattacatttttcaagatgtttcaaaagaagattagctcgctctgacaaataagctccctcattcagacggccagaaagggtgctgacaggtgacacaggttttcataatctgcttagtgtcatcaaaataacaatgatggttgacagctaaactgttcctcttagaagtttatgtaaacgctttttatatctcagcactaaattagaatttcataaagaatcttttttatgccttcatcaaggacataagacatttttcctggcaaaatgtaccatatagaataactttcattagtcacagctaataatgcatggaaataatgtttgttcttgtactttactggcattaattgagtgtttactctaaggtctgttttaaagagcttttgtaagtgttcactcacttaatgcttcgaatatctccatgagatcaacatcatcatcaccattttacagatgaagcaccgaagccagagaagttcagtaatcagcacaaggtaaccctgctaagaagctagtcttggagccataatgtgaatcaggctatttgcctccaaagctcgggtccaaaaccttcaatcaggttaacatcatcaatcttgttaatatcatctggatttacaaaattataaaccccttcacttatttatttgttaatgcatatttattgagatctttttatgtgtctaggattgttttatgctcaaccttaacagaaagagtaaatttcattcacatggcagataggacctttgtgaagatggaagggcagaatatggataagtctgatagtatatgttgttaattaattgttagtatatgtcaggtacttctggaacacttttattattttaattcttttgatttctacatcagcctgatgaaatagatcacacccactctacagaggaagaaacagagccacagtttaaataacttgcacgaggtaatagagctaataaatgagaaagccaggacttggacaaaaaggtatagccccagggttcatactttgaaccactgctgaaaggttagttggagatggttttagcagccagcaacatgacgaattcttgcaatcaacaccaattttgtataagaaaatactccacgggcagggaagacagggtcctgttttattccctggctatataacatttatgaatataaaaatgaattcattttatgttcttaaattgttgcatataaaaaacatcctgatttagttgtgggtttttgagaaaaatgaatgcttacaggtaaaagcatgaggttctgaattttaaaaatttggagtctatgttctatcaaaattccacgagaaatgcacataacaaaacatacacccctgattttatccctgtgagctatttaaataaagtttctcccattttctaagttctgccgttactgacctttttcagctttcatttagtaactgaaaattagattataattagtgggggcttattttgtttggtgtatgtgcctgtgcatgtgtatgtgtatttttaaaaaatcaaagtgagttcagaaaaatcagaatatcctgcatatgagaccaaattgggtcaacaattttctcaagaaattgttctattccattgatttcaattcttaaatgaagaggtatttggcgggaattatgtctgattttgctgggcaggctgaggctctactgcagttggtgaggctggaagtcttgaaacacagctattttctcttcctgttaaaggccagattactttttctagaggggttgtaaagaagtgttagcacagaggctgtggtggttggtagtaatttaccagttaattgccggccaatgctgcctgttaattaccagcatatcttgccttaaggtagagtagtatggaaaatagcgactttaagtaaaattcaagtttgtgtgtgtgtgtgtgtctaaaaaagaaaagacaggttttacagtagttattactgaggaagtcagacagagctagtaaatggagattcaaaggactgtactttcactgaaaaactatcttaccaaagtgctttcggattcggacagaaattatgctgtttttcctcctatcaggggaagctagccaccctagatgaaagatgtgaacagacttgagtaatgccactttgttcataggagacaaggacattcatttaaaaatgggaacggatcagaatctgaaatagtttactgagagaacaagtgaaaaaattaaaacattaaatttgaagatccctctactgaaagtgaacctacacttttaaaacttaaaaaaagtcagcgaaaaataatgtatcacctactatgtgctcaaccaagatatcaaggtaaataagaacagcttctgctccttagggaatttacacttcaaagggacaaggaaatgcggggacgttgatagaggagaagaggtacatatttggatgaaccatataattatatttctaatacaacatagtaaatcctatcacagggatgagatacttgaatacagacatatatgaatacagacaaataaaagaataaatctgccagaaaaggccacataaataaggaaagaaacaagtaaataaggaagattattatgagaaagataggtgatcagatttgtagcttaggaggtaacaagttagtttagatgggaattaattgttaagagttaagttggtaaggtcaacaaaagaaactcctacaggttgctagtggtggtataaattgatacaatcacactggggaaaaaaaggtggcattaaaggttaagattcctagacttccttctagacgctagaacctagagaaactcttgtacttgtgcaaatgtaatgaccaacaccgacatacaagaaaattcgtaagatcattggttgtgatagcaaattaaacaacagaaatatattggaaacaacttaggagaagagataaataaatgagatttgttcattcagtgaaatgtatagcagtaaataaatgaattacagctgcacaagcgataatatatattttgtgctaaaaacaatataatggttgaattgtatacaaatatgcatatacatgcatacaaatatttatatttatgcatttattttatataaattatataaatatttattttatataaaatttatatttatgcattaaataagcatataaataaaagcaggaaaagtattcaggattgtggttatctacatggagttacaagatattggtaaagtttgctttttcttttgtaggatgaaatatttcataataaatagtttaaagtgtcagtgatgacagctggctgtactactgctatgtgtggggtctaaatgcaggatccgctgggaattatgaaccttggtgttcagaacccaaaactgttttttccaacttaataaataccattgcgtagatcacaggagcatctcctgtgcttatgaggtcttaaccagcaataggagacctgggattgctggtaaccttgccatcaattcttcccaactcaagatggccctttagaaggacatacatcatattgccataaaaaattacctgcctttcagggtttaagcagatgccaagtgaccaaatggagaaaatatcgtaaaatgatctcttgtaatgtacagatagttgttctaaaatttcccaattccctttcaatccaaaaacgacaatgatactcaattattttcttgggatttttctttcagccaactttcttcccaatgatcacgcaagacttctttccccaatttgtttaattaatcaattgcttcaattattacccaggtctgggtattcttgacttctctttaactcacagcattaatgaatttgctctccccatttgcttaataaatattatttatattgtaattcttttttttttttttgctggctagttagcatatctatcagctagaggccaccaaaccttagttggtacttttgttcttaaaatcagtactttattattgtaacaatcttcaattatcaaatatagaaagaatttatttagaatgagtgttgacgctagaaaagaatactgcctcagtagaatgcctggatttgagagacctgctagactagtctattaactaaaccacaaagatgttatagtaatcaaccaaatagcaattgataacatggaaatgggttgtactgacctcaacaaattgatgattcaaattttcctcttcaactatttcatatatatattatatatattatatatattatatattatatatattatatatattatatatattatatatattatatataatatatataatatatataatatatataatatatattatatatataatatatatataatatatataatatatattatatatattatatatatacataaaatatatatattatatatatataaaatatatatatgaaagtatgtatgtatgtatctgctctcatagccaggaaattatttatttctatcctaagtctttcatcctgtaatataaagtcatttccttttttggttttctacaactgggtatctcaataagtagaataattttattttctaaaaaatgaaaaacacaaattatttccaaaaacacaagggcatatcaatcatatacatcatgcagaatatcgctcataatgatggacttccacaaacatcataaaacatgttggcagctatccttgctatgctaaaaatacaatattttgataaaaataacatgcccagtttgctcaaataaaagatgttaacagccacagatttccctgtgttggatacaatagttataatgaaagtgaaatacattttgtgtagatcaatagtactccccaaacaactgacgcatgattttctacttcttactatagtgtggcaactagtctttggtattctctgtagatatgaaaaggaacataatgcactagtaaaaacataacattggttttattttactgctctgatggaagacgattacaaattatttcacacccttcaagtatatacaacataatctctagtattcaggattgctgaagtctgcaactacataaggaattctgaattttttctgaacaactataagtgactacattgagctagagagtgtgttaccttacaaagagtgtgtcaccttacagtgtgatacattcctgaaaacttcatctgtgcattttacttcagctacatgcaaatagttttcgtgggtgaaggaaggacagttttccttctgattataaaaaggtcaaaacataattttttaaaagacatgcttcaaaggaaaacgtaaaaaaataaataaataaataccaacactcctatggaaacaacccccttttaattatccccaggaccatgttgcattataatttacattctggccagctgaggttcaaattaaagagctccatgggtgacaggaaccctgaggcccatgaggatcctgaggacacaggtgactgtgtcaatgatttaacagggatggcttatccagccttggtgtcagcatggggcaaagtattgggagtctgatgcatgtagccatgtaattacgcatttaagtatattttcctaattaatttaaatatgcttgaaaagctcacaaggcttgaacctgaaaattcctggggtttagtcattggaaggaatcaatgctccctgaagtgagagagcttgtcgcatcattcatgagcttttgaaagatgcctttgatagagaaaatcatattactgaaatttcaaaatttggagaatatgctttacctcttttataatattaattttagttaaaaaatgaggctgaaaatgttttcagcaactgatagtctggttgctatttaaagcaggacaaaagaatgtgcaggagcataaacattgctcctaccatacgataaatgactcctgaaggacacccagacagtagtcagagaaggcaggagcagagctgagaacagaaatatgatggctagagttgttgatatttgtgtcaaaatattcccaaatgagagggtaaagtgagccaactcttagacaaagaagtgattcagatgcattcccagagaatctcataagggagaatgtacctacaagccttcaactcaacctctagccaccctcacatggcctcatgccttgatccctgacctgggacgcatatccatgtctaggcaacagttattattttctaactctgtgaaaatattgactcctggccaacttttctttgccttcagtttcttatttgatgaatactttacaaaattataatttattggaaaaaaaatggaaccgtggctcatttccctccatgagcacatgctgttttatcttgatatgcaaggtgacagtgtctcctctctggaaggttaagccacctgcccgcacaggctccttgctcacataattgtggtgccttacaacatggacggcagctagggtcattttcccttttgatattgtgtttccgagttagaattaagagttagtgaagtcagaaagagacgattcttgctaaaccaatacccagtggggtttaaaaaacaaacaaacaaacttaaacagcccagtataggaatatcagtgaagttaaacagccagctttagactcactcctgaggatgcagagttctaaagaataatagcagtctggtcagcagtgaaagatacttgcttgtatgtggagatatctgaggtccccaaggaaaagcagaatggtttaaaagcagagtagagaaactgaaggcatcagccagaaaatataaagtgagctaaactggactttgctgaagccacaaaattttcccagataagtcatgctcatagatttattataaacattcagtaaactgcagcaaacttcattaatacattatacaatcattttgtaattagttacttttataaaagagtgatttaattgctggtttatcttccatttacgagggatgtgctatgaaagaatgggatcaccatctgatggcaattataggcattagtcaatgtacttcaggagaaattccaggctttcagattcagtcatgcagtgtgttacatagaaagcagatatagagatatataaaggtatatatgttatatgaagtaattcaaaggcacatatgatttataaaagtaatattaattttaatgtgaagtatcacttctaaaagcaggctaatttcttagattttaagacacagtaagtaatagttcatacttactggttaaatgttcttgaaatgttctaatgaatcaatgtgctgtactgtctcgtgatctaaatttcccacacttaaatggcaggtagtaatagcatacgtgtgtcaggactgaacctactgaatgtattcttaaaataaaatattattttctttgggatttaaaaacacacacttgtaaatattgatatgaataacttttgattaaaaaattaaagtaacagagctagattgtctctgaaccaagagcaataagatgtaaaatcatagtggtacttaccacagtgaaattcataactttcaatatccatattgtcatggctaagttaactatcatggtaaccaacagcagaaggacaaagaagtataagcacctctttcgccatccataaattcccactgggtaaagttgtgcattctcagtccttggcaggttattctgttgggttgctagtatgtattgttctcgtgtcatctgaaaaagaaaaaagaaagaaagagaaagaaggaaaaaaaaagaagcattaaaaaaaataaacccatgatttttttgaaacaaaagaacaatgtacgttaaaataattggcagtgagcattcaaataactattgttgtgtaattaaaatgttatagaaaacttcgaatcattttgttcaatatagttttttagagatgtttaattcattgttatatccacaatatatatattatttccagtcagatttgtcccatttcaacagtaagtttttcccttgggaggctcaggtctacctccagttaccggtaactaaagaactctactcatgtccaagtgatacagtttggatctatgtccccaccaaaatctcatcttgaattgtactctccaatgttggagatggctcctggcgaaaggtgatgagatcatggcagtgaatttccccctttggtgctgttctggtaatagagttctcatgggacgtggttaagtgggtggcacctccccactccctcttggacctgctcctgccatataagacgtgtctgtttcccctttgccttccaccatgattgtaagtttcctgaggcctccccagaagcaaaagcctctatgcttcctgtacagcctgtagaactaggagccaattaaacctcttttctttgtcaattaccccgtctcaaatatttttttataccagagcaagaatagatgaatacaccaagctacacttagactatgatttacctgttctttgcagtagagagagactgagtctaccacaaggattttctgtacctttctctaaaaatgcaggatacaaatggttcagtatatatgcttcagtaaaaatattagtgtatttgcaagaacctatgaaagaaaattcacatttgtgcagatttatgtagacaatagctatcaaattaagttttattcagaattatgttggttattttagttgtatttcaatgagttatcagaaaaaaatatttaactctaagaacactatatattataccatactatttcataatgtaatgaaattagaagtcagttctgaaaaactaaagatgatattctttgataatgcatacattcaggttctagaattaattctttcaataagcaaatgcattttttactgtcttatacaacttagaaatatggataagaagagtaaaacaatatgaataagcactgaatatgtcttaagtgtacaattttcagaataacatatttattaccagaaggatggaaactgatttttataaaatataattttctataagacaataattgttcattattatctcttcagttttttctcagattgcttttatacttattaaatgacgaatctaacataaatacttctgaataaattatacacaaataaaaataatattaataagtaattaaattatatgttaagtaatataaaatatatgtactatacaattatcattgtaatgttcattgactcaatcctactgtagataaaatgttgagaatttttttttccataggtttttgggaaacaggtgatatttggttacatgagtaagttctttagtggtgatttgtgagatttttatgcatccatcacctcagcagtctataatgaacccaatttgtagccttttctcgttcactcacttctcaccatttccccctgagtgcccaaagtccattgtgtcattcttattcctttgtatcctcacagcttagctcccacttatgagtgagaacatggaatgtttggttttccattcctaagttacttttacttcacttagaataatagtctccaatcccatccaggttgctgcaaatgccattaattccttcctttttatggctgagtagtattccactgtacatatatataccacagcttattgactgatgggcatttgggctggttccatatttttgtaattgtgaattgtgctgctataaacatgaaagtgaagtattttttttgtataatgacttcttttactctgggtaggtactcagtagtgggattgctagatcaaatggtagttctacatttaattatttcaggaatctccccactattttccataatgtttgtactagtttacattcctaccagtggtgtagaagtattcctttttcactgcatctacaccaatgcctattactttttgattttttgattatggccatttttgaggtagtaaggtggtattgcattgtggtttttatatgcatttccatgatcatttgtgatgttaagcattttttcatgtgtttattggtcatttgtatatcttttttttgagaactgtctatttatgtccttacccactttttgatggggattttttttttgctactttgtttgagttcctagtagattttggatagtagtcttttgttgaatgtatagattgtgaagattttctcccaccctgtgggttgtctgtttacctttctgagtgttccttttgtaatgcaaaagctcttcaatttaagtcctagctatttatctttgttcttattgcatttgcttttgggctcttagtcatgaaatccttgcttaagttaatatctggaaggatttttccaatgttatcttctagaatttttataatttcaggttttagatttaagtccttgatccatcttgagttgatttttgtataaggtgggagatgaggatccagtttcattatcctacacatggcttgccaattacccccacaccatttgttgaatagggtgtcctttccctacttcgtgtttttgtttgctttgttaaacacaaatagagaatctcaggtcacacctcaaggaactagagaaacaagaaaaaccaaacccaaacccagcagaagaaagaaaataaccaagatcagagcagaagtaaatgaaattgaaacaaacaaacaaaaatacaacagataaatgaaacacaaagctggttctttgaaaagataaataaaattgataggccattagcaagattaaccaagaaaagaatagcgaagctccaaataagcacaattagaaatgaaatgggagacaatacacctgacatcacagaaatacagaagatcatttaaggctactatgaacattttaagtgcatagactacaaaacctagaggacatggctcaattcccaaaaagatacaaccttcctagtttaattcaggaagcattagaaacactgaacagaccaataacaagcagtgagattgaaactgtaataaaaaattaccaacaaaaagagtccaggaccagttggattcacagctgaattctaccagatattcaaagaagaattggtatcaatcctgttgacactattccaaaagatagagtaagagggagctgggcacagtggttcacacctgtaatctcagtacttttggaagccaaggcaggtggatcacttgaggtcaggagtttaagaccagcctggccaacatgggaaaatcccatctctaccaaaaatataaaaattagctgggtgtggtggtgggtgcctataatcttagctacttgggaggctaaggcagaagaattgcttgaacccggaaggcagaggttgcagtgagcagagatggtgccactgcacttcagcctgggtgacagaatgagaatgactcttagagagagagagagagagagagagagagagagagagagaatcttccataaataattatatgatgccagtatcaccctaataccaaaaccaggaaaggacataacaatgacaacaaaaaactacggaccaatatccctcataaacatagatgttaaaatccttaacaaaatactagctaaccaaatccaatagtatatcaaaaagataattcaccatgatcaagtgggtttcataccaggaatgcagtgatatgcaagtcaataaaaaatatgatacaccacataaatagaatcagaaacaaaaatcacataatcatcccaatagaggcaaaaaacacatctgacaaaattagcatccctttatgattaaaaccctcaacaaaactggcacagaagggacatacctcaatgtaataaaagccatctatgacaaaccctcagtcaacataacagtgaatgcggaaaagttgaaagcattctctctgagaactggaacaagataaggatgtcccctctcaccactcctcttcaacatagtactagaagtcctagtcagagcaatcagacaagaaaaagaaataaagggcatccaaattggtaaagagaaagtcaaactgtcactgtttgctgatgatatgattgtatacctagaaaaccctaaagacccctccaaaaagctcctagaactgatgaatgaattcagcaaagttttaggatacaaaactaatgtacacaaatcagtagttctgctatacaccaacagtgaccaagctgagaatcaaatcaagaactcgaccccttttaccatagagcaaaaaataaaataaaatacttagaaatatacctaaccaatgaggttaaagacctttacaagaaaaactacaaaacactaccgaaagaaattatagatgacacaaacaaatggaaacacatcccatgctcatggatgggtagaatcaatattgtgaaaacgaccatacttcccaaagcaatctacaaattcaatgttgagaaatttttataaaaattatttggttttccatctttttgttttaatttcaaaattactgtaatttcaaactgcattaatgtcctgttaaatcttatgtttccattttttaccattgaggcatgttatgcttcatacaataaaaataattggataagctattaaaatatcataattttaaatgaattggaaacgctgataacggtagataattcatagcaagttctctcagaatgtaaaaaatcctatttattatcattattatttaagttaacatgtactatttccttaaaactgaccataaagctttatttcttaattaaactctgatttggcgtagatgtgaaacccattatgttatgtaacataagtgttataacagatgataagttgccaaggaattgactttgcctgaggaatttggtagaaatttcaaggttctgacagtggttttgataatatagtagagaaaacataaaaagagaatagtatgaagagaatttggttaaggtgtacaaaatacagttcgatagaagggatgagttctagcatttcagcagaacagtagggaaattatagttaacaataatttattgcacatttcaaaagagctaggagagaagacttgtaatgttcccaacacagataaaagataaatgtttgaggttatgaataacctaattgtcctgatttgatcatccaactttgtatacagatatcaaaatactacatctaccccaaaatatatacaacatatatatatatgtataaatttttaaaaagcagaattttaaaaatgaagattaaaggagctctggggatgatcacatttaatgggaagaacaaggaggagcggagaaggggaagaatgtggatgtaggaggagcataggagaaagctgaagactgaatgttcctcactggcaagtaggagaccttccccttgtagagttggtctctgaaaattccaagttaagtgctatgactcttcagatcatcgaatcccctttatctcatattaaagcaaacttattttctagaatgttctatttctacaaattatatttcaatatgaaggtgaaattactgtgcattagaaatgaaaacttactaaatctatgaaataaaacatacacaactacaaagaaaattgtctttcagcaataagattgaaattttttttggtaaagcaacagagatttggtaactatatcaaatgcctctaacaattttgacaagcaaatgagataacaagaggctaaaagaaaagttgtgaaaaaaacaaaacacaaaaaaaagttatgaaattaaagctatgtttatctcctcaagaaattcaatattattttctttaataaagcttagtttaacattattattttataaattgtcttcatcacaaaatactttagagcatctacgctgcagtaagaaaaggttagacttttcttttaaaagttcctttttttgttgttaaatctgagtgtttttcaagatcacaaaagctttcagtggctgttttagtgcaatagtagtattagcagaagaataaaaacatataattctaagtgattatgcaaactatcctccatttgaaactttacaactttagctttaaatgtttaatattgccatttttaagcattaactatattctgaaatacattgttttctttggcattatgaaacttctataaataaaagtattttttactaactgcctattgtcattctaatggaatctaccaaacaatgctgcaattgcagaggtactgattttctcagaacagttaagtggatttcagagagttgatcacaattttctgagagacaatatcatagtaccaagatgtttctctggcttcataatattgctgtacctcccttttgatgttaattcaatgccctcaaaatctgtttgttacaattatcttggttttcttggctacttacagtaactaggaccctttttattttagttttgccattctgtttcatatcacattttatgtttaaaaagcattcattagaatcaaatgacttctaaaatctaatgtttcttagctaatactaaggaagttttcagcattcttgggtcaaaatgagtatccgcattgcttatattactttaaatgcatttacttggatcctcctgcaattcagggaagagctggtttaaatttgcactttgaaatttctctacaaaggaatacactttccaacgcagtattttatctaataatgtaaataacatttctggcaagatgttataaggttcaatgaaagatgcctgatcaaatagaattacatgtcaatttttggacatttttctcccaaggtgtggaaaatctggttttcagacagggttagtttgctggtaaatttaaaaacacagcatgtagacaacagaagggaatgaattaatttggaatcacctaaacatggttcatcactaataatcgagccctagagaattctggtgacttctactgatctggatggtatgggagaaaaaataactagggtagcagagaccattttttaccttagtcccttgcctcacgtaaggggaaaatagttcaaaatattagtgcccaggaaatttactaataattccaaactagctggaatcattacttcagtatttttatataagtattcaggactgggaatagtagttgagcctccgagcagaagattgttttcatttaataaaatatttacgagtgaaaactattggaaggtagaggtcaagattgatgcattatgaatctcacgtttgacgaaaacacaatatgtgcatagaaaaataaataacaacattatcaagtagtaacatgatctgaagatgataaatacaataaaaaagaaatacattatataagcaatataatgttaattagtgatagatattacaaatataatggacatggtaatataatcggggactacttttaaaatggtagaaagagaatatctttcagagcaagtgacacctgagatgagactaaaatgaagaagagacataaaagaagtttttatttgaaggcctaattggagtgggataaacagaaaattttaaaaattaagaagtagagacagcaaatgtagacaatttttgagagataaagaaaatccaataaatagaattgtagatgagtgtctgggggtcttgtattgcagtattaaacccacgaccaataccaacgtatacaaaagataatagaaaactgaaaacaaatgaggaaaatgaatgtgagatcaataattgaagtgacgaagctgggatcgagagagaagtcacgtgatcttagagatgtggtagcagaggaactagagacaatgtcagcaaatcacccagtcaactgggctacccaaaggaggagtagtatagacaggtaataattattataatccaaagagaatattccttgaccttatacactattatgctgacatggaggactcacatcagcttatgaaaaactgaagatagctgtgctatggctgaagtttgcaggagtctggctccgggacaagtggtactgagtgtcgcctcctccacagtgtgcttcctcagagcctcattaccccaagcttgctctgtgtggatttcagtgtctgagatttaggatacctgcaagtaaaagtacagtcttcaccttttctactccaagagtctttccattccttcagtgaggttttatttttattttctaaaatggaagtggaagaaggagggcataagagaatattatgagatatggcttctttctggatagacggcaaaggctaaaataaatgactcctgttaataggtgtgagtggacagaaagaaaaaagtcgttaaggaaatgtacaatgcctaagacaattcgtttaagttgttgttggctatattaagggtctaaatacaaactatcaatagaatgccttgttttattttctgtaaggcagaaatattgtctgaaaggatgaataaattatcccacctaaatgtgtgccacaggtttgcttctttataaccctgtaagtgtagggatctgaaaaatttaaaactggcaataagaactaagtttagaggtgagatctggtacatagcttttaaaaatccaagtttcatcaagaagacaaaaagaactctcgagctttgtacaaaagcttgaggaagtaataaagttaatttaagtccagctgttgagaacctattatctctagtccaaattttatcactaagtagtcaaaagataaagtcaaaaacagaatgcaattgtatattgaaaaatataattgatataattttttaaaaatattacatttaacaatttataatattactcacgtaaaccctgaatataatgaggagagacatgcacaaatgttggaggtaaacagtaaattatttgctcttctcactcactaatttgattccttaaaattaaaatataaattgagcctctaatttctgtttagacctgtgttccctgttatgggaaatatgaatataaaagagaagcatgtgagtcctggatagcaagatagataatttgagaaattgcttttaatttctgatgatgaagctagcatttggcgtgctgaaatagcaacatgcaacatccttgtgaccatgcaaatttaatctggattccaaaacctcttcagttccttactgggagtgttgatattccaggagaagtggtaaatcatgttgctgtcactgttcattaggtgttgatcatatttagatttaacgctacaatatcagtcatctgttgtttattcaggcaaggaatgcgacacaatagtttaaaatgcagtcctagacttactgagttcagatcccagcttgtccattgccttctgtgcgtcttagggaaagtcacttagcctctctctgtcccagtttcctcaaagctcaaatgcatattacattgacatatataaaggcaatctgggagtagaaaaggaggatgttaaagtactcttttcattttaactagtaaaagtactcatttttaaaatgtatcgtctaccccttagctagtgatcccctacttaagtactgtagaagtatttttattggaattaacttttaaagacatggttgaaatagaatttttaaaacataatgcttgaagggtccaaattatgtggtgtgaactttccataccagaaaggcattttgttttctgctccaacaaaatgagtctctaaacagctactaatgttgagagagattgaaacaatacagtaaagcctacttaccacggcaatttaaacttctccctatctatgatacttaatgctcaaagggacatttcagcataatgatagtcaaaatttgctgtataagaaaaacggccatttggagtggattttttttttctacttggtttatggaaaatgctgtagtcaggttttgcagcacggaaaagaagcaacctagcaactgaatttcaagaatgatgaaagatatctgagtcaaatgtgctgcctcttgagacaggaaatagatgattctagccaagcctgacagaaaagagaaaactgaataggcactaaaagggaaacattcccagatgaaaacaacttttatttaaaatgtggacatttaaaaaataatttttttcagtcattcttagttttctttacatacctcatacatcctaaaattagacagttttatgtgggaaatagttatccagtatttcattggatgaaaatgcaatgactttttttttttgacatttatttaggcacaggtttacatttgggcttttaactttgaaatcatttcattctcagagcttttctgctaataagaatagaaatacttagccattaatgcaattttgaaggagcccaaggtagtctttttcctgctcagaggttatcaacatggagagataaaacaacaaagacagtccacgggcaccatttacactaaaattgcaagcatgagacactcattggtgagtcctgctgcatgttcacagcaggggaagaaggaaaaatctttaaggaaaaacaaattggccagaaacgcagcaggagagcttaactgggcaagcagaaagcccacactacttcaaacagtaaggattaacaagaaaacatatttgaaaaacaatggtaagaaaacatatccagaaagaggaggggatattgtcttgtattctaacaccaagcagaacaaggtaatgagaaaaaagataatagaggatggcttccataacactgataataaagagaaagacaccaatggttatgaaaaatcttgcaaacaattttcaaaataccttattggaacgtcatttttttttccactctgacaaacttctttacattttaccagattcatgtaaattatttatagtgtagtcaaatttattttgatgtaaaattttcaaatggataataaatctatgggaaattcgttctgctttgggttatctcacttatggagatgaaaggacaaattcacaatgaatatgttttaatttaaaatgaactgctttaaacaaatgaaacagaagatcttgcagagaccaacaaagtctaactaaaataagtgtttaatcagaatattattatatgctgactatttagataaagagaaagcagttggactaataattttatttttattctcttgaattatttacattttaaaagagaaaaaagataagcccgaatattgatataacaaggtagaggcagacaggaaatgggaaggagtacagcattcaatggcacaaacaaggaagtaaaaagtggccgaatggccatcataagatggggccagtgtgggtagatctctccatccctgctgggtcgattccctactgaggccagaccctgattctctgctctccactggcggatctcagtagagaccatacaagagacaatggacccaagaaaggtgaaagctttactcatcattacttacaactgaggtacacctatatcatgagtacaatttgcctttccaccaaagatgaaaaaggaaaagagaaaatgactgatgctaccttcttcttttgttttacatgatagtgagaggtgacagcatgctggcagccctcacagccctcgctcgctctcggcacctcctcggccttggcgcccactctggccgtacttgaggagcccttcagcccgccgctgcactgtgggagcccctttctgggctggccaaggccggagctggctccctcagcttgcggggaggtgtggagggagaggcacaggcaggaaccggggctgcacacggtgcttgcgggccagtgcgagttccaggtgggcggctgtgggctcggcaggccccacactcagagcggccggctggccccgccagctggccccaccggccccgggcagtgaagggcttagcacccgggccagcagctgcggagggtgcaccaggtcccccagcagtgccggctccccggggctgtgctcaatttctccctgggtcttagctgcctcccagtggggcagggctcgggacctgcagcccgccatgcctgagcctccctcttccccatgggctctggtggcgtcggagcccccccagggagtcgccccctgctccacagcgccgggtcccatggatcgcccaagggctgaggagtgcaggcgcacggcttgggacttgcaggcaactccatctgccacaccagtgcgggatccactgggtgaagccagctgagctcctgagtctagtggggacttggagaatctttatgtctagctaagggattgtgaatgcaccaatcggcactctgtatctagctcaaggtttgtaaatacaccagtggacactctttatctagctaatctagtggggacatggagaacttttgtgtctggctcagggattgtaaacgcaccaatcagcaccctgtcaaaatggaccaatcagcaccttgtcaaaacaaaccaatcggctctctgtaacatggaccaatcagcaggatgtgggtggggctagataagagaataaaagcaggctgcctaagccagcagtggcaaccagctggggtccccttccacagtgtggagggtttgttctttcgctctttgcaataagtcttgatactgctcactctttgggtgcacactgtctttatgagctgtaacactcaccgtgaaggtctgcagcttcactcctgaaaccagggagaccacgaacccactgggaggaatgaacacctccagacgcaccaccttaagagctgtaacactcactgcgaaggtctgcagcttcactcctgagccagagagaccacgaatccaccagaaggaagaaactccgaacacatccaaacatcagaaggaaaaaactctggacatgccgcttttaagaactataacgctcaccgcgagggtccgcggctccattattgaagtcagtgagaccaagaacccaccaattctggacacaatatgatcaacctcctttcagtgttggtattaagaaactaaagaacctttgcaggcacatggatgaagctggaaaccatcatcctcagcaaactatcacaggaacagaaaaccaaacaccgcatattctcactcaaaagtgggattcaacaatgaaagcacatggatccagggaggggaacatcacacactggggcctgtccgggggtggggagaaagaggagggagagcatcaggacaatacctaatgcatgtagggcttgaaacctagatcatgggttgataggtgcagcaaaccaccatggcacatgtatacgtatgtaacaaacctgcacattcagcacatgtatcccagaacttaaatttaaagaaagaaagaattgatcgttttgaaaaaaaaaaaatacattatcagaaaaaaaaaaaaaaaactaaagaagatgcttagttgttcttgactgagacttttggaggatttatatgtcatactcttttctgttgctttatgattttttttgtgttagctcaccataggattataaactcctttgcttgcaattctttcagagtcttcctaccagcaaacacagagctaggcactctgtaaatgacaaaagatatgaaaaatcacttttgttgattgcctgcttcttcctgtcaggcattttcctagaggttttattgttgaattcagttaaagttaaattgattttcattataactcagaaaagggagcaagcactttgagaatcaccgtagtgccatttactccatcattacatccatgggcttcattaaataattcaatatatatttgttgactgtatggatggatgaatatgtgcagaaagagtataattcaagcaattggaaacatattcaggggcatggtgggaggaagtgaaattgtatttgagtcaaaatattccacagttatagacatttttttatttggaaattggaaaagctgtacctgtttcttatcatgtattgtgccagatgacataacaagactggtaaaggaagctttcgagtcaatattatttgaaaacatctttcattctaactttaaatataacccccatgtctgaatcaatactactgtaaattaggaggcttctgaatcacattaaatataatatataaaattgagctatttagtcattatggtttcactgattctgttgacagtgcacagtattttaattcattgcagctgaaaatcaaataattttactgatgcttagatcttatattcttcttcagagttaaatagctccattattttttatttctcatacttttcacatagatctctttgtgtgggtccttactgtttcaggatttctgttataccaaaataattttacagttttacagcttctgctttatttcttgtttctttccttagcttcaagaaatatattttcaaaacacaaatatcatgtttatttatgtattaaacaaaaattaacttagcattttcactcaggaagcactcttctagaagctatggatagaatagtgacatgagcaaacaaaaatccctgtcatcatggggtctacattctcttgatggacacagacagtgaagaaaacataaatgtaacatatggtaagtgagatgttaagaggagctcaagaatgccaaggaaggaggaaaataaaaataagtgttataatttagatagggcagcctgtcgaggcctctttgaaaactgaagttttgagtaaagtccaggaggtcgtgaaggagggagctttgcagccattgaggtaagaacatttcaggtgggtgggggctgaaatacttgttcagggtggagtggggaggcagatgcagccggaccagagaggtcaaatgccaaagtgaggccaaagaagtgaggaggaccagaatctcatggggcactggaatcttttttttttttttcagccagccctaccatgacaacttcatacaaaataacatagcaaccctccattcctcattaccttcatctccctgatttgtttctttttggaagtatttatctctgcctagcatcaaatgaaatatttatctgttgattttctgtcacgtccattagaatataagccatatgaagaccgggactttggggttgtttacacatgtaactccttcaagcagagcaggtaggtgctcaataatacttactgaataaacaaatgactttgtagctaccatttgtcccatcatgtggttatgcattcagcaggtattcagtaagttctgattgaataaaatttgtcatttctcctgaatctttgaggtaagtcttcctcaacaagaatataaggtgtgatagtcagaggatggagttaatgaaatcttaaatttcaatactcttcttgctatttatgtcacactaagtatatttgttctttctgagtggtttatttatgcaagggtagattcacctaccttagaaacttatgtaaatattaaatgtggaaatgtataacagcttatctaagatataaatattttttcatagagcttttccttcttcatcatgtcagtgaatatattttctaagaaaaattatgtaatatttagaatttctgaaggaaattgatagctttgttattactgactttcaagaatttaaatcagagaacaaagtactgaaaaatgcatacctccagattttggaaatgtaacaaatattcaatattcaatgtgatatgaataacctaagagactatttcatataactcactttcaacccctatctgcctcttatttccataagcttttaaagagttttattttattccagtattgtgcaattgaaaacaactttcaatcagttaatatatctgaaatgactagaagcgataagaaagaatttaaaatggttatgtatgtaaaatacaataattttacagatattaaataaataaaatgactttcatacttttctcactcatcgagattagtcattaccttgacaggtgtattagtcagttttcgcactgctataaagaacacctgagactgggtttataaaggaaagaggtttgactctcagttccacatggctgaggaggcctcaggaaacttacaatcttggtggaaggtgaaggagaagcaagtaccttgtctgcaaggtggcgggaaagggagatagcaggggaaaccgccacttacagaaagagcagatctcatgattacagcatggggcaaaccgcatccatgatccagtcaccttccaccaggtcactccctcggcacaagaggagtacagtttgagaagagatttgggtggggacacagagccaaaccatatcaacaattgcaaatgtatttgcattaatgttgctgtaatcaaaccaagtagtcactgtttttagcaacacctgtccacggaggcaggcaattagctgagtatacagatctggctgtggtatgcccaactatctgattattcctattaatattctgtgtggtgaccaaagcacatgctccaaaactttttccaaagcttgattttagatactctcaatgtataaatttttttttctgactgcattttacaaaattaattatttgtaaaaatgcattttctccagaggcttcgagctctatattccaagctataatatttaattctgtcttctgcctaatgatctgaaaaggccttgaccatattataaattagtgacgtttgtatattacatttaactggtttaaaattacctaacttaaaatcgagaaacagcacgaatattgaaggagtttgaccacatgcatataaaacaagacagtttaaaattatgtcaactgctggttctgagactaactaaagtaccaacagccaatgcagtccatgatacttgcttgtttatttatttatattatttacttaatgtacacattactatagaaaaggtaggttggaatgaataggaaaagaaataataacaattatctgattgtttaaaatacttaaaaatttgaaagagtgaaaatccacatattaaaattcacctgaaacattacatgaatttaaggatgaatttaaaagcacttattcattaaattgttttcatgatacagcattaagatgaaattgcattaatacatgttctgctaatatctacagcattttgcatttcaacagtattttactgctctctaccagatagttaatgccaagcttatctttttttatatttccaaaaaggctaaccattcctttataatctgaaaataaagtgaaatgaagtaatttattcatatcgccaataattttctgtaacaaaatgaaaaggaatcctttttagtactacacatcttaacactgactaatccttcattcaaaggaagaaagagaattaacaacaataataataatattagtagcaaacaatcaaatgagattaccatgtgccaggcactaatgcccacaggtgttaactcatttaatcctcaccgaacccagagagggaagtttattattattatcccttttttataaagtaaggaaaataagaccttgagaagttaaggaatttttgcaagaactagcaggggcaggagacataggaggaggcttttgattcctgaactcactttcaaagccataccctactcagtccatgagcaaagtaccacgcctcccctttatacagatcatttccttcatacatctgtaccactcaattaaagtatcaccaactctcttttagtaatgaacaagctccaaaaatgtaacatactcaacaagctccaaaaatttaacacactcaaagtcccacaaatgaatagaaaccagatttttaaatccaggtctgttttttttgatatgggagttactgttgatgtttctgttttcttaaccatgtcaggctgtttctgcaatgaatatttactaaatacctatacatgcaaagcattttaaatatcacaacatataatacactgtctctaatgttcatttgttacagatttagtatctataaagaaatatgcaaatgaatgtaatttgtgcttctccatatgtgagatttgtactactggtggtaggtagttattatatgtggcaagtgtaaccacttcagatagcaaataagcataacatgaaacaacttcgattcccttttaaatttgcctccaagctttcttagcaagtcttttttttttttttttttttttttttgagacggagtctcgctctgtcgcccaggctggagtgcagtggcgctgtctcggctcactgcaagctccgcctcccgggttcaagccgttctccggcctcagcctccggagtagctgggactacaggagccctccatcgcgcccggctaaattttttttgtatttttagtagagacggggtttcaccgtggtctggatctcctgacctcgtgatccgcccgcctcggcctcccaaagtgctgggattacaggcatgagccactgcgcccggccgcaagtctttttttattctattaaacacattaccaatttctcctacctttctcctcaacgaaagagctattagagaatttttcatccaaacagtatctttctacttggattataataactttgtcttatttttattgtatttatcttttctgttctcttatggcaggagagactggttcccaatttccagcatcagtgtaaaaaattcttttaaatgcatttacttaaataagggtagtaagttgatttaatgaaaaatattcaacgaatagtataagtagtatgtgaatatggggaatcttaggaagcttataggaattggttagtgtttgagaaacaccataaataagaaatggaagagttttctgattagaccatgaaaaaataaaatggcctaactctgagaaggtgagttcctttaagccatagaagggagctaggaactagatgtccttaaggaaatttgcacagaggatacatgcatacactacagggagggctagggaggtgcttagtcattgaaactcctgggagctatgggtcccatagcagcaatccaaacactgttgataatctccacatgagtaatagatgctctaggaatgtgatcaagggactgatcactctctagcttcacagaagcatttgatgcaggtttcatataacctttaggattgtaatgaataaagaataagccaagatgcggatgttggggctcagaaaacgatactccaaaacgaaggcctctgcagcagcctcagaagcaaagattcttgctgactttgtcctaccctcaatctgccacccttattctccccttaggcaagccaaagaaacaagaattccttttcctcaaagtggttcatagaaaccagaatcactttccctaaagccagccataaagcataaaggtattactctaactttcccccagctttctgtgtaagctggccataaataaataaagaccctcattccagagggatcctgccatgtaccagggaagaagaaatgctctaacaagaggcaaagaagaatctgagcagacaggacttgctaggtttccccactctgttgccatcagctcaaaccctttctctccaatcacatttctacatggttgttcctcctttattgaacctaagaataaaatcagaatacttacactgtatctttggggcttcaatctgaacactccatggtcatgtaaaactgtggtcaaattaattagttatgtttttctttggttaatttgtttttactaatagaaatttcagccattatccttatcatgggaaggaaagaatttacccactacagtaatatttcaggcaaagaaaaagcaagaaaacaggaatgcaaaactcatacagtgaatttggagaaaactgagcaacactgaaaaaatatgaaattaaaaataacttcttgaaagtgaatacatcaagaacgcacaaaaataaaattattttataaaaataacggttttcattaaaagaggatggtttgtgattatatttacagaaaataattttgttttctcagaatatagttatatccttattagccaccaaattacttttctaactttgaattagagcaaactgattttttgcttcaaaatgaaaataaatttgtgttcattagtgaagactggagaataaataattttgggaaaagtaaaatcagtagttaccttttaagatgtcaatatttgttaaagctgaattattccagatgcttatataggggtaaagaagtaaaccactggaatataatagagattccaaaaagagatgtacaggtatggctactttgagttgaatggaaatagcaagtgatgggaaaatacaaggtgaaaccagaatccttaaaaactggttgtgtccatatgaattagtaccatcactttgaagagaaattaagaaaatagctgttaaagtgaaaatatgtataccttattttccataatttgtgtatacatgttacagaaaccccaacatttataaagaagaaaagatgttcaaatatgtttctgtaatagtaaaatattggggacaaaacatgaattttcattaacagaaaatgtggtttatttaaagagtggaacaacacagagcagttaaaatgaattgagggccaggcacagtggtgtacgcctgtaatcctggcactttgggaggctgaggtaggtggaccacctgaggtcaggagttcgagatcagcctgaccaacatggtgaaaccccatctctactaaatgcaaaaaactggcctggcatggcggaacatgcctgtaatcccagctactttggaggctgaggcaggagaatcgcttgaacccaggaggcggaggttgtagtgagccaagaatgtgccattgcactccagcctgggcaacagagtgagaccctgtctcaaaataacaaaaaaaaaaaaaaaaaaaaaagaaagaaagagagagagagaaagaattgaattacatttttatatattgacattcatagatcacaaaatatgttaaatgagaaaacaagcaatactgtaccaacatcctcacatgaatctatacgcatgtaagtcatgctcacaagcataatcaatgcaaatactaatgtatttccggacagtaattgatctctgttaacttgtatgtgagatttgtgctttaggtacctgccttataaaatgagagccatgcaaatctcccaaggttttgtggtgtgctgtctatgtcggcatattgaaaacatacagacaatgtaaagtgaaaacagggtgagagaaaaaatgatgagaagtcaatgtcatttatcattgcttcacaatgaaagtctatcctgaagtgagccctctaaaggagggaaaaaaaactgagttttagaatcagtccaggaagaaatggggggacccaggttctgaataacaagaggagccatatagtataatgaagtaatatgtagtagtggtaagagtcatggagaagttagctaagttaatgtgaaatgaaacattttctatttagttacacaaaagaatggaaaattgaatatgaatggaattatttttagaattgattttatatccctgatgcacaattttagcagtcagtctcttgaaaacagggacctggagacatttgctcaaagccataggcattctttcatgcacttgctctttagaatctttttaatctaactgattagagagagcaacaggacacaaattagtgcaatttccttggacagcattcaacatcagtggaagaagcattgtgttggaaacatgagcagatgcacacatcaagggtataatagctgctcaacaggtaattcatctatccctacttttgggtttataagagagaattgcagtcctctccttgtaagaaggagctatgaaggatggaaagtgatgaatcattcatgctcaatttgattacccgtgaggacattcattcaaagagtcttcacccaaaaggcccttcatgaaaataagttatgaggatttacataatttagatttgccatatgaaaatatctaaactgtacatttcttgactaagatctttcaattgccaaaaggtatatttgaatgaggactggattactaacatatcactaaacacctataaaccatattaagtgcatttgcatttgagaaataccaattaactggacaaataagcccattgtgttatgtggacttagtatccattcagtaacaatagattacaatagattagttcactgaaaacaacttactgctgtttttctgctcgaatacaagtatgtcataaatatttcaatttttatctgatctgacagatcttcaacattatcaaatgaagccaacatttaataattttacatgaaataagaaagaaaagaaatatatcttttttttttttttttttttttgagacagagtctcactccgtcagccaggctggagtatagtggcgcaatctcggttcactgcaacctctgcctcccagattcaagcaattctcctgtctcagcctccgagtagctgggactataggtgcatctcaacatgcctggctaacttttgtagttttagtagagacagtgtttcaccatattggccaggctggtctccaagtcctgacctcaggtgatctgcccgcctcagcctcccaaagtgctgggattacagccgtgagccacggcgcctggccccattttcaataataaagtggagagaaattcaacaattgtccttccaatctgctcataataaagtaacattcatcattttatctgaatttcgtgcatccattgagattctgtgtgtattgtaatcaatcaggccatgtcttaatgattgatcatatttttatacttatttattttcaaggctggaccatgtaaatactcaataaacacttatttaataaatgaggaaatgaacaaaagagtataatcattgttgatgttttgtttctattttcagcagaatgagcttgatatgcactgcaattaagtgaactgtacactacatcaaagggccaggaaaaatgacggactttcacaatccttgtgcaccattccttactcatcatactccaccttgaacattgaggcctattttatcaaagttgggtgaaggcagaggggagagcaatatgcatgttgggaatacacatgaagattttggtgataaaaagagaaatggcaaagcactgatgaaaataaaattcatctatagccatcagttgactcaaccaggtgtgacatttcaccagccaccaccatacatgcaccttttccctaatccacatctaggcctcctcagccttccctagaaaagaagtcagagtattctggtgcccaccagttatcagcagaccagcctggcccagagcatgggctcctctcttcctcacccctttgcaagttgtcctacatgctccctgggtttggttcatggctgcaatgtaggctcacattttctgtgaccacatgactaaataacatatcagagttatttttctagaatttcaacagagattatatattattgtcccactcaaaagaagtttgggaggcttggaaaaaagtgaatataatttaattagagttaagattaatatgtatgagtgctaaaactgttgattaattctagggcacattctgaggtcaatttcagaaaattcggtgatgaataataagggatattacttgtaatttcaacaaatttcttcaaaatgattcatggtaacagtaaataaaatttggattcattagtccataaagaaaaatcctggcatataagggtctagtatagtcattaagacattgtctctctgtttacaaattagatatgtaaaacttaatagcatccaatttgtaaatttaccacatttaattaattttaattgttgaaaatctatgtttttgtatggatcactcttttcctactcttctgtcgtttactttaggatctaggaaggataaattctctacattttgaagttatttaggtttaacatgcagaatttaatgatctttgcctttatccattcctccagtaatatcattatttgcacaaagtaagctcaaagtaaatgtttaaataattaattttgggtttctttcccagcaacagaaagagaaaataaagtattgagatcttaggcccatttctcattttttatttatactctattagctaaaatgtcaacagccaatgttactaaagtcatctcaagtgttgaatgctttactaaatcagttactctatcaagatacaaaggaacaagtgtgtttaaatatgtttaagtatttataaaatacaaactgaaatagcacatgaatgtaaattataaaacagaaaccttaatcagaaatgcatgttctcattctttctaattccatatcgaaacaatgactcacacccttaatacactctctatcaagcattgtatcttgtacattttttctgaatcaagtgaagcagtattgatctttttatttgcatcgataactgaatgacttccctgattctttacactattaaagttaattaaactgttggggaaattttatacaaatatggcaggatgagaatatacaggttcagggaacactagctttctagcaattacttttttactacattcacatcctatatcttcagttttgttaaatttccctactattctctgctttgggcagttagattaattaggattctggacaaagaaaattagttgaggcttagggagtggctagggagtggcatatgataccataacaagtacatgagttttacgttcataggcatcataattttctcttgattcccttttgtgtatctaggttaggtgcagttctacatttagataaagagactgaaaaatccttataagttcccctgagtctaagcagatgttttatgtgccagagagtgtgaaggtttaagattagtatatttgttctattgagtattatgattgtctgctgaaatgatttaaggagcagttaaccacgagtggctctgaagcactgaaggcctgtttggctgaaggttcattcatgcatagcccattttactgctacccaacacaaagacagtatgaaggaaaggtcccggagaaagacagacctaataacataatcacaaacacagaattgctcagttaggttatgaaagaaaaggcaaatgcagcctaagagtaaaatgggtcaacagtagaacaggaatacacagagctattacttttgaaactaggaatcttagctatcacgataattttgattatcagtgctaaaataaattgtagaattgtgtactaatttctactctgatttttcagttatctgggtaagtttcaagaaaccatttttgaagtttaaaaaatagtaatactttaaatggaaggatttaataatacaaaccttttaaaacacagttaaatagaagttagagcttgtaagtatattaaaattattcttatcataattatctgaagaaaaattctaagggaaatatttagaggatagtgttagtataaatataaacaaaccaacaaacaaataaattgtaatagaaataaaatcccattttcatggagaaaataaattggaaatacaactggactttttataatagaaatcagagttatctttatcaatacatggattaggacaaaattagagtttaaaacattttgggaaagcttttggcaaataattatggctcattcatgtacaaagaaatgctttaaccaagctgtaagaactgtttagcacatagaaagaaaatggatactatcacatgtgccattctgattaaattgcagtagtggcctggagagatggagggagccttctcccaggctccagcgatagaaacatcatggttgattagggctcactcattcaagcacaatttactggtattcacaaccctttctctctttcaaaggaaaagtaaattgaaattaacggcaatttcagtagtaaatgcctttcttgagaaccatagctactgcattacactgatacaggtatcctgtgagatactttcctctaaaatagtaaaatgctaagcctaaggaagaggttgtctcgtactttggttactaattttttttatttatttgtttatttttgagacagtgtctcgttctgtcacccaggctgcagtgcagtggtgcgatctcggctcacttgcaacctctgtctcccaggttcaagcgattctcctgcctcagccatgtgactagctgggattacaagcaccaccacaacacctgcctgatttttgtatttttatagatacggggtttccccatgttagccaggctggtctcgacctcctggcctcaagcgaacagcccacctcgaccttccaaaatgctgggaatacaggcatgagccatgagccactgcgcccggcctttgcttactatgttttttgtttgtttgtttttttgtttttttttttcccccacagtgctcaatgtgcattattatatctgacttgttttagagtctaaatgaagaataaccttcccaagcccacaacattaagtaataaacacctgggaatggcatagagtgaaccaccttactttgtccagaggcaaaacagaatcacctgtgttttgcataatgttgcttcagagtccagaaagcatcaccaagagttactattcttctctaagaacaaaaagcaaagcacttactgcaactccccaaactgtcaattatggcagagctctttgaaaaaggttgaggatagtgataagggaaatgtatcaaatgaaattagtgaacaaaaagaaaactgaagtatactacttcaaaataaaactctttaattagttgctttttatacacagatgatgctagaacaacaggggtttcaatttcatggacacacttataagcagactttttcactaaaagttagagtgagtgtgcctgtctctcatgcttcccattccacctgctccacctctactgcctctgctactgctgagaaagaaagacaaatccttcctcttctccctcctcctcagcctactcaacgtgatgatgagcatgaagaactttatgatgatctacttctgcttaataaataaatatattttctctttcttgtaatttttaagtaacattttatttctctaattatgtaagaatatattatatatatgtataacctacaaaatatatgctattgataacataagcagtcgaaagaaaccttactgatagtatcaacagtcaattaacatcgctaggctattagtagttacgtttggggggagttaaaatttataggaaaattttcaactatgtgggggatcagcacccctaaccctgttgttgaagggtctactgcacattattacaaatgaagtgtgtatttatgcatatttacacacataaatacatacatatatgcacatataatacgtaatcatgtattttggggggagcttataaatcagctaaacttctgaaagttcccacactcttttctttaaatttattttattattatcatactttaagtttagggtacatgtgcacaatgtgcaggttagttacatatgtatacatgtgccatgctggtgtgctgcccattaactcgtcatttagcattaggtatatctcctaatgctatccctcccccctccccccaccccacaacagtccccagagtgtgatgttccccttcctgtgtccgtgtgttctcattgttcaattcccacctatgagtgagaacatgtggtgtttggttttttgtccttgcgatagtttactgagaatgatgatttccagtttcatccatgtccctacaaaggacatgaactcatcattttttgtggctgcatagtattccatggtgtatatgtgccacattttcttaatccagtctatcattgttggacatttgggttggttccaagtctttgctatggtgaatagtgccgcaataaaaatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatgtgcatttctctgatggccagtgatggtgagcattttttcatgtgttttttggctgcataaatgtcttcttttgagaagtgtctgttcatgtccttcgcccactttttgatggggttatatttttcttgtaaatttgtttgagttcattgtagattctggatattagccctttgtcagatgagtaggttgcgaaacttttctcccattttgtaggttgcctgttcactctgatggtagtttcttttgctgtgcagaagctctttagtttaattagatccaatttgtcaattttggcttttgttgccattgcttttgatgttttagacatgaagtccttgcccatgcctatgtcctgaatggtagtgcctaggttttcttctagggtttttatggttttaggactaacgtttaagtctttaatccatcttgaatccactcttaaaaattcgagtagagatgaaaaatcttctgtgaataatttgtctttaatacttttcagagagtaaaaatgtctattatttatcaataagcatgccaatcatctatatgatattcaattttattcaaaataatttatatggcaaaacatatatatatatataaacaaataatttagcttttatttatttaggtctttcttatctcaaatatttctattttcccattttgaggtatgcaattatgtatgatgccttaaattatttttgtaacagggcaggtattaaacgtaatattgtggttttgttttgttttgtttcattttgttttttctgggcatgactctgttatggatgcaagaatataagtcctattctttatctcagggagctcaacatttacttaaatattaaacgttaatataaattgcagactgaggcatgaaatcactgctacaaaccacatagatttaaatagcaaaagggggaataactactaggtgttagacttgagaggcagatgaattagatacggcattgaaagacaagtaaaatttaaatcatgaaaagagaggacatgatttacaaggcgcagaaagcacaggtaacccgagaaagtcatgaaagctggaatttgcaaattatggttgtgtggtaagtaggttgagagtatgtcttgatttttatgatgtggatttgggttagagatcttggagggcttacattctaggctaagattttttaaatgtatgataaataatgcatgtttaacagagaatacaggaggaatttgagctagtgactacatatatgccattaatgtattgtgagcattgacataaggaacacagggagacagatgagaaacgtgacatgaggaaacaaggtaattacaaatgattaggttacaaagtaatcttattttgagcaaagatgtcaaaagttaaaataaaagagttgtgcggtcttcagggccaaaagcacgctaaatttaatttttttattcatagtatctagagtagtacctagaatatagtagaattccataattacacataaagaagggaaaagggaaggtagaaaacagttattaaacacattttccgtgataggaattaggctaggaaatagcacatacagtattcactgtatgatcacaatgacagagataagtactattattcccaattttgtagaaagaaacagaatatgtaaggttaggaaatttacttacagtcatttgttaaataaatcttaagacttataaagcaactagttttgcataaatcttgagcccaggtactttagccaggtacaacattgggctacaagaaatagaaaaaatctaactcattcaacttacaggatgaggatgcttcaaggtcacagaataaatgtgaagtattctgaaaaggtcaatacttaactgatccctgcatttagataatctctactaataaacattagctttttgttatgataacaaggaaactctcagtaaaatttagcttcggcgttaaatgtacttttcaagaagcattcttctggttctctagttattttccccacttaaatataaaaacttcagactgtttttgtttcatatatttgtactattcatcttgaatcatcagctgtagctctgtgacattttagcaaagtttttggatgaagaaaatttcatactgtatttattttacctttgtagttctgaaaataataaattataatgtttatacttctttctattttttctattttcattgtagggctacacaactatttcaatacattatgactcccatattatgaatatggtatttctccaaaggttgcaatattcctaattgttaagagacttgaaatggaaccaaggcaaaaataaacctattaatgtattttagtgtcttttaaagttttactctcagcctacaaaggttattattttatgaaaaatatatcagactcattctctgaaagaaaatttaattacaattgaaattaatgttacagagttcaaacattaacaaaaaatatataatgtttcttaatacatttaatactcaacgattaattgtttattgccacaaaagaggtaagatgattcaatgaaaacaaagcaaaaagttcatgtgattgtcaattctgtttcgtagcaaaccatgaacactcaagaagtagatttattaataaatcaccttcagtaaatcatgcagtggtgaagttggccacacagttgcttttatttcaattttttaagacaaagaacaatatcaaagaaagtcacctggtggcattatatctccaaaagcaaataaaaaagaatgggggcaatcatgtacagataattttatttaaaacaaaacgtccagcaatactaagttaaaaggataacggactagttaatcctattaactatacacgcagctgagaataattctacttcataatcatcgttgtcttagatttcatgctataatcattaaattaattgaaaacgtatgctgcatatataaaatactttttgggtttttgtttgttttgtttttgtttttccctcagagtctcactctgtcacccaggctggagtgtagtggcccgatctctgttgactgcaaactctacctcctgggctcaagtgattcttgtgtctcagactcccaagtagctaggactacaggcgtgtgtcatcacaacaggctaatttttgtgtttttaatagagacagggtttttccatgttggccaggctggtcttgactcttgggctcaagcaatctgcccgcctaggctttccaaagtgttgggattgcaggcattagccaccacgcccagcgcaaaatatgctttcatttattaattttaaatattatcattttaagcatttttaattaaaaaacaaatgaaactactaagaaaaataatagtcatcataaatgcaaagtgatgcaaagttaggcaaagaacagctttccatggaaggacctcaggatgtctcattactgtggtcaaaactgcatgtttaagtggatgacaatactggtactaaaaatgtattgtatatcactttcttttatgaaatatctacgttttaagcattatgcataatattattcataaattagttctttgttttcttcccaattttcttagccaatttcctcaaatgctactgacatagaatataattaaaacgaggaaattttgacagattaataaagttcgtagtggtgattacctagttaaattgcaaattatacaaggtcatgtcatcatatagaacaaattcactaaaatatactctttggaaagtcatattatttacagaatatccttatgtgtttcttacattaaaaaaaaaacaaaataaacttggattttattattcatttattttacaaccaagagaacaatttctaaagttaggcataagcattaaagacttaatatataccgtctctaatacatattttatgtatgtgtcatataaaatttcctcattacataatgagagggttttacacaattgctaaatgataataaagtttcaaccaaacttctactatatcttagtagaagatatagccagatttttaaaaaactgaaaaaaatgtttaattaaaaaaacaaaagaaaatattgtaaaatgcgttccacgaatgtgttaatatgaaattatctacacttgcatttggagctaaaaaaaaaaaaaaagtttgggtgttgtggctcacagatgtaattccagtactttgggagacgaaggcaggaatatggcttaagcctaggagtttgagacaagctgggcaacacagggagacctgcctctaccaaaaattaattttaagatatgcttacaacttgtttatatattgttagtaactcttttaacagcacatgctgttttgcttagccacacagtgacagtcttattgcagtgaactttaaaccttgcagccatggatagaatatatgcagccaatctaataggaagcagatgtaatacttcacctctcttttattaatttagttatgtcttaggtcactgatttttaaatgatgttcaatactaagtgtaattcataaatcaggaagatgagacttacaaaaagtcttctttttaacaggctcaaaataacaaatatgaaaatatttcagcaaatagttttgctatttgggtttaccaaatgcattgtattataaactgagtttttgggcaagcttgtaagagactcaaaattgcatccactgtttccttgtcaattttatagaatacttcatgggtaacatctttctcaatggctttcagtggcatctttacaaaaagatgtttaaaaagttgagcgataatattagaaatttttatacagaattaatttatacacatatatatttcaaacatttttgctagagatcattaattcagactgtttcaggtatattagtaagaattttgtgtctatgttattagaccaaattagaatatgataaaatttttcaggaatagccattgattacccagaagaaaaaaaaaaaaactgcctcatccatctgctaaaagtcccagtctgtctttaaaggagtggatttgcataaaatcaagatttcaggaaatggtatacttgatttaatgttgccaagaaagtaatgaccagcacaatcaataagtaagtttcttgaattaacaccaccaagagatttcaaaatttatgatataggtaaacacatcatttgaaagtaaatacaggaaaactttgatttatttattcagtgaatacattaataatcagaataaacaataacgataatttagttcactaattaaaaattttgccctagaacattttatgtgattcaaatattacaacaaagctacattactttcatgagcaaatagaatgtttaaactacttgggcaaataaaataaagtaaaaatgagaaaagaaaagagaaaatggcaaaaaagcaagaaataaaaacgttaggaagggaggaggaacagaatggaagaaatgtcatctctctgaattttaactgccttgtaaaataattctcaacaagaaatgtagtctgtgtagtctaatagattgataacaaagaatttttttaataacatgaaaatgtaaattatttttagaatgttatcaattaaatttaccctctgggatttggtacactcatcctcagtcttagtctctaattaaagggaaaataattataatcgatactacctctgactatgacatggaaaatttgtcaaatataattcagatcgttacatttgctatggtgtatgatgagtacaatgaattttttctctttttgcctaccactaaaatatgcattcttctttcacccttccatcaattgtgtgacctttgttcaatgtagcacactgatgggcttgggtgatgtttattaaaaatgcagcacaccaacatggcacatgtatacatatgtaacaaacctgcacgttgtgcacatgtaccctcaaacttaaaataaatataataaaaaaaacgagctgggtgtgctggtgcatgcctataatccccgctatttgggaggctgaggcaggagaattgtttgaatctgggaggtgagtgttgcagtgagctgagattgcaccactgcactccagcctggatgacagagtgagactccatctcaaaaaaaaaaaaaaaaatagaaattttaatatataacctactgagttagaactcatttcctaataataccaaccaaacttaatgacattcaccagaaatgtctgaagaaaaaaacatgtattagatttagataatatagctttggaatcagacataactgaattttagacaatactggttcaggcagtctttcaaaaatgaatcttgagcaaattacttgatctctttaaactttagatgtcttatttttaaaattgagggagaagtatgactaatctaaactttattattattacgcataatattcatagttgcatttaatttggaggaacatagatatttccttcagtggactacaaccctgtaaatattcttaagaaattacagtaaaagaaaaacacacagcacaaactattctactagggagatgtatatggataaatcttgaaatatgttatccatcactttcgttttatgtatgtggaaattaaggccaagaagaaatcttccgtattttgcccaactagatatggcactgacagaatttgaaacaaacttcttagtccaggtttctttattgactcctgtaattcctttcacccagttttaagagcaatttgatgattatgaagccaactctttgccctacggagtgattcaactgacctggctgaatagtaggttttccttctttctttgctactttatgtgtgtacagtagtaagaattgacttcccaaattgatgaggattgttctttggtaaaaaaaagaacagtaataatcaagtatttttatatttttacatcattcaaaaatatgctatggacaatttgaatccaagaaaaaatagatttaaatatcttatgtctactaggacagaggatatgaataaaaaagcaaaaataatatggtgtggtaagtcataaattccttagcacataaacaggagttaaagaaaaaattataaagaagctcatgacagagcaattgttaatattttggaaatatctggaaggatttttctaaaagatgtaaggtatacattttaattggtcaagaaatattgttgtctgtgtttcattatatgtacagcacagtagtatgcactatgaagaattaataaaatcaagttcttttactcagatacgtgatattaattctttaaaattatgttttttattatttaatctattatttcttctttctatattattgcttataattcaaatagtggactagagtttgttttaaagtgtattttataacaatgaaacaacaaatggcaaaaccattaaaatcttcaatcgagttgtatattctctttgtagatatatttcctagtacatatatatgtataaacagtatatactatatgtactatatatatgacattatactatatactgtcatagtatatactatatataatatagtatctgtactttataatatatatgaatatatgatatataatatatcatgaatatgtattcatattatgaataatatgtcatatattataaagtacttatactatatatgtcatatattataaagtacatacactatatatgtcatatatgtgctatataatgtatataatgtcataaatatatgcaaacacatatttttctttatgtaacacttttcacaaatattatgccatcatttttttttcaggcaaaaatgagattccaagagacttgctcaatgttgtgaaataataaatgagaaacaggacaagagaccagagtcatctaataaatcttattcactattcaatgtcttttattttctctcttcataaatatgattataaatagttgaaaggattacaatcatttaacaatatcaaataaactacctataaatttgatccttctttttaaagatttggatatttctctgattcctctggaaattgcaaactaagtctacttagaaattaaatattatgttttactgaaattcctaactttaataatccaggccccttttaaacaaatgaattgatatgttattaatcttatatttcacatcataatgctcatttctagagctcgtgcatttcctagatttgctaatagttgagttataaaggcttaattgaaaaggtacaaaaaatattttaaaaccctgatcaaaacctagaaaagatgttttatcctcgaaatataaaatatacacaaaatagtttgtgatgtaagcacaatattttattcttcaaatttattttaagaatcataagatgtttgcaccttatgcaaacgttattgataacattaacatttttataaatcacttcactatgaatgaatgccagtaaaaattaaagtgcaaagttttaactcaaaatataaagcttcctgcataattttaatgcttgaaagttaaataagctagagaaaataaacttcagccattatgaaaagcacttttgacattcatgtcaacgagacttaagtcagcatgtctcttctgatagtgcaatttgctttcctctatattgtcgattataattccactttcctgctaagtccatacaattagattactacagggacttcattacagccacagggaggacagcagctgaggtacacaattttcttcctatgatgccagcaatagtaaacagttattggaacaattgtctacaaaggagcaataaaagctgctgcattaaatattgttgtgtcattatatcatctcccaaaatatagcaaagacttgaaaaatgtcaatgccaggaaaattttgcttttcccacttgtctgttttgctaagtttcctataaatcagttgtttttcatttgttcatttaaacataattcagactacacattatctccaggccttagattcctagttttaaaatgaggggagtgaagaatttataaatatttgatgtctctccaaataaatcttcaacaatgaagaataatgatacattcttctgtattagattgctgcttgctcataacaatataaatttcagagctaaagtttacatcttattgtcatatagtccaatgtattttctactgtcattgctttaaagtatacatgctatatttcatattcaggattctattttcaattggcattctaatgtaattctttcttaattttacaaagtttatctcttccaagtttttatgctcaattttttttcatcagccttggtatatctcatgcatattattgagtcttaaaacacctagcatattttattactttccttattcaaaaaaaaaatctgtaaaaccaaacaaaaaaacaaacttttaagcaaaacaaatcagattaatagtaataaaatttcttttaccaatattccatgacacttttagtggaaaaatttcattttatgtgacattaacatctaactaaattttactgagtggttattagtggttgggcattgagatcagagattgcaaaactactgaaggaaatcagagtggctcttagcagtgttcagagtttaatcagacagactagaagacaaacaattacagtacagggcaaaaagcatcacataatgtttcttagctcactggtatgaatccatttgtctttagatatttcagacatcagtttctctactgtgtgaaactaccgcaattgttggtttctgttgtctctgacttagtgcctttacattggtactgaattatcattgtcaaataatatcaaccacacctgccctggtgtggtcaggtgaataatgcacctcctcacccccaaagatgtccagattccaatgcctagaacctatgaacatgttactttacatggtaacagggactctgtagatgtgaataaattagatatcttgatagagtttatcctggatcatcacaaagctccgttgtaaaaggaagcaagagaatccgttggtagcagcagatagacaatgatgagagaagcaagtggttggagggatttgaggaaaaggctactaaccaagaaatgtaggctgactttagaagctgaaaaaggacatggattctccccttgaccctccagcagacacagaacttctggcgtcttgattttagatgtctgatctccagaacggtaacagaatagatctgttttaagtcactaagtttgtagtaatttgttttagcggcaatgggaaacaaacacacctgctttccaagaaaattttaattaaaatattttctttgattctcatgtcacaggtattaattttcagtttggaaaggatggcgacagtggtgaaggtgtaagtgtttccaaaatattaggaagccttgtatgtgaaagaaagaaaatctacacaatgtaaatgaaaaataattattaaacaaaatcaaaaaataacaaaaccaactatacattagaacatattacatattgaaacattttacattggattgaattttatccctagactgcttccctaagggaatagactgaatttggttgaaagggtacttatttgagaagtcagcagttttcagacttgggtgtgtatcagaatcacctagggaactttttaatatacaaatggctagggcaggtgccgtggctcatgcctataatccccgcactttgggaggccgagattggtggatcacttgaggtcaggagttcgagagcagtctggcccacatggtgaaaccctgcttcttctaaaaatacaaaaattagccaggcgtggtggcacacgcctgtggaccccactactcaggaggctgacgtgggagaattgcttcagcccgggaggtggaggttacagtgagtcgagattaggctattgcactccagcctgggcaacagagcaagactccatctcaaaaaataaataaataaataaataaataaataaataaataaataaataaataaaataaaacaaaatacaaatggctgaaccccgcctcccaagtttgacttgacagccaaggatttgcatctttatcaagtttggggatgatgttgatgctactggtccaggtacctaaccttaggaaacactgatgtagcattaaaaaaaaacatgaaaactggaagatctgggttcatataatatttctgtcactttctaactatgtaataccttaacttcagtgattttcagttttctttctgcccaatctcacaattccactgggaggatcaaacaagaaaatataattcccgtggactataaagccatataaaagcatggtgatgatgcataattaatagaagcaagcagtttatgtctatggtcatgttatttgatactctggatagttttctcctaattgatgtatttatttgcgacttttcaggcactctaaaagggcatgggttacttttcaaattaaaaataaaatatgaataactgtctgtgcgttgggggtgtcttgcatatgtgtgtgcttgtgtgtgtaaatactattacgtgaattctagtaattcagtgtttcctgattaaagagactatgcaatgttatgacgtaagacgttttccttaaaaatttttttaccaacaattacatattattttctgtgtctctattacagagacactgttatattgctgtaagtcacttttgataactcaatagagacttggcaaggagaaaaggagaaatttccatatcctaattagtaaagcctttgttatatattttatatttttttctgtagtaaaatacttcgtctaatactttttgaattatagaaatggctttacttatttctatactgtttcctaatttgttatcacctcaaaattgtattaacatcaataatgatgacaaatgaaactggaattagttctaccctttcaagtgtccccctagactatttttctcctggagaaccactgtcatccactactctttatgtaaagcccttcaggcaagattaaatacaagtcatttcaaaataacagtatttttttggaaaacatattaaatatttcctcaatgtcaagatgcacccacatctggtaagttaccaaaacaagtgcatatgtatctgtgtctttgtgtttgtactcacatatatataaatgcctaacatgcacaaacacacacacacacacacacacacacacacacacacacacaccatgtactgatgggtggctggaaagagaaaaggaacggattcataggcagaactataacaacacaacatgtcaggcagatagaacagtggactgaagttccgtggctgctgtcagattcctcagaactcctactagcagctggctaaccttgaactaattcccagtttgttttgcatcctcatctcccttccctccttttatgagggcatcaaaatgcttcacgtctaaaactcttccacctttaacatcctctgccctgtccttggtagaatgccttcagggaaaaaaataaattaaacaacaaattctttccataatagcttacagggaaaacacgggtgctgccttattgagtggaaaatttaattgttctgacaattgtcgcatttttaagaatgcagctgtgtcatgtgaacacagacaatttcctggactctatgtcagtttaactgaagaaaaaaaaatgttaggttgtccaatgtgttggaaaaataacagacctatttaaaatggatggaaaatgcatgtttaagaagacactacagaaacaggcagctgttggtcctctaactcatcagtttacacggttaaataatgagaggaataaaacctgccaccgtcagatagatggactttgaatcctccagacaggttgtggtctttatctcacttagtatctgtcacaatgatgagtgagaatatactctgcagtatttgtaggcctttcattttgaatgaattgatagccccagatgcaaccctttatgactgtcttcaggcaaaatattttacaaagcttctccaattaggttatggcaaaactagaaggttgtgcactaactgaattttgcctagtatataggataataataccatagatgatgtctcagagcaaatatgaaggaagacatgaatgacttgaatcttaaaatatttgatgaacgacaatttatcactcggcaataaaaatcatttaaacatttaatgaggataattagcattttgacataccagatctgtatttaaattttcataaacaatttcatatggtttaaataataataaaaggttatagaaatgtcttaataataaaatatttattttttctttttttgctctgtgaattgaaccaagatttccttggactacagtaattgcagcaatttcaaaaacactgaatgattagtttagaatatcgtccatgtgggagacacaccagggtctctcacggggtgggggaaggggagggagagcattaggacaaatacctaaatcatgtggggcttaaaacctagatgatgcgttgacaggtgcagcaaaccaccatggcacatgtatacctatgtaacaaacctgcacattttgcacatgtatcctggaaattagagtaaaataaaaaataataaagaaacagaatttttttaagaaaagaatatattccatgtgtttctgttaaaaataaataactgaaaacaaacaaacaaacaaacagcaacaaaaaaacaacctgtcatcaacctttggggaaccctgaaatctaagtaatggtataagactagaaaattgtgaacaactcataacttcctcaaaacgcctgaggtagtttagtaggcagcattttcaaaagttaaactagaagcaactatgaactgccattcttagacattcttagatagtttcaactattgttagaatacgttaaaatattttaaatcaaaaaagctgcaattgccttctcctaacaaaacctggctttattgaagcagctgctagtttatttcttcaaccaatatattcagtaagcagtcttaaaggaaactttggtgtgtggcactatgtgaagtcctatatggagggcatacaaaagtcaaggacttttaagttagaatgggagagaaaaagtacttaggtagcattcagtgctttcaatagtaataaaacataagataatttataaatagattattatagacacaagtctcttttcaggaaaaccgtccaggaaaatgcaatattcattcctttttttgtttgtttgttttgaaatggagtttcactctttttggccaggctggagtgcagtggcaggatcttggctcactgcaacctccgccttctgggttcaagtgatactccctttctccctgcctcagcctctagagtagctgggattacaggcatgtgccaccatgcccggctaattttgtatttttagtagtaatggggttttaccatgttggccaggctggtctcgaactcctgacttcaggtgatccacctgccttggcctcccaaagtgctgggattacaggtgtgagccactgcacctggcctcacttctttttatttctctttctctcccacaagttgactcaaccatgagcaccacaatgtataacagtagaactgtacagtcatgttttctgttctctagctttgtccctaaagagtaaatatacaaaacctattccttttgctacaaccatctcaatatttatattattttcacgtattcttcattgcaaataatgttttgaaaaatacatatgaacaaaaatctttgaaccactgatgttttaggagaaattattggagttagagcaaaaattatgagtatacttattttttctatatatgactacattggtttttaaaaatgtgcaatggccacctcagataaaatgattatttctttacacttggaagaaggttgagaattatcatttttaatgttttggtaattttataatttttatttcatttcaagtggggcattttttttcatttatttattaacaatgtacatggcctctttgagtatctcaatcaatctaattatatttgaatttaatgttttcttgcgagtttgcatatgtcgttgtatacattctttatatattgtttaccaacatttagtcatatttgttacaaatatcttcctaattgccggttcccttctaattttatgtctttatgttttcaggaaaaattttgtttgtgtgtatatatacatgtagtagagatggggttttatcatctctctctctctatatatatacacaaacacatagttttatatatatacatagcttttttttttcctagacaggggtccactctgtagccaggctggagtgcagtggtgcaatcgtcagctcactgcagactcgacccccccgggctcaagtgatttcccacttgagtctcccaaataacttggactataggtgggccatcacacccggctaatttttttttgtaatttttgtagagatatgtttttgccaagtagcccaggcttatctcaaatttctgggcttaagcaatcgcctgacttggcctcccaacatgctgagattacaggtatgaggcagtgtaccagccaaaaagatatttaaaaatattagacactcctatctttccattgcaatcatttagggaactccaggcaatactccctcccatgatttagattttagtattaaccttgttttgtctttttatttttcttcatcagatgctcaattaatttttgatcatttcaatatccacataatgtttaaaatacccggacatctcagattctaaacctcctctcctccaatgatattgtggtcttccctaccttattcattcaacagcatgatcatatgcaaaactgtttcatcaacaacatcttcatctccgtacatcaatttcagacattcttcctttgacctctgtctcttatctcttaaactactactcagaaaattttctaaggttctattccaaggattcaaccagcactcccactatttcctcaaatccctccttacctatttttgatgcaatgtctatcattataatcagtaccttgtatacattttaaagtccttcgtcctacccttgctttttttgtattcacttgtcaaaaccacctctacactgaaatcaaattctctcacctactcagcacatacattctcaggtaaatgtggaaagtcacacagccactctgactggtctcccattaatttcacaagtgtaaatgtcactgtggcttttaatctctttatctttctctagtcaatttacccttctactcagctactcatgctggtttctctcttctctaatatctagccccttcttgttctcctgggagaaaactgaataaggctggaaaatggcttctcatctttcccttcactaaatctgaagacgcatattcatctatacccataaattctgcctttcttttcctaataaatgaacacgtgtccctctctaaaacaaactcctctactctttctttttactaaagctctgacattagtcctcatttctgaatcataagttgttccctctcttcagagaatctcctagcattttataaacatgcaatatatttttccatcatacaaacaaaagacccttgactccacactctttacattatcttcagtggctgccttatttcttcacatcacttcataggaaataaaaataaaataaaataaaaatggaaaaaaatctcttcaaataattatttttgtagccttcacattttctttcaaacttcattcctatgaggtctttatcctcagcaaggaagcaaagctattcaaaagtcatcaataattaattacaaaacctcattttatcccatctagtagtagcatttaacccagctgattataaattccttcttccatggtttctttacttggacttctgggcaccacactctcttggatcttattctgcctccctgccttgtcttcttcatatctgttatgcattttctgcattcacccaggctctactcccttgagtgcccttggactcaattcctgtgcatttctccatctatttcctttaacggcatctatatactgatgactcagaagggtaaatctccagatattcctctgaaatctgggatctatcatctctacttggatgagttgtgtactccacatcctcactggaatctcctcctgcagagattattctacacagaggggagaggactggaatctttaccctgacattacttagtcattagttaagggctctctcagtgcgggagagtcaaacctcccaggcagttacgaaaatatggattcctattagccaagcacaattctccacaggaggatgcaggtataatccattagcagacaacaggtgctgcacccaggaataaatgcatttgctgataaaggttatcacagcacataccgcactctgattcagcctgtgatggctgtgtcatgatttcaactaaaaaaaatatacacatgcatcattttaaattaaaggtatccttgtactattttagtatttaagtataaagttttaaaaaagaataaaattaactccattgttgtacttaatacaaattaaatcaatagtagaacccaccactttacttagaaaacattaaaatagacctcaagccttctgatatttttttttttgatcaacttaacctcaaagtaatcttgattctgaatcggagatgactttttccatacatttccttatacttttaatgcatatgtctctataatccctaaaatatatgttttatgcattttataatatattttatacattttatataagtataaaattatataaatattctatacattatataaaattgatcatactgtatatatccctttacaacttgattatttttctgctaatattatttggtaggttcaataacattttacatgcagctataatttattcatttcactgctaattctattggtgattaaatcataatgtatacattcaatatttttgacggacaggtagcttgtttttatttctttcctagtataaaaagtgattgattagacattccagtccacagtttcttctgtacataaataagctgttctctaaggtttatatcaagagagtacagttttaggtgaaagggtaggtttaaatgttattaaaatacaataaatggaagaatacagttagtttcttgaagttggttccttttttttcaaaaatcatgaaaataaatattcaaaagaatgactgtaaagttgatcttttggacaatttatgtgttttatatgttcggagacaggagctgattttcttccctgaacctgttctaatacgtagagcatacaagttggtagttggtatttgattgtttacaaaatctgtacacaatcctcactgggattatctttccttattggtagcagaaagtttttcttttcctcaatgtggcagatgtgagaacatctataaggatacatttcagtgctgcattagtgaaaactggaaaactggcatttcttttttgttccaagttgtattctagaatatttatgtacatccctttaattaatccttaaaaccttatgatgtggtgccgggcgcggtggctcacgcctgtaatcccagcactttgggtggccgaggcgggcggatcacgaggtcaggagatcgagaccatccgggctaacacggtgaaaccccgtctctactgaaaacacaaaaaattagccgggcctggtggcgggcgcctgtagtcccagctactcgggaggctgaggcaggagaatggcatgaacccgggaggcggagcttgcagtgagccgagattgcgccactgcactccagcctgggcgacagagcgagtctccgtctgaaaaaaataaaataaaataataaaataaaataaaaaagtatgatgtggatatatggtaatttttctgcttcagagcttcagagaaaatattatccctaggtcatacagctggggttttaaaaaaattctcaattttaaccaacatttacctcaaaacaccgtaggaatttgagttgtatttatgacagtgaggtaaacttggtttaatgaataatgcacatgtcacccaggcatggtggctcgcacctgtaattccaggaggtaggaattactggggaggtaattgggaggccgaggtgggaagaattacctgggaggtaattgggaggctgaggtgggaggattgcttgaacccaggagttcaaggccagcctgggcaacatagtgagatcctctctctagtgaaaaaactaattaattaattaaattaattttaaaaattaatgcacatatcaatgaatagcctaaataattcacataggttttgtgtattaaaatatcatctgtctttcaattcttctttgaagccaatctctataccttagctgatattttcctttctctatgcttctctggcagcattttatatcctgttattctatactgtcgttgtctgttataactgagtataatatccctcactggaatttaagcatttgagagtaataaccttaaactatgcatatatggcatcttctaatcaccacctctcagctgaaaggactgtgcttcataggcagagacttagggaatcagagtgtaaaggaagtaacactatcaactaaggaaatggagatttgataagcaagccatgattgtcacagggtattgggaaatcatacactaggcatgccgaagtagaatcagcagggaaaaaaagccatgcttaatctaggaaaacattcaggcatggcttcagagacactaggaggattctagtaggggacttgacatacgccgggggcaacccattgtgaaggagctaggtggcctgggagtgcattctcaggctatgagatactgccacatataggtcaacctaaaccttcgttcttgaagaccactagctttggaaataaacggcttttttgatctagaaaaaggccttgaaaattaaagtcactcagcaacgttagacattgaaaattaaaagtaactcaattcaaacttttcattttataatcaggaaaactgaactgaaaacaatatatcagttaagtcatttgagcatgtctcacagcaaatgattgttgaaaaaaggctattcaaaatgctaggatatggttgttatctatataaagattttctatgcctttcatctaaaaaacaacttttaactttattaagataccaccaagaagcttaggtaccgaaagatgtaaaagaaagaaacttcaagtatcttcaaactaacagcattttataaatagtgatattttaaacaagatcatgataaaggttttagggtttttttaaaataaaaatttaaactttcatataagtttatatggtgagatagaaagacccacaaatgcaatttagatatgattgattaatttttcttgacactttcactgatagcagttatctgttgttgttaatttttcacaggctttcaagtaaaataaagttgctgctttctcccaaaaaattataccctgttacatgatttagtttcctgagatcgggacccttgtcctgtctttgttttgcactcctcagaaaagcatgcaatagttgactacattgctaagtattcaaaaacaatatgatgaaattatttagttatgcttgacccgctgatcttgttttcaaactaagattccatagcgacatatctcacactgttactatgtgaaaaaaatagcaaactgccctaaaagtaattcaacatccttaacaattcatcccaactaaagctcaacaatcatattttttgttccccgagaaattatctattgtgactgtttatataaaatatactactctcatttgttactctattttaacatgaaaaaacacttatcaaaaatgctactgtaatgtacggatgccacttcctgtataagcaaggtacaaatagacttatagaagaggcttcttcttatagaagaagaagaatgaaaaatcacttgcatttcaccaccaacttcaattgatcgtcagtaactgcctggagagttctttctttgagagaaattgtgaggcctagtgtaagctcaccaggaaagtatgccaagatcaattattgatgtctgccatgggcatataggagaatggggtgacaatctataagccatgattttttttttatctgtgcactagagcttgaaatatgtattcattttaattattgagacataggcatactcttggtagatgagtgtcatatcaggtacaataaactctaacaatgtacactgacttttagaaggcttgtttactacatgttgcaatgaggtgataattgccctataaaaggattatcattcctccaagatatgactgtcaaagtaatagaatgccacagctcatagtattgtttccagtattaacccattataaacgcagactgctctaagtctttcagaaaattttaaaaaatagccagagagaattgttacttttacttaaatatattttgatgtgactgctgatatcaaagaagaaatagtccatggaaattcaagtcactgttagacaccacagcgttatactgcctccttatattggaataagaagacttacttttgatctccaaatagacctttcagtaacagttactacagagattaaattaatgaatgacaaatttcaaagtgctctatttgcaacatggaaatattaattgatgttatatgaccatttactgtctgcttttacattcagtcttgctctgtggtattgaacctaatctcagtaatttgagtccattatttgtttctaactaatctcttaatttggggctacatcctggctcccgttaatttgttaaaagggttcagcagaagaatattcagctacttgcctcgaaaaatgactccttgaaacgtaaaattcaaaagtaacaagcaaacagtgactccattaaaaattacgtctagtacattctttttttacttttaaaaatctttttaaagtttttttttaagttttgtgggtgcatagtgagtgtatatatttatggggtacgtgagatattatgattcaggcatacaaagtgtagcaatcatattagggcaaattgggtatctatcatctcaagcatttatcctttgtgttaccaacaatcgaattacactcttttagttactttaaaaatgtgcatttaaattagtattgactatagccaccctgttatgctatcaaatactagatcttttaatctttttctatttttttgtacccattaaccacccactccccaagcccctccatgcccactaccctgcccagcgtctagcaaccaacattctagtctctatctccctaagttcaattaatttttaggttccacaaattggtacattctagaatttcactcatcatgtttactatgaaagggaaaccatcacagagagtgttgacttcacttcttatttgcagatatagttactgtttcattagaaactgtgtaatgtgatcattttgagaaaaaacagtcaagatttaggtgaacagaaaacatactggaatcttatgtagcaaataaaaaggaataactgaacagatgagggaatgagatggctctttgtgctggaatgaaaagatgaagtatctgttgcctcctagttctatgatattttattccctttatatataattaaataatggcagtttctataaactctctaataatatgccaaaaactgataatcattctgtatacctttctctatgtaagcaccatatctaatttatctataagtcttgccgattacacctttaaaatataacactaatatatccatatttctccaacttttctattaccaccgaggaacaatgtatagccatgacttcactaatgctaaaatagtctttttattagccatctcctccctcttgtacatattgccccatgacctccaatccattccttatcttacagataatttgatttgcctttaacatacatgtatatatgattatgccactttcttgcttcatattcactaatagctttctgttacactccttatttggttcctaaacctcctcaactcaataccacaagttctagccacaatggctttgtaattagttcctcaacaacacaaaacttgatcttggtgcaagatcaaaactcttagtgcaattctcactatgtattaagttgttgttgagaacttctcagcattctggcttcttctcattactctccgtcttctggtatccacctaaatggcaggaatcatatgactatatcaaccaaatcagtccctttgtcccttccccccatcatagtagcctgtttcatttgtcatatcattctttgagaaactgcaattaaataggtttactgttttcccttactagactaacattctgaaatgaaaagtccacaggtattttgttcaccacagtacatgaagtatacagcaaaatccctggcacatggttagtgttaaatgtctttttatggaggaatgaataagaagaaatgctatgatgtggtttattttttgttgctgttattgctatctttagtgataatagtggctttttgtttgattctttatgtcaagtttttacagttaagactattaagtattagagatatgaggtaaattgatcaataagtggaaaatccaggatatagttcactgtgtgaggctaatgttactgcttctactagtacatgatactgttttcatattcatcatataatcaggcagcatactgaaatgagaaaatcactgatccgacagctctggatttaaacaatggctcatctattcattgactgtgcctggtcctcagttttttcatctgtaaaatggggataataacttttatcttgtgaacttactctgaagattgaacaaaaccataaatttatacatacatacaaaacaacagacatatactgaaaattaaataaaatgtagtcttttgtttcccaatggtcatccccatatatttggccttctttctttgccaaattgttaattatccttcagattgtacatttccaatattaatatttttatcactgaattacgatcatcactgcttaaatataacttttatgaatctcttttctaaagtgtctgatggatttcatgccctatactattaatccaattaattaggtaattcaatactagttcatatcctgagttaaaataatctattttcaaacagacatcatttcccttccaatatgttacattgattcttcataacatttatgcaggaaaatttggcagcagctataaaccacatgcactcttgaatgctgcccaaattgacaacaatttcaattaactgtctagactgtgagtgcgagcaaaatgtgcagggtagtgacaattataaaatagagatagaaagtagtattgatctcaactcgtgggatctacacaatcaagaaaagataaatataaagttaaaagtatccagaggaacaaggttttcagctcctctggataattatgttaacactgacagatggaagcacatatatgatctacacctatgtgcccagtgtaatctcattaatatatttgcacagtgttagaagaaggtgttagagtactactcaaaaacaatttttaaaattacagtaaaaatatgttcaggccacttggagtaattgttactgctgtaaaagacaaaaaccagctatttgaaagtttctaatgaataatagaaagattacatgattttcagaatgagaagtaagattacaatgtcactgttaactgtcagcaggaaaagcatatccttactcctatgtcccttgatgacttccagcacaacaatacaaccagaacaaaaagataattacaataaaaaggcactaatggactgctttttaaaaatgaagcgccaaaactctccataaggtggaatgaaaataacatgtgaatacagctttccacaaattcattcaacttacagtgctttatttgaggcttttttttttgtaagtgtggtaaatacaagtgtatttgtttgttttgaattacttgaggctgggtaatttataaagaaaagaggtttctttggctcaccgttctgcaggctgcacaagcatggtaccagcatatgctcagcttctggagaggccacaggatattttactcatggcaaaggggcggggaggcggggggcagatgtgtcatatggcaagagagagagtgagagagagaggaggagatgccaagctcctttaaacaaccagctgtcttgtcaactgagggagtaagaactcactcattaccgtggggaaggcaagaactactaagaattaaataaaactatatttagtctgttgtctttctcaatggtcatcgacatacatttggtgggctggtggaagctgtttgggtcatgggggtggattcctcataaatggcttggtatgggggatccacccccacggcccatacacattctaccaggccccacgtccaacactggagatcacatttcaacgtgagatttggaggggacaaatattcgaaccatatcggcaagtgtatcattttaagcttttgaaaaaaaatgacaaaaaaaaggtccaactttttctaagatcattaatattcttatgtaataataggcttcttaggacaatttagataaaatttgactctggtgatagaagaatacgaaaaaaaccagaataattaattctacctttaaaatttattattatgttgcagagtgtcttcactgctctttcatgtgttttgcagaaaaaagcaatcaaatatttgtttttatgatgaactatttttaaaccttttagttaattatgcatctttttttagggaagataatgtcaagatctcaatggttgtctttagctaaacatagattccctttgagattgtaataacataacaaaattgtattattacttacaaataaatgaaatttttgcctggggttatgtttggtttatttatttccttattaattctttgattcgttattatataacgtcaatgctggtattacaatgaaataaattagtttctctgtggaaaattaccttggaacagaaccaaacaaaagtttccaagtaatctatctgtcaccagatgtctataagtcactttgagattcttgaaaggaagatgttaggcaagtaatataatttcttgaaaaaaagtcttaattaaattagaccttctggcatgatgaaaagtactgcatgaaaaatttaactgaagatagaggtaaattttatcctcaatttatcaacactatatgaggttcagacacatgataaaaatgctgtcatgatattcaacactttgaaaatcaacatttttgacacatcattctaaaagctggaggggaccaagggagagggaaggagatgccaggctccagtcctctgggtacccagaactgaagccagagctaaatttggtacctgagctgataaaggtgctttctaaaagagcagtggtttgtatacatgtctcatttctctttaagtagcacaatagagaaactattcagaaggagaaaaaaaaacagcaggctaatgtgaagcagagttatctatgaccttcttattcttttacaagtgagtatgacagctttgagcaccctaatttgtttaatgagtcagtaaataagctcaaattaaacaaaaataaataaattgaatacattcatatttttgttacaagtctgttcacgagggagatttcaactgctacgatcttatttaaatcaattgatattaattgggggtttaaaaaatttaagtcaatgacctgggccctgctggaaatctttggggaggcaaatttctagctactttgcagagaccagtcttttaagtggggagtaaatttgcaggatggcagaataagtggccccaacctatattacattgttacaagaatcaccttgacctaaagacacttgagaaacagtagatgtaagaagggcatttgagtctcccccttttctccctgaaaacaggagataaactcccatgtgaaagatgccctccctctacaagacaaatgaatcattctttgatggagagtcagaactgagaggattctgcacagactttcttagaataattcttcttctttaagcttccacatataacttacatttcctcaattgcctcctttagtttaacctaactcaaaagcatgtagattctgtcatttatttgggtctcaagaaccctctttatgagggctcttgtgtcacataaaactcatcttaaatgtatgtgcttttctcctattaatctatctgatgtcatcttaattctcagagtcagcttgcacactaagaggacagagataaaattttgcttcccctacagggtgcatagaagtgatgatgatataaggcagaaaatatgtttcataaaatgaaaaaaataagttgcatctgttgtaagacataacacacagacactgcctcaaggagagggaaggctcaaacgtgaaggaattaataggatagttgagtgttcacacagatacttcatcttcagaattgaattgtaaagctaaagaatggaatggaagatacggaaagtcaaatattcagataatatttatggaattgtaacccaatagtttttaccacatgcttccaaaccttcatattaattcttccttttaaaaattacatttcctgttttctttgataggctcagctacttgacttaaatttattttttcataattaaaaaagcaagaatcaagaaagaaatcttttattggaagatagtaaaataataataatcagctggatagagattcatgaattagaattatctaaaatgtctattttcttttctttatgaatatatttctcattttacaatctgtgactcaaaagtgatacttactttgctcttcctcaacactgagtctttcctctatccttttcaaatatctttatatttaatccattaatatgcctatcatttttattccctttgagaaataatcttcactatctcaaatggagagagtaaatgaatatgtgggtctatgtgtgtgtgtgtgaatgtatgaaatagattgtggaattgtttctaggggaaaatgacacttttagagattatggctttctaaaaattgtttctgggaataaagatgtatcagagtggctttaaattccattttatcggtctcagtgctgaaagttatacaaatcaataatcagtaatacataaataaaattaacatgaattaatgaagagtcctccagtaatttagagtgatttattttgtcctttgctggaaaacattttcagtgtaacattccttcaaatgcaaatggaacattattttcttgacagaagccataagcctccaatatagaaaaaattgcagcaaaatttgtgcaagatttttcataaagaaatatttccatatgtagttgaaatcctaatgtgacctatgccacaaaagactggaaacaatacaaatttatattaccgagactgactaataaaatacagtatgtaaacacaatagattgctatgtagtcattaaatgggcagaaaaaaatggttttgatgcaaaagcttgtcactcatgagccattgcagtacatatgctatttgcactgtgtaaaatacaggtaaatatgatatgtaaatattatgtcttaaaaattcttagtaattcttattgctctaggacaaggcatctatttctttaagggaggcattaataagccattaaaaaattatttagcatttgtccttcaaatttggattttgaaaaacattagctatgaaaacgtatgtctttctatgcaaaagtgaggcttttcttttttattttttcctattatgggaaaaggtgttgatatggtttggctctgtgtccccacccaaatctcatctctaattgtaatccccatgtgttgagggagggaactgttgccaggtgattggatcatggggtcagtctcctccatgctgttctcatgatagtgagtgagttctcatgagatctgatgctttacaagtgtttggcatttccctctgtcctctcattctccggctcccttatgaaaaaggtgtttgcttccccttcaccttctgccgtgattgtaagtttcctgtggtttcctcagccataaggaagtgtgagtcaattaagtttcttccctttataacttacccagactcagggaagttctttatagcactgtgagaatggactaatacagaggtttatggaattatagccacaaagcttggattagtcagaacctagattattttcccccaaaggccatagaattgaaagaattcagatatttttatgaggacaggtttctgcttcaaagataacaggaaggagttgtgtttttttgtttttttgttttgttttgttttgttttgtttttttaaaagactctcactctgtagcccaagctggaaggcagtggcaggatctctgctcattgcaacctccacctcccaagctcaaatgattctcctgcctcactgctcaagttgctgggattacaagaacctgccatcacacccagctaattttttgtattttagtagatacggggtttcaccatgttgcccagggtagcctcgaactcctgagctcaggctatccacttgcctcggcctcccaaagtgctgggattacaggcgtgagccaccatgcccaggaaaaagcagattttttaaagaggacaaaaaagcctcctggtctggggaaagaacttaatcatagggataggagagcacaagagggaggctgcaccctgtgccctgcaccccacatgcaccctgcctggcactcagggagagtgaacctgctgggagggtgcatgctgagtgggggccctccatagagccttggaggacctaaatgagaggtcacaacataatttttataatgttttaaatagtatgaaagtttatgatgtaatgtactttgctattccaacctgaaaatatatttcataacataatgtcacctattattttgattttattgaactgaaggaaactagtaagtttatgaacgtacgattggaaccatttttaggtggataattaacaaaagaaatagcaaaataccctagtataatattgtctcttagataaaatctataaatcatgctcttttgggaccatgaaattcaggtaacttgaactgaaatgtattgtataacaacatctaggtgatatactcttgcaaatagtattttgtttcctacttgtataacaagagctgataaattctttcttcctatgctcaatcattaaaaacaaatccttctaaatttcagagcatgcagaatttgcaggggtatacgccattaaatcatgtaaatgatatgcaaactactgttaaaataattgcatcatttttaatatactggaatcatctgcaaattccaaagatttagacataagaattatggagagggttacaggaaagatgtgaggattaaacaggggtttaatgaagttggccactcttttcaaggaatgaaattgagactgaaatggcaaccaattcacattatctacatgctgtcaattgaggttatcaaaaccagtaaaaagtacaaaaaaaaatcaaaatctagcagacgttatcttgccatgaaacaattgagtgatttatagatgacatgacagattgatttttttagaaattaaattcattgacagtttaaactatgtcagtttaggcactgccttcagtgagtacaggccgctcacactcatttgaaagcatactgtgagttaagtaacaaacactagatttaatccttcagattacattacactaaattatgtcatccagaacaatttccctaatgtccgttgctaaattaaatgtgttgtcaagaaactaatgagataaacttgaacctttagaaccgaaaatgaattaaatctccaaaccaacttgaaacactactggatttttaaacagcacagcaaaatataagaaataaaaattgaagaacatatttttccatataattacagtaatgaatataattcccatatcaaccgcctataaatttacacatctcaccctcccaatacagaataaaaaaatgtaaactaaaatttctagcatgaacaaagttctgtatatgcattaacagggtacacatgattgtatttttctatttatctctatatcattttattcagaaaaatatttgtagccttttatctttcaagatatatctattaaagactatttaatactctccttttgtgaatagtagcttgaaccatcaaaattcaaactgcaaatttgtctcaccacctttgattctacttcatttttgagttggtactaccaacagttcatagttggagttagaaaattttttaaaagaagatgactacagagggaaaatgtgtagataaaagagaacaagagactaataagtagtttttgataagtgaagagagttaacataagtggtgggggatacatttgaagcccagagcatctaataaactaagaaaaatgaataataaaatatttgaataaaaaccaaattatatgtaatgttgatgactaaaatgtaaaatgacccaagcatgacatgttttatcactttatatgtatattttatcactttatatatagtgataaatacatatcattttatatatacacatgtacacacatatgtgtgtgtatatatgtgtgtgtgtgtgtatatatatatatgaaagcttgttacaaaaagattaaaagtgaattttgtgaaagtttaacacaatgtaaaaaacatttatagtagacataattatgacagtaaaggagaaacattatgactgtactacatttggacactttctcccataaactgttacattaaataagcaggaggcccttaacctgttgactctgtactttgaattcctacataacaaactgcaatctaacatagtttagttcaaactaagaatatagcaaacagccagatttcagccagttgcaagcaatgcactcatcacaccagccccaaataagggagatgcccagctgtagccactcaggtgatttctcttctgtgctcctgtatctggcccataaaagctcactgctctcactgctgggtggagctctctgaaccccttctgcttctgagtactgcctgattcataaatagttctttgctcaaataaactgtgctaaatttaatttgtctaaagtttttcttttaacaagtatcaagaatatagtaagaaaaaatacactgaaaactttgtacatttctttcacagatgatggatcctaaaagattttaaacatcaccccggaagaacccagtaagaggtatgctacctgggtctttgtcagacaaaattgtaagtattaagttttggggaaatgtccttaaataaagcaatagttataacaagcttgagtactgtttcaaatatgttttatcacaacctagagtaagaaatactctgtacctcgcaacacagaacatttacatatatgtataaatattgaactattacatgtgcaagtgtcaattctgtttcatttcatcccattcaattctatcctgggcctattctctcctatctcattccactttactctattacacttagaataagttctggccacagtccagctcatggattaagtaactcactaatgggtcatgattgtagtatggaaaaccctgggctgggcgcagtggctcaggcctgtaatcccagcactttgggaggctgaggcgggcagatcacgaggtcaagagatcaagaccatcctggctaacacagtgaaacctcatctctactaaaaaatacaaaatttagccgggcgtgggagcgggcgcctctagtcccagctactcgggaggctgaggcaggagaatggcgtgaacccaggaggcggaacttgcagtgagtggagatcgcatcactgcactccaacctgggccacagagcgagactctgtctcaaaaaaaaaaaagaaaaaaagaaaaaccctgaactagactgatgatgcacagatgatcaccattacaatacactaaatataaaaatgatgtaaaattttctctactttggttctctaaagcttaagcttcccgaaagcctataattactctatttttgtatttttactagtaggtttacacagtaaaaaaatgttattttttaacctaaaaaactatataaattagtgttagccatgacagaaaatcatcaaatgtaaattttatatgattcataaaaactacctaaaacatccctgtccaggtgttctccagtttctctttataaataaacttggtgagggagaattcaggcactgagcttatttaaaaagagagaccggaaaattgagtatgttagtcaactgattgtttttcaggacacgtttaatttagactagatataaccagatcccaatttaaaaccttgaaaataacaaataaatgccactgtaaaacacccaaaatagtaaaattcaaattttattgttagcaatttaagatctccataagccttatctttgtctatttttacatgtcctcagcattgtccttaaggaacttaaaaatttagttggaaagttacagcaaaattacctttaggttgttctctgctatttcccagctatataaaatagccatttcttttctgagttttcacattcctttaatataatttgatgtatttgtagtaagaaaaaaggggtaattcagatattaggaagagaaaaaaatcttaatataaaacacaatactatgaaatataggataattgttattactactaaattttgagagaaagaaagaatcagtttaagcttcccttgatggtcttcaattttgttccctaaagcatttctgaaggcaaagaaagtaaaagtaagtattaattattgtcaacatatgtgtttatacttagcatattcatatttattttttcaaatcaaatgtatgatacaacaaaattgaacttacatgtgtgatttgataatatgtgcaacattagggtccctgggaacataaatatgtacactgcctttatgccattttataatgtttagaggattattttactgttcaaaattatcacgtttcatttatctgtacttttattatgtctcattagtcatagctatgatttatttaagctatgtccttggtcagaaaattttatctgccttaaaatgttgagatttataatgccgtcttcagaaatgtattttggcaaaaacccagggcttcttgtttctaagctttgcacagtcctaaccataaatacacttgaaattcagagaacagagaactaaatgtggagtggtaatccagggaaaatgtccagttagggcaatggctttagctgagacgtcaagaaagagtagtatttagctagactgaaatgcaaagagataggaaaacaatagacatggaaataaagtagggtgggaatattataaatccctctgtggttgggaaagatagtgcatgttgaagaagatggaaaagtaagtttttataattttttgtgtgtttatgtgtgtgtgtgtgtgtgtgtgtgtgcctttaaaatggaaaaattacagtcacagatgtggatttatttcactatcacaatacgttaagaggcagataaaatagatattatttccctgttacaactaaaagtcatgaagtccagagacctctttgagtttccatttttctgagaaaaatggaaatagtctattaaatgagagatgaaaagctaacttcatgccttttcatatatccaacagatatttatggagcaaaactatgtgccatgcactattctagatacttagaaaaacttgacaataaaataaccaaaaatatctactttggtgaagcttatattttataacgaaagacataacaaccataattaaaaggtaaatgatatggtatgttatacaaggtctttggaggaaagaaatagagcagaattaatttgggagataggggttgaatagagcccattgcattttaaaacagtttactcaaggcaagccctgtagaaagaacggaattagaactgggactcaaaggagtccatgaagatatttgaagcaaaaacattccagtagccagaaagtccagtatagaggtcctaaggcagaaacaatcctggcatattccaagggcagcaaagatgaccagattgattgtgatgaaaacagggaggcaatactagagaaatacagaaaagtaacaagagtggaaataggtcaggcagcctatgcagtgttttgtactcattcaaaagactttatcttttattcagtaaaaagtagagtcaatgaaggattttaaagagcgggataactctttatgtaggaagttttgtgtaggaagaataaataagagtctgttaaagtaattcaggaaacaaatgatgggtgctcatgaagggtaatagccaccgaggtcatgtgaaatgaacagagtatatgtaataattttaagatggactgaaagcattccttaacaattccgatggggagtaagcagaaaaagagaaaaagataacaccaatatttggcctaagcaaattaacaagaaagtaaggagaggtggaaaagcagttgagctgcagaaaataggaagagaacatgttttatggaaaatcgaagaaatctagttttctcttttagatgtccaagtgaacacatgaacctggagatcaacagggcaatatgttggtatactctatatattagtccattttcacaccgttataaagaactacctgacactgagtaatttataaagaaatccctgggatgcaaggctggttcaacatatgcaaatcaataaacgtaatccagcatataaacagaatcaaagacaaaaagcacatgattatctcaatagatgcagaaaaggcctttgacaaaattcaacaaccttcatgctaaaaactctcaataaattaggtattgatgggatgtatctcaaaataataagagctatctatgacaaacccacagccaatatcatactgaatgggcaaaaactggaagcattccctttgaaaactggcacaagacacggatgccctctctcaccactcctattcaacataatgttggaagttctggccagggcaatcaggcaggaggaaaaaaataaagggtattcaattaggaaaagaagaagtcaaactgtccctgtctgcagatgacatgactgtatatctagaaaaccccactgtctcagcccaaaatctccttaagctgataagcaacttcagcaaagtctcaggatacaaaatcaatgagcaaaaatgacaggcattcttatacaccaagagcagacaaacagagaaccaaatcatgagtgaactcccattcacaattgcttcaaagagaataaaatacctaggaatccaacttacaagggatttgaaggaccttttcaaggagaactacaaaccacgctcaacgaaataaaagaggacacaaacaaatggaaacacattccatgctcatgtacaggaagaatcaatatcgtgaaaatggccatactgcccaaggtaatttatagattcaatgccatcccatcaagctaccaatgcctttcttcacagaattggaaaaaactactttaaagttcatatggaaccaaaaaagggcccgcattgccaagacaatcctaagccaaaagaacaaagtgggaggcatcacactacctgacttcaaactatactacaaggcttcagtaaccaaaacagcatggtactggtaccaaaacagagatatagaccaatggaacagaacagagccctccaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggtcataggcatggagaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttatctgacaaagggctaatatccagaatctacgaagaactcaaaaaaatttatgagaaaaaacaaacaaccccatcaacaagtgggcaaaggatacgaacagacacttctcaaaagaagacatttctgcagccaacagacacatgaaaaaatgctcatcatcacttgccatcagagaaatgcaaatcaaaaccacaatgagataccatctcacaccagttagaacggcgatcattaaaaagtcaggaaacaacaggtgctggaaaggatgtggagaaataggaacacttttacactgttggtgggactgtaaactagttgaaccattgtggaagacagtgtggtggttcctcaaggatctagaattagaaataccatttgacccagccatcccattactgggtatatacccaaaggattataaatcatgctgctgtaaagacacatgcatgcatatgtttattgcagcgctattgacaatagcaaagacttggaaccaaccccaatgtccatcaatgatagattggattaagaaaatgtggcacatatacaccatggaatactatgcagccataaaaatgatgagctcatgtcctttgtagggacatggatgaagctggaaaccatcattctcagcaaactatcacaaggacaaaaaaccaaaaccgcatgttctcactcataggtgggaattgaacaatgagaacacttggacacaggaaggggaacatcacacactggggcctgttgtggggtggggggaggggggagggatagcattaggagatatacctaatgtaaatgacaagttaacgggtgcagcacaccaacatggcacatgtatacatatgtaacaaacctgcacgttgtgcacatgtaccatagaacttaaagtataataaaaaaataaataaaaaataaagattccttgggaagcacaaaaaaaataaaaataaaataaaataaaatacaaactcaaaacaaaaaaagaaaataggtttaattgactcccagttctgcatgcttaacaagaagcatgaccggaacgcctcaagaaaattacaatcatggcagaaggtgaaggggaggcttatacatcttcacaatggagagcaagagactgagagagagtgaagtggggaagtgctacacttttacaccagcagatctcttaaacactcagtcagtatcaggaagacagcatgggggaaacccactcccatgatcccatcacctcccaccagttctctcccctgacaagttgggattacaatttgacctgagatttggttggggacgcagagccaaatcatatagacttctgtctatagactaagtggagtctctcctctgtcatacacttatatctatagaataagtaggatctctccccaaaccatacagacttatggtttggctctgtgtccccgccaagtctatatatctatggcctatttgtgctctacagatacaaattttaagatctaaactattgtataaatgatgtttagagacctaagactagatgaggtcatcagataagtttgtataggtagaaaaaagaagaggtaccaagattcagccctccaatgagaagaggttcatgggagaagctaggaaaggtaacttacattgattaattgatgaatttgcacggaaaccttgagtatgtgttgtcctgacagccaaataaacagaatgtatcaaggaggaggtagtgagtaactgttaaatgtggctgacaagacacctactgagaactgatcattagatgccacaacatgggagccttctatgagtttcttggggtcaggactatgttcttatttgtttctttttcctgtaatctggcccagagtttgaaaaatgtgaggtctgattccaagtgtgatattcttcaattctctagctgagagtgttaccagcatccagagaagcccaattaattagactacacaaaatttaaataacaaaaaacaagaactagatgtcacctgaaagagtgttgctgtttatgatttttcatcttcttttattcttgtttgttttgaaaataaaatgtttactcattcaagatgttttagaagccagcttaaaaagtgattagaaaataatttaggttactgctcaaagctagcaagtgccttgggtgacacattaaggatgacacaatgacattaagtgagaatggtgtaaaaattgtatatgaggaaaccagaagactaagggtgccaataataaatcaaaataaatttcactgatgttattagtggcttccagttatttttgaaattcaaaatatagttagttcaataaaatgacaattcattttttaatatcagtaacctgggtggagaactgaataaaagcaggtaatgccctaaagctcctcctttgttcaagcaaaactccatgtatctattgatattttcagtagcagagatgaaagaacatgtctgtagtgaaaaggtcctggcttttctgataccttggagggcagaattctctccaggaacataccaaaacaagcaccaccctcatgggtctaattagaaaacaattcagtcgctttgaacttatcagtgtattaccatgaagtattttttaagatttaaaagcacatatacatcggaaggcataataacgaaataaccaatcaagatgaatataacaccaatgcaaagaaaagttagaaattcaaatcaagcttgcaaaacaaattaagtagcaggaaagcaacattcataacacattagtttgcaccaaaacaaaattaataaagagaaagtgcataaatagtacttgaatatttttgtaattaaaaggaacatctctttgcgtgaagcaaaaagcatccagagaagcaggcaagcatcccgctgttgaacacataacaagagaagaggcagacatctctgacctctgttgtttttctggataataggaaaaattaatatatcccgtgaaaaggacaggaggggaaaaaattacttcatgtgtttgtaggcagagacttcaaatttttattcaaaatctattattaatctttccttttattaggatcttagctagaggttacattttccaggtttctttgtagcttcaagtggccaatgagttatgaacaaaagtaagtaatgtttataatttttaaccccttttccttgaggaagctgcttgtctttcatgcattttccgcctccctgcagttgagatgtcaccggggtgctgggagacagatttctcatgtagaaagtcaataatttagaccatagctgtgcaacaagatgaaaagaacctgcttctaactagccttctggaacagaacttcttgcccacctggactgtactcaatacccacttctggacttttctgtgagggagaaataaactattttgttaggacactgaaattttgtgttgctttgtgactgtagcttagcgtaaaccctaactgattcaggtataaagtcctaacgtagtttctagcagataaaacacacttttatttgcattttattcaacatctatttaataaacatttactatgtgccgcaatactatttgcctctgtcgtccttaaaagattcaacaagtttaatatatgcatatttaatttctgcagggtcaatgcagacacatgtacagcaatattttcattaatagcttatcatataagatttaacaaagccaaaataaactactgaaggtccctctctgttgaaagccttaggaatcccccaataacaatgtttataatgccaagaaagtgatgtctttatggttctaatgtttcctcggccaacttagttatcatcaaatcaaattttttggcagtttagaaagtaaaattcatcgactttcaaatacatttaccaatagaagagctgaataaagattattaatagggttcattgcagtatataccaagaagcgcaataattttttctatgcatgtccataagagcaaaggaattgtaaagaaacataaatatcactccccaattttattattattatttttttttttttttttttttttttttttttttgagacggagtctcgctctgtcgcccaggctggagtgcagttgtgtgatctcggctcactgaaacctccgcctcccggggtcaagtaattctcctacctcagcctcccaagtaactggcactacagatgtgcgccaccacacccagctaatttttgtatttttagtagagacggggtttcaccatgttggccaggctgctcttgaactcctgacctcaggagatccacccgccatagcctcccaaagtgctgggattacaggcatgagccaccacaccgggctatcactccccaaatttctgacctcaatctttctaaaagtgagggtacacaaaaggtatagatcgtccttgatatttagaattattcttccttagatatggtcattcaccacacatgaatttcttaggtataatcttctgttagtcattttttttaatatttaaaggtagttgttttaatatgtgtcttaataaacatacatgtttcccctgttgtcatcttatttgacagttaaactgataatactgtggttgcaatataatacattgctattgaaatttgctcactgtgttcagtgttccataacttaaagataagttattcttattttagtagcattacaacattttttaacatactacaataaatcttcattaaattgcatattttgaaatctttataactgattactgttttctttccatggatcatctagtgacatttttcagaagcagcttctgttgtgtggccacttggttcaaacgacagtccttttagaaggaaaacagacaaattgtattctcacgtaacttatgatcaagactgcagaatatatattttatgatacattgttttaccatatatatagtgtccttactctcctatgagcattacatggctagactatatggaagggaaaatacagctgagatttcatacctagaggacatttatcaatatctgaacattatttcaaaagtagtgttttgttgttgttgttgtttttgttttgtttattttgtagaagacagggtctcactaggtttcccaggctggtcttgaactcctggaattaagtaattctcccaccttggcctcccaaagtgctgggattaaaggcatgagccagcacacctggctagaagtgaacagtgtaagaattctcccccaagtttgaattctggagtttactatatattccgaccccattagtgacacagatatattacaacttggttcagtaagtttcagatgacattaaaagcagcagaattaccatcaccttaaaaggtcaaatgagaattcatgataatctggactacttggaaaatggattacattaattaatttactaattaatttagacagcaaagtttcatccaaggccaaactccatttgcaaagaaaaaggggcagtcgcatactgtcgctagggcagacatatgaggaatagtggcttttatcctaaaatgctgaatgggagtccacaaaatgtcaaatgattaacataacacagagttatatcttctttgctatctctcagtctttttgttttatatcatttttattttattttatgttctaagatacttgtgcacaatgggcaggtttgttacataggtaaacgtgtgtcatggtggtttgcagcagctaccaacccaccacctaggtattaagccccgcatacatcagctatttgtcctgacgctatccctcccccaaccccctcaacaggctcctgtgtgtgttgttcccctccctgtatccatgtgttcttactgtttagttcccactttctctctcctcctacttttagaaaacactggccttaggtttaatatttgttctttgaacaaatatttgaactttgtctcttctaaattcatctggtgaagttctaaaccctagttcttcagattgtgaacttacttgaaaatggggtcattgcaagtgtaaatatttaagtaaaaattaggtcacactggagtagggtgggcccccactccaacatgactgactggtgtcctcataaaaagatgaaatttgaacatgaagatgaagacacagggaaaatatcatgaaaagattggagcttatgctaccacaagccaaaaaatcagaaaaattgctagcaaattctaaggcagaagcataaaagagatccttcctcacagccctcagaaggaaccaaggctgctgatatcttgaatttacatttctagtcaccagaactgagagaccatcaattctattgcttaatccacttagtttgtggtactttgtgatggtagcaaactaataaactggctcatatttatctgtaggttgagatagcacgatttactgcttcaggatcttataaagatgaaatgaaataatgttcacctcacatggtaaaaaaagcacatgatagttgccttccaaataataggtctcattctcttagctaatctctttaatcttgaacctaacatttggacaataatcttgtaatgccatttagaaaataactgatttacattatgatacaaattgttaatacatttactagtaaaatatgtattctttgaaaattatttatttggaagtgtgcaagttgcacataaactttctactttgatcttggttgtacacgaagacaccacacagaacctttagtttacgtagtacatcttctgtgggtaaaataacaatatatctttgggatatattaacacacaaatatgaaatttgccttcaatttggagggacggatcatcagctcctcaaatccatatatagaatccaggttgagaacatctaatacctaattttcaatgctggatcatttttgatccattgtgtttcttcttccaacgtttttatttacttcagtggattttccactgtcctatcctcacaaagtcttatatttaaagtcctctagcatcataagatagaaagatcctgaaaacattatttaccattttcctactatgtggtaataattcaagaaataatttttagcaatatatggttattcctaattttagatttcagcactttttttcctatgaaatattctcattttaatttctgaatgattgtccttggattaggcgcatcatacacccagctgatctgtataggaaaaacatattcagtctcaatgaattacttcatttttttttgactgcaatcatgaatacgtctgctgacctcaaagtcccattttaggaagctgaaaaggaaaggctctgacgttaacctggatgtctattgacttatttcaggagtattaacatgtttaaatggaaaagccaatgtctagaaactaatataaattaattcctttattgtataattttaagcttcagctacatgtttggaggatgtgaagaatctttgatattagacccacacatcactatgtcccagtttatccctattatattcccagttaagcataggcaggcctcatagacagttcatcttgctggttagaatagtcctaaatgttatgctagaacatgaaattaagattgcaggtttaatgctacattggccatttaatttcacaaaaaaccttttaaaaaatccattaacaaggtgggggttgctgtttgtaccaaattccagcaagtcatctaaaaaagatcccatcttgatcatgaaaaagcttgaacaaaaaataaatattgtatacatctcttaaaatttgtcttgagttttaaaattttaatttacctataaggaaagaaaatattacagctgataacctccctctaatcggattagagcactgtgttctcctgtttcacctagatgtcaggaaactcacaacaaaactcacagctagagaaagcttcttagaaatagaagctagatccaaaaactgtttaaaaaatttgcaaaagtaatcatctcaagacaaacctgctacacccaggcctaccctcaagtcctcaaatatgaaactaaggaagcaataggttccatggattgaaattattgtgttttcaaatgcaagagaggagctcttgtcaaatagctgattaggcaaaatttctattagcaaatgacaagagacaaaacaagacaatgtaaaacaatatttactcgtctaatatcaaactgcttttcattttggttatctcctcataacctaaaaattgaaaatgtctgctttcacatcaaggtcatttatctttcctgtaaatatgcaaacttctgacttaaaataagaaagtatatttaaatctttccttggctacacagcctggaccttttggtgtggttctcataattcctagccacactaaactgaaaatataggtggtgaataaaaaccatctgtacttttgctgttgtgattcaccccatttctgagtcgtaatcaattccaaacttattttcacttaacacaggatgtttgcaaaagaaccagctgtgtttaatttcccttaattgccctacgaaggaaaaagaatttgaccagatttggggaaaaatttaatctatcagtaagattttatttcttatttttgcagaaaattgaagcccctatatccaggtagtcatacctgaagtccatcttcagttgtgcatgttccagatatatggcagccttccaatactttgattacttcactgtagaatggagttactaaaagtttacttcgtgtgatttgcatatcaataaatcacttagcttaatgcccacaaaaagttataggtgatctttttaaaaattgtttttagtgactagtaggtaagattaatgtaaaatacattatctaaataatgtaaaaataaagaataatgaatacaattactgaaataattatttttgcatttataatgtacaaacagatccatcaaaaataactttatttatggagctcctttatacagtcagtagtggtctagattctgtgagggatataaaaagtgcataagatatcgggaagtaaatagtcagcaagaggcttgccatccactgtcctcttagccactggaaagtgacttgttggaatctctatgtatgcatgcaaatgaaagacctctggcaaacacatccatggtatttgtccaaaggtgaatccttgtctatggaatgctttcaatgggatgtgtctggtctatttaggacttttttagggtaaacaaaactgaaatctatgggtttatgagcgtaacaatctggaaaatcatgttaactattaatatgtaaaattgagatgcttcatgactcaaagagctccttttcatataaataatgcagccacatatatctagaatgtccaatctgagttaaagagcatgcttcaagcaaaggcctaaagagtggtgtttgcagttacttgtgatgacttgcattttgaaactgtttctaagtcttgatgctaggtaaaatatctgattattgtgtgctaggtcaaatactttgtattatctcagatatattagggaaaaaaatgtcttttccccattccttgatttccatgaggaaggttttccttaagcattgttagtttcttgcctcatcccttatttacttctccctatgaaagcaaaatgaatctttgcatttgtggggtaacagtatagtatgctcctcatgtgggcatacaaattcatcaaagttatttttcacatgtgttttgattttttttttttggtttctctagtgggaataaatctgcttatgtctgctctgtggaaaaatgcttgcctctagtgggctgttctaagagagaggcttggaggagagagatggcaaaacacttggctctcaggattggctgcgatggagaggatgtggagaaataggaagatttttacactgttggtgagactgtaaactagttcaaccactgtggaagacagtgtggcgattcctcaaggatctagaactagaaataccatttgacccagccatcccattactgggtatacacccaaaggattataaatcatgctgctataaagacacatgcacacgtatgtttattgcggcactattcacaatagcaaagacttggaaccaacccaaatgtccaaaaatgatagactggattaagaaaatgtgacacgtatatgccatggaatactatgcagccataaaaaagatgagttcatgtcctttgtagggacatggatgaagctggaaaccatcattctgagcaaactgtcacaaggacggaaaaccaaacaccacgtgttctcactcataggtgggaattgaacaatgagaacacttggacacaggatggggaacatcagacactggggcctgttgtggggtggggggaggggagagggatagcattaggagatatacctaatgtaaatgacgagttaacggatgcagcacaccaatatggcacatgtatacatatgtaacaaacctgcacgttgtgcacatgtagcctagaacttaaagtataataaaaaaataaaaataaaaataaatttatatgtaataaaaaagaaaggtgatttccatgccccattggcttgctttcctattttcgtaattagttcccaactcaatatgtaagaagagtactattcattgcgccactcgaatctccaacacgttatttaccactgggatcctcctcaggggtgaggagtctgaaccgatcaaacatgaaatggttaagtgatcggctaatgtaaaggtagtgataatacagaacacataggaattctttttttattattattatactttaatgagagcattctctatcaaatagagtaattagtgacgtgctagagttgacttgtacttactcacgagagcctattttgatttctcttccatgttgagtggtgccatgtcgtagcttgaaactggccatagtggaggtatctacaccacagaaattagcaactacttcaagtcatggcttccccttgcccagagataattggtttgaaacatttactacacccatgaatttgacctggcataaatggatatgaataaagtctcagattgaggaaagcagaaagacacttctgatatctaataagtatgtctcccacccacctccttgctggagatactattacagaatactgaaagataaaaacgtaacactgacattgactctcatggtgaggataggctttatctaccattagtattatctcatataaacaataatgtagcagaaggattatagaactgagagttaggaaagatttccacatgtctctaccaccaaacacttgagaggcctttaatacatatgctttattttaaaaagaaacaacttcttagtctcaattaatacactatttgtataatactaagattggaacaaacgttaactgaaacatatcttagtagtaatatttgttgggtaccacataatgtttgttacattattacaatagaaacattttacttttcttgttagtgcttaaattattttattttatttatttatttggagatagggtcttgttctgttgcaggttgaaagagtgcagtggcacaatcacagctcattgctgccttgacctgctgggcttaaatgatcctcccacctcagccacctgaatagctgggactacaggcatgcgccaccatgcctggctaatttttaagatttttttttatagagacaaggtctccctatgttgcccacgcttgtcttgaactcctgagctcatgtgattctcccacatcagcctcccaaagcattaggattacaggcctgagccaccatgcccagacagtgcttacattataatctagtgcattatctaccattattaaaatatgtggatgaatcagaaaatgtatagagagataagctaaataaaaaattatttaaggtagctactatgaggggtttatcatttattaaactgaagcaattcactgctgttattcaacgtatggcttcaacaaaatacactattttgaagaagttgtgaaatgtgtatccctacattgatagatagcactaagaaaaaataaattgaaagaattcatctaaaaacaattcttagttgaatatttactgaatacttttcagatctgtgattaacactttaaatataacaacagactgccatctctttgatgtcttaacacacaattcatctgaaatcaggagattagtccaagtgaaacttgatttgcttttaaaatccaatattctatttctatattgatttaaagtcaaagtaaacgggtcatcctataagataaaggggagaaagttaatacagcattctgcatagaggaaatagaaataaatgaatggataaaggtaaataaaatacatcaataaagttatttaaactatgtaaaaatgatcactatgtaagcaaacagtgattcaataataaatatgaaaactttttgcttgttaataagtgaattatatatatatattattttaaaacaaattttaataatttaatcccaaaataggtagagaagtgattgaattacatgaaatctctatttatacctgtcttgtaactgtcacagcaatggtatttgcaaagtgtttacaacatcatgaatgtttgctgagttaaaatgcattagcatgtcatgaataaatacatattttaacatttgctacctgcataattcatctggcattattctatatgtcttgctgtccttttattctgtatatagacagcacagtttattgggtaagaaattaatttctggagagggacataatgaggtttgaattttagcattctcattattagcactgtgacttcagggaagtcacttgctgccctgatgaaatttagtttcctttctctaaaatagacatagtaatgcataaaatgttcttttgaataagtaacctattacttaacatataacaagcatgaaataagttatttcagcaaaataaatacattcttaagcaaaatcatttattatttattagcaagcattcctttctttctaactagaataaaaagttggcaaataattacaggaactatattttacacaactttctgggtgtagggaaatccactgactacaacaaacagctgtttttatctaattagggaagtcataacagatcttcttacttatttgtatacctctaattttagattagctttattttattttgatctcttaattcaacaagtttagcctccaggcaggtagagcttacagaaatacacaaaatttccattaataataaaagacctgatgctaaaagttaaatctgaaggatgaattaagtagtccagtgttctgaacatttatttaacctcataaacatgctgtgttttgtgctgattttaacattaaacaaacaaaagtttcttaatttttagttataaaggtcaattttcgcagttcagaaatgaatactaacagtccttctgcacttggttgagatccaagactaccagtataaatgattctaatacattttccagaaatcttgacaaagaagacagaatttaagtcaagataatatgtaatttcacattttatataattttcagtttaaagaaaccagctagctattctactgtgatattctatttcagaaaaaaattttttaaagctttgaataagattttattctccacttccaatttttatcaatttgacacagtcagattttcatgagtaataattaatagatttgtgtccatagtatcaaactaaattttgaattggggggaaaacagcattctttgttatttgtttaaaaatgcaaaatttttatccattttaaagggatactggtttcattttctttgtttattttgtattttttttgttctgtgttttttgtgtattttttaaaccacccacactcaacgccacacattttgagtatttggccacttaatatgaattaaaaattttcctaaaaccacagtgtaccaagttattgcagaaaaatactaaaataaaaatcttcttttatgatattagtggaagccttttaaataaatcagattgaacccttacttgagcaaaaccaggtaacttatctacaaaatgactgtacgagaaagatgccttgaaggagtaaaaccactgaggtctccaatttcactggaataccctatggatattaagaggaacctgacaagaatgaaggactctcagacacatacggaaatcacaaaattccataaacttttcctgacttttctaagaacaagaaagaaatatcaaagcctaaaggaataaagaattactttccagataattcagaaaggaattaaatgctgaaaactgacatctgtgaatatcacattttttgagagttatgtatagagaccatccaagtatcataattttattaaaaatatatacatagtaactattgataatattgtttattggtataattgatgcattatgatatttaaatgattctttggaggggtaattaacttttatacataggctttttttagtagtatgtattattatgttgatttatattgaaatagtattataatttaaaaacatatagaaattttatctttaaggctcaagttttgcatatattttaacatcaaacttttcattcaagctattcattcgcagctgtcagtaaattttatgaaagaaaatagatattcgtcataaaccaactcaagtcattctttttctgctttagaaaataaaaaatgtatctccatttccatttacttgctcaatctgttgtctttcttatgaaaagggtcacctttttagccatgagaaatatatccaactgtactggaaatatatccaactatattctcattttagcaatgatctcacttaatctattattcttcaacttataaaataaaaaatctccctaatttatttaatatatttgtgtataaagccaagtgttatgtgacaactacaggggtcctcccttatcagtgctttacttttcatgatttgttacccatggagaaatacactctgaaaatattcagtggaaaattccagaaataattcgtaagttttaaactgagtgctgctctgagtagcaggtaaaatttcacatattctctcttcatcccaacaggacattaatcctcagtttgtccaacatattcatacttagtaaagatggaaaagtgattaaatttctgggtggaagccgtgttccaactgacagcaatgggttcagtactatctgtggtttcaggcatgcacagagggtcttagaacatatccctggatgttaagtgcagactgctatactgtaattgatgctggagatagaatgagagaaaagtagacatatttcctgcttacagaatttacattttacttggggcgttatttaagaaaactgatcattataatgctgccgatatgctgtgagttaatatagtaggtgctgtgttggcacaattaagttctacccaagaaggtttggttaatcaaaagaggcttgcaaaagaagagctgtccaaattaggcctaattattttgacgaaactaacctagtaaaggggcaattgaaatggcatataaaaaaatctagagatgaataaaagcttgaaatgtctgaggacctgcagtaagttcagtgtgggtgcataatagaggatgagaggaaatatactggtagatgaagcggcagacataagctgaattttgttatagagaagctggtagtgatcttaagaattaattatttcacaaaagcaattaggagatgttgaagggttttaaggaggaagataaaatgattccacttcactttagaaagatcacgttaaccacaatatatggaatagattacacaggttcaaaacaagaaaaaacagacaaccagctagtcttactaagctatgaaggcaagagatttacatgaactgactaggaactaaatgtgacgatgaagagaaatgagcaaatttgagacagtgttattaaaagtaagtaaatgaagaggcaatagaaaaatctatcttgtcagaatttttgcttagatgaataggctgtcaataggtttgtgggttgtggataaaagctcaatttagggcattttggtttcaggtgtcattgagacaaccaagcaggaatgtctacttgacggctgatgcaagtatcagaagctcaggaaggaaggcatatatagaaaggtaatatgagtatcacaagtatatgggaagtaacttaaaccttatgactaaatgagattgcatgaatgaatgactataaatgctaaacataaattccagttgagaccatttaaataaatagccttaaaacaaaaacaaaagcgaaagtcattatggaaactcagaagaataaaatactgatggaaatgttttattactaaatctatcaaaccttttaaaatgtttacgttccctgacaatggcagcatttaacattctaggtcattccatttttctgttttccaaaacacgactctcattttagttttctttctacttctggccttcattgcaatctcctattttttttctttttcatacattctggattcgtgtttcactctctccacctatcattttttgctcctttccttaaagaatttctcatacctctgaatttacctacccatatatgtgaaggagtccaaatcttacatcactactctaggactctgctgagttagatttattcagtctgttttctagaccctgtcaaccaaacactctaccagcacttcaattcattatgttctctaaaactgtcctctccttttctattctctattttcatttttttttttaatttcaacttttattttagactcggagtacacgtgcaggtttgttacacgagtaaattgcgtgatgctgcggtttggagcatggatcccatcactcagataatgaacatagtacagaataggcgatttttcaacccacatatctctccctcctacctgcctctagcagtcaccagtatctattgttcccatctttacatccatacgtgctcagtgtttagctcccacttataagtgagaacatgcagtatttgttttttttgttcctgcattaatttgcttaggataatggcatccagctgcgtccatggtgctgcaaaggacatgattccgttcttttttatggctgcataacattccatggtgtacatataccacattttctttatctaacccactgtcaatgagcaccacagttgattttatgtttttgctattgtgaacagtgctgcaaaaaatatgcatgcatgtatctttttggtggaacaatttatgtttctttgagtatatatccagtaatgaaattgcttcactggctggtagctttgttttaagtcctttgagaagtctgcaaactgcttttcacaggggctaatttacattcctaccatcagtgtgtaagtgttctgttttctccacagctttgccagtatctgttatcctttgacattttagtaatagtcatttttgactagtctgaggttatatttcattgtagtttgatttgtatttctctgacgatcagtgacgttgagcattttttcatatgtatgtgggatgtttggatgtcttcattaatatgatctctacttaactagtcaagttgaacaagtcagaatcctgagacatagccaaagattcttacattctgttcccaacttttttcagtttgtcaggatgtcctgctgattttgctacatcaagtttcttagagtctactccgttgcttcatcagtcattacaactgcagagcaggggttcaataaatgctttttgaatgaatgaactaattcctcttctctctgcccctacctgagtttatgctcctcattactccttgctcacaaattggaatacattctcaatgtctcccagtataaataacatttccttaaaattaaagccagtataatttctttaagtctgaatttaatttgttcaatcactttcttaaagtccatcaatatctccttacctcctgcaagacacattataaactccttagcatattgttatctttacccacttttgacagcctggttaaaggctgacccagtaaatcctcttaaaggtttcctagaatgagaatctccttttctcaggactatgaactcctgtagctcctgaggctctgctcagttgttttctcccctgacagatatctcagctcctccacccattgtagagaagtgagcaatcctttattgtgctcctagagattgtaatggttagctaacatttcagtctccctcaggtgcactacattttatgaggataaggattttttggaaacattattttcttttatttcacatttaaaataggcataaaatcatgtgtggcattcatcaaatgctggttcagtaaaagaatgaatacgtcatatgtaaacatttcaaaattcacctgcactaacaataatatccgaaaagtaagataatcatactagaatacgggagatgtatctttagaaataatacactaagaaactggaatcttttttttttttttttgtctttttttgagagggaattttgctctgtcacccaggctggagtgcagtggtgcactcttggctcactgtaaccttgcctcccaggttcaagtgattctcctgtctcagaaaaagtggaatcaactttaatgagagactggaaaagtgctaatcagaaggattctgctgaaagttaggagaggcagcaatccactcttacttaccttaccactaatatattattagtgccttaccactaatatattattcctgagagccatttgagtgctgtcattaaaaatgacttttcctgaagttccctccgttagtaatgagctcataatgtcaaagagcaaaagcttttaagggccatattctttaacaagagggatagattacttcataaagatattaggaattaccaaggggataaatcaaatcactcttaccgcattttctttcttcggaaaatcagtagatttcaaaatataacacagaaagctaatgactcaatagtattcatagttaatatagtcttgggtaatcttgaaggcctcctgatcatgtatctattcatgtatagctaattttcacattttaaaattacttattatccaaaatttaatttaaaagtatgaaagcaatcatgaatactagtctttaaacataaatgtccagagctttatcagaataaaaccgataaggactttgtactggaaaagaagatgattctcatgtgagagacttttttttttcttgatacaggataatttcaaagaaattatgagttaatgtgattccagccagtccaggttggcataatttgttattaaagtcaatcaatatctccctacctcctgcaagatactctctactccttggacacttgatactgtattagaaatgacagacagtagttacttagagcagaaagataaatcccgagatatacttgtcatcaatcacattaagaataaactatacgtatttatgcattagctttaagtttttcttaataaaagtcttctattacaatgataacatatactttaagtgcttttcccctatatttactactttacattaagggaggtttaaatttaaggcaagatattaagaaacagaaaattgggaagaatagtaaaagcaattaaaattgctttatcttccttctggattcatttttcttcttcctgtaaagtgtccttcagaagttccttttctaaaatctgttgctatcgtatctttgcctttgttcttacaaagtttgggtacataattctacattatcagtcaatcacttttagcactttgaagatatcgttatcctgtcttctagttcccattcccattattgctactgtgaagtctactctcagtctaaagattattgttttgtaagcaatcggtccttttctgctgcatttgctctttgaagcctggaattaagattttcctcttcttttttcatcagtttcacaataatgtatcttcgtgaatattcctctgtttttaactttttaattgatatataacatgcaaataaaaagttgataaaccaaaacaccacacatatatatatacacacatatatgtgcaaacatatatataggggtgtgtgtgtgtgtgtgtgtgtgtatatatttgctttgtacttgagttttaacttttacttgaagaatttcctaaagctaaaagataggctgcatcttccaatcctcttagccctcagatagctcatcctctgtccagagacagtcaaagcacatctcatcttttctgatagctggagcccctgcaagttctgaatactctgggtatgagacactaaacagcttcagccatctgcagcatacatcttatttagaatatctggaaatgtggttatgaataactgcaagttgctcttctccctgaaggctataaagttaatgttggtatgaaatcttcctctatcaattcagaaagatggtatgaatttgagaattccattagaaaattataaacaggaaggtatactctgttcccatcttgtccagtggtaataatcaaactaacacttccaaaaagattagagggggtagggatacaaagatccttccaaagactctttccccaaatcatatcaaaattgcttctactgctgtaacaactagtctgtcactacgttttcgctccaggcttagtctattacagctttacttcaaatcagcaaaagcaacaaaacacatacacatatatgtacacatataatatgcacacataaaaattcttgataaagtttcaagatggatgcattattcaagctgcttctcatacagtttatgttttaaagtattttaataaatgtttgtagaaaaaatcgtaacatttgaaataccaggatgtagcaaatagtttgaaataagtcacaattatttcctcaaaaacaattctaggacgctacaagtctcctaatgtcaatcccttgtttaaaacgtttttagagtttccaagccaggagtcttttgctccactttgttcagaggcacagagaaaaacaacatattatatttaaagtaatagccaaatattactcaagtattatttattcacagtctccaaaacacaatctttctcattttaaaatacatgattttctgttgttccctgaaggacatagagtttattgctacaataatcttttctatgagattcagatgacataaattataaacccactttctagcgtatgggctagtaaaactgtagagtttctttcccattcttataatccttgcaattatgggaataaaaactccaagtgagccagctttactgtaattctattctttgcagtggtaggtaatgaaaattagcaaaatagcttagagtgactaagatgatgctgatagtattactttgaaacaaaagctacttacttcctgaacacgtatctctgcagggatgcaaggccttggaaaatgacctacatagtgtcttatcttactgctttacaaaaagtccatgtaccaatggatcattagtttgtacaattcacctggaagtattttactaatggaaaagcaccaggagtctcagagcacagccatacaggccagttaaacatttaagtcatggctaatgagacaactaacgtgaatatttccttgtcctcttttaggatgggaagaaattgggaagagaatcagatgggacaaaatcatttacaaagtaggtgaaataattgtaacaatatcattattatttctattagttctgtttctatagctgttataaaattatataagaactataccatctccttgttaagtcagaaaaagtctaagagatggtcacacccatttttaatatctatagacaaatctctttccttattgatgatttgaaagattctcttcaagtcaagtgttatagagagttactatatgtaaggtaacttactatatgtaagttacaatatgtaaggtatcgaccttacatattggcttcttctaacagcttagtttaacactctcagtgagatgaaaatattttatgtataactctacagggcaaatatttttcttccaaatgctatgttaattttcaatggtagcttcctttcttattgtcaatgctacttttatttaaaaatcaacatatacacaagataactggtcttttttgtaatgtaaatacttaatttgttggtcagatttatagatttttcagttataaagaaataaataatatatatatctaagcaaagtaatacaaaatggcactgactttttgtactgaaacacagcatgatttctcaatttaaaaaagtattggaaagcatagggcaatatgttgcttgaactttataatatttagtacagacggaaatgtaagcttaaaagggtagagatttctgtttcacacctcgatatattgcaaacccctagaaaaatgacctgtgcatagaaggtgctgaatagtattttttaaatgaatatattttgactttgattttcttttctataaagcaaatgtgctatactattgctttcaatgaaatattttcttctccttctacctatacacttcttccaaaagaataaattttaaaacatgaatagcaaaatagatgaaggggaaaaagagtggaaagcaagaaagtatttcctgattggcatcactgaacataggaagtcaactccacctttgaacgctgttgggcttctgtggtggcaatatacacatatatgcatatataatacatgcagacagtgaaatatatatatttcactttctctgtctacctgaaatgtcatctattagagatatatttggattcatgaatattattgttgtaaatgcaagtagctctgaataagaaataatttaaaaatttgcttaattagattattttgttcctaaaattgagacaattagaaggggtagagttttataaacataaattatgtggaatgagcagatgcgaagaaagaaaggtcagggagataagtgaatatttttcaaaaaaaaaaagagaagcttaatccatggcaagacaataaatggatgataatgactccacctccaacctattccctcataactatattgatagataaattatattcaacaggagcatcactaaaagtgttgatgatagaagcattccaaggcactgaaaaatcaaagcttggaaatatctgaaagataaaccaggcctgtcttgcataatatagtatgctttcatttgcttctccttcaaacaagtcacatcctaaattgaaggttgcctctatcatgagtcacagaaaccctcttttcacagcttaacgtgctgaataaattaagataaagttataagtaaccaacagctaagaatagaactgcaatgtataaattaaaaataaatacattataagtcagtgtgaatgaagaaagaccaatacttgtacaattctgtacaattcttaaaaatatattttgtacctggtagtattttacatgtaaggtctatcaaggataacttgaaataagaatgaaaataacttttaagtattatgatctagcatacctatcaatattttcttacctattgtgatggttaatgttatttctccacttggctaggctatggtgcccagttgtttagtcaagcacccatctagatattgctataaaggtatttttttagatgaggtaaacatttaaatctacactttgagtaaagtagattgccctccataaagtgagtagagcttgtacaatcagttgaaggccttaggggcagatgctgaggtttcccaggaaagaagaaattctggatcaaggctgaaatctagaaatcctgctgaccttccagcaagctgccctgcagaattcacactacacactgcaacatcaactcttacccaagtttccagttaccaagcctgcctcatagattttagacttcccagtctttacagttgtgccagccaatttttaaaaaatttatctttgtctctctttatctctccttcaaagtccattaatggttttgtatctctggagatcctgattcgaaaatcaatgagttttgggtcaaggtgtctgtggctcttgaactcttttatttgggggaatgtgttctttttctgtcatgcctctattatggcatgcttcaaaattttaagagaccagccaaaaattaatgaaaatttgcaaaaatatcagaataatctagaaatgcaaatgtacttcttacgtagctaacaaatctagttctacctgttgaatgagattaccaactaattctaagaattagttgatttaagttatggggaaattagtcaaacattttgatgacgaagaccagatttctttctcactgattcagatgccaacctcttgacagaaatataaaatataaagcctttgtgtagttgcataaataaaaaaaaaaagtctccaacgttactcgttagactgtggcctacagtctatctgcaggtggtctcaggtctcatctgagccttaataaatcaaatatttgagaaaaggcttaggaatttttatatttggcaagcatcccagggcataaaagtttgaaaaccattgatctatcatttagttcctaaaaatgtacctgaaatttcaacttaaactataaaatgaggaatggatctctgaatgatttttaaattactctacaaaatttttggctataaaagggttcacaatgacaacttcttcaattttttgatgaaatatttctttcttattgcgaattataccttatgttctaaaaataatcatgattttttaaatttttaccattattataaaattgaagggaaagttttcctttatttttgtaacacatgctggcgtcctctaaaactttttacacagccaattaaaatatttgcaggtttctttatgaccaattagaaaagtatcattgattatatatatatatttatatgtatatatatatatatatggcacatatatgcaataattatgtttattttaaaaatgctgtatattaggaacaaatagacaaaaataaattcctggtatcctcgaagcttggataaacagcatcagattgaaaatgatcttttcctatcttggaacacttataacactattataccccatacgcaccttttcatatttcctaatgaccttatagtccatttacacatacatacacacacacattctgttttaatattgtaaatttttacgtagtaagttaccaaataatatctgttgattgatacactcattaacaatgtaagcaaatgcagacattcacagcaaattttattttctttgcattatgaaagcattgttttactcaattaaactaaattgaagtgttccataatgtacctcatgatattttaattaccttgctttcttcaacctgttctcttactatgcacaactttattctataaaaacgagaaaaattggaaattcagaatctcagaatcttgaacaaattaaagtagcttgtagagatagtttccttttttatttttatttttgaattttaacttttattttagatacagggaatacatatacaggtcagtcacatggttataccgcatgatgctgaggttcagggtacaactgcacccagatactgagcacagtacccacaagtagtttttcagcttactgctcctgactcccccttctctagtagttgccagtatctactgttgccatctttatgtccatgagcacacaatgtttagttcccacttatgagcaagaacatgtggtatttggttttctgttcatgcattaattcacttaggataatggactccagctgcatccatgttgctgcaatgggtgtgatttttttctttttcatggctgcatagtattccatggtgtatatgtactacattttcattatccaacccactgttgatgggcacttaggcacttaggttgagtccgtgttttccttctcatgaatagcgctgtgatgaacatacaagaacatgtctcctttggtaggacaatttattttcttttggatatacatccggtaatagttttgctggattggatggtagttgtgttttaagctctgtgagaaatttctgaacttctttccacagataatagtttcctaacagcataaaatacaagtattttgtctaaaagttggtctttggaaaatactagtagaaatattaaaaaaatgacattacttattaaaaattattttgttcaattgtccatttttttgttcatatattcattcaaaacacttttttttggcaccaataatacaccaggaactgggaagctaaggcaagtaagacagagacccttttctaaggatttttcatttgttatgagagtatttcaaaaataaagaagactttatacttcttttaagactctagctccagctgtctctgggctcacatttcagaaatgaagcctggaaaatttaggtcgtagagcttcctcatggtccataactttaggtggtcttgtggaatatggaaatgaggagacaaaaagaaaggggaagcccattttgtgttaggacttgtactgctgcatactccaatccccccaacatctcccttgcgcagaaacatctagactattttttaagagaaaatgttttagtacagatacaactaatgataaactatatagctctctggactgataaacagaaaaatgagaccacactccttcagcatttaccttctgttataggatatgcataactattcactagcattaaccatgacatcattgctttactgatatatcaaaatattgagaagaaaataggctttattgtacaatataaaaggacatacattagtaaaagttataaataggaagaaaagactaaaagtttatttcactgatctatttagagacctagattaattgcattcatatttctagctgtctaacaaatcgctgtgaatatataaaataaaacatatctatgtaaagtcaccttctccctttctctttctctctccgcaatggtacgagccttcttcatgtgttttagacatggttgtggcataaagatttttaagacatgtaaattattaaattaatattaaaacatagaataaattagtttgttcattctaaatgtgtcattcaaatataaataatctacattttaaatatatatgtaggtatactaaataagtaaatatgtatgttaatatgtttaaagcagggtgagaaacctggacacttcctgtgtgggcaatgacatcaagatgatgctagagaaaccacttcactattttcttcagtgttctcatctgtaagttgaagttattgacagccttacagttctgtgacccttacgacaacatttcattatttaattcttgtttgggtattcctccactatctggggagacagttctatttaaccaaacacccaggcaccagaagcacacctggagtggattctgcaaagaggagccctcatttcccagagggaggtaccctgaacttgactttgaaaatggcttggcagaaggatttgacagggagtgacctaagcaggcaaaaactccaattccacagagcaccacctccttaaaagttaaaagtatattggatgctaaggctaacaatttcaggtacatatttaaaaaatcataataattcaaaataatcaaaaaatattacaaactttaaaacagatagggttagtactatcggtaaccaaggtatctctgtctggctagatgatggatatatttatctttacctcaaatgtttcattctgtagctttgtataagaaacatgctttcttcaaatcaagaaaattcgtactcacacagaaagtggcaagaagtgtttgatgtgtttgagtcatttctctttatttggatcaaacaaacaaaccaaatataatggagcaatatttcactgaatagtatgtttagtacattgtgacatgttaagatgaatatatagttaaaagctataagattaaaggttccaaactggaatacagcaaaaaatgaattccttatgcagcactgggaaatgtttgtcaaagaaaaggttttttgtttttcattttccattatatttaatttctttaaatttctctgataatttattattgttttatttttccataagtgaagaaaattatcaaggtgtgcaagagactcatattatagacggccgagtgtctaggctatttgcatcatagttcagactacataaaaaccaataataaacaaaaaccaataatatctgaatctcaatatttcgagtgattatatttctgccttgtagtgacactttcatcagggtcaagtttggtgttttactgctggcatatattctcagattaagccatctgaaagaataaattgtgtcttatctgggattattggagtttgtagaaatatcttctatctcctccctcatttcaaaacatttatactttttcccccaacagtcataccaactatagtctagctgctgtttgatcatttaaaatcacgtgttacataaatccttttagcaactgactgcgtgttttcaaaagcgtcttctctaagtcttaaggaacatcactggatatttccaaagaggatattagaaaattgctttccaagaactgagaaggaaaagcatcatgtcagacagggctaggtacttatcaaacagtaattgcctcttcttcctttctattgtttcctagattttatttgtgaggtagaaatacgctcactgtgtgcagactcttgagcaactaagtatatccatgacatgcatactttgccaatgagaaataagctgggtgttttccagataatattgcttccctaatatgaagggacaacccatctggcttctggttccctaattcttcctgtttgaaatacagacttaatgcgtggcactgcagcagccaccctgggatcctgaaactaaaagagacagatggcaaagatggaagaacaggtcaacggaaggagcctgtatctgagatagtgtttttgagcaacagcatcaagtttggactgtctaccttcagatttattggatatgagaaacataaacctaactgtcgaaagctcagctcgttaagttttcagttactggaaaataaacacaagcctaattgctaaacacgtagatttccaattctaattttaatgacaatcagtaacctgtctaccacctgaaacaaacgcctgtgaggctggctagtgcttcttttccagaaggaaagatgaccagcacaggaataaattgtacttccacccaaggcagggcaaaggcacacacctacagctggatggatctgagtcctcatggaaccagtcagcctagaaatagcttgatgagaagattgtgagttcaccacaagagaaagtttgtatggtttagggctattggaagcagcaggtgaagggtgatctgtcagagatcagaaggagtgacatccttgccaggaaactatagttggaaattactgggggaggaaaagtttctctaagaaacctccaaaaggtacaataattctcaggggtttgactgagcacccagacatagacgcaatttaaaaccaaaccagccatgtgactgtttttgtttgttttgttctgttttgctgaaatccctcaaaactactggagttaacactggataacagacactacagccagcaaatggatcaggagtaggagaaaggaagtgagaagcacctgactccccactcttcatctttacaggcttctcatcctaagctaggctggaggtaggacggaagtttagctttaaagtggatgatgttttttaaaaaacttgtattttagcttcagggttacatgtgcaggtttgtcatataggtcaattcatgtcatgggggtttgttgtacagattgtttcatcacacaggtactaagcctactgcccaacggttatttttttttctgatcttctccctcctcccacccctgaccctaaggtaggccccagtgtctgctgtttccctctttgtgtccacgtgtcctcatcatttagctcccacttataagtgacaggttatctttaatattaagctggactgaagtatttatgacatgaaaaagaagcttcaattcttagctgagagtgattagtaaaactatgggatcagcctgaaatattgccaggtgaaagagatttgttaggacaaggaggaaagcaatgcaaagaaagctgtttgtggtttgacccctacctactccggctcgttcattatcacagtaatattacattataacaaatgtttatgtggtaaaatagaggggagtgatatgttatacctatatgaatgataaaattttactatatacaggcatgcttaagatgagaaatatttataaggcagagaatctagaacaaatgactaaatgcagaatgtcttatacattttcttaaaatataaactataaaaccaagtctatttgataaatgcagacttatctagtagttgtaatcatctttatccctagacagtttcatgaagctgaataattagcagctatgtatcagttcttcctagccaatggtaaccacatatacaattaagaatgttactataattgatatcatcttgccaatgtttacatttaaatatacactatgagataaacaaaatatcaatcagatatgaaaaagtagattgctcctaaaaatttaatcctccttatgcaagaacagactgcatttatgaaacattaagagggcattttatgaaaatatttttaacatattatttccttattatttagaagcatttcaaatcatattttactgttggcagagcaggaattgaatatgaacatgtctgaaatgatagaagatacaacggaattttaaatcatgctgttcttaaaatgttttctgatcaaaacttccccaaacaatagacagtggtattattatatcaccattatacaatgttaaaggcttttaagcgtggatgaattggcccattacctctcttttgtgttttcttaatctttttttcttcactacgcacactcactcagaatctagctcattttcaataaattaacacaactttttgaactgcacatggacaatttttatgcacaaattttgtattaattttcttattctcttcttgagacttaaaattacataaatgtctttagcctctcatcttgcccatccttgctgtagaacttcaaatattgtgtttctaccccataaaagatgcccacttttctactctgtaatagatgtctagccattgctcctcaaaatatttcaaggacagtatctttgaatgtttctgacatatattttcagaaaattgagagtcagcatattgttctgggggaaaaaaagtatatctttgtgctaagaatgggaaagtttacatttaaaaaaaaagcaaacaaaaaaaacgggtctcctactaccagctgtgtttcctgtgactttggggaagtcaccgaaattctctgtggctcactttttccatctttatcacggaaagaataacaaaacatgcttttctgatctctcaatgagacggatagatgaataaatgcatgataaattatggtagtgagaaatacatgagttcaagatggagaaaaccctgtctctactgaaaatacaaaattagctgggcgtggtggcgaatgcatgtaatcccagctactcaggaggctgaggcaggagaattgcttgaacccgggaggtggaggttgcggtgagccaagatcatgtcattgcatgccactctgggtgacacagcaagactcaaaaaaaaaaaaggggggggtgtgggggggagaaaacactgaaataatgcatatatattcataataataatatttgaacaattcctatgaagacaatgatatctataagcaattaagtatttcccagttaagtaggtatatattttttgtaatatctagagctgtgggagcaatgagtaaattctatgtatgcagagctgcaatttgttcagtgaattccgacagcaagaatttagcccagtaagcatatgaaggctctgctaaaatctgtttcccacataggaactaacctattaaaagttcaaaactatgtgccattttgtctttgttgcaaattagttaggtataatattaacactaaaattgaataggaaaggaaagtttgttaagatttgtatatttattatcttcaaaatatcaacaaattcacagtgactacatgcatagaagttccctgtttaaatatagatgaggtgtctagaatagaaatagacaagtctacaatgaatttgggtggccattgggtatcattaactcgatcccttactaagctatgcctaatttcccattattgtaaattggaaaatatcttaattatcatacaaaaattttgtgaatatggatcatgtacatgaagacactttcaaatgacttcagatacatgcaattgttaatatcataaattatgaaagactagtttattgccagcaaaaaaagcactagaaaacataaaatcctctatgtctattatctagaattggaattttaaaatattactctctcaatccatgaggtacagacagtcagtaactggtatctcagatctgtttttttaatctcctttgcactatgtttgggtccacataactagttccgaccaaagcaatgtgacgtgacatgacctgtgtcaattctggtttgaggcagtaacaagccaatctgtttcatcagcaacgtgtcttcctaccattgagaaacacagtggtcttgtgttccagatatctagttactaaatgaatgaaagaaacatttgaactgcatagagtttcaatgagtataaattaatcctatatagtgcttagcccatatattttgtagtttatttcttactacaagatagcttagcctatctttatcaatacacaccaagtctcactattattcagtagcgctgcattacaattgtttaaaaaacaaacaacaaaaatcttttaatccctgggtaccaaatgtttcaaccaatgtttacctttctctggcaccattctttgacataaactctattgaaatccatgtctataagcgaccatgctatcttgattcttagcagcttcgctttctcattcctgtccctgaagtgatgtcccacccatcttcacagacataatccaaacagttttcaaacgcaatgccattggcaatacatgctagaaaatctctatccaaagttagcaaaatgaaaatccattcatattaaaaaaaccctcagttgtctcaaaaatgttagattttcagagaatgaaacttctcatagaatcataatcctttttttgaaagctctattactctgtgataattgaacaagcatttcaccaattaaaagacagatttgtttttgtccaaaatgcagatgactataaactttcatttgcttgctcaattgaatttcttcaatgaagccatttaggacaatgcatgatggagcatattatattcgcaaaagttcctgccaaaataataagagtcatagaagttaacattcaataacttttgcatatatatatatacacacacacacagagtagtagaatagaaacctactaaaatccatagcatttattctaaaataaataattcagtaaaataatgggtaacatatgacaaattatacagagaaattaaaaaaaaaaaaggatatccattgcatggaatgtttaggagccagcccacctcgggaggaatcccagttctgtcacttatttctgatgctaccttgagcaatttcatccaggctgctcactgtgcctcattttacctatctgtagagtggggaagatgatggtcatgaaaataataacaaaaataataataatgcctatttatagtagttgctatgagaattaagcatgtaaaaatatttaaatctcttagaaaattgccaatatgtagcaagcactcaataaatatgagctttactactactgctaccactgcttctgctaccatcattacttcttttgttgttgttttgttttgagacagagtctcgctctgtcgcccaggctggaatgcaatggcgtgatctcggctcactgaaactactgcttcccgagttcaagcgattctcctgcctcagcctcccaagtagctgggattataggcacgcaccgccatgcccagctaattttttttttttttgtattttgaaataactttaggtgttttatttccacacatgtaaaggtctcataattttgtcataaatcatgcacaaagaacaatttctatttttagtagagatgtggtttcactatattggtcaggctggtttcgaactcctgaccttgtgatctatttttctcagcctcccaaagtgctgggactacaggcaggaagccactgcactggccccatcattacttttaatgccacagccatgttagacattaggtgtatatttcaggaaatattacataataccttacatttttttccccagagcaattttgggttctttcaaaaatgtgtaaatattgtacattatgagtaaagaatctaagcttattttatgagcaaatgaatacctactatatattccagagaaagaaaactacatgatttacatgggtatgaactgtaagttattcttactgtttgccagtaacttcttagtttttccactgtcgtctttaccaaatcttgaatgctaatctgctctaaagactttactatgtaactgcttgtagaaggtgttcatatgttcaatataaagtatcaaaatatttaattgaaataaaaatgcagccactgatttttgttcctgtaatcatttatttgtataacaattcttgtaatttcctgcatgcgtaacttgagggacaaataaccaattgttttatgggaatgacatttccaatgtggtttatattaaaagatgttatgaaaaattcaactttggttagaaagttaattttgagtgtgtagatgaagggtttttaaactttttattttgagataattggaaattcaccagtagttgtaagaaataatatagagacacctttaattctttacccaatttcacccaatgggagtatcttgtaaaactattatgcaataaaacaaccaagatactgacagtaatagactcaagataaagaatatttccatcacaataagaatctctcatgttacccttttatagcctcatccaatcccttcctatccttaacactaagcaaccaataatctgtcctccctttctagaatgttgtcatttaggagtgttacataattggaaccacatactatgcaaccttttgtggttgccttttttactcagcataattttatggagagtcatccagagtatttcaagtattgctcctttttattgctgaagacccatccatcgtctggatgtagcacaggctgttgaactactcaccccttgaagcacatcagggttgcttccagtttgagctcttacagataaagcttctgtaggcatttgtgtacaggttttatatgaacgttgtttttatttccccaggaaaattcccaggagtgcaattaattttttaagtaagtatcaaactgtttatccaaagtgactatgccattttacaaactaaccagcaaagcagagataaagtgtctttatccagagataaagtgtttccacatcctcaccagaattatatatgttgattgttttagccattctgataaatgtgaaacagcaagatttgttacagccctccttcctcctcctctatccctcccttccttctctccttccttcttccttttcttttcgttttttcttctttttctccctttctctttcctcctctcctctccttccttccttcctcccccctctatccctcccttccttcttttcttttcgttttttcttctctttctccctctctttcctcctctcctctccttccttccttttcttttctttcttttttctttctttccctttctttttctttcttttccttccctgcttcttttcttctcttctctcctctcctctccctctcctctctctctctctctcctcccctctcctttcctctcctttcatttcccttttctcccttcttttctccctttctctctttcactctttctttctccactggaatctctagtttgctaacagcttcaactgaaagtttgggatttatgaggaatatagaaaacaacattttttctaaaatggaaattgtgtatactaagcctttaaatggtaccaaaatcagcaaagaaatatgacttacatgtatgttttgataaagtgaccctacagataagtattaaatactatataaatactttaaaaattaaaatactagaaacaacataaaaatgaactaaatcaatcgaagaagacatataaactctattatatgtctatatataaaatttgttttaaatgttcaaaacttaaaaaaaatatgcagtggggatattatttaggaaactattgtgcgtcactcatttattttcaataactttttaaattaatgaggtttgtaaatgtttacatatctttaaaatttagagggattttgatcttccttttgtgttcagtcttcctcagcagtctaattttcttagttgagtgaagagacgtatggatttttccctgtaaccccagaaatctgtattctcccgggttccctcatgaacaggaaggcaagatggtggccttaccatgtacactgacagtgagaaaagggggaggtcatgattaagtttcccatagtaaacattaaatattacaactttagcataactatatatgcatcaatacgcatatttgacagctaatattaaaatggggatatattttgactttttaaagtattttgtaaaataaagttgacattataatgaatacttactaatcattgaccatgaagctataattaaaagcaaagaaaaaaatcatttaattattcaaatatgctcaggaaaagtatacatttattctttttcttgggaactttctgaatttggattcttaacagctgccaattaatattgcattacttctaactctttaatcagatagtgaaaacaaaaccagaaagagaaagattggttccaaaacgtgtctctctgttgtcaacacatattgtgttcctgaatatcacaatccatcaatgtatcttacaaatgcaaatattcagactatagtttgttttatgtatacttgcatgttactgaaatattgaaaacctaagtcaaaattacttttaaaaaacttagccacaaaatcctaaaataatatgtaaaatattcttatcctaataagaatcaggctttggatttcaaatgtagaattatttactccttaccttctaaggaatttgaatcacaggtgaaaacacaaagccaatgtccctgaagaatgtataatctaatttaaaaaaaggaaactactgaggatacatttggcaattgaaaaatgcagttataaatgatggacacaacattatgccatgtccatcttcatgcgtgcaaaaggagccactcagaggtgctcttgccccacgctcctcctctcagatgatgacaacttcattctttcaattcctcaagcccaaaccctggagtcatccttgctcctctttgttatacctcacacacaattcactaatgtattttcagctctatcattcagattattcagaaagtgtctacttcttaccttactgggatattgcttcacctggataattgcagtgttgtcctaactagtctgctgcaattgaactcatgccctttcatagttttttcagcaaacagagtggtcctgtaaattcagatctgatcactttgctccgtgctttcctatttttctcatcattctaagcttcaggcacctgctattcctaccagatgataagatgcgcagcctccaagcctttgcagtagctaatcctttgacctgttatgcttttccctacacatccttacactttggttcgcccactccttaattcttacttagattataccagatctcttgagtcctgctctctgtcctatttaatttgttatccttttgcctgaagtctttccataccactctccttctttacttttcttctcagcaggtattattaatgtattaatatactaataatttcacctgtttgtgtatttgttattcgtttagctcagtagaatgcagtttccacaagagcaaggatttctgtccccagaatctagaagagtatctagcagagagcagatgcttaataaacatgaattgaaggagggaaggaaaaaaagagaaaagaagaaagaaagaaaaaaatgaggaaaggaaggagggaagggagacaggaaggaaaaagagacgaaaaaagtctctacagctctctaggggtgtcaaagaagttttactaacttaaagttactgttaagtacccaatgtgaaaaaaactatgagctcaatctttattttattatgataaaatggtatattttattaaatactcacagagttacttttctgttagtatttaaatcaagtttaaagtttagttacatttattttccaaacctctggaaatactagttttggtattctgttacacactagggtgactatagctagtaacaacgtagtatatacttcaagacagaagattttgagtgtcatcaccgccagagatgataaatgcttaaagtgctgaatatggtgattaacccgatttgatcatcacacaatgaatatacgcattgcaacatcacattataccccataagcatgtacaattattttgtatcaattataatgtaaaaattaattgataaaaatattgatttcttttataattctatccttttctcaaattttttacagggtatgatacaacaacacgatctgtaaagtatttgttaataataaaacaaggaccagaacaattacatattatactattcataataattttggtagccaaatacacgtaatggcaaaggctaccttgagagcccattccaaaatattctattttcacttaaaatagctcaacattttaaacggtggtcttggaaacccccttttatctatggcttttggtgaaatcaaccaattgctctctgctcctgctataggtcacaggaaattcatgaagcaatagtgctgatattgattaaattgtctcccagcaatgtacatgttgaagtccttaaatccagtacctcacagtgagatttggaaataggatacctgcatgtgtactatttcaagtcaggatgagatcatacaggagtacctattacaggtcacactttagccctaatccagtatgactgatgtaattctaaaaaggggaaatttgcacccagtgagaatggcatgtgaacatgaaggcagagattagggagaatgccatgtacaaggcaaggaacacctgaggctaccaggagctaagagagaagtttgaaacagctttttcttgcagccttcaacaggaaccaaccttgctggtgccttgaaatcagacctctaacctccagaaccacgagacaacaaggaaaacgaaacatgcagtgtattgccagaatacaatattgcatgtccttatattctggcagcagagacctaacatttttgaaagccattttagacactgttcggtgtatgaagaaaataaaagggttgaagggttactgtcatagaaaaatagctgcagtaaggctgggcacagtggctcatgcccataatcctagcactttgggaggccgaggtgggtggatcgcctgaggtcaagagtttgagaccagcctaggcaacatggtgaaacctcatctctactaaaaatactcaaattagccaggcgtggtggtgggcacctgtaatcccaactacctgggagggtgaggcaggagaattgcttgaaaccagaggcggaggtttcagtgagccaacattcagccactgcactccagcctgggcaacagagcaaaaactccatctcaaaaaaaaaaaaaaaaaaagagagaaaagaaaaatagctgcagtaaggtcatttaatagaggcttcaggaaaggtctctgaggaaagaaccacttgagtttagctctcagagaagagagaccagtgaaataatattataggcagaacaaagagtaagtagaaaggtcttactgggaaagcttggcattctcaaaataaagaagaaactggagaggccatacagtaaacatgaagaggagagtagtccatatttaagagagagtagttttgtttatattgctttgttctaactggaaactgaacttttatatagaggtcttacctgatttacttttcaaaattttgtttaggctcaaatctgaagaatttactcaggatagcaagtatgcacatgaaaacaatgtagaaaattcattattattaataaatactattgtgacagcagctatatttagagggttcttcccagaatccctctgcccaaaattattttttgctagattgcctgttcctttagcctcagattctctttctagaaatgcatttatggaaacatcatacataagctaaaaaaatagaaggtgcgttttatcatttaggtagtttgtgccccccgatggacaataatatactcattaaaatggtgtataaaattgctgtgtgacaacaactagagtaacttaaaatagaatattaagcgataagcaagaatgcatgtttccatctgtcataatttcaactataaatatatgaatgcatttggacaaccattgaatggcctagaaaatatgaaaaaaatgttgttaaggttacagagttgtgtatttttattatgattttcctcttacaattaaaatgtaacttaaggtaaatatatttctttggattgagtcagtgcaatatctacaatttagaaatcctcttttcaaatacagcaccaatcaaacattgaggcatgaacatatgttttaggttagggtgtcaacaattggtcatccctgacttcttgggaggttaacaaaccatgactcaacataaatcagtagcatttggggatttctggctaaggacagtgggaattcagagctctgaaatcacaacccaggtatttcacatcttggagtctctcttgggttcttggatcaaaaaggagagtagagtaacacatgaacaatgaatgggagaagaaaatttaaattcctaattcacaaaatgtttaacccatcatgaaaactgttattaagtctatgaaatgtgatctcaaattgttaaaaaaaaaagatagcaggaaagataatttatctttggcttgtccccagagacaatggggtatcttgataattgttttaacaatgttaaattttaaatacacaagcattttcaaatgatgagcttattattcatttactgaaatcactagacttatattattataccaaaagatttgctaaaattaaccagctaagtaaataagtagaagaagaaaaatcctttcatatatcttagaaagcagcttaagtagcctcaaagttgtactgaagaaattcaaaatccagtcactgtaatactactctctccccttctcactttttctgtttccattttctccatgcgttattgatctattacagtctctttgcttatctatattctacctatacttcaagactcagtttaaattctgaggttgacagactttggattcaaacagatgttatttccaatttttgatttgtctgtttctgtgatttcaagaaagttaaattacctgaatttgtttcctcatgtgaaatgggcaatattatgttttccacataaatgctatcaggaaaaagggagataaagcacccttgtgaggctcctaatgaatattaatctcttccccatttgtgttactcagtgcagtctcatccagttggaaataatgcaatgtaaagaatatgagcttagtagtagagtttcaacagagttttaccactcatacatgtgataccttcactaggttgtttaacctgactgggtccctgtgttaggctaaataatggtcctccaaagaagtctatgaactaatccctggaagctttgaatttattacattagaggacaaaagaaaattaaggttgataatgaaatcatggttgccaattagatgaatttaagatggggagattatcctgcattatccacaagcatgggcccaaggtaatcacaagggtccttggaagtggaagaagaggtagaagagtgggtctgagagatgcaacaggagaagaatttgacttgcttttccagagtttgaaggtggaggaaagagtcatgagccaagggatgtgacagtctctagaagatagaaatgggtttcagctgacagccagcaagaaaaccggaatctcagtcttacagtctcaaggaactaaattctgccaaaaacacaaataaacaaggaaacagatcctcccctaggatgtccagaaagaaatgcagttctgccaacaacttgatcttagcctcggaattatgacctataaaactataacattggtgtcttttaagccaaaaatctaaaacaaattcttgaaggaacaatagaaaaactaatggaatttccttcataagaattcttaaatagggacaattgtacctaccccttggtatgattttgaaaatttaatttattagtttcacaaaaaaacctagcacattattagcatcccataataaatgctctttttacgtatttttcttcttttcttatttcaccctggattcctgtaaatgtatgccatctgtaggtgttatgtggaaactatgtattgctatatttcacctatagatgtatgcaactaattatgtccaggtgatatctcttccagtatcaatttctattataatttaagctccacaatttactggctgtgattttcaggtgagttgtctaacctctctgtgcatgcctcctatctgtaaatgaaaataataagggtaataactcttttatctagttgtggtaataattcaatggaatgctacttaaatagcatttagaccagcacctggaacattgtatttgctcattaaaatgagctacttttatttttttcacaggcttatagccttcaactgattaaacgatatgtcccttgatgttcaaatagtatcttggagtaattcttatcccacttagaacctggaaaaatgtctaaatgaaagtagatacttgataaatattcatggactcaattttatgttctcctttaatctagtcacatatcattagcacttagacccattctatccccatccctagcttgaaggataaaaggaactttcagtgagaggagggaaggatggaacaagttagagaaccagcggcttagacacttagctgcagaaatactgtcttccctattctactgtgtcagacagagcaagaaaattttaacataatcaaaattcactccaactatgttaaagctctctgatagagctaagtgctgtattttcatgcttagatgtacaatgagaaatgaggactaaatggttccaagttagtttcccaaattctgaaaatctgaagtcattattctttatagcataagacactcatcttttaaataggatttgaacttagaattaaacatttttccattgcattgagcacacaaaaggctgactcaatgactgaagatgggaatgtacaaaacaagcctgctgaactgagccaatcacaaacacagtttgctgaagcaggtggaatgggaatctctaactagaattatgttagattacttgaaacgagggaccatattttactcatcttgtgcttagaagtgtgtctttaaaatgaaagaaataccaatatttgtttaattcgattgcatgaatttaactgctgtttagcagagtatataggaatagaaaaagatatgtgatatttcaactagggaatcaagatttgagcagagaacaaaacacaacatcatactttaaggaggacaagagctcaaatcatcaacacctattcttcttattaaaagcaggatgtaaccaactagtgggactaattacttaaaatgacttatttcagtacattttattatttcatgtgtgtcacttagtgtatgctatatgattatcttatgaaaacactgattttaaaaatctaatatcagctgttgacattactctcataatttgaattctgtgaacattactacagtgaatggtttttctctgagaaacatgttcaaagaaaatagcatctgcttccaaatatctcatgttgttccaaagctctctgacatatggattgtggttagtagaggtggctttgagaccaggtcacctcattttagatactatctctagcactaggtgatcctggtcaagctatttgtgaaataccatttgaatttttaggtgggggaataaatggcattaaaactcttttttaaaattatactctaagttttagggtacatatgcacaacgtgcaggtttgttacatatgtatacatgccatgttggtgtgctgcacccattaactcatcatttaacattaggtatatctcctaatgctatccctcccccctctccccaccccacaacaggccccggtgtgtgatgttccacttcctgtgtccatgtgttctcattgttcaattcccacctatgagtgagaaaatgtggtgtatggttttttgtccttgtgatagtttgctgagaatgatggtttccagcttcatccatgtccctacaaaggacatgaactcatcattttttatggctgcatagtattccatggtgtatacgtgccacatcgtcttaatccagtctatcattgttggacatttggcttggttccaagtctttgctattgtgaatagtgctgcagtaaacatacgtgtgcgtgtctttatagcagcatgttttataatcctttgggtatatacccagtaatgggatggctgggtcaaatggtatttctaaactcttatcactatatctgcaacagaacaagtgttcaatagacattagatatttgcattactatattttaaaaagtaatcctttccttgtggctttgctcaaagcatcttggagcttttcataccccattcatcatgtttatagaatttaatacaaccaaccaagaaaaaagaagatgcatctatattttcttcttctattcttctaatgtctgtgtagaaatctttactagctgtaaataaagggtgacaaaagtcatatggtcattctgaaattaaatacgagaaattcaaaaatgactattaagtgtcgatcgtctgaattgcaaaagttatgttttcactttcatttttagtaaatttaaacttcaaaaatgcaagtaattctaatgaagggatttgaggaaaaattgaacgtcatcccacatcctgggcagcatgtaagccttgcagcattaggctctgtgacctaagcttgcacaagaacctgattctggcaactgagcaaacatttgcccttctcagattttaagtcttttctctgaatatcttttaaccacgctgtttctgatgtttttgccaagcatccacctgcctttcaaatgtcctaacaaatactagggttgcatccaagtctcatgaagcatcctattactgaaatgtttgtagggcataaaaggaatgctggcagtgtgtacagtaataaatgccttttctgttgttggtaattttcacattgctattttcatcaattactcacaatcagagacttgcaggatggcaaaactcacatgcaaggtctttaaaaatctgtcctgcaagtgaattaatattcctcattttatgatggtaattggtgaccagatgcagtgaatcacaaaaacgttagtgtcctttcaacctaagaatcttttgtctgcttaacaaacagcaggttgaagcctgtaaaagcaaatcacaaataatatctcaattacatcttatcagcacaactatttgcctggcttttttctgtagataaaccaaaacatatttatcagtctttggaactgagaaggagagcacaagttattttctcagtaccctaatagagagacaaggacatatcttgttggtagaatttgcaaaaaaaaaaaaaaaaagaattgaattacagtgtaagtttctgaaaaacatgacaacaaaactaggccacatttaattattattttacgctgcttgagagaaataaattctggaatcactgttgatatctacatgtttgggggagtgaggtagtaactctccagccttatttcataaaaagaactattttaacgtccattaggtactaaaatattctataagaataaaccctagaaatatgtttgtatataaacacacacatatatatgcacacaaatatatatatttatatagtactaagaatcgctaatgagcatagcaatgatcagtttatatatagcaatgataatagagacatatagagagagacatatatatatgtcaatgttatagtattatcttcaatattcaaagtgcttgaagcaggtatgatataaatacaaacttgaaagtttccaataaatattctgaaaccattctttggaaaggaggaagggctgagagtaatgtaaaagttttggagagggcatcaattcctaaactaatttctcaggattattctggcatgtataactgatgaagaaacctattacactaacttaggaaagttatttggctcctagagaagcggatgaataaattgaactcatacagggtttttcataacacacttttcaaagcttcatctcatgatgcagaactggaaaaatccagtgcacaaaatgtgggatatcacagcaatcatcgaaccctggactcatgttgtcataaaagcttgtcgtaccacaccaaattaacttccagagaaatgcatttcaactgttgctctttaaaaatacagtcataaaatactcttattctactttatgaagtaccaaactataaaaaaatataacactctctttctgaagccaaatgttgtggatttatgtgctgtttataccacaaagatacttaaaaatctaatgattccagaatagtataatcacaatattttgaattaccatcactattgaactcttgttgattttcatgatgcttagggcattgtgttgccattttagaatgaataaaacatggtctccgtaatcaaagggatagttgttgagacaggttataaacataaaaaagagatgataatgaaaaacaattagaatattattgctaaaataaatactatccctatacatgaggacctcagctctcttagatacctagagtttacaaatacttcaatgaaaatttcaaccatgatccaccaagcaacctgggttatttatttatttatttgagatggagtctcactctgtcgcccaggctgtagtgcagtggcacaatcccggctcactgcaacctccgcctcccaggttcaagggattctcctgcctcagcctcccgagtggctgggattacaggcacccccgccaccacacccagctaattgttgtatttttagtagagacgggggattcaccatgttggccaggctagtctcaaactcctgacctcaggttatccacccatctcagcctcccaaagtgctgggattacaggcgtgagccaccgcccccagcccagatttatttttaaatgaattcagtccaagctcataggcggaaatctctgtggtgattatatcccacacttgaatatatggttttttcagtcaaatcctacacctgactttatactccacttcatttgattacttaaaaaaataagacctcaggttgtttctaacctctgaggttagcaaaagaaacaatggcatgataaagtggtctgatgcctttctaaatgaaatttaaaacctgaaactccaccaagatttataatcaggaattcactctttgctctgttttgaacttcataacttactttaaaatataagttttaactactctttcctctatgtgtcttataaataattacctttgtccaaaagcaataaattttgatatgactctaggctgaagttatgaggaaatatgaaggtactatactgtcacagaacagcagaaaggctaacctagaagaatttatatgagggggtgagtgaaaatgccaacatcatgcaggattattactattgcattatgtctttattttatttttaaaaaatttgacaaacatatatttaaggtatgcaggttgaggatttgatatccttatacatggtgaaataaatcactacaataaagctaattaacaaatctaccactcagttattttcttgtgtgtgtgtgtgtgtatgtgtgtgtgtgtttgtggtgagaacatgtaagttctactctcatagaaaatttcaagtatacaataaaatattgttaactagagttacaatattgtgcactagaggtccacaactggccaggtgcagtggctcaggcctgtaatcccagcattttgggaggcttaggcaggtgaatcacttgagctcaggagtccaacaccagcctgagcaacatggtaaaacctcgtctctacaaacacacacacacacactacaaatatatatatatatatagctgggcatagtagcttgcacctgtaatcccagctactcaggaggtgagaggcaggaggatcgcttgagtccaggaggcctagatctcagtgagccaagacatgccactgcactctagcctggacaacagagcaagaccctgtctctaagtaagtaagtaagtaagtaagtaagtaaataaataaataaataaataaatagggttccattacttactaatcttgaataactaaaagtttgtatcctttgaccagtatctacccattttccttgcccctccatccataggtaaccacccttctactctctatttctatgagtataacaacatagattccatatataagtaagatcatgcagtatttgtcttcttgtatctgaattatttcacttagcagaatggcctccaggtccatacatgttatcacaaatggcagcacttgcttctgtcttatggctgaataatattccattttgtgtatacacacacacacacacacacacacacacacacacacacaatattttgttcattcattcaacagacttttagtatgtttccatatcttgtctattgtgaactatgttgaaatgggagtgcagatatctcatcgagatcctcactttacttcctttagatatatacccagaaatggggttgctggatttcattttcatagttccattttagtccacataggaattaaactaacactaaatacaatgtccatgtcttgttacagattcttcctctaattacttattaaacagcatatacaagtacagcatgatattttggaagcaataactaagtttatatctttttcagctgtaatgatttgtcaaaaaatcaaatctatccttaaattcaactccagcaggaattttaaaaattgtttttgacagttttattaatcacagtgtgttcctgtatctttaagatttgttccagcctgcattccaggttttaaaattagggaaatgtaagattatgtttccaaatatgctgatgatatgaagttttatattgtagcgatagtggatccactatggttggtgatatgaacacattaatttgtagcataaacaactatttactattcccccccaaatcagagtaaaattacctatctgtacttcaatttatatctaatactgtctcttctgaattgcatattattgctatcagtttatcattagtctcccaaattggtatgtttcaaggtgcctggaaaagttaataattgtgtttgcaagaacaaagttaaagtattttcgtctgttatttagtctgttattatactaagacttcctaatgataatagcaatgattagattaatttgaggctaatgggatatgagcagatctaatctacaaaatgttcttacacctgaggaaaataatacacttagtacatttaaattggaacacaatgtataatattaagaacaccaacaacagaaatagcactctcaatggtccaagtcctaagctgtttgcatattttgactcatttattttcagtacaacccatgaggtaggtgtgatccttgttcctcattttaaagatgatgaaactgggacctaaaggtgtttaattccttgtcttagtttgcatagatagcaaatgtcaaagctcacattcatttcaaactcaagctatctggctgcacagccatggtcttaatttactaccctatagaactagtgagtacacaggttgaagccaagaacagctatcactcaaagaaagaataggtcagcctggatgtgtttatatacccatgtttctagctctcaagcttccttggtgtgctgaagctttggttgggaaaggagtccactgcgcattcattttcctcttcttcagtgtctctggatttatatatgtaatagttcctctggacttcagcttcagaatcatgtaggactgagtcatccatttatagaacccatttcttttgtaacttctcaaaatatttaaaattgtgcagatgagggagtctgatggttctcgcagtggtgtcatgtgacagtggtatctttttatgacctctactggctgtctctgctctggcatttcataattgggcttcaactttggagacctaagttatttaaaggagtttcttatcaggtgttaaaacccttttattaatagatggaatggaatcacttgattttaatttttatccaagaaaagaaaaagccaagtttgaaaagtattacatattcaatgctgcctattttaataaactaccataaaattatttgaaaagatctaactgtaggctagcacaaacacaattaaatttcaagaaggacttattttgcaactctgtactgcaaactttacttcagggtgcccaggtgagaaaagggcaagaattagaaagaatatgattaagaaagtagaaaagaaaacccagaaactaagcctgagacatttatattcttaacattcaaaccatgcattttcacttttaagccaaattacttataataaatatttggatataacattaggaataataacataaataatttcaaaaacaaataacaaacaaaacaattttttccaaagatatattttaattccgtattgaatatatataggcattggtgtcttctctcttccgtatatcctaattctggaatatgtcttcccaacataaacatactaatgtaattaattattaattactctaacatattttgccattttgccttattaatatcataaaacatcattttcgaaactgaagagacagctacattgaaaacagactatcttccaatttgggaataaaaatcacaaatcttagctaccgacccagaagttattaggactcatttcatttaggaaatagaggaagagtactgaaaataaataatgcgggaatttaaaaagaactgtgaggttctctttgccttctaaatgccatgaataggttacgtacaaactataccactcatctggcagttaactatgaccacattttgaaagctattttatctagttatttaaaatatataattattaaaatgttcaataaaatagtaatctgccatttgctaagctgttaatgcccaatgtctcatattccatagcggaaaaccagctgtaaatatttgctgattggtcagatgtgcgattttaagaatattcttgcaagaaacatgattgggcttttaaactacaggaatcaagctggtggttgttttttaaattcatgtatgtatgtatttaatattcagccctgaagtgctattattagaatatatgttttaaagatgattcaaagatgaaaaaggatggttcttgctcttaaatcatgtagccacctacagtaggtgctgtaataacataaatataatggttggagcaggaagtaactaactctggctgggaaactacaagaaaagctttttggaggaaacagtgtttgaatgaagacactggttgtgctcaggacaaccctccatcacagaaaattctaaattttttagtcacctcaggcctccagaacttctttaacactacctttacttcattctgctgtctctcctagtactagtaagacctctttgcttttactcatagagtatgaataaatggtctacataaaggatcagtaatctttttcttataaaggggtcagaaaaatattttagcctttctgggtcacatggtctatgctgcaactactcatctctgctgttgtacagagagagaaaccagacaaactggaaagaaagcagtgttgctgtgtttcaagcaaaagtaatttataaaaacacacagcaggcaagatttggcctgaggctgttgtttgccagcttttggtctagattacccacctcaaatgtcctggtgtacttcttttatgtttccattgtatcacatcccattatcccatctatacaacatagtgagtgttatgatgtttaccctgtattgtaaccactatactgtcttgtaaacattaatttatgacctattagatggttgatatggtttggctctgtatccccacccaaatctcatctcaaactgtaattcccacatgtcaagggacggacctggtgggaggtgattgtatcatgggggtggtttcccccatgctattctcatgataatgagggagttctcatgagatctggtggttttataagtggcagtttcacctgctctctctcgcgctcgcgctgtctctctctcgcgctcgcgctgtctctctctctctctctcactctctctctctctcctgccatcttctgaagtaggtgcctgcttcccctttgccttcgccatgattgtaagtttcctgaggcctcccaatccatgtggaactgtgagtcaattaaacctctcttatttataaattacccagtctctggcaatatttttatagcagtgtgaaaatggactaatacaatggtaaatatatagaggtcaggaatcagatttataaatgcttaatatgacttgaataaatgaacgaataaatgaacaaattaatgtacagatgaacaaattaaaaatggaagaaaagaaaaccaaggacaatctgatgcccgatgtagatgctactcaattattctaggccctaaaattaatgcaaaagaaaactaaaagtaaacacaaagtttataaaaatgtatgatctgtgatatacacaatatattcatttttattttagtttcattgataagaagacgttcaaaacaagaaaggtaattggcagtaaatatctttgttattgaatgtgtcacacacttttaaatgctttaaagtgatccacaagataaatactaatttggagatgaagttcgatgaataaatttatatatttttatttttttagaaattagtataaactgttaaaaccttcaataaagtataactcagaataaaacataaataggtagttatctgttttcatgttagcttagctaatttttaaaagaaaagtaagaatccctttttcttgtttttttttctaaacgtgaaatcatcctgatttcggtgtttcctacaccaaaaacaccaacgtaaaaccttaattcaagtttgtttaaggaaactatttcttttcttttagttaaaagataagagtaaaaatgtgtgggaaactactattgttcaaagtaattaaaacagctcatttttaagattaaatttacaagaaaaaagataaactaattgtacagaagtagctaaatggagcatattatgttgaactgatctttagttcctgatagtatagctataaatatgcaaaattggtttgaaaataaaatgtgtagtttacaataaacctatatggtgctattctattcattccacaaatttcagttttgatacggtttgggttactttcccacccaaatttcatgtttaattgtaatccacaatgtttgacgtgggacctggtgggaggtgattgtggatcatgggggtggatttctcataaacggtttagctccatcccctttgtattgtccttgaaatagtgagtgagttctcaagagatctgatcatttaaaagtgtgtagcccctcccctgccctctcctcctcctgcttttgccatgtaaactgcctgctcccactttgccttccaccatgaataaaatctcgttgaggcctccccagaagcagatgccatcatgcttcctgtacagtgagccaatttaacctcttttcttttctgttttttttttttttttttttttttttttgagatggagtctccctctgtcgtccaggctgaagtacagtggcgtgaacccagctcactgcaagctctgcctcccgggttcacgccattctcctgcttcagcctcaggagttgctgggactataggcacccgccaccacgcctggctaattttttttgtatttttagtagagacaggctttcaccgtgttagtcaggatggtctcgatctcctgatctcgtgatctgcccacctcggcctcccaaagtgctgggattacaggtgtgagccaccgcacccggccaaacctcttttcttataaattacccagtctcaggtatttatttttagcaatgcaagaacagaacaatacagtagtccataaataatgcataataccgaaacaaacatttctctctttagaatgtacaacatatatttattgtttcagaaaggtccattttagaggtatgtaattcacatattaaatacagaggaaaatattatataatagaagctctatacattaaaatcacattttaaatggcttatttattgaccactgtatacactttacagagtgtatacactttaccattgtatatatagattcctcaatttatatgagaaaatatgttaaattaccaaaaaatatacactgagctcctactgtttggcagctgcttgcccaggtgctggaaaaaatgtgatgagcaaaaacaatggacagaaagagagggacagaaacacaactctgatttcccgtcttgccttaaacacctggaactcccaacaaaatatgtaaaatatcatcttttcagggaaaatggaaacaaataacactgatatcaaagataaaaacaagcaagatgagctcattgcatggaatgaatttccaaactgctgtgcagatttgggggacccaaacaaagctcattattcttgctgagtttggagacaggtttcagaggtcagggaggctaaggtggtgagaattttgaccagaatagcagatagatggaaggtaaacagaaacacctgcagagtggttccttaaatattttctgtactgttaggtgcacgtatttgagaaaactactgagaccagggaagaaaactagcagaggaatgaagtgggaggaataattctcagggatcaacccaactcaggaatagtttgtgttcctaccagaaagaataaagacctcctaacacatgatataatgttgaacctagactacaggctattctgtctctgcactcaaaagtatcatccctgcaatgccagaacttttggaggccaatgcagaaggatctcttaaggccaatgcagaaagatctcttaaggccaggagtttgagaccagcctgaacagcatagagagatcccacctctacaaaaatgaaatagatgtgtgtgtgtgtgtgtgtgtgtatctccagccctgatggcatatgcctgtagttctagctacttgggaggctgagacaggaggatcacttgagtccaggacttcgaggctgtgatgaggtatgattgtgctatggcacttcagcctggagacagagtgagactccatctctatcagagtaaacctcaaaattaatcacaatgatttaactgcctcacaggaaaatagtccaacattatttaaagaaattccccaaaacctactgcacaataatataaaccacgatgtgtggcattagaaaaatacaagatatgcaaagaagtggaaaagcatgaaccttaagaaggataaaaatcaactaataaaaacacatgatcatatcaacagatgcagaaaagaatctgataaaatccaacacctgttagtgaaatgaaaaagctcttagaaaacaagaaataaagcgtattttctaagcttaataatatctgtaaaaaacgtacagctaacaccatacttaacggctagaaactaccagatttactgcaaagataaggaataaggtaaggatgcctcttctcgtcactctttttcaacatcatactgtaaattctagttaatgcaataagaaagaaaaaaataaacaaggatataaagataaggaaggaagaaataaaacaatatttgttaacagatgacataattgtctatgtagaaaattaaaaagaactgaccaaaaaaaaacctctcctggagcaaataagtgataatagcaaggtgatgcaacattaatatacaaaagtcaaaaacttatatgccagcaatgagaaagtgggaactgaaattaaaacacagcatcatttacattagcatccaaaaataaaatacttagaagtaaatctagaaaaatataaaagatatatataaagaaaattataagactctgatcaaagaaatcaaataactagaaaatgaagaaatatttcatgttcatggataggaacactcaatattgtcaatatattagttcttcccaacttgattcatagatataatgcaacccaatcaaaatctcagcttattttatgaataacaacaaattgattctacatattgttatgaataacaacaaactgattctatatgggccgggcggggtggctcacacctgtaatccagctttttgagaggctgaggtgagcagatcacttgaggccaggagttagaggccagcctggcaaatacagtgaaacccagtctctactaaaaatacaaaaataagccaggaggggtggcctgtgcctgtaatacaagctactcaggaggctgaggcaagagaatcgcttgaacctgggaggcagaggttgcagtgagccaagatcgcacaagtaaactccagtatgggcaacagaatgagactccgtctaaataaataaatacataaataaataaataaataagtaaactttatatggagaggcaaaaggcctagaacagctaaaataacattgaaggaggagaacgaagttggaggactgatatttatctgaccctagtatttactataaagctatggaaatcaagataatatggtactggtgaaataatagacaaacagagcaatataacagcaaagtgcccagaaacagacaaaacaattaatttagacacagactttgaatccttcacaaaaattaatacaaaatggatcacaaacttaaatggaaaacacagaactgtaaaatttcaagtaacataggagaaaatctagatgagcttttgtttggcaatgttgacgtagatacaacaacaaagacataatccatggaacaaagaattaataaattggatttcattaaaataaaatgaaaacttctgcttattgaaagacactgtcaaaagtatgaaaagataagctacaggctaagagaaaatattgtagaaaacatatttgaaaaaggacaataaccaaaaatatacagagaactcttaaaataagaaatcaaaccaatctactaaaaaatgggccagacaccttaatagacacttcaccaaagaagatgtaccaatggtaaataaccatatgacaagatgctccacattatatatcatcagggaaatgcaaagtaaaacaacaatgatatgccactaagaacttattaaaattgccaaaaccataatattgacaacaccaaatgctagtaaggatgtggcgcaaaagcaattctcatccattgctggtaagaatgcaaaatggtacagccactctggaaaaggctttgacagtttcctacaaaactatataaatgcttatcctatgatccagcaatcgtgctccacggtcttcctcaaaaggaattgaaaacctatgttcatagaaaaacctgcacttgaaagttgatatttattcataattgaaaaaacttggaagcaaccaagatgttcttcagtaggtgaacagataaatacactggtacacccagatgatggaatattatttagcattaaagataaataaaatatcaagctatgaaaagatatagagaaaacttaagtgcatattactaaatgacagaagctaatctgaaaagcctacatactgtaagattccaaatacagcataccaacatttcagtcaaggacagacagcacgtatgatagttgcctgtcctatcataagattataatgaagctcaaaaattcctatcgtctagtgatgtcatactgtcgtaaactcatagtgcatggcacatgtgtttgaggtagtgcaggtataaaccgacctactgcactgccagtcatataataatatatcacatacaattacttacaatacataatacttgataatgataaaatgacttactggttcatatatttactataccataaattgtattattattttagagtgtgcttcttttgcatacatattttttttaaagttaactgtaagcctcaggaagatctttcaggaggtatttcttttatcataggagatgacaactctatgcctgttattggccctgaagacatgttagtggtacaagatgtacagggggaagacagtgacattgatgatcctgaccccgcataggcccaaactaatatgtgtgttcgtgtattagtttttatcaaaaaagtaatatatatacatatatattatatatatacacacatatatgtgcttataaaatcattacataaaatactttgtgcatctatacaatggttttgtgctttaagtgttattacagaaaaagtaaaaatttgaagaaatataaagatttataaataaaacagttacagtaagctaaagttaatttattattgaagaaaaatattctcataaatttagtgtagcctaaggtacagtgtttataaagtccccaatagtgcatagtaatgtcttatccctttatattcactagccacctactcacccagaataacttctagacctgcaagctcctttcatggtaagtttcctatacagatgttttctttgatacccattttttctctttgatactatatattttttatttttttaactttaaataattttgatacacacttaccattgtgttacaaatgcctacagtactcagaacagtaaaatggtttacaggtttgtaactcaggctacaccatgcagtcgatgtgtgtagtaggctataccagctaggtttaagtattttccataatatttgcacaatgatgaaattgtctaagtatgtgtttctcagaatgtatctccactgtgaagtcatgcatgactatatgtgatattctggaaagtgcaacgttatggagacactaaaaagtacagtggttgcaagaggtgaagtggagggggtagagataaacaggcaaaacatggtggaattttagggcagtgaaactgctctgtatgatgctataatggtgtatacgtgtcattataaacttaacaaaacccatagaacatacaacaccaaaagggaaccctaatgtaaactttccgtattagtgataatgatatgtcagtataggttaaccagctgtaaaaactgtggcactttgggagatgtttacaatggggaaactatgtatgcatggtggcaatatatgatatttctgttccttttgttcaattttactatgaactaaatactgttctaaaaattatctattaaaaatgaaataaaaatcactcatataaacggagcaagaaatctcacagatataattagtgaaaaaatacattaaaaagctcttataaatacactgcatatattccaaagtagaagaaggcatgagactggtgaggagagacatagattgtacggagcaagaaatctcacagatataattagtgaaaaaatacattaaaatgctcttataaatatactacatatattccaaagcagaaaaaggcatgagcctggtgaggagagatacagactgtatttaaaaagacacaaattaaactcccaaagatgaaaatacagtgtcttagatgaaatatatactggacaggattaacagcacattggacactcagaagaaaacattagtgaacttgaaaatatggcaacttgaagaatccaaatgaaacatacagaggaaaaagagtgggaaaaaaaaaaaaaaaaacagaaaatcggtgaaccctggcacaataccaggagatctaacatacttttaattgaaatccatagatgaaattgccctagttcagagtaatgagctagacaaatacatttaatgaaataatggcaaaaacaggcccacaacaactgtaaattaaagaaaaaatagtccaaagaaacacgcagcacagcacactaaaatatatcacaatttctgaaaatccatgattatgagtcttgcaatcagcctgagggaggaaaaaagacattatgtacagatgaacacaattaggaattactgtagatgtataatcaggaacaatgcaagccacaagacaatgaagtgccatatctaatgtattaaagggggaaaaatgacagcctaggcttctatacccaacaaaaactattttactaaaaaatagaaataggacttttagaaatataatgtaaaccatcacattatcatgtataggttaatttcacctgtggttttagtcatttcatggctacagaaagatagataccacctatgtatatgttaccttgcctggatcatgttgctcggacttcgaatgatataaagagaagctaaagttatgatggtcttcgaaatacctcattcatatatgtaacaaagtacatacgcataatcctaaaatgagattagatgtaaaattcagcagtgatcagatattactcagatctaaaataattatgtccctgattattaattctataatttagcagctatttcatcaacccttcttcttggtgaatgaatatcttagagagaggtctctgcatgttttttaatgttctcctcttgcatggcaggaagcccatgggcttttagatgacacaagtgaattcaacaggcatcttagggagaagtagtttaaatgataaatggcacatttatagctaatgtttggtaagtattttaatgttccatatattttaatattaataataaataatccataataataatgactttaatattcatagtaacagagaacgaatttgaagcacagagaaaaataacatatctgcccagaggtagcaaagggttcaatccaacctttagtccaggtagtcagatttcacagccctggggcataatctattatgtagtgatgcttcaagcatggatggcaaaggctggaaaggttcagagaatagccgatcaatttgttcgactaaagaaatgatggaaaatacaatgggaaatacaggaaactttaacaggaatataaaagaggctagggttgtactatagaaaatatttcatttttgaatataagattatactttgagtatgaaaagcaatgaaaggcctcccatccaccagatggtgataataggaacaatacatatgtacagattatgtaccactttgtataagtaaaacttaattaaaaatgcacatacatatataatgcaccctgcaatgcaattttttttttttttttgagacagagtcttgctctgtcgcccaggctggagtgcagtggtgcaatcacggctcactgcaatctccgcctcccgggttcacgccatcctcctgcctcagcctcctgagtagctgggactacaggcgcccaccaccacgcccggctaattttttgtatttttagtagagacgggatttcactgtgttagccaggatggtctcgatctcctgaccttgtgatcggcccgcctcggcctcccaaagtgctgggattacaggcgtgagccaccataaaccatgcacataacttaacaaacagagatgtcttttaccatgcagaatactttaccttaaacactcagttttgaaatctaaatagccatttgaatttcagtgatcaaatccaaactgattgatttaaaggtaaattgggctagattcagtattgtttaaccttttgtaaataactgcatagatgacatttgccggcagatggtgaaagtcaacacctctgaatctgtgttcagaatttgtaattattggggtggccatagaagatgaccagataacgccatttaatttaatagaaccaggtgtcaaatatttctataaggtacaaaataagcaacttgtgaaaacccatgatgataaatgactgtatatttgggattctgacaagaacacttcaagtatgtcacaaaatcagaaatctcaatgattcaacaaggtactcaggtgtaaaatatgcctaaatactaatagggaaatcttcaggcaatagactaatttataataacaataaatgcttacgattacaatccattttatacccaacatttaccaggagttaacaccaagaaagtatgacagatgtttaaggtggcatcaaccgttgaaataacacttgtataaatttagaaatttcagaactacaaaaacattcagaagcaatatataaaaaaagaatttaagaattggaaaaaactaaaaattagaatatttatcctttaatggcagatatttaccctaagaaatagaaaaaatacatatgaactctttgtcatgattaacttgaaacacacaatgtaaataacttcttcccaaattcatcaagtaaattatattaatcattagaaaacagtttaaattagatctgatcaagattcttattttcccagataataagaggaactttgatttcttcaacttggaaattaattttacatcaaatataccataacaaaataacatagtacaagtgtataattcttcacttaatttttggtttgttttattcttccttcagtgagctttttcaaaaaatattgccatcattcttgtacagaaccatagcattttagggctcgagaaaattaagtgattttctcatttggagattaattagcttatctggaactagaagttatatcctctgatacacacttaaacgtaccatcaactatagaatttcatcaatcttaagatgcatgatttttcacattttaaaatatctaaaatctgaatgtgtttcatctcacaatccatgggatgccataggtttatcacttgtgcttttcctttctcagtgatatataaaagtggtttatggtatacagtcctagagattatgaaacccaacatgccatttttaaatatataaattatgtacttttccagtgattacatcaattaaattgtttcagagctttttaaaaatgattgttcatttctaactaaatgaacgtctacatgtactcactcccttcataatgcaatttttacttggcatctgatggcttcttaaatgatgttttggcccagtttaataatttttctataaacaacagcttgttttttgagtattaaataagacaatcaagttctttagggaaagtggaaccaaatcatgtattgaaaagtcatggcaacgtatttatgtacagacacattttggttcgttacatcacatttcatacaacttacaggaatttcactaatatttttggcttctctgttactgactctggctaaaagagctttgggacattgtagtgagttggctcgtgctcttaaagctgctggagttttgctaactaattttctcagagtattcatactgtaaacatgttgtagcagattaaaaatacctataaaacacacaagcaaataagtgtaaaaattaaaatagctttaaaaagttcatctaaatgatgcatctcaaatctgaggctgaaatagtttcgacacctttgtttttcctttttttgtttttttttggtttttggtaaaacagtttaacaggaatcacatcatatataaaattgctgcaaagaagtctttcctttcaaaaaaaaatctacaatgcttcataaccctattggtagcaggcccttgtcatttcaagaaacaatgcagccttcactgaaacacatgtgtggaggagggaggtctgttatctgtgcaggtcgtaattcctggtcctctgtttaaacatgcagtggcatttcctatgtaattaaatttctaaatgtacaagcaaactttgtctacatattggcatgtataataaattattaattagaattgtcaaaaaccattaatttgaaatctgtagagcaagtcttcagcctcttgactgtaccatgagattcatttagaaattatttaaacacattaattaaaactaagtttaaatattctaaaattaatactgataaagaaggaaaattaaatcttcaagttatgttctgcttgtatttcatgatggagcagttatttgcacctggaataatttaaatagtaaaggtatatgaataaaacaaactttataattattatgtggtattttggggtggacatttccaattacagagtaaaaaagattaaaaaattctctcattactattagaattagacaaagatagaagtctagcttgagctattaaggcacgtttaaaatatatctaaaaaatgaaaatggttaatttttctaaattaacaacattcaaacttttcaatcccatagtttatgaaattggaggagcccttttatatgacaatctcaatttacaacatactttggttaattcatgtatgtaactactaatattgctattcattgaaatactccagtaaggcaatacccagttttaatggctaactttgtagggctgtggtattattctaattaatcactacatatgagttattaaatatttacagtattattcatttccatatctacattaacaccaatattggtatctattacatataaagctagtttttatgcaaagtaaaatgtatgatttaatttacaggaaagtctatttaaatattacagatgaacacacagctgttaggaaaaaaacctcgacaagttaacaattctgtcaataaatgttcattaaacaatgaataaacctttcactgaactaaagagcattcatctagtttaccaccccaaaccagtgtactagaattcatgacagcaagacttgggtttagctgttacactaataaacctacagatactcaaccacaatatggtggtctaaaaggaaaattaaggaagcccatacttctactaatgaacaggtaactaattacttctaacaaactatatgtttcgtctcgggaagactttgctctcaagacttaactcacctcctatccaggtagtgcatataaaaactcatctgagcaatttatatagaaaattattcttgccctccaatcactttattgagtatcatttacagtatatgtttagaagtaatttggaatcttggcttcaccctgatcaggttatagaaaggatatccaaatgaataattgctgtaatatgttgtaagcactaaatttgagtaatttgaaatatacaatatagtaacaaataaaagaaaaaaatctggtgcactaaataaaatgtttccaagggagaaacaggagtgatgggactcgaaacatagcaagaacaattaggagattgtttcaataattcaactgagatataagagatctgaaaataaactaggagtaatagagttggacagaaggtagttggaattgataaattggtcactaaggcatatagatttaaaagcatattatgggaggaggatagagatgggaaacaggaagacggccaggttttcagcttctggagatcatggctattattaagtagaagcaggggtactggggtgcaatagagatttcaggtttagacatgttgcaggggctgaaattgtggacacaaggatctagactacatcagggaagaaggttggaatagtgacctatattttaatgcatggttttgaatatgataaatatgtaatgattgcaaaaagaatatcaaattctgattgtccaggaagggagaaagatcagctaaagagagtaagatgatactgccacatggcttcatcagcagcacaagggataaacgaacaaaccatcattaacattttcaaactgggtccctgaattgtacttgagcctttgcaactcacctcacaaaatattcagtaataatattaaatataggactatttacaggatcacaccaaaaccaagccaagccaaataaacaaaaaaattctctactttgggcccaaaatggtattttgaagatttgtacattttacattatttcagtggccataaatgtaattatgaaaccttaacaacagttcatttcccaaggcttttactcactttaaagaaaaaaaaaatatatatatatatatatattttaattttattattattatactttaagttttagggtacatgtgcacaatgtgcacgttagttacatatgtatacttgtgccatgttggtgtgctgcacccattaactcgtcatttagcattaggtatatctcctaaagctatccctcccccctccccacaccccacaacagttcccagagtgtgatgttccccttcctgtgtccatgtgttctcattgttcaattcccacctatgagtgagaatatgcggtgtttggttttttgtccttgcgaaagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagtgctgcaataaacatacatgtgcatgtgtctttatagcagcatgatttatagtcctttgggtatatacccagtaatgagatggctgggtcaaatggtatttctagttctagatccctgaggaatcgccacactgacttccacaatggatgaactagtttacagtcccaccaatagtgtaaaagtgttcctatttctccacatcctctccagcacctgttgtttcctgactttttaatgattgtcattctaactggtgtgagatggtatctcattgtggttttgatgtgcatttctctgatagactgtaatggtgagcattttttcatgtgttttttggctgcataaatgtcttcttttgagaagtgtctgttcatgtccttcgcccactttttgatggggttgtttgttttttcttgtaaatttgtttgagtccattgtagattttggatattagccctttgtcagatgagtaggttgcgaaaattttctcccattttgtaggttgcctgttcactctgatggtagtttcttttgctgtgcagaagctcttgagtttaattagatcccacttgtcaactttggcttttgttgccattgcttttggtgttttagacatgaagtccttgcccatgcctatgtcctgaatggtaatgcctaggttttcttctagggtttttatggttttaggtctaaagtttatgtctttaatccatcttgaattaatttttgtagaaggtgtaaggaagggatccaggttcagctttctacctatggctagccagttttcccagcaccatttattaaatagggaatccattccccattgcttgtttttctcaggtttgtcaaagatcagatagttgtagatatgcagcattatttctgagggctctgttctgttccactgatctatatctctgttttggtaccagtaccatgctgttttggttactgtagccttgtagtatagtttgaaatcaggtagcgtgacgcctccagcattgtacttttggcttaggattgacttggcaatgcgggctcttttttggtgccatatgaactttaaagtagttttttccaattgtgtgaagaaagtcattggtagttggaagttctggccagggcaatcaggcaggagaaggaaataaagggtattcaattaggaaaagaggaagtcaagctgtccctgtttgcagacgacatgattgtatatctagaaaatcccattgtctcagcccaaaatgtccttaagctgataagcaacttcagcaaagtctcaggatacaaaatcaatatacaaaaatcacaagcattcttatacaccaataacagacaaacagagagccaaatcatgaaaaaaatatatttaaaaaaaattttaaagcaagcacagtcagtgaattttcttatttcaattgttaaaattattataatagttcttttctatgttagcactaggaaatggtatttgactactcttgagtagctctttaatacaaattttctgaagagtaattttgagatgaatatcaaaagaaaaaagggcttatgcttttatacactaattttaattgtttattttaaaaatctatatagcttttttgaaaattgaaaaagtttgaataacttaaataagcagtggcaaaatggtaaaatcacaggcatttgaaaacttttaattaatgaaataattttatgattatgtggtaagtaaaaaacaaatacattgtttaatgcaaattataaagatgtatatgtcaataaacaaaatacccatagaagtaggactgtgagagattatttacatacttgctccataaggaacatttctagtaacaattcatttgttttacagtagttattttgatagaaggggccaatatatttgggaatttttagcacactaagggcttttgttattactaacataattaaattctagatttagtgaattatattatacacaaaagtacacctccttaccagtgggagtaatttgccctacagaaatctgttataacatttaaatgaaattgttaatcagggactatctacagctgcacctgctcttatttgtaggatgaaactgtgtaatcactgtcagttcttccagatagaggcagtggatatctattaatacaacagacgcataattaaagagaatccccatcagctgtggtatcctggctttgttagattgagcaaagtgaggacagagaacaccaaggagaaaaatgggcggagactggttgtttatgacaatgtcacttactgcctacgcaggacactgaagaaattagtcaaaaaagttatgtgataaagtcacaaagaataaggttagaaaaacaaagtttaatgaattaagcaatggtgaattcttactttcaaaggaagattttagaatacaaaagcagttgagaatgagacaaattcgtgccacaaatatttctaagtaaattgtgagtgttgtctcttttttttttttttttaaagtccatggacttctaaagaggttattttgggcccgtgttgtgtgtataggatactacaggaagcatttttagaaaaagggttatgcctattacggtctgaaataattcgtatatcttaagtatgtagtttatcctccttgtttgactagttccacaatttcaaaagtcactcttgactcttactgatggcttcccactccttgcctcctgtgtgggcttgctagggtcccagcaacccagccaggaggtctcaggctgagtttgaaaaagctgctgagggtattaggcacctcaagatcaagctaaaggatgatgagatgctgttgatctaagaacattgcaaccaagtggcgtgggcgacataaatacagaaatacagcaaggccaaaaggggtgtctggaataaactgaaagcaacgaccaagaatgacaccatgaaagcttagtccacaaagaagcattcaagaaaaactagagacgggatttggtttctagtcacacatttaacctaaactgatgcaatgcctagttttttctaataccgtggctggtgtaaaataatgaaaataaccagttaagttagttccttcattctgttcagaatatggctctaggtaaaacaattactgaccttccccaagtgttttttatctgaaatcaattaaaagtgtatttgctactttagaaaaaagtcactcttactgaatttatatggaatacaaatttagcctttcttgatagagtacatatgtgttagtgttgtgaaatataaagtcatgtatgtgctgtaagcattgcacttacagtatttcagattataaagtcattataatcaatgtgtccaggtgaacataagcttagaattcaacctacattctgtgaaagaaatacatgaaggaatcaataagttaataagtcctactatatgtatcactttttagcatactataaatgcacttatttattatgtttattgtctgtctctccacttaaacaaattcctacataacaggatgtctttttcttcaatgatgaatgaagtctatctagatgaatcaacaatacttcgataaggcactcactatttggtgaatgaaagaattatcttgatctgaaaaatacagactacgtactcctgttgctctttgaaattttaaataaaatgttggaatatttattttagatagtttaaagaagctaaaaatctctacaaatgcatttaggtggcagagaatctacaaaccaagtcaaccgatacatgaacaaacaaactgtaaatgagggaaagaaagaaagtaccaaaggatgacctagcgtgggtatttggaagggttacttaattatgtcgtctaagtaacctaatttatatgattgtaaaagatcaggaattccaaatatttcaaaatattttgcaatcataggcacataggcctcttggaaaggttcagctaatcctaaatattactgatatgaataatgtcacctaaaaaaaaaggaatatttgactcatatagtagaaatagttccataaataaagaaagcatagatgtaagaatatgagttatgttagtcagatttaaacatcgttcttcataatcatgtgtccaaatacagaataataaaatagcaataatgaaccaatcaaaaactgcaataaaattttttttgccgtaataaaaaatcaaacttaatataagaaaacaacacaaaaatgtcaccctaatacataattttataactgttttgtgagaaaataaattacaaattttgtatctatatattgtgttcttgttttttcaaaatgaatattttagtttagtaaatttccataattgatacgtgaaatattagtaggatagttcacttataatttgatcaattgattgaaataataatttctaattttattttaaatttctcaagaatgtcaacaacatattctactatttttagtcaagaatttcttgtgaaaaactataattaagaaaaataaaatcccggttgcatctgaccattaattttttactacctaaattacatagttaaattgatatataaaaatgattaatttttaagaatttcaaacacttaaatcattaagattaatgatatatcttagaataaaaccaaccataggatattgtcaaatgagccaagagagaagcataattatagatattgtttaggaagcagacatgaaaagggtgatttactattatcataagtgataaggtggccccattaagatgaccaggactattatcagagaagtttattttatatacacatatccaccaataatacctacatactataatacactatccaccaataatacagtaataccatataggaaagtaatcttggtttatatttcctagcattaaaatattcttgttgtacacattcagtgtattgtccaggcatattttcctctgatcctaggtgtctgtaaagcaaacataaaaaagcaactgctttgtggagaaatatgctttgctatctaatacagaaaatttgaactatttgtatcgccatttgggaccaactgaacataacctgcttaaaagttccacctaaattattggaatccttttatatctatcttagacaaaatcacctaaattgtatctttcggagttcagagttagtaataatggcaaatatttcatctcctaaaataaaaactattcaggaaaataaatcttgagcatgaaacttcaattttctgatttcactgaacgcgatatcgaagatgcaaaagcaaataacaattctaaaccttgatggaatatttacttcgattggctttcacccaaaagtggccatggattactgaaaatattttcagagctctctgtataactttaatggatagtggccaagatgcaaccgtggctataattagtttctctgtttatacatttcaggcacggtgaaatgtgttaataaaaaattaaaaagacacaggtttgtggtgattaagtaagattaagtaaattgttagatctatattacatttgtgcataaatattctaatgctaacttgaagaatatatgaaatattcattaattgaatattctaatctgttaaaatgaccttaataatttccattcctcaataattttactttcatttcaaaaaagattaattgaataccttttttttttttcccccagatgaaatcttgctctgtcacccagactggagtgcaatggcacgatctcggctcactgcaacctctgtctcctaggttcaagcgattctcctgccttagcctcctgagtagctggaattacaggcatgcactaccacatccagataatttttgtagttttagtagagacagggtttcaccatgttggtcaggctgatctcaaactcaggtgatccactcccctcggcctcccaaagtactgggattacaggcgtcagctaccacgactggcttttttttttttttttttttttttttgagacggagtctcgctctgtcgcccaggctggagtgcagtggcgcgatctcagctcactgcaagctccgcctcccgggtataagtgattcttctccctcagccccccaagtagctgggactacaggcgcctgccaccactcccagctaattttttgtatttttagtagggatggggtttcaccatgttggccaggctgacctcaaactcctgacctcaggtgatccgcccacctcagcctcccaaagtgctgggattataggcctgagccaccatgtctggccttgagggcattttaaacagcaattaattttcagccacactgtaccattaatataccttatgcagttgagcagttatgaccaagtttccacatttggaggtaattacaattctattttgactgttgcctggctgatagcagttgtaagttgtcatttcttacaaaacagagcaaaaatctacttatattaatatttggggaaatcatgtcttaaaattgattgaatataatatgtatgaaaaacagagggtaaatataacccttagcacacaataagcactctcagggcaaaggcaaccttccttggtatcaagtactttggtcccactggcaaggctatctcaacagatctatttacctgaaccttattataaaacagtataatttttcttttgttgtattcttacaaaagtgctctttgaaatgttgactgccctttaatacaggcaaagaatctatttttctgggatattttgcatattcagattcttgttgccatcaattctaattggaaaattcattaatattctaacgttgactttagtctgtgtttattatagttgtcaagaaccagtccttcagggcttgctcaccccttagtccgaataaatataggtctttggtctgcagagtaaaaatttgatcctaggactcaataaactagtggatgatttgcctaaatagagcctgctctgatagaatctgatttctgtgggaaaaaaggactgtgcctttctcatttacaatgaacactcccacatctaacacggtgccaggctcaatacatttcaggcaagtaaagaaataaccttactgtcatttcaatatacagaattatggttacttaaaagaaataactcatatttatttatcaaaaatgttcttttcacatttctaaaagtctcacttaaaaagtttgctgggttagcaatttatttgctcagaaatattgtctatagaacattcagtagtttgtgtcttcaaaaatcatcccaaatgattcaaaagcaatatttaaattcaaaatgcaatgtttaatataaaatgaaaagaaaaaaatgatctcaaaaatttacctttcaggtgtcttattatccacatttgcacggaatatgacaagggataaaagagcagagacttgcaatgccttggaaaacaaactcctcctcttgcctgaaaagcaaagtgactaatgtccaaagaaaattgatgctgatagacagtttcaagaaaaggaagagtcaatcttagttgcaatgggagttaaaataaaaaaaaatagcaaataactagaaatatttttatgatgataatgatgacataatgatgtattgccatcacaacttatgtataattctcttatgaaaagctcttttttcatagaggaaaaacctataaccataaagaaaagtagaaaataaactcttaaagaatacacaattattttatatgtattgcaactaattaaagcagtaaaagaagtaatattaaatgcatgtaaaataagtatcattagcaatattgtggaaactttatctcatgtgtccaaaagtaccatgtaagaggatatttatcataacatctattatggcaggatggagtaggatgcaactggggtgtcactaccaggaaattaaataagtaaaatgtgttgcctccggatggcattgcatatacaggtcagatttaattatcttccttacagcaacatggctagagagtttgattatagttaaaagctaaaggtgtggaactataaaacctacattacacaatatcatttacacaaattaaacatgcacacgcacacacacacacacacaaaccaacaatatacagttttcaaagatgcatgcatatctaagggcacaaattaattaaattcactggcacatttactagcaaaagtgatgaggagggggccaagaaatgatgattaacatataataaaacaagacaaaggcattgctagatcaataaagaacatagttaatgagctgagggtcataagtacttcaaatctgtgcaaccaagataaaaaaataaaaataaaagctaaaaccttccaaattgcttctacaattaccatatcagtgaaattttataagatattggtcacctgaattgtttcaccctacatatccagagagctcccgggacaaatattggttttgtagaaacagttcattcatacagttgtatttcggttgctttttttcaggttgtagaaaattgcatttttctaaaagcttaacgctttcattatacatgggttgacattatatcacgttctcaaaagtgaatcagacatttaatatgcctttaatctaaaactcctctaaactgtgtgatttaattaaccaataattaaataccaaatatgagaactttagggactaacacattgaagcggtatcaggataaaagatgtttacactgaacgcaaagattctcccctgactgagtgagactgggaattgcaagcatggcagagcgaaagcccactgataacaagctgtttattaaagcattagcctccctgagcttaaagaatgtcaaagcctgttcttacacatccatggaaaaataattgcagagcaaaaaggatgctgctttgcatttgtaataaggcaaaatgttactgaacattagatttaaatttatttctaaaaatacttatttctaacagttctttttgatggccttttattttcaacatttatcgttatgaccttccatttattcagcctctcttctgcttatctggcttttctcttttgcgttatgaatttgcttttttgagtagccccattgtctcattttgtcttgcctattgtatgctgcctttaacatcagtaacatgtggcgttcataagtgtctgtttgccaaaagggggatgtatcctggaatacacctttaaagtccagaaggcaagcaggcaaaagatggtttgccaaaagggggatgtatcctggaatatacttttaaagtccagaaggcaagaagaggcgaaatatgttttcccaagtgatgacagtgaaaaataattaggaaatctatgttgataaagttaaaaaaaaacatagatattagttaaagtaagcttagcacagtcttacattaaatatggggaaacagagagctacaggatttaggagaactatccaatattctatagccagcaacagagattaaaatccagaaaaacacccccatcccatctccctggtataacaaaacattatattctaaaaataaaataataatggtggtctcattacactcagtttttagtgtggccaggtcactatagaatttggagaaagtggcctagagtcacaatgcttgaattcaaattctggctttactacatgccagaaatgactcttggcaaatctctctgagcctgtttctgtatttgcacaaatgtgaaactaatcatacctatctcattagattgttgaggggattaaatgaaacaattcacatcagaacagtcccaggtacatggaaatacatctaatatactgcttatctttaaaatatattatttcacttacaatacatttgcataccaatccccttgctaatcattaacacacacaaaaggtgcaatccatgtagttaaaaagtgtataaacttgttctgctgattatcggttcttttgtgaattcaataattagctcatgtctttcctttcactttgtctcaggcatagtgtttattaaattccataaacatgccaataaacctatctagaacatgcttgagaatttcctcaccttctcattgccaattatcttcctcttctcaaaaaacaatcactgaaaatccaaaactctggataacagaatatcttaaataactttatcctcaaaccctcaattccaaaaatcatattttatattgaacacaacagtccagcaatactattcccttaattctcaacatttgttcttttcatcagtaatattgaaattcttggttgctttctgtttccctctattgtcagccctccctctctatatgttagaatcccacagctagacatttcaaacatatgtttcaaccacttcggtatttgttgaacgtttagtctgcttccaggaattattttcatttcaaaaggccaacatttcacattttgccatttaacttttaaaataaatagctatgaggtataaaaggatcccttcgtatttaataactactcactatttaaataatcgcctttctagcagtcaaacaaaatatagatgtgttccttttcctataagaatgaaatattatactgtttggttatttttagcatctaataacctaataaaatttgcttttatgtgaaggtattattggagactctcaacaaactacaccataattcttaatatactgatcccattagctggccttaggaaatttaaatatatatttcagattgctggacaatgatttttctggtttctaaagttgctttagtttagctccaagttaaacttttgtatttaaccagtcacaatattaaataaagagtaaatgggtaatgaaaaaatacaatttataaattgtattaaagatcacattataaaagctataaaacacacctaatttctaaatacaatccaaattttaaaattatagaaatttagcatgagacaaaatgcttttccagaaaaattgttaatttctgagctaacttaatacaaattgcatgttttctgcatttagcatatgtgtgggggggtataatcatgacatattatatcctaatctctaaatatagccagataaacttcagattcagaagcccacagctttaaatcagcacaagtatgttgtgcacaaagactaagccagtagacactaattcacccagacagctgatcttgtatttgaagaaaatgagacacaatcagggacagattgaattacacttctagaaatgaaagtagtgtgaacacatgtctcctcatccactatggggtagaaaggtagatcaaatatctgggtaatcgtgaaaactttgaaagagtggattctcaccccaacagagcctgctgccataagtatataagatacgaaataaaatacggtaataaactatgataaaagttagaaaattaaatagggataaataatccaatactatgaaaatcatctaacttctttgagctttaatttatacaaacaaaaatagagctaagaagatccctcccaggtttaaattaaaggacactaaaacagtgttgaatagtaacaacagagggtatataaatatgtatatacacacacatatatacacatatataatttgaatttatatataatatataaatctcatatatatatgcatatatatataccaatcttttcagatacatagaccaatggaataggtcagagaacccagaaataaagccacatacctacaaccatatgatcttcagcaagtcaacaatcacaagcaatgaggaaagggctctatattcaataagtggtgctagggataactgactaccatatgcagtagattgaaactgaatctctaccttttaccatatgcaaaaatgtactcaaaatagatcaaaaatctaaatttaagacctaaaactataaaaactatagaagaaattctagaaaataccattctggacatcgaccttggcaaaaaatgtatggctacatttccaaaagcaattgcagcaaaacaaaaacagatttgtgggaccaaattagactaaagagcttctgcacagcaaaagcaaccatcaggagagtaaagatacaacctacagaatgggaatacatcttcacaaactgtgcatccaacaaaggtctaatatccagaacccgtaaggaacctaaaaatttcaacaagcaaaaaacaaaattaccacaaaagacatgaacgggcacttctttaaagaagacatacatgcagccaacgaatatataaaaatatgctcaacaccactaatcattagagaaatgcaaatcaaaactacagtgagataccacctcacactagtcaaaatcgttattattaaaaagccaaaacatagcagatgttggcgaggttgcagagaaaagggaacttttataacattgttggcagaaatgtaaatttgttcagccactgtggaaaacagattggagatttctcgaagaacttaaaagagaactaccattctatccaacaatcccattaagggcatatacccaaaaagaaaatcaaccattctaccaaaaagatacatgcactagaacgctcgctgcagcaaaattgacaataataaagacatgaaatcaacctggatgcccatcaacagtggaatggattaagaaaatgtggtgtatatacatcataggatactacacagccatagaaaaacatgaaatcatgtcctttgcagcaatatggatgcagctagaggccattatcttaatcaaattaattgatgcaggagcagaaaataaaataccacatgttatctattataaatgggagctaaacattgagtacacatgcacaaaagataggaataatggacactgaggactactagaggatggatggcaggagatgggggagggttgaaaaactacctgctgagtacatgctcactacctgggtgatggaatcattcatacaccagacctcagtgacacacaatttacccatgtaacataccagcacatgtacccccaaaactaaaataaaagttgattcaaaaatcaaccttttaatttaatactatattcatatatttaataaaatgattaatgtttaggaaatatgttcatgttcaagcaactacaaaatacataacattttggatgttaacattttattgaatatgataaagcacacaaaaattagctaatacttaagcaactatcacttctctgtaatcaaaggccaactgccaccacaaagggaggtgatagaaaacaaagcttattaaagcattattaaaggaggactgaaaaaattccaaaaatagttagcaagaagcaggaaagggggaaggttagtaggtaggtgaaagaaagaagaaatataaagaggctcacataattatgaagttaatcccttactttactaaattaaaatacttaaaataaaatattttaaattaagtgagttacaaagttttagtgaaagaaagtaggaactggagtgttgcggaaggataagatggaagcataagctatccagaacaaaattccttacatggatcttgttgcaaaataaaagggcactctgagaaactaaatggaaattaaacattacaataaatatgtattactaaaggtagttgcagcatgggattgttcaacagtcaagtctttacaggatttcaagttttgaactcttttaccattataaaccactttggaaaaatttataaaacttataaaaataaaccatacttttattgacagaagtacctctctctcccctgagtggtgagaatattaggaccattaaaatcaactctcttccctcacaactttttgttttctttctctattcatccacaataaagcctcagccctgcttcaattacttctcttctcaccgtctacttctaagcagatggatgtagacgaatgaaaacaaccagcaatcactttaaatttaataacataaattccacaggccgtccgtgctgcctggtaactctacagcattatgtttgtcaacaaactatcctgctactaatccaaaccttctccttattcctgcagctttctcttcttttcttacggcccaatgtcttgttctgtgtcccactgagaaagcagacacaatcatgagaccttctttctctcaccagcatcaggtctgccacctcctgacctcttaccaaaccccctgcctccttcctactaacatgtgacctctattgacccacccaagcaagatttcttccatctttcattttcagccttttttctctcttttcttgatcactcatcaacctaaaaatatgtggaaatagtatcccatgtttaaaacgaacaaactaataaacctcccttcatccacatttgcccccagctatttcctaattatgtcctcctcttaaaggtcacgctcaaacatttttacacgcactggcactgtctccaccttcttcagtctcattcaaaattctcccattaggttcttgccttcctcactccacaaaaatgttcctgacaatcccccgccattttcaaattcagggataaatgctcagtgctcactttgcccaccccgctggaagtaataacacagttgacagttttctttcaactttctatttgttgaaatgccctccttgatttccacttggaaatctctttcctggttttcctcccacattaatgcctgcttcttctctctgtgtttttcctttactgacacttttcttgcgccgacatttattgttagaatgctcaagggctcagctttctatccacacactcttcttaagtgatccaatccagcccttctaagtaatcctctttactatagtgtatagattatatctacgactaaataggaaacacatccctccagccaaagctctgcacccctctagacttccacactggtatattcttatttatacatgatacttccacatgaataactaaaaggcaagtcaaatttatgtctggaaacaaaattattgacccaatcccccacaaccaaccctcccttcagtgttctgcatcttaataaaggacaccgctatttactcagttgctcaagtcaaacaccttggggtcactgatgactttctctcaaatgccagttcatatatcagcaaattctgctggcttcaatgatagatagatagatagatagatagatagatagatagatagatagatagacagacagacaggcagacaggtaggtagttaggtagatagatagatagatagatagatagatagatagatagatagatagatagatagatagatagatagataaaaagatagatagacaggcagacaggtaggtagttaggtaggtagatagatagatagatagatagatagatagatagatagatagatagacagacagacagacagatagatttatttgaacaattcttacctcctccattactaccatcctgaagcaagtttccattattttccctctggactgttaacttgtttccaatagtacattgtaagagcaattaatatattcttttaaagatacatcacatgatgttatcaccctattcagaacattccatggcttcctatcacaatgaaagcacaattcacaatatttactttcatacatgcagtgatctggtggctctggctctttcttgacttcatctcttaccgtcaacccctttgctcactcttcttgtctacactgacatcctgttgcttcctgtgaatcccaaggacaattttgcctcagggtgtgtgttcccttctttgcctgggtggtctgtattccacatatttgcacgacttagtctttttattagaattcctactcatgtgtcagaccatatgagagatttccctatctagagaatctagggagtcactgtcaacactctccaactctcacattgctttatcttttcctcatattgctgaatattgccttatatatttcatgccagctacacaagggcagaaactctattctagtctatttggtatatactctatatatgttgaataagcaaatttatggtatagcattcattgcagctatacattcttgtatatttctaaaacctttatggacagcagaaaaccagtgtttccggaaatactgtgcttcacttgtgtaaaatgactttagtggctgtggtctcttaataacactaagtttgattgaagagccatgtcaagcaatttgggcttttagttattaatctgaaaactgagaatgaaagagaagttgacgactcatgccagttatagaaaattgctaatttaataagcaactcattagaatttgttatggtggctctgaagtttaatgagcaggaattttccctctaatttttctgaagcagcgagatgtcagtgaactgaattgatgctttaataattgtgattctttctctactttcttcttcatgagaaattagcccacatagcctctcagttatacttactcaatgttggatgtatcagcataagaaatcaggaatcatgtccgttacgacactaaaatattatccagcacatattctgacatcttgattttagtcctggggtaactagttcatggtcgtacagctatgcatactcatagatgtttaaaaagtgttagtaagctaataataatagcagtaactcttgccaagacctatgttgagtgttcaaaatgctctctttaattcagtttctttaacatagctattttttatccccatctggaaaaaccaaatcaatgtaatcatttttttgaaattataactaactcacacatgtatgttcacttaataatgctcttttaaagtcattcttttatattccaaattaaattttgataagtttttcaaaaggcaatatttttctttcttgtcaaatttcaaagataccttattaattcaccttaatgattattacagctgagaaaggtgtgtttttcagaatcatgtactttgaagtcagatagaaatgaaattaacaccaggtcatgtggtagctgtgactgtgggcagttaatctctcaaaggctcactttctccatctttaaaaggaaagcaagtctgctacagagaattgtggtgtaacccagctgcatatacttgtataaaatgcttgactcagtttattaagtgttttttccaatgccattacactttttaagatgctactcccttccttctactcctctttaaaaaacacaaaaaaacaaacaacaacaacaacaaaacacttcttagggataaactaaatactgggcatcacaaatatattggtaagcaagccaaactcgcttcattcaaaagcactataagaatcgatgcaactatcagtcaatgttttgttcactggtaatagctaaaacatataaaaagtctgattacttttataactttgaaattgacatttattagaaaatattgatattaatagccaccaaaccacagatttttattgttaatttcgaagctgatcttttttccagttctaaagttgaaaactgtccaaatgaagattagcagtgcctagttaagggttccttcaacacccctttttagaccttatgcacctcataacaagaacaaaagcaaattctaatgatttagttgaatatttttggtggtcaatatgtaaccttggtggggaacatggactacatggtgtttaagaacaatcagtataggcataaagggtttttgtctatttgttaacaggattatgaagaacaggcactttgaagtttgacagtcatttgtgatttttttctgtatgatacatggactatctatgtgactatgtgactataatcaaattactaaatctttctgaatttccatttcctcatctataaaatgtgtcttgagtagtgataaaaggtaaaatgcctgccatataagaaaaatagagtattactgcattgcaaaccttgtctccgatgactctcaattaatctcatcatagttttgaagcaatttaatagatcaaaatgtttctattttcctagagaattattatgcatttgttttccaaatgaatgctgtgttttacagccctaattgcctaagtgtgtatctaagagtcattgatgtcttcagattacttgcactgattacatgaaattctaggaagcagaggttctgaaatagaacatagtaaaaacatctttggaaaacagtttttctgaataattaattcggcataaggccaatatttttacccttttttattcagtacatagaactttgaataaattgtaatccattgtaactttctgaacacgaatcactatatttttagagaaagtctctcttccccaccaggataggagttgtataaggatagggattcattcataactcctgttatcccataattatttgttgaatgaatagcttagaatcataatagaaataaataatagtctagaaatacaaaatataaaagaaatttatttttcttttattgggcaccatgactccttgctgaagaaccctatttttcctccaaaatctagaattttcccccccatggtctaatagcttttagtcttcaatgaaatcttatctgtaaattaggaatatatcatgtatcatcatttatcctaaatgagttttgaattaaaaaaaattagatgaatccacatcacactgccctttttaaaaccagaataaaacaaaatctagttcacgctctttaaactaatcaaatttcaaactcactattgggattctttttgacaattgtgttttatgtgaaatctctatgatgtttagaaaagccaacattttcccatatgtaatattcaatttcacttaaggatgttcttaagctctataggaattaaattattttcagtgactctattctatgcctttttgattgtagacacatgtgtaaacctttgccaagtatttccagagttcgtccatttcatattcttaatagccaagttgaataggacattagagtttatcaagtccagtaattctaagttggaatttgaagctctaactctttaattataatcccatagcctgagccaagttgtgggactcctatactagaaaccaggttgtagctagcaatggtagaagcaaacacactgatgcgttaaaatgatttattcttataatactaacactaaagtagtaagcgtttttaagttactttaagtataatgtttagcaatggtaatatgacaatattatacttttaccagcacatgactctcatgtgcttatcagaaccagctgacggttagtttgattcaaatctcttcctaagtatataaacggttttattataaatgtaaaatacagccagaaattcttattatttagaagaaaattttcagattaattacaaaactttatgttgtcatttagtcaattcttttttttttttttaagagcaggagtgaaagtttatttaaaatcttttttttaaaattttattattattatactttaagttttagggtacatgtgcacaacgtgcaggtttgttgcatatatatacatgtgccatgttggtgtgctgcactcattaactcgttatggcattacctatatctccaaatactaaccctcccccctccccccaccccacaacagtccccagtgtgtgatgttccccttcctgtgtccatgtgttctcattgttcaattaccacctatgagtgagaacatacatagtcaattcttttttaaaaagtcagtgagctcttgatgtgtgtacacatgtattcagccattagaaaatttaacaaacgatgttagtaatggaaaatgttttagaaacagctgtagaacatgtgaacaaaattaagatttcccaaaacaaggagaaagaatagcaaaaccagtcttcaaatttcccatttcagctccaactactgctcaggaatcgatcagcataaaaaacaaaagaacctcaaatctacgtctataaaagactgaatggtgggctaattcacaaatactttttttggtgatttggtttttatcttcagaatgagtacaacaaagattgcttctttgtctgttacaatttccttactttaaaccataaaaacacttctaaaactctagccattacacagcatttatttgagagcaaataaaaatgaacaattgttagaaagaataatgaaggaacaagcccgtctggctagccttggaccatgtctcattcctattgtcattttacctgtggcaaaataaatcacaattaatttttgacacaattgagtttaacttcagtttgattaactcgaatttaaaatatattaacaatagcatgcaatcattaaaataatgtaaatggaaaatgggtatgatttggggttcagagaatcaagcacaaatatatgtactataattaacaaacatgtaggacaaaagagagatcaggaaagcaactaaaggaaatgcaacaaaataatatttgttatattatcaaaacccaaatgtccagatttctacaatgttttttctaccataatttcaagttaatttttctataaattcaaatttaatttaaattttaattaaattatattttaattagactttcaattttcattcgattttgtctacaataatttttaaattataaaatataaaccccagagtagactattttgcaacatattagtacattcaatttcttcacgttaggtatgcagttgtgcctttttcatagaatattaatttatgcacagaaatctcttgagatagtaaatatctattatttgtaaaaatattttacataaagagatttaatcattaaaaccaatcccagatgaatatattttaaaaacaggcagtcactcccatatgttctctttttttttttaatcatttggatatttttgacctacttttcaacccacagcaataaacattcagatacagacatttgccatttattgctgattcttctgtgtatataatatctgagatttctgacatgcctgagcctgtccctgaccaacttggaaagggctctcaggaatcaaacagaaaactggttttaacaatcagtttgaaaaaaattgacacaccatgcaacatcgtaaatccaagtattaacaaacatactactttttaaaaagtattttagctttttatcataatagaagaatatatgcgttttttaatggaacaagattctatatgatatggcttcagtaagaacacacttggaatgatgttttattcgagtgtgtgtgtgtgtgtgtgtgtgtgtgtattcagctttataatcctattacattttttcacatgtaacattcaaattcttgctacttgggaccttaaaactgcttacatgagaatgtgttagacaagtttctaagaaaagaaatttgatacccagaattttgttcatcttgacccaatttataagtccttaattgtggctaaactctatcattcagcagattcaaaggccaaatatttcaacgaaattatggttaacagtgaagaagaataaaaatttgaattctatccctttctccttttttgtgctcttaccatagaagaaaagtattttgtcatgatctaaaagcatcttactaaaaagcattgagatgtattaccaatcagcagcagagattatctgttcaccaacttgaactcatctagcttgtatcaaattctcagataacaaatttgatcttcgtcttgatctgctgaatgtcttgcgtgtgtaactaatccctccaacccagagaaagctacatgccccacctcattacttcagcttaaataatacattataaatgaaatgcttattttgtgtaatgtcacaacaaacatttaatttagtcatttactgaaagctcaattactcttacagtatgaatggaaggaggaagaagaggaggaactaaaaccatctcttggaggagatatcacccttctcaattgtgcagaattcagtcaataggtttgctaattcgcttgttacggcataagcaggaatgcaaagttaaagcactattaaaataaattttcacagtgattttaaaaattaaattcaaaataatacagcaaataatttcattaatcgaggcccaaatttgcaaaatgaaaaaaaaaagacaaactatttaaaactaaatcttcgtgaagtcgaaatggcaatgctagaaccatccattctggtacattgcaagaggagtatatggggctatatttaaatgtaactaacatttattgatgccttactatgtgaggaattttaccatgagtatctgttgcaatctacactacttttatgacacagggactctccttattttataaatgaacaagtaattgtcttaatattatgtacctgttgaagtctgtacagcaaaataatagagaaactaagactcaaaccaggtgctaagcacattagtcactctagaagtccattaagctcccttctgtcacaagtcagagagcaattctcaaacatgaagaaatttcttaagaataaattaatgggccaggcgcggtggctcacgcctgtaatcccagcactctgggaggccgaggagggcagatcacgaggtcaggagatcgagaccatcctggctaacctgtgaaaccccgtctctactaaaaaaaacaaaaaaaaaattagcagggcgtggtggcaggcgcctgtagtccccactacgccggaggctgaggcaggggaatggagtgaacccggcaggcagagcttgcagtgagcggagatcgcgccactgcactccagcctgggcgacagagcgagactccgcatcaaaaaaaaaaaaaaaaaaaaaagaataaattaatggttcttattttcaaacttgatctaacaattcaatggagcaattaaaacttatattttcagaagttcttcaagtgattctgagaaaccgatccttggcctatgattaataatttagaaattccagtctttataaagtttttcactgtctacgtgagttaataaattattttgttagtataataattatatactctgccttatttgtgtatttattgtttacgaaaaaatgtctttcaaataagaatatacaaataaaatattttcaggacacataatttgtatcaaaaagaactatttttaaaacactttaaaataacctacttttatagaaccaaaaaaatactaattgtaactaattcttacctatttttaagtgtaaaatagtacttggaacaacaacataaatctttttaaagcaattttttgaaaaaagtcatgcggaattttcattaattcagagatgttttgtaaaacacactcaaaacgaagaccgaatacacaatgaaaataagttagtaaactaagaaatagtcacaataactttagaagaaagcaagtaagaggaaggacaaagatatcttcactagcattgttttcataggacgtatgacatatatacccttttaatgacaataaaagattaaatgttcaaattaattaagatggaaaagcttatgcttattcatgaagtccacaattacttgttaagtatgcctgacacagcactagaaatagaagacatactgagcaagtcactatggacttaatggataaatgttaaaacattaaaaattatgtacaaatgtaacacaatttgtgaaagttattttttcttaaattcagttctccatctcaactaatttcaacacaaacttttattctcattaataatgtacatatgttggccaggcgctgtgtctcacacctgtaatccctgcactttgggaggctgaggctggcagatcccttgagatcaggagttcgagaccagcctggccaacatggtaaaatctcctctctactaaaaatacaaaaaaaaaaaaaaaaaaaagttaggcatgatggcgcatgcctgtagtcccagctactgagaaggctgacgcaggagaattgcttgaatccaggaggcagaggttgtagtgagccaagattgctcaactgcattccagcccaggagacagagtgagactctgtaaaaaaaaaaaaaaaaaaaaaagcctatatgcgtcccttgtacggaaaaaaatgctagtggaaaaggataggaacatatgtaataagtcatatttaccatgtagcattagtgttaatagtccttttttgtgctgacttcatgtactaaatcaaaaactgcacatagtaacactaatcgcctttatctggtacgttctgataggagatggacaaagaaactagacattcattgaagacatttctgtttgtttgcttgtttggtttttcgcttaattgaaagccaatatactgaggcaactccagcctctcaggttcctatgtaggcaaaccaaaatccaactcagtgcaaatcttcacaccctacaaaatcaaaactaaagcttaaccaggccaggcgtggtggctcatgcctgtaatcccagcacttttggaggctgaggtgggtggatcacctgaggtcaggagttcaagaccagcctggccaacatggcgaatcctcgtctctactaaaagaaaaactaaagcttagccaatcagaaacttccacaactaacccctaactagaaactttaagactagcatttcactttaattaagtattttcatgatcttgcttttgagaataccttataaaagtattccccctctccctccttcagctccgtcctgaaacccttgcaggctggcgctgcctggttgatgaaatgctgtctactcaagtaaacttcgcagaattgtaattacttttaaagactgtattctttcacttaaacctcatggaaaccatttttacagaggcatcattagaatcacttagttcattcccaagatgtttctaaagagagaaatctgcagtatgtgaggttattcaggactgtcattagccagtagggcagttatgtagtgaattttaaaagtgcttcatttggggaaaaatattagcaaagtaattcttttggggggagacaaatggtatctctgagatggaagcaattcccttatcacatgacttgacaagggaagcacctcttggattccagcctcaacacacccacttagcatgggggcctttgagacagtgcacggccataaaacggtctaatgtagccttgagaatagttttattttcctggttatttactgcattgctaactcagacgcaacatctcttcctgtaaactctagtaaccctgtttaaatatgtccttattttttcttcttttttaatgtgaatgagtcactgggttttctattgtgttgccaatagaccaggtcacattttggcaattccaaaatgtgacctggtttttaaacaataaaccaattaggagactgagcagtagggccaagacacaaaacatgttctcctcaagactaggacatccaggtgacaaatgtagtcatttcctaaactactgtgtaggcccctagttgctcatttttactaaaaagtaattaactaagcacaatacaacagttctaagcctattaaaaaagtttcttggaaatttaaataaattagctatgattagaactaatgaaacctctaagtgtaccaggtttaattgcaaaagttgttcagataacatgcatagtaatttgtaaaagaaatccggaggaaattaaatgcatgtccaagcgtatcaaagttagacaaattaaaattcaaaaacttcaacattgcagagtaacttacattttcagatattttcatccattgtttaaagtacaatgttacagtgttacataactatcactattactataatttgtcaccattattgtaatttaaggagatgtcccagacaaaagtagaagggaaaaaagtataaaatcaggaggagggaaataaattattgagctaggacaattcaaaatgtcaaaatactaggataaaactgaccaactgactcacactttacacgtgttgctaaatgcaaatgagggttgaactaatctgctaggttagatttttgttgttgtgattacgaagaactgtgattaatgatatactttggaaaatagaattgatcaggaaataaaacaaaagaagaaaactccaacccttaaaaacagtaataacccctgccgcaaaagaaaaaaaaaaaagctaaagaaggataatacaggttatttagaaatttcagcccattgattcaatataattatattatttatgttaatttgttattgtcactaagattttaagtgtaatttttgggagtccttcagggaaaaataaaacatccctgacttatgatgatttaccataagttaagctaatcaccttaacttacgatattttttaaacctttaaaatgactttatagagaggtaactccattttaagtctagaagcatctgtatgtttgtttttgtttttgttttcagatggagtctcactctgtacccaggctggagtgcaatggtgcgatctcagctcactacaacctctgcctccttggttgaagcaattcttctgcctcagcctcccgagtacctgggattacaggtgcccaccaccacgcccagctaattttttgtatctttagtagagatggggtttcaccatgttggccaggctggtttcgaactcctgacctcctgatctgcccgtctcggcctcccaaagtactaagattacaggcatgagccaccgtgtccgaccctgaaattttctttaccatatgctgaagcttaatgaaacaaacttttaaaagtttatagaagttaaaaaaagtaacagtatcatagtacaactcaagcacaatattggtttcaagctcatgattacttcaagccaatgatttaataacatgatttattctcacacaactttaactggcatttaaaaacttacatgaatttccgaaaagctatatggaatattttttttcagtgaataaaatgccttctatctagaacacattttctaaaacattgttctattaaaccactcaatttgtcttagccaataataatgtcaagttttcatggcacacttatctttgttttatagtgtacctcagtctgcagatgattaaagaaaatttaatgtaaaatatccaagagaaaactgatcaaaagataaataaaacataatcaggaaaataaatccagaaaaatactagaaaaaaattaaaaataaataagcaagtggtaagcagctatatatttaagaacaatggaatttttgtgcttctagaaggcaaaacaatcagttttataatcctcagagtcagatattggaaaacttaccagggaatgcggggatgtttttttcagagctaaattttaaaattaaatcaatgtgagactttcttttagagaagtgacagacagataagttgcaaatttccttattgatatgattttttcaaatgcagtggtttagccttccaatggtctggttttgcctaaggatagcagttgagagcaggatttattttaaaaatatatattcttcagtcagttttcaaaaacaaaacaaaaagggaaaagaacacttgtctacgatgcatattcatggaaatctggaaaataagtagtttgaccttaaaaggtctcaaaaggttagtttgagcttttggttgagagtgaatacctaacaatggaaatcaaatcatcataaaatatttgatccatctcaagaggttcagaaatacctcctcctaatagagtatgccaaaaaaattggggaggaaaaaactgaacatattaactcttcatttaatgcacagataagctgatgaaagggtaaaacctacaggccataaagaacaaaaaagagctggcctaagcgaagactgtggtatgtaaattcacaaaggtatctgcccacctatctatggcataaaggttgcatgtaccataacttcaacctgtaacaaaaaactagagcccaagtatgggtaaaattacacagatatcctccaccacacacacacacacacacacacacaaacatgcacacataaaaacaggattctgtagaagaccatggccaatggcaggcacatgacaaaatacgaaaattatgtctgataattcctaaggaaaagcctactacactttaataacttaaaaaagctctaggcagaaaatttagattaacgtcaacctgttttgtcagtaccaatagagatctgtcagaagtaaatataaatccatcctgcaagtttatacttaaaattgcctcaaagaattctcatagaaaaattccaatttagaggagcttacaaatttaaaaaccccaaaacacatcaggaaacaagttatcatcagtaggagctggcatgaacacaacaatttggtagaaataaagatatcagtatatactggtaagataatccactcactagaaagaaaaacaattctaaaatttatggcactagtaacatagcttcaaaagccaaattaataaaattataggagaaagtcactaatcttagaaatgcttcggaaaataccagatagcaaaacttaaacaaggccgataaagtggaacctagaaattaattaccttcttaccttagaaaagagaaaagaatgacataattgagccgagtatccaaatttagaacttaataaaaatacaacagaataagtgtcatagtgaaaacaaaaaaaagatacacttaaaaacagagattaatgtagaaaacaatgttagactagaagagaaaaataggagcccatgatttatttcttgaacaatgagagcaaaatcataaacttcaaaatttttccatgcgcacacacacacttaaaactgtaaaatgttatgtttaaagtgatattacatagcatattgattattaatctatacagatatacatctcccaaaactgaatgcacacttactgttattttgggggacctgcaaaaccgagttttgtttagaagacactggaatcataatttgaataaagtcgtattatttatatgacatagaaaactaaaacattaatttcttttgagttttcttacactctaaatccaaaattctatttgtctgtaatagaaaaattaaaaccaaacccatcttaggtttcttgctgcacacatttttgcaactcatctttaggaaaacgtacagataacacaagtttctaaatgcatagttcattgaaaataacaaagcattgtatttttgatattttaccttttatttcatttaccttgtggcaccaaatgggaagcatggtgcattttatgataattccactttgtaatactcctatatttatagcccatgctatataaactttctataaagcctacttcctctaatgctacatgagtttcaaaatatccatctaatacaatgcaattatatttcatcttattaataatacatgagatgatttcatcactcatgggatgataagggacaaaaaagcatgaaaggtatgtagtaaaatccactgagaaactacatttttgaataatgctcgaacaattccttttttatgaatttcatgatttataaagttgccattgaaattcaatagtgtaaaaaaggaactacgacaattagattactcaatattattttgtatcatttagaaaaatttttctagataaataacaaagcttagtatgaaacattcaataccatcaataattattttatatttgttaatatttaagcaaatgattatagagtgaaaacaacttgtagggaatacatgctttctttcctgtgttaaggtacaataccaggaagccataagtaaaatatatgtttcctttactttctgaaacttactataaatcacttacagtaatatgcttaaaatcaacattaaaatatagacaatttctacttttcgaagaaaggcagcaccacaaaatctttttgcatcacaaagaattgaagaagaacagtctggaaggtactggtaagagtgactcaaggagaggagagttctgtccattctctctagtgatgagaaagtcgtcttggggacagcttcatgggtatgcaaactgtacggagcataaagccatatgctcagaaagactatgcttcatttaatgttttgctgtggtagtcattacattcttaataatttttgaaaatagggccttgtattttcattctgcactgggcctcacaaatgatacagccattcttagctggcacttgaattctaatcacaattcttctacaactgtgtgtgaaaaagggataacttacattatttggtttcttatttaaaaatcacctaaatccactctagtaacttcctaaattctcctataactgtgattttccaaggttattttgtggacataaaatctgcatcagatttatttcatccctctatgttaatcatatgactcttttatcaacttgctagtagaacctggataaatgtaaattctaaaataagatatatatatatatgtaatatggctcttagcatttaaaaactgactcaaatagttttcctatttttcttatctttgaaaatcactttatagaaatgaataactgtgactctctaagctaaatgttatactttttttatattattgaaatacacatatgcatgcacacacacacacacaaacacacatacaaacaaaaactgtggtgtttttaaaagatggtttttcttttgaaagtgaattttttaatgttttaatttttcgtcaggtaatttttacagcattcaggagacagctgctataaggatttcttaggaactaaattatagcctgaaacaaaaattattatgctcaggaaaagtagacagaaagcaaaatgtcactaaaaaaaagagagaaaccaatattatctatatacgactaatcatgtgatgctctttttaaaggatccccacaagaataaaggaatatcaactaagtaaacgtcccaaatcaatgataactataaagaagagtcttataaattaaatattgaaatcctcaactaatggctgtggacgcaaacccaggagattttagtaaactatacatagcctatacatatacaatttaacaatgcttagaactttaggaaattatataagttcacaggagtatgctataataaaaaaactgtcctactgaagataaattcaaatgacagtgttgatgatctttaatgccaccctgatccatattatcctaagattttattaatgaagcaatggagaagaaagaaatgaacagtttagaaatcccttcttcttacttccactctttgtcttttttctttttttttgtttaagaatatatatatatatttttattattattattatactttgttttagggcacatgtgcaccatgtgcaggttagttacacatgtatacatgtgccatgctgctgtgctgcacccattaactcgtcatttagcattaggtatatcttccaaagctatccctcccccctccccccaccccacaacagtccccagagtgtgatgttcccctttctgtgtccgtgtgttctcattgttcaactcccacctatgagtgagaatatgcggtgtttggttttttgttcttgctatagtttactgagaatgatgatttccagtttcatccatgtccctacaaaggacatgaactcatcattttttatggctgcatagtattccatggtgtatatgtgccacattttcttaatccagtctatcatggttggacatttggcttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaatagtgtaaaagtgttcctatttctccacatcctctccagcacctgttgtttcctgactttttaatgattgtcattctaactggtgtgagatggtatctcattgtggttttgatttgcatttccctgatggccagagatggtgagcattttttcatgtgttttttgactgcataaatgtcttcttttgagaagtgtctgttcatgtcctttgcccactttttgatggggttgtttgtttttttcttgtaaatttgtttgagttcattgtagattctagatattagccctttgtcagatgagtaggttgctaaaattttctcccattttgtaggttgcctgttcactctgatggtagtttcttttgctgtgcagaagctcttgagtttaatgagatcccatttgtcaattttggcttttgttgccattgcttttggtgttttagacatgaagtccttgtccatgcctatgtcctgaatggtaacgcctaggttttcttctagggtttttaaggttttaggtctaaagtttacgtctttaatccatcttgaattaatttttgtagaaggtgtaaggaagggatccagtttcagctttctacatatggctagccagttttcccagcaagttctttgtcttttttctgacttatatttttttcttttcagactatctgatcttggccacaaatacatatcttcaaaaaaatacctacttgatcaataaatattttatactacttacatgcttaaaataaaaggtgatcacaagaaatacagaaaaaatgaacgatgcccactgaaaaattcacagtttgcttctccttttctaacttgataaaacttataagtaaattcttaagtagctatcactaactgtaaatgatttttaaaaacaataatgatagatataacaataaagagaataactactgtaaacaaatttttctaaataaaacagttgaatgcaaatatagtagtattgccaatattgccattattaaacaaaacactttacaaaacctgttacagctcatcattaacctaaggttccactggatttcctaggttcactctgtatcagtggtcatctgagttattcttatccttatgcagtgaaggcaaactctggctcacaagtaaaatctggccctctgcctgtttcataagtaagttttatcacaacccagccacattcatttaaatattgtctacttctgcttcctcagagatgagtggctgagttgagtagttgcaacatagaccacgtaaactaccaagactgaaatatttactaaccagccatttaaaaaggaaatttgctgcctactgctttatagccaaacatcttgaaaggaatgtttacatattatgtaccaatatttcttctactgttttgtaaatccattccaatcaggttttttccccaatacttcatggaaactgttttttttttaattttttttatgattataaatgaccccaaattgctaaaggcaaaggccaataagttcttaacttactgacctgtatcagcagcatttaacatagcagaccattttctccttaatgcaatttttcacttgctttccagggtgccactcttggatttctttgcacttctgggactgtttctctttaattatattttctagttgcctttgtttccctaatttcagaatttctgagtactcgaaagttcagtccctgaacctcttctttgttactaacactcatttatttggtgattgcatctagttccatggttttaaatattatctataaactgaaaagccatgcattttgtatctccatctcatctttccttagaaccagagatttatgtatccagctgcctcatggacattttcacttgaatgtctaataaagagctcaatctagatatccaaaagagaatacctgattcgtgcttttatctgaaaacctgatccttctgtcatcttctaccatgccagtaaaggcaactttgtccttccagttgcttaggccagtattgaaagcatcagccttaactgcactcctcatatttcacatcggcccatcaataaatcccactggcctttaaagtatacacagaatccgtctacttctcaccacctctaccactcacagcctggtctaaggcaccaccaattctcacttggattattatgatggttttataatttgtcaccctatttctgtccttttcctatttcagcaactttctaacaaagcaatcacagtaatgtcataactcacatctcatttaaatcttctgttcaaaactctacattttactaaaagtaagatggagattttaactgcagccaaaacaaacaaaaaccctgtaagcactggccattcattaactatctgatcttaactcctactctctctgtgcacaaccagcaccaaccacactgtcctctatgtcctgttccttggaaatttcagtcattctcacaccttaggagtatttttctcactggcccttctgcctaaataccctctctcaggtgtttctatgattctccccatcatttcattgtgatcttcttttgaatgtcatcttctcagtagtgttccctggtcaaactatctcaaaatctcaactctgtttgtcttgctttctccttttccttttccctcttctactttttctgctcagaactagtagtataaaatgcatttcatttttctattttattatttctctctacctctagaattaaaccacatgagggcatatatttatgtttatttagttaaccaatattaaatctagcatctataacataatttgctatgtaggagagaaacagtatttcttgaaagaatgaaagtattgtcttcggtaggaacactaagcaataattttcaaaagcatgtattcctctaataataattgattttatatcttccatattttctcagaaattgaataaaattttaaaaatgtggatttattaaggaatactttattattataataaaacaaaatattgcaggaattttcttaatatgttgacatacttttatgtatgtatttatgcacacaatatatgtatttatatacatatatatttattactttcctcactgaaatgggagaaaaaggaaaacacaagaaatgagaagggaaaagcaatatgaaaaagcaagacaaagtgagagagagttgaaattttacacaggttgactagggaagactactgagatgataacattcaagaaaatatcagaaggaaatgatgaggagaatcaaggaaacatatgagggaaaaccttctaggcagagggaggggcaagcaaaatgtcctgtgtatgtatatgcatacatgtgcatgtgtttttatgtatatttatataagtatgtacacagggatttatgtgtgtaaagtcggaaataaaatgcgttccatttcaacaacagtaaacaaagaaaaaactagaatttaatctccgaaaaaatctaaattaccaattcaatagaatgcagggccagaattcaaattcaagtcacgcagattctaatttcaagctcctcatttttattccattgtttgtttctattgtttatgtccattttgctaggcaggttcaaaagaaatgcacaaatattaagtcaaaaataagatcacgggatccttttcaagatggccgaccagacgcaccagggaagtgccactcccatggaaagaaacagggattttgactaagtcagcataattggagcagatcttcagagagaaaatgcagaatgtgaatggagaaagatgcaaatattgaacctgaagaaaaagaaagctgagaaccctgtgtaggatgcctgaacaccagggcttgttcctggccctgaaaagctcttggggaagaggtgagtgggactggggcactgcccactcttgctgtggacctatgggatcctagctgcagaggaccctcacatgtcccacagatatttgagctggcaggggtacctttctggagaacagagggagaggaggccttagcaggcgtggagctggggacctttgtgcacaggacagctccacggagcctggccataggtgcccatccctcagggcacccctctcccattgagaggctctgaccccagctgacattcattttcttcaaacatgtaaaatgatttaggataggaaacaagcatagaacacatgaaatttatatatttatctatatatatatatgtctgtgtctatgcatatatatgcatacatatgtctatatagtgcatctatgtgtatattatacatgtttatatacatttatatgagttttatgttatctacgtattacatactatatgtatataatatatacttttctaattgcagcaaacattgttcaggtaaaaggctctccaaacattctataaatagagtggtagtggttccttccaccttcattgcctttatagcaacacacaggtcattgaagcataatatgataatgatgagttctgaccacattaatggactaattcttaagcagaaggaatagcctactgcaatgaatattttattcacactcttggtgttaaagaacaattgcttaaagtcaatgaaatctcaaaataactatatatcaagtaaattatgatgtaaaactagtgtatgagaaaaatgtgtcttatctttagtaatcattccaagtctaaatgtgtggagaacaaaggctttccagtatttgaccctgaatgttgtgttctgctgtactatttagaggcaagggactggaaacaatgctaaagagaaagcaaggtggaaatacatgtatatgtacacatatatgtgtacatacataagtgtatatatgtgtatatatatatgtgttctaattatttttttcctatttctattgtgaagtcttttaagtataaaaattcagagagaataacatgatagcctctactgagctttcatggtatactgcaaaatcttaattaaactattgtattattatattaacttcaaatatttttaataaaatgaagcataaaatagacatgaaattcatattttgcacctcataaaagcttatttttcttctatatctgagagacaatcactatattgaaattcatttgtattattcagtttgatattaatataaataatcagagtgaatataaaataagaccaagcgtttctctttcacctacagattataaataaaagagttatcactaagtgatatatatatatgcatatttatttttatgaatacataatagttgtatatatttatgggatacatttgcattttaatataagcatataatgtttaatgattaaattagggtaagtggaatgtctaccaccttaaacatttatgatttctttgtgtcagaaacatttcagtttcactcttctatttatgttgaagcatgcaataaattattgtcaaccatagtcgccctatagtgctacttaatactagatcttattccttgtaactgtacttttgtaccattaacccccaccaacaccactttatcccatctccccactacatttcccagcctctagtggccatcattctactctctatctccatgaggtcaacttttttagctcccacatatgagtgagaacacacagtatttgtctttctgtgcttggcttatttcacttaacataatgctgtccaattccatccatggtgttgcaaatgacagaatttcatttttcatggctgaataatattccattgtgtatatagaccacctttactcattcctctgttgatagacacttaattccctactttgtctactgtgtagaatgttgcaataaacatgggaatgcagctatctctttgatatatttattttctttctttggatatataccaaggagtgaaattgctggatcatatggttgttataatcctagttttttgaggaaccgttttccttatgactatactaatttacattcccaccaacagtgtacaagtgattccctttctctgcatcctcggtagcatctgttattttttgtctttttcataaaacgattttaaatggggtggaatctacaaaaaataatcagaagcaagaagaatgagaataaaaataatgagaagcaaggggcacacaaattgataacaatgtgaaggcaaatttaatgaacattttttaaaaatcactattactaacacctacttctgtattaaatgaaaagtgaacttaattttggacaacgatatcaagggaaatagagaaggagtgttttctgagtagttactgaaagcatgaacaactcacagaacaccccatgtactaattaaaaagaagattgaaatatacaaaagatttagactttattagaataatgtgtggttatgaaattacttaaagatggaaaggcgattactaaaaaagtagatatgttacaataccttaaactcagcaaaaatatatagaaatataaaaatttgcttttttttcacttattaaagtaaaatattattaggtaaaattttatggccaggctcacgcctgtaatcccagcactttgggagaccaaggtgggcaaatcatgaggtcaggagatcgagaccatcctggctaacactgtgaaaccctgtctctactaaagacacaaaaaatttagccaggcgtggtggcacgcacctgtagtcccagctactcgggaggctgaggcaggagaatcacttgaacctgggagggaggcagaggttgcagtgagcagagattgtgccactgcattccagcctgggcaaaagagtgagactctgtctcaaaaaaaaaaaaaaatcatacgcgtgtgtgtgtgtatatgtgtaaatacatatatatatatctatatatatatatatataaaattagataggattttaaaatttcagttacatgacagacaaattatttaaaagttacacaggaagattaaaaataaaagagtagaaaaatgtcatatactttatgtaagtcatttaacaaaagctgtttatatatatttcaaaaaacaacattttagatggaaaatgctattatgatagaggcacagtattggttgaccaggaaaatatagcaattatgtgtttcccctggccacaaactcaaccaataaaaataaatttaaaattcacaattttgagaaattattaataactatgtatcagaaattgggagtataaatacagaatagattaataaatgtataaacaacttgaaaagtgacacaattagcaaacttgaatgaacatacaaacctgcaacaatatgatgttttgcataaggtaagttaattcagatataaacaataaaaagatggttaataaagcaaatatttacaatctgccaaatactgtctgtcacctgatgaaaagaggaaaaactagtatctagtataaatattattcaacaaatagcaaagaaagtattaaggtaaaaaacttatgagcttcacgaatcatgaaggcaaattctgattaattgaactttatcaaaattaaaatgtgttgttcatcaaaagacaccactgagatgttaaatattcaatccacagtctgcgaggaaatattttcaataagcttatccggcaaaagacatttaaaaagaacgtataaagagcacatacaagtaaataccaagagaaaaacaaatcaaataatataagtaaatttataataatgaaaatacctgaacaaacacttcaccaaagaagacatataaatagtcaataatctcaggaaaagaatgctcaacatctttactcaacaggattataaaaatgaaagccacagtaagattctatttgaatactgtttagaggagctttagaagtttagacagtttcaccgtaccaactactaaagaagatgtgtaaaaaatgaaaatactattcattgctgctgggaaattgaatggaaaaagtactttggaaaactgcttggcaatatcttatgaaatttaatataaatctatcttatgacccaacactttcactcttaggtatttcacaagagaaatgaaagcatgtacaataatgctttttttttttttgaggtggagtctcactctgttgcccaggctagagtgcagtggccagatctgagctcaccacaagctccgcctcccggattcacgccattctcctgcctgagcctcccgagtagctgggactacaggcgccctccaccacgcccggctaatttttgttgtatttttagtggagacggggttgcaccgtgtcagccaggatggtctcgatctcctgacctcgtgatccacccgcctcggcctcccaaagtgctgggcgtgagccaccgcgcccagccaataatgttctttttagcttcataatcgtcaaaaactgaaagaaattcatatgtccatcaacagaggaataagttatttgtgttatacacataatgaaatattactaagcaattaaaatgagtaaactatagacacatgcagcagcataagtgcacagtaaaaaatactctgaaacaaaagaagctagacacaaaagattacctacttgatgcgtccatttatatgaattcgaagactaggcaaaatgtatctacggtgataaaaatcagaaagttgttacttctgattggtgtccagaaagaagcaagatggaactttctggggtgataaatatgttcgaaactttgtatgtgtaggtatgtgcaatgtcaaaatgcatcgaagcaaacacttgaagtctgtgttttttaatttgtgataattttctctaaaaataaattaacaggacttaattgttgaaaaagcagaaaatgtataaccttaatacatttatttaaaggaagaaagaaaactaaagctttaagcattcatctcaaaatagaaaaaaaaaaaagtagaaccaaaagagtggaaagaaaaaaaaaacataataaagacaaaagccaaaattaatgcagtaaaaagcaaacaaaaatatctttgacaatgatcgtcaaataaacaaataatttgaaaagacttattaaccatggaaaaagacacgaaaatgaattatgaatagtaaaataatggagattttagtaaacatttgatatatgagaaaaataaatgatttttaccccataaacattaaaattctgataaggagaaatttctagaaaaatgtgtgatgaaaattgacacaaaaaatagaaaaatcatttatttatgtctcaatcagtatagaaaatcattagatcaaatttagcaatatgatattccatgccttatctgaaagagcttctcaaaagtgacaacaggctctaagaaattaaatggtcactaggggacacaatgaaacaaagttgaatgcgtgtggtgagtagcaaatacatcccaagttctaaagcaacagagcatgcttcaacttgagtgatgatcagttttagaagtaattttataggaagcatttgaatgttaaacattatcatgtaaatctgcctatgttcctttcatgcgaagtcaatgcccctgagtaaccttgtttagtgacctagttttaaaattactctttgtaatgtggtcactaggaattaagccttcaaggaaggaatccagtatttaaaattcatattaccatgtgacaaattgatctcccttaagaaacccattctatcaaaatgtaaactaatatgtcgagctgcttgaatacccacaccactaaagtcacacctttcttccaaggtgttatttctaatttgatttccccaatgcatgaagtaaccatgcccagtcacgacaacgcttaatgactgcccaccaaagccttggctgatccacacctatggaccacatgaatgaacctttcagtgtttattcttcaaacttgtatcatgctattgcggactgaagtgagtacccccaaaattcatacattgaaaccctaaacttcaataagactgtttttgaagacaggaccttttaaagaggtaattaaggttaaattaatttgtaaaggtgaggacttatttcaacacgactggtgtctttaaataaagaggaagagacatcagggatgaatgtgcagagaataggccatgtgaggacacagtgagaatacagccacctactagtcagtagagatgtctcaccaaccttgctggcaccttgatcttgcacttacagcatccagagcgttaaaaatcaatcaatcaatcaatcaatcaatcaatcaatctgttgtttaagtaacctagtctctagaaatttattatggcagcacttgaaaactgatacatatttatctgcaaaacagtgctacaaaacctaccattctggttaaaatatagtgccttttaagggaaggcatggtggctcacacctgtaatcctggcagtttaggaggacgaggcaggcagaccaattgaggtcaggatttcaggaccagcctggccaacatggtgaaaccccatctctactaaaaatacagaaattagccgggcatggtaggacagtcctctaatcccacctactgggtaggctacggcaggagaattgcttgaacccagtggggcggagattgcagtgagccgagatcgtgccagggcactagagcctgggtgacagactgagacagcgtctcaaaaaacaagcaaacaaaaaaaccatagtaacttttcagacaagtttagacccttggccatcatctcatcaagagaatcttgtctgctctcatcagtgggtgagaagttttctggagtgccgcacgaagctttatggtacaactggcacattctttatctgtttaatatattattgcttattcatttgagaaaaaatatagatatagagaaaaataaacagaacatttatggtgatattatcaccatacatacatttgtatgtatactggggtggagtgaggagacgggatatataaggataagcaaaaatcagtaaaatcgattagaatactaaagtgcaacctgctcttgtatgttctatttttttttcttatcctgaagtgtgtgctttgacaatacctcaagccctagcttgttatattacaatacgtgacaatgaactcagaagaagggaatcagaaacaacatacaaccctaaaagaatcctaagtatttaatatttgatctgctaacatcaggttctgcttgaagtgagagcacatggatgttcggaactgaaaactgtcactatgactctttttccagatctttattatgtcaccggggactggggccaacatgttcaccaaggcacctccattccctaggacttgtgcctatctcaacaaatctatgttaaattggaatgaaactgatgttaaaaacaattaataattacattttgcaatgaacaaaatgagaaagaatgctgtagcatctcacaccagttagaatggcgatcaataaaaagtcagggaacaagatgctggacaggatgtggagaaagaggaacaattttacgctgttggcaggagtgtaaattagttcaaccattgtggaagacagtgtggctattcctcaagaatctagaaccagaaataccatttgacccagcaaccccattactaggtatatacccaaaggatgataaataattctaccataaacacacatgcacaagtatgtttattgtggcactgttcataatagcaaaaacatggaactaacccaaatgcccatcaatgacagactggataaagaaaatgtggcacatatacaccatggaatattatgcagccataaaaaaggatgagttcatgtcctttgcagggacatggatgaagctggaaaccatcattctcagcaaactaacacaggaacagaaaaccaaacaccacatgttcccactcataagtgggagttgaacaatgagaacatgtggacacagggaggggaacatcacacactggggtctgtcagggggtggggggataggggagggagagtattaggagaaatacctgatgtagatgatgggttgataggtgcagcaaaccaccatggcacgtgtatacctaggtaacaaacctgcacgtactgcacatgtatcctacaacttaaagtataataaaaataatttttaaaaaaagaatgcgtgcctgtttaattcaacaatacttgtagaaatgtaatttcagtaatcatgttttaccacattttcttctcccttgctctgtgtgtatgcctcctcctaccttttcttctccagcattccatttcattgtacatatgacacattttgtaaagattacatattttaatttttgttcatttctgggtcaatctgttattaaattctacttcccaccaaatctctaagaccatttctttttctaaaatggttactcaatctgagtaccactttttctacaattttcctttccatgggatggtctccttaagctccccactcaaaacacctagcagatctctgacctattatcatgttaataaccttacatatctatcacaagactcttccagtcgataccattaatgtgaaatatgacactaatggagtattaaaggaaaccaggagttaaaaggaatctcaatcctaaccgtgattcaagtacaacttgttgagctttctctttagaaataatattgcttctgaagttagccttaatgctggaaaaaacactctattctttgattatttaagtgataacaggatctaggtccttttttattgccttctcactctctataactctcttctaacagctttaaaacacattccttataactctcttccaccagctttaaaacacatccctgcctgcagctcttatcttatcctttcaaggaatgacaggataccatccaccctgctaaggaggggtaatatctgggtgtggactctctgaccccagaggcctcctcacttccaactctttcgtttccactcattcttctctcggcacagaagctaagaaagaaaataaatgaatcaaaacagatgactggttctgtataaaagagagtggtggggaaaattattcaaaatgacctcaagttctctaagccctctgcatgttaggaagctggaaagcccagtcccacctgcagctgtcaggaacctgaatgctaagcccctcacactccactgcaggtgtaatcagcaaagcatggaaacatatgatgagaattagaagactgagctgctgttttcgtgaactgatgcagggattctgacaagttacttaacctttccgaataggtcttttccttcctaaaacgggggcaaccaatatgcacaagacagtgggcaacaggtacacaataagtgatagagaagtattttataaactacgacccgcttgaaactgcaattatctcttttgtctttaaaaaaaagacataactatgtaccacatcgtcttttataccaacagtataatgaatggcctggtaatgatgtcttagacatcatgttctaaaacacattttcaaagtattacctacaaaataagattcgcattgattatacattagtttatcatttaaaacatgtattaacctcgtgtttctgatgcgttttcatctggaactgtgctctcagggacgctcagggttctatcactcctagagacagtaaacgactcacctgtgagcatgacactgacaagtaaaacaatcaatccacagcccatatctcaaacagccccagctttcaaagggctctgacactttgagccactgcccaccttccctaactgccccagggccaggtaccccaggtatctagggacaatctaggcagctgcagatcccaccaaaagtattcagactacccagtcctaagcagcttttcctgttgaccttgtctcacccattcctttccatggaacaacaattgaggatctatatttccttctcattccctctgcctcctaaccaaccctagtacatccccatatggccctgcctgacatgctatgcctcttggttctagaaatcggtgcagacaaaaacttcttctttcccggcattcatgtccatatctgtgtcttatcatacctgattaaaacaaatttcagttaccctttaaatgaaagaagaaaaatccactactattaattctaatgaataattatcttccttgaatcttttcttgttaaatctgttcttgttttgtgagattttatatcttaaaataggctacatgaatcactgcacttgtaattacaacttgttgtcaaatatatttaaaagcatgtacatcaatgcagctatgctaacatgagggaaagatggggaatttaaataacagtcatacattttaaatggttccataagaagccacagacctcagggttaattttaactcagttgtaaaaggttgctacaaaatagaataaatcctaagcaattttaaggctttgaaaccacatttgttaatcgtatacccatgaatatcttattttgctcctctgagtagatacttgtctggatactcaatcaaagcaaagaataaacccatgttgaaaagacgttttatcctccactatcttcactccataaatcagttaatggagaagctgaactagttttctaaaccattgtgtttagcacttatgtaccttgaaaatgttttgacacaatcacggaaacagcaatcatggacgctgttaagatcaagaagtcagaggaggaactgcagggctctgacatatatttaggaactagaacagcaaatgatgaaatgcattgtgactctggcagctggccgaaaaagaatacgacaagattatattgtgttatcaagattaaattctaagaatgtaaatttagcataagatggtaggaagagaaaataagatatctacaaaattgtaataaaataagaacacatcattgaataataaatggtaagaaaactacagcaacaagaaatcagaatatttgaaactctaaatttaaaagaagttcaaagaagtgctatgatacaaattcacgcatttgccccgaaacttttataacaaagtttgtctttttataccttcaaagaagcaccgtaaaggtttagcaacccaaggaacttagtatttttgccacatttcatgaatatttgcccattagtctttttaaaatgcttcacgtatgtatagaatattgaaggaatattgaggaaacaataatcacttctctttatactaataatatgtgaaataaagagacaattccaatgtgctgtgtctatatcaccaccctctccaagcttcctctacattaagtgctcttgattgcatagtattaaacaagaaaagctgtctattattatttttaatggtaataagtaattccacccaaaagatagtattttttcatccttcactgttacaataaaaattgtatgtagtgggtatttaccttaatttaaaaaaaattaactgctaaacaattacataaaatattgataacgttagttttctcttgtttaacatggtatgggaatgggtattctgattcatcaaatgtttgattaataattgcttgttatctatgtagtggagtctcaacttcaaagtagtaagacaatgataagtaaacagtttattcaaataagtatgaagcatagaatacacaaagactgagtgcaggagtatcaatttcatgaatccccaaaaagacggtagcacataaaattttgattttgatgctttctcaggaggaaaattggtgcctagcacattacttgacccaaattattttgtgatggtcaatattaggtgtcaacttgattggattaaaggatgcctccatagctggtaaagtattgttctggggtgtgtctgtaagggaattgacagaggagattaatatttgagtcagtggactaggagaagaagacccactctcgatgtgggtgggcaccatccaattggccgccagcacggctaaaacaaagcaggtggaagaaggtgggataagctgatttactgagttttctggttttcatctttctcccatgctggatgcttcctgcccttgggcatcagacttcaggtttccaccctttggagtctcagacttacactagtggtttgctggggcctctcaggcctttggccacagactgatgcctgcactattggcttccctacttttgaggattttggactcagcctgagccactaatggcctcctacctcctcagcttgcagatggcctatagtgagacttcaccttgtgatcctgtgagtcaattctccttaataaactccctttcgtatatacatctgtcctgttacttcctccctctggagaatcctgactgatacatacctactaatattaatataaatatattagtataacatgtcatggacacacaaataatggaaaattgtagcttgtgctattagggaggccttgctgacaatcaaattgagtaggaatttagcagggttggaggcaccaagagcgagtaaagccattcctgactgagtgatcagtatgagcaaagacaccaagataaaagtctaccaaatattaagaaaattttgataagtgtaaatgagtatggagattgtaagcaggctgagacctaaagaaaatcacatcacaggatgtgatttctactctgcatttaagccctcatctaatgtctacagattatagactatcatacttggtgcttttggtaaatatttttccaaatcatgctccctgcttgaacctacttcattccagaaatatgaatatatgagccatgttttgtagaggttcatacagtaaaccaccttttgttcttctgatttcaaaatctcataaatcttagagccaacacagcaccagtttgtgtaactggatcatcatcacaattaagcaacataaattccctttaaatagtctgcaacataaattccctttaaataatctgcaacatttttttattagtcgttagttgttgcattctacattaaatgaaagaaagcatttgtttccagacatttcaaacgcaaactggctataaaatcaaaataaatggataaatgacttttattttattttattttcccataagttttgaggtgcaggtggtatttggttacatgagtaagttcttcagtggtgatttgtaagatcctggtgcacccatcacctgagcagtacacactacaccatatttgttgttttttattcctcacccccctcccactttcccgctcaagtccccagagtccattgtgtcattcttatgcctttgtgtcctcatagcttagctcccacatatcagtgagaatatacgatgtttggttttccattcctgagttacttcacctagaatcacagtctctaatcacattcaggtcattgcaaatgctattaattagttctttttttatggctgagtaaagaactaaaagtagtacaatctgatccagcaatcccactaccgggtatctacccagaaaagagaagtcattatacaaaaaagatacttgcacatgcatgtttatagcagcacaattcacaattgcaaaattgtggaaccaaaccaaatccacatcaatcaacaagtggataaagaaactctggtatatagatatatatattatataccagacatatagctatatatctatataacagtatatatctggtatataagatatatatctatataccagatacataagatttatatctatatactggatatataagatatatatatatctatataccagatatatatatcatacatatatatatatgtatgatgggataaatgatatttttctttgatggtagagggtttcttagtatcctatattgttgatcaataggattacagactaatattaattttataaagttattcttagaagtttagaagttctaatgaagcaaaaacctcagaatcacagacggtcaattggaagcaagctaatgtgacccatttttgattgaaatctagttaagttgtaccttttttattgtcactgagaatccaagtttcttaatttcaatcaatcctccttcaacagctaacattcacttcgtgcttatgtctcaagcactgtattaccttgttagggctgatataacaaaatggcactgagtgtgtggcttaagcattttctcaaatttattttctcataattctagaggctggaagtctaagatcaaggtattggcaggattgattccttctgaggcctctctccttggcttgtttgcagacggccatcctctgtctgttttcatatggccttctctccataactgtgtcttattttctcttatgaggacatcaggcatattggattcgagcctgtgctaatgacctcattttaacttaatcatctctttatagaaacttttttccaaacatggtcacatattgaggcactatgagttaggataacaacatatgattttaggtagaagagagtttatttcataaaaggtactgtactgaatagtttagatacattattttattctatattaaaagccaacctcttagatatagtttcatacatactttacagatgaagaaagtaagcaagataataaataatgatcccaagttcacacaggtagtgaggtagaaagctctcacatataaatcctggcgttcgcactttagtctccatactggtgacagccacacgatattgctcttgagacgacctcatcttctagatgaaagtgatcttatgcaaatttctttgggatctctactttatattacaaaaaatctctgttttcaacattatttcccatcatttatcttctttctaagggggaatcatcttatctaattgacaagattttacagcatgctagaattctcccctcttgtacagcctcagtatttttctttccacaagattttcctggttccctctccttcatcatgtgtgatctaaaccactctcaaagattctctttcccattccatttgttatcaaattacttttaaaaagtaaatgatataagccgctagctagacccaactgattaaaaaaagtttttaatttttcttcccccagtgaaacttggactaattaactaataaccctttctcagttagtcctcaataggagcagtgtacctagctcgtaaaatttcctctgcagttaccattctgatacaccactcttaagttttcctctgacatctcttatggttagcagcagtttacatgactttctaaagcccatttgggtttaatagactgagaatattttatttattaagattccttcagaggagtcatggtatcccaaggacatacaatggtaggtcatgaaagttggttgttaaactgcttgcaaaagaagataaccctactaactatgccgttgatattgttcctgtgagtctgaaaatgagagggagaacgggccgcaggacagggagtaagtggaaattggaacagcctgaattgctttgcctactgcagataagagactcccccaggtaggctctctctgggaggaagaacctacagttgtaaatttcaacaactatgattggtggctaaagggttgacaagggacctgaaagaatatacatgcattatcagggcttttaattgtgttagttgtggagtatagaatgtacccatattgatctgttcccctgaaaacatttaatacctatatgttgttaattactactgtgtatgtgtgtctgtgtgcgtgagagagagaatagttctttaggaaaattcaaagaggctctaatttttaaatctaggtggaaaataagatttaagagtcattatgataaagggctggttcatatctaaatacagcatctgcatataagacaattaaaaggggaaaaatcaaacatataaagacaagtttctagtatgccatccaatgtttcattaaataattcactgcatttattcatattcaataagattatctacatagagaaataaaattggaatccattaattatccacaaacttcatatgatttaaaagcacttttaggttacatacacacgtggatttaagattagttatccagattaccattttggaatatagagtttacatattctgtctctcttttttgttgaaatcaaaaattacccacacaccacaaaactctaaagcaaaattatttatggtctaaaactgaccagtattactcaattttaatgtaaattcttctttgttttgtattagtcttccttttagaaaactagtttatttctgtacagccatgaggtaataagtaacaaaatccttaaggatgatagtgattatattatttacaattaatcttcctcctaagagtcacaacgttaaaaggaaaggggaaaggacactttctaatgtgaacactatgcatattccagaaggaatacttatcatgctaggtcaacaggggcttccatttttatccaaagttctatcgcaatttctcatttaatttcactacagcaaaacctttccgtaccacccaccaaatagaggaggcgtaatttagttcttatataataaacaacatctgcatatggaaatggtctccctagctccttttgcaagcacatctataggccttattacaaagtcaacactttctttattctgtggggatggggtcaaaattggcagctaaaaacgtgaagcatataataataaaatgcataagtgattgtagctatcaagcattatataacttctagaggttactttcagcttgatcttagattctagagtcattgactttaatacatctcctggaaaaagataaaagtttattccaaatcaaatatctgagtatattaaagagcttacctttttaaccaagacagttggaatccttcaacttgctaattccagggaaggatcctcaagtgacttaacagtgaccttgactgtgctacaccaggacgggtttaccagcaatcacagattcatctgtaggtaggggtgtgtgtgtgtttttcctttcctttccttttataaccaaagttttacttcacaggctaccaaaggaataagataatgctgcctatcttagtggggccctgtggatggctcacaaacacatttggtaagttggcaaaataacgtactatgaatgtccactaatgatgtcccattgtttttaaatctccttctcagtgtggaactgcactaattaagagctgacataggcacaactcagtttcctgaggtgccacacagttcatattagtcaactctgtgctttctcagtcgtcctgggattgctggagtgcttatgccatatttcagatcacaaaggggaataaaattatctatttaatttgaggatcatctccccctttgcctggagttgatctgagtctttctcaccataatttctttaagttatctttgcaaaaaaacaggtagatgtaagggcaaacaccaagtcaggaatccatttatgtttaaacatacagttgttggaggtttcttcgccagcacccttaagatgacatggataactcaggataaagaaagaaaactattattctgcaacatataccatccatcagcataatctgccattaaaaataattggcacctttaattatgtacttatttcagacataaaacatttgacctcaaaagcaggtgagggaacaaaggttttcttgtaaaactgcagtaactagaaaaacagaaattaaaaccaggaatatatatgtctaaagcttgtgtatttaactatgaaggacggttgattcttaattgctttcttgttttcctgggagaggtgaggggatccttatcctatctcctgccctcccattaattcaccctgtattttggagcaataaccgtattaacataattgacatctacaaaaattaagcccatcttttagaccatcaaccaagaaataagtgactgattttactgtgtttgcatttacagtagatcctcacaaaggaagtatttaaagcctcttacacatatttttccattctatcctttctctcttctaaatagatgacacttttgtttgttttacgttttataacagataagcattaaatttttccaagtagttttaagcattttagcttctccataatataacatttatggtaataaaataagtatttacattcaaaacattaacaagctgttattttacagaactgctaaatgtataatctgaaaaatcataactgaaatgctttttatattattgtcaaaattggttggcaataaaccatactagcacaattaatgcaaaaatataaaatgtagatatttttctaaattgcttttccaaaagtatgtctgaaaggacaattaaatgtggtatttgaacaccatgaatcattaaataaattcaaagtattgcaagaaatatagatagacaattatgtcggtaaagcttaaatgatttaagaagtagaacagtatcaatatcaacttctcttttaataactcaatttaatcacaaaactttttcagaactgttccaactcccatataaacttaaggtggcaaaatttaaactattttaatattcccgtctgtttagtcctccatattgacaataaagcataattatttaaggcataattatttattgatttgtaattacaatagtaagaaaatgataactggagtatagtactgatttagagggaaaaaaaacctagatttcaccctataaatattcatatattctagacaagaaacatgagcctaaagtttatataccatgctaacaatccaaacttgcaattcaaataaaccatctgccgtcagtctaatgatccatctgtgcaggcatttaaacactgacaacacaggtgagcagttacaataaatttcatgaattaaaatacataagcacttatgcacgtgcacgcgcgctcacacacacacacacctcagcaactgacattagttttgtaaaattaacaactttaaaactcaacaaaaattcagtcttattgtgcacattgccttttcttagtctggcccatgtggagataaatatggaggaaaatttaagcacctatgccacccatttagtgagcaaagacaatttggagaaatcaagtcacatgccctctttacaatataggaaattcagggaactaagtgtaaacaagctgaattatctattcagtttacttggatctccatttaataaaattgtacctattgtatacatacgtacataacccagataatcttattcatccttagcaaaaattatagtacataaatttccagtgtacttaaggaaagggaagatgctcattgatacaaatactcctgagaatacaaaacactacttagccattagttttagtgtacaaacataaggaagaggttagaagcatttacatttcagctatgaatgtatgttacctgtatatttacactttacctttatcacaatgttgaatttctcactaaacctgcttagtaataggaataaatattcaaaagttactttccaagaaccaaggacctaaaaccttgagactcagtatgattttcataggaaactgcgtttgctacaatgtttgtaccatgagcatttaaattttctcactaatttgctgatcaccacttcactaatctgcttaattaactcaaatatcataaaagactgcgtggattttcttagagttaaaaaagtatgcacaatcagcacattctttaagaataaatttttctaaataaagtcatgattattaatatgttagtgaatgcccccaaattttaccattctatgctatagaattcctactttatagaccgtatcaaatgttatcattgatgatattcttattaatatattttacctttattactgaacatgaaaactatgtttacaaataaccatattttacctttattactgaacatgaaaactatatttacaaataaccatattgcttaagactgctcataagttcatgttttgaacagttttaaatattaaatcactaatggaatactgttttatatgaaataacttttcatatactgtgccctatagaaaagtaaaatgaatcagatttatttcctttttacattattttaaaatatgaagtaaatttttgttcttttattttgtaaagttaattgtagaatgggggaagaataaaatacttaagtttacttcagaatctatacataaagatacagtattgcataatttaatgcaataaaattgaaaatattttagaaaaagagtgaagatttcccctcagtttgctctcccccgcccgacacccatcaagtttattcagccatatcttgggcaaatatttttattctttttccgtcttgcaaaaagaaaaccagaaactaaagaataaaagtcctttagaaggaaagaagataattcaaaattatcatgctcatgtactaaaaaagtgaaaactatgaagatagaaaataatgacacagtgaaattcaatgatagattaaatcccgtggagaattccccatgtattttattctggggatccgaaaggacaggttttctttgcctgttgtttcataatcttttcctctagcaaatattgcctcttgaattctctcctacaggttttgcatgcctgaagaagaggctgagcccacagttacaggctgttgaatagccacagggttagatgttggcaagggtttcgtctcttttaggcttctcaaaaaatttaaaaaacaaacaaacaaacaaaaacacaattcttaaaaaccaccatagggagcataaagaaaatggaaaagagcagagataaagaaacagaggcattgttttctgcagactaagcctgctgagctacgtgcactgcacaatatttacttccctgctttcattgaaaacgccaaatgtgcctatattattctaaaaagtacagctgatccttctgtttgggccaacaggtctataggccagaacacattccaaagcttttcccttgaggctgtctgcccaaagccagataacatcttctatccatagggcttggtctgccttggtggatgtcatttggagaaatgcatccatatcaaaatttaccctggaccccattccaacttcctttttttctggagaagtaactgaatttatttagaaataaaatcagtatctctgtggaaggcttgttggatggagaaatgagaatactggatccacgtagaggtgtagttcatttgtatacaatggacaagaaaaatactttaacttggaactactggctcagagaaagcttaatagtaacacttgcagaatgactgaaaaaagggaatctgatttccctggtttaaaaatgttcaatgagagattattgctgaagaaatacctttcagtcattcatttattcattccacatggcaattatgtaccagcagggtaaagtgaaaagaggcaatacaaaggttttcctcagggactatcgtcttctcttctccatccagcttttcattttataacagctttttatcatactgaattaaaacattgtgttcagatccatcattctgactagactgatatctccttgaaggaatgttttacttgtcatcattatgaccctaacacttagctctccaataacaatttcaaagactggatatttactctgtataacgtaaatgtattatttcatcaacaatttttcatcctctccttccatttattttccctgactgtaagtttcagtttcactgtgtctctacctgcacttttagcatttctctttcgctgtgcaacatcacttcattttctgttgatgattttaacactactgtgtgtgtgtgtgttgaatcagaaaacacatgtgttagttgccacccccatcttaacccacactctgagatatgtccaaggtgccaaatgcatggcagtcactactaagatttcagtgggtcaacctaagtcttttggaagctagatctgtataatacatattgatctgttgccaggagccttgtggaaattccaaagagatgatataggatcaaaatatttttccttagccaggaatggtggtgcatgccttagtcccatctactctggaggttgaggtgggaggatgcttgagcccaggagtttgaggctgcagtgatctatgatcgtgctactgtaccaggtgacagagtgagaccctgactctaaatacacacatacataatatatgtagacatatgtgtgcctgtgtatgtatgtacatatatacacacacacatatatatatacacacatacatatacgtatctatatacatacatgccatatatatatatggtatgaaatttaaccgagctacaagaagaaatgacccaggggaggggcatggggaaagaggaaaaatctgttcccatcaacagttttctggacattgatacaaccaagtagggaatttagtatattatttttatataacaaatttagtctttcacactcttggaagttctgaaaactccttcaggaaataacccaaacagatttttttttaaaagacttatgcttacattttaaattttatcagtttcaattatttcttagagttgtaagttacagataagtgcaataacaattattattctcttgttttcttacaaacaataaattatacagtaaaagattatatatttagaaattatttttgttttaatatgtttgttaccattttccataaatatcgatctataaatatatttgtacagcatccaacccacaaggtcattagcataatagatattaaatataacaaggcattcaaacgtagagatttaaaaaaatgggaactgaatgtcagtggaatttttaaaaaacctgctttttattccatttgttctttaaaaattttatacacaagatttttcacgttccacattgcgtaagtttcacacattttcttaagtctttactttttcataatatgaataaaatcagaaatacctgaatatgctcaactaataataatagacaagtccactattgcatttagtagtaaaaaacaatatagcatttcagtataagttggaggtgcttagtatccacattataaattgagataaaatcagtatttatattcatatttcctcattcactctctcccctcccactctctatctcaggatgtgtaaataaaataaataaacctggcataagaatgggaaatattaaaacatttctagcacaaaggacagatattcaatttattacacactaaagagaaaagatactacacttgccaaagaaatctaacctcaattatcacaaaagtcatcatgattatatggtgactcctaagtctctaaacacaaccccttaaatgtaaaatagaacattggggttttttgtgtgtttgtgtgtataccaaacagtatttttgtaaaagataagtagtctcttttgaaatgaattcaatgtatacagacgtaatgttttttaacataagcatctttcaactgtatgtcctactttattgattccaatgctccactgtgatttatttatggaaatttacatggaatgggttcaaagatatttgaagcattcatacctgatacagtttattctctacagggagtagcagttttcctgggaacaaattatgcactgaatttaatgctcattttcacttttgatgtgtttcttttaagagtgctatttcaattggggtaagattgtatattatgtttcactcttacggttaggattattttctgttcagctgaagatactccacttgggagccactcattccacccacattgtcaatgaagcaccgtgttaggaccacagacacctgaccacagtcagaggtgctgagtcgtgtgtgaatacccatctcgtctcctgtccccaggatgtctaaacttgtagcctgagagtacatctagccgccctcaacacaacacagtggctgaagctttaagatttaaaaatctggagttactggtggcctggccatatttcagccatagcaacctgcaacaatacggtgacaaaaccaacgtccagagagaagcaaattaaaccatacacagaattctaacacatatacttatatccgtgcacatgccattactattttttgaatgcacgtaaaaagttttgtgattatcaacaagaaaaatccaattttaaagtatttttgtattaataatttgttataatttttttcagatgaaaaccattaaaatgacatattctgcaatgttgtacctggtacagggaaagggtacaaggcattattattattattattattattattattatgtgtgtgtgtatttgtgtgtgtgtgtgtgtgtgtgtgtgtgagactgagtctcattctgtcccaggctggagtgcagtggtgccatctctgctcgctgcaacctccacctcccacgttcaatcgattctcctgcctcagtctccttagtagctgagattacaggcacccaccaccacaactgactaattttttttttttttttttgtatttttagtaggaacagagtttcgccatgttggccaggctagtcttgaactcctgaactcaggtgattcacccacctcggccacaaggcactttttgatgctcaaatattataatcatgtttttaaaatgaaaactaatgacaaagacttcccatgactcttatctccaaaaggtacgtggcatgtaagaatcacatacgcttctcaaaggcttcccgtgtgtccaagcttcatgaatattaagttaattgtattaagctcttctaatatatcactgtgctgaggtttttacatatatttagtgcccacaacaacgttttgagatagtactaattatcttcatgttacagttgaagaatttgaatttacagtgaaagaattcagacccaagttggcagaattcaatgcccatgcttttaactattatactatctcaaaattatttacctagtgaggcaatatggtggcatgaatgggcaagcaaacaaatagtttcatcctgacttctatcctttaggttgtaataaattggaccaaaatcttcgaatgtcagagcaagaattttgccccaggtattccccatgcttatttactgtgacaccataaggactcccttacaaaatatgactctgctttttaaatacagccccagaaatgcattggaatatttcggcatgtttctctgccagaaaaatatataacggagctttacaaaacagatttttggaaaaagctaaaagggagcaagagagatctgatttcttcatagatgaatcatgaaggaatcatctatgaataagaaatgtgaacaaattaaatggctatacatcaaaatagtgcatgttgaacactagaaataaaataaattatagtatccattttactgagcaattatcatgtgcctggtattatatggtgttacaatcctgacatgttttattaatacattccttgtaacagcttatgtggtaggtagtgttcttttccctattttacaaatggtttaatggagactaaggtagattaaatgattttctgagttttaggaaatatacatatttataatcatatgtacatttatattctcatatatataaattttggttagcttttatatacaaaaataaggttgactaattttcatccaatttctatctaatgaattctaataggttagctcattaagtgaattaatcttctattcatattaagtaatattcaattttcaaaaaaatgctcatcccataaaactgagattatatttataattaccaaataagcaagataaacctaacctgatttattatttttatttgatttactttatcactggactggtgatgtttggaccaaaatgatccacactatatcaagttagaatggccgccagagttccctgctctgtttcccagaaaccgaatgctcaacatgatgaagtcattttttgaataccaaacagaaatagtcccaaactcatcaccccaggttctagaacgaacattccactgatgtgtgtggggatgcgtgtacatgcttgggtctagcttttggtcaaactacatcatgtaatataataaatctaggattcctgttagcagagaactatcaggatacaagtatttcatttggaattctgtcttatgttactgcagtaccaaatatttgttgattttgttgatgatagtggtctattctgggacatttttcaaaagcaaggcccaaattcaagtaatttactagattaattaattacctatggttaggagaattgttaccatagcaaagaaatatacacatacaaaataactcaaatgcagtaagtttttttttaaatcagtcaggattcagaatgagtaaaactaagatttttactttgtttgcctaaagtctgtgatcctgcctccactggaagacggaatttttaaaaattaactaaacacattttatccttgaaatctcaacataagtaacactatttaaacccagaatgtcaaactgaaagaatattatgtacaaaaaataaaagatatacactgcattgttgaaccaaattgtaaaatttaaacataataaattacactataaaagttgatcattcaaactctccgttagaagatcaaaatgacaaataggtagaaataccatacaaagctggggcaccttaagattatttcttggtcttaatagtccaaattaataatccaagtgtctattttagtaagtggttatatatgaagccttttgaattaaggttaaaggagaacatatcccatctgtggggaagaaacataagcagatggaaacaagataagctaaagagattactttcctgttacctgtcctgagacttaggacccaagcaggatttaacaagtagtttttaatgttgggatggcatctaaaggttttatgacattaaagattcacagaaacatttttaatggaggtaatatacaaaataaatcatttaaaatatagtaaagtaggagaactgaataattttcactttgcaagcataggaagggacaatttttcctcccatttctgccttaataggtagaaaaatctaagagttttctaaggaaggaaggagagagctgtctttatgtgtcacttttattatcatggaagatatcaggcattaattttcttaccattgtagaataattttaaacatgtaggttccaagaatgatatggtgtttttttaaagcctttaaaacacattaaacatgaaagaagacaggcaattcagagacattatgatacaaaatgaataaaagctgatcagatatgaactagaatatttgaagcactgtgaacgatgacatgtctgggtatgcatgactaatcaagttggcttcgtttatttaaatccagaaaaattacttccgtacaaagcaaaatagttttgcgaaatgcatattactgtgcctattcaggtttgtgatttggtaactgaattctccttttatctttcagtctcttttgtatgaataaaacagattgtgactaattgaaaacggtagtcagaaagcaatcaggctgacatggttaataacaggctgttcaattgaagcattgttatgaaccaaatgaaaactacatttctttgctaaatatgaaatctgctattgctatcatatgtacaactctttttaaattggatgtaaaagtaagaaaaatcacagattccaagatatctttcttagatgttagcctatttttaagtatatgcattttcaatttattattaatatatttttatatcttgtttaaatcaggaatatagttcgtaagcacatcagtgataaagatagacacagtctctctgaccagtttaatgaatcagcaaatgatacatgttctctacaagaaaagttggaatcagttacttcctaatgcagccactacacacttagaatggaatcagtggtaggatccattaggggaaaacattatctagtccattcattagtaggatctagagtatttataccatatgacatcttatctaccttctgatcaaaaacacatagacagttacttaatagatactgaacacaatgttaaaataccataataaaggccatgaaaaggattataatttaatggatataatatatacaacatttacacatcatatgtattaggaaccagaatactgtatttttatttccacagattgaagtcatttaatgcatgagattgcctgaaaagagaggctggttttaatacgggcctagcatttaaaacctgagaggatttgcctcccgagtagctgtgactacaggtacctgccaccatgcccggctaattttttgtatttttagtagaaatgaggtttcaccatgttagccaggatggtcttgatttcctgacctcgtgatctgcccacctcggcctcccaaagtgctaggattacaggttgtgagccactgcacccggccatgaacccgggaggcagagcttgcactgagccaaaatcgcgccactgcactccagcttgggctacagagtgagactccgactcaagaaaaacaaaaacaaacaaaaaaaaaaaacaccttagaggatttgaggacagacacaatggaactattgtcaacattgttgctacaaagaaaagggaaagtgaagagagaattcaaccacaaagaagggtaaagatgagaaaactatttagcaacagagccaaaataccgaaaacaaaagaaaacaaaacaaaaaagccaaaaaaaaaaaaaaaaaaaatcatacccttcctctggactttacatttccttgcatcattaaatctcctttactatttaaactggttttcgcagggttttctcttatttgcagctgaacgtttcctgtgttaatcattagaacgcatttatcaagtgttatttccactagctatttattatgtttataaatgcaattagaaatatctcttaagctgcttgatcacatctctgcaaagccagccctaggtctaacaaaaatgtttccagttcaaaaatatccttttattttgcttgggccaatttgagttaaatttactgcatttcattattctctttttatttaaatcaaaattaccatctcaatctattgtaataattggtttattcattatctagcccaattggtctataagctctgtgacagtacgcactctcctgtacatcaccatattgctggcaactaaaatactcccttggtctataggagatacttgaaaaatatttgcaaaataaatgaactagtaaaatgtatcatatctctagaaaatgtgcaagaaggcagaatgaattctagaaattgtatggcagtttggaaagaaagcaaaagaaaaaagaaactattatcacaaacatgatagattagctgaacctcaaaatgatttaaattatactggggagatgatgctttagatctattggaaaaacagcttatgccaaagaattaaaaacacacagaatcatcaaagcactatctgtgtttgagataaatgatagtctgagtcacctatgtaagaagtaactctgaaatagtaggatagtattatcatttcctgtaatagattcacctctcagcaattggtctgttttcattctatggaaactctccgtactgtaattttcattctatggaaactccccatactgtaattggacagttttggtttccacaccagctatcatcagtcttggaggcaaatatgtgggctaatctcacgtgcatttctataataatgggctctatccttagcctgatacttggcctgtttcttccccaccattatctctctgtcttacggagctaaattaacacacttttctctaaaattttagattcataaatttctctattatcaaataatgtacttcaagggatccaattccattctccctgccccacaggttcaaacttatatgttaaataacatatttatctaaggatgcacacttttaaacaaatatctcatcttcggccaggttttattaacaacaacataaaaacaatgggacttactgtgtattatgtgtaagagatgtgttgctatagcattgaagaagaaaatttttcaaatatgcataagcaacatacattgctggcattttctcacttctgaagtgtctcaaggccttcctttgtgcaattcccctttaagataagtctgattcctggatatcatgctccacttcctcagaggaggcatggtctggaccacaaaaattacagaatatcatattgagttgcagtcttagttagtgtaacatcagaatggttgtacaattttagtgactttcttctcatgatacaaagtggcaaagtataaaggactcattctgtgagctctttcccttgatctcagttgcccatacatgacagccaaatctggaattattattctggatggagaagcccagggtggacaactttcactagctgcaatcatgcaatcacctgccccagtacttgagttgctgtggtagcagaagaccataggcaaaactgtactgcctttgcctacaaacgtatagctctaacattctgctttagtctttaaatatgaaataaataaagtggactttacctactgtttcaattcagggctatctcatataggaaaaaaaaagtttgttgctttgtttgtttttaataagcccatgtcaacagagttctgcattgagttttggagctaaagtccagacaaatttgactttcagcttgtccttgatgttgacatatatttaggggacctcaaaaaagaagagtaatggaggccaatggtttaaatctgattactcttataacacttggaaatatatattacctttagataaccctcatgttctactatttgaaaccgtaggcctcaaagaagactacaaagattaacctacttagaattgcagtcttccctttctcagcatcatcatgcctgatcccttcaacctctctctgtttttcttcttttccatagtagatactacactctaacatgccatataataagcatttttgtatgtggacatatgtatatgtgttatataatatttattgcttattattgcttcttgtctattcatctctctgcccattacatttaagcttcatgaaagcaactttcatttacacatatattataggaatccagaatagtggctggtacattataggtacccaataaatagctgtagaagaattgtagaatagcatttgaactacatttctataattgcagaataaataatggttacatttaagaaatttgcacttataaacctcagtaatatggtgcatctctcaatatagtttgtttttgttttgacacatagtcttaatttgtcacctaggctggagtgcagtggtataacctcggttcactgcaaccttcctgggctcaagcaatcctcatgccttgagtaggtgggactgaaggcaagtcccaagtagctgggactataggtgtgcaccaccacacccagcttattattttttctttctatttatttgtagagacggcgtttcaccattttgcccagaatggtctcaattcctgagctcaagcgatcctcccaccttggcctcccaaagttctaggattacaggcatcagacactgcacctggcctggatttctcaacatagttttaatggtagtttttaggtttcaatgtcttattcatgttgtttattcacaatacatttatgaatatatattttttctgtaatttttttaccttgtctcacttgttttaagtcttgaccactttaaaaaaatctttctttggatggattcagtataatagaattcaaattcttgtttgatttttttaaaaaaaaacagcatttgtttgctgtttgtttgcggctgtagttttgttgatctctactgagtattgattttcacattaaaatgcactttctatttgttgttattgaacacattagcaaacaaactgacttagaggaacataaatccaaatgaacaattaaggagctctactaatgggcttttttaagtgtcagctggtttttcataaaacgcgggaaaactcccttgtctactcacgataaggaaatacaaaggagcagtattttataattgtctatgatagtcttcttttaataagctcttaacaacaacttttaaaccctcaatttctgtgagtaatgacctttgataagcttttattcatgagtaagtgacatgaccatgctggaaaatatatacaaagaggtaatctggtgtagaattagatatacatatacacttctatggctggcccatgatctttattggtaaatatcacctccactaaaggctgtgctaagtgccctgattgctcataactgtgatgaatgctttataaataaaactgtagatgcagcccatgtcctctacagactttcatgtaaaacaggcactatgccatatacaggacatagataacaaacaagaaactaaaaaaaaagtaaaaataaaaaataaaaaactatacattgaatgaaatcagaataagttcacttcagtgcattaagactagactcaagataaatacataaatatgtagttcataggaaattaccacataaattataagatattttactaagaagagtgaaaaaacaaactgtgcctcgccactcataagggatcttctcatggtcagatttcagcagctatttaaatggtggaagccaacaatattgtagagaaataaaggataggctgggttatgacaggcatataggactcaattaggaatattttcagtagaagtaaatttttttttttttttttttgagacagagtcttgctctgtttccagctgggagtgcaatggaactatattggctcaccacaatctccgcctcccacgttcaagcgatcctcctgcctcagcctcctgagtagctgggattataggcatgcaccaccatgcacggctaattttgtatttttagtagagatggggtttctccatgttggtcaggctggtctcaaactcccgacctcaggtgatccgcccatctgggcctcccaaagtggtgggattacaggcttgagccaccacgcccagcgggaagtaacaatttttgtttcttgttcccttttcccacagtactctgcagatgactctaatatgtttcaaactctaacatcattatgagtttgcatttctatctcctgcaaaagaatacaagctcctcaaacataacaggcgtgcttctaattcatttgtttttttgttggaggctacataacttttggtctgcatatactagttgatcagtaaatggtgataaaatacatattttgcattaaaaaatattaaacctattgaaacaaatgggagaagacattattaatacaattgtacaaacattgaggagatatatctaggattgttctgatgtcagtgttatttaatgaaatctcacaagttatgaaaagccaacagtaaagagtatcacagtggtaagtatcacactctaacgaaatgaaagaacaaatggtgctattataatcttgtaaaaacggcagaatacttgctttgtttgtttgagatctggaataaccacaagtcccaatcacgtctgaatttttcctctcctgaacttacttcaccttccccaccaatatgtcaactttttctttttttttgagacaaactcttggtctgtcacctaggctggagtgcaatggcacgatctcagcccactgcaacctcagcctaccaggttcaagcatttctcctgcctcagcctccctagtagctgggattacaggtgcctgccaccacacccagctaatgtttgtattcttagtagagatggggtttcactatgttggccaggctggactcgaacccctgacttcaggtgatccatccgcctcagcctcccaaagcactgggactgcaggcgtgagccaccgtgcccagctttcaactgtctttttaactttagcttttctctagccagacgctgccacctttctcaggtactgtgtgggctgcccagctgtctgaagcaggagtactgatagaaccactaccgatgcctctttgtcctctctaactatacctaagagttcagagaatagaaacctcagagcagtctagactcctgcaacagaaatctttccttaaaaccaaactatggttgcctggtacataaaaaggaggcagaaataacttgccagatcaagttgttctgagtaccgggtagcatgatagagaaaagaaacaactctttcggtttcacagcaactctagccatccttatcacaaagaattgaccttccaaatcgaatcagaacctaaaaataaatattactttgttaataaaccttaagcttcccaacaagggatgacagatttgattttactatcattttacgtaaatatttgcccatactttcatgacctatcaagtgaatggtaactataaaatggaaactacaattgcataagcaaagacaatatactgtcttatactaacgcctttaaatgtgttaaatagtttcatcttaattctcccaataactctatgagatatgtataagcatgttatgcatatatgtatatacccatgtatatacacatacatccatgtatatacataaatatataaaatattatacccatttccagtaactttttaaaatttttcctacatgattatttattgtagctatatttttacttacacagctgataaagtacaatgatatttctctccttatgcacatattcaaagatacaagctgtccagaaacatatgcaatctcatctgcctggtttacaaatccagtgttgtcgaattcacatcaagatcttctattaagttcttcctggatggtgcatataagagtgagggtgacaggcatggtgctttatctctcacattcttttccctgaactttacaattgcagatattcctcaattcagtcattaatactgatttttttttaaccaagtcagcttcttttttcatcaatttataatttcatcgttcttccctctcctccaataatttcctggcataagacaattactgttagaagctacagactaacattcgaattggtttctaattagaagttgaatcattcctgagaaatctgggacaccgatcaaagtgtgaaattctatattaaaaattcagtgccttggatattacacaatgctgtcggtgttaagttttgcctcacacagtaaaacttgtgattggtgcacagtcaaataatatttcaaataactacattaaagcgaaattatttaccatttatttctttattttcttaaaattctttacagtaggccgagtgcggtggctcacgcctataattccagcactttgggaggccgaggcgggtggatcacctgaggtcaggagttcaagaccagcctgatcaacatgaagaaaccctgtctctactaaaaatacaaaattaactgggtgtagcattatgtgcctgtcatctcagctacttgggaggctgaggcaggagaatcagttgaacccaggaggcagaggttgcagtgagccaagatcaggccattgcactccagcctgggcaacaggagtgaaactccatctcaaaaaaaaaaaaaaaaattctttacagtcaaattccaagtaatatttcagtaacttaaaatgcaactgtatggggaaagtgtgcagctgttaggatgcaatatatttataaatactgacaactaagaagcttccagaaagtataattctatttatattacgaaaacacaatttacatctatgcatgtatattactctccctatgtaaatagacagtaaattttctgggaagatttcataccagagaaactaggatattgctgagaagaaaattggagacaaggagaaggaaacattcaccttttatctgattttttaaaaatagttttagcctcaacaaaaaaaaaaatgttattttttggtttgaggttgttttctcaaactttaattcttaaagcttcattttccattgtaggtagtctcaaaaacttaaccacaacacatttaatatttttgtacacttttggaaagacaacttattccagaaaatatcaaaagatcattaaaagttcacagaatgcttttctacatgacatggagtaaacagtctctaatgatttcttggttagatacgctattaagattcatagagagtctattactggacttgattaccttttgtatcatactgacagatctacagctgccatgacagtatttcagctcacaggtacccatggccaattagtcccttatgaattggaccagagttagccagttgtgacagctttggaagtgtgttcagctctccttgataaaggacaccacaatatttaaactcgtattagtgagtgtctgtgatggtgccttcacacaactagatcagggctactttaaaaggaggaaagattaaaacttcaccatgtggcccaggttccaggatcaacagaacactgccattactaaaacttggctctgggacaaatttcttttttatttaaaaacttgaaattgtaaagatttttctaaggaaaacatttagctattgagtggtgttttaaaagttaataacagagtgttaggtctattctaaatgcacaattcctctaactaacccaccacccgccccatgatgagcactgctctcaaattgagcacgggttccacagttatgcgtttcaacatttcatacttaattatgtaaataaatgactatgcccggaaataattatatcacctgtgattctttctagttttaccaaatagccaaagcccaatgaaaacaaggtaatcccttcgtagcctttaacaaccactaagtaaatgaagaagaaaatcattacacaacaccgttttataaataattcatggatgctatcagttaacaatccgatggaagaactgccatttgatgaggacttgtgggaatttaaattgttgctaatcaatgaaaatcataaaagtatccaccctctttgtacagccagattgggggaaaatatatatctttaaattcgtttgtctgccttaataaaccaatatattggaatttaaatattacttaacaaaaaatgtatgcatgtattttataaccatgtaaaatacggcatgtaaccctcatttaacttttgcagtgtacaactggcaacttatttttacagtttaaagtgaatcattaaaaatttacctctgcagctaattcaaatttcaataaaatcttgacaactctcctatattctgtgaaaagaacactggataaatatcctctaaaaatacatagcaagctaacagttattcagtctatttcttcacagaaattatctctaatgttgcaatatctgggccctacttatactaaaaagtttatttgttgttcatttgaaattctaaattaattgagggccctgtttcctttttcatgtgtgtgaaatatagtagtctgaatcatctcagttaactggcaaaggtctcagaagctcaaggtatatttgggtgaatgtgggttcaaagttttgttaaactgttggatgtcagatgtaggtcagaagaagcggtggtggggatttcgaagataagttgcaacacaatccaatcatgaatataaagctattattttcacagagtaatgccctaatcatcaagttttatccattaatgtaattagtataattaaagataattattctgtcacagtgctttcacggtcttcgctaattcaaatatataattgcattaattttggtcagatggaaaacgaggattgaaaaattcacaataaattcctctaacaaagcacatttctgaaaagtacatatgtgagatccttaaatattatattaaaatgttcccagttgatatgtcatattgatattcaaaataatgctgagctactcgctaaggatactacaatatttactaaactctagaaaacaaactttattttcttggaaaacaaaacaatggaaaacaaagcagtcttcctcaaaccaatggaaaactcctgtgtctcattttgatctacctgtagactctcaagattaattgtacatgtttctattattattattattattttatttatttatttatttattttttttttgagagggagtctctccctgtcgcccagactggagtgcagcagcgtggctcactgccacctcctcctcttacctcccggattcgaacaattcagcttcaggagattagctgggattaccggtatgcgccgccacacctggctaatttttgtatttttagtagagacagagtttcaccatgttggccagtatagtacaaactcctgaactcaagtgatccacccacttcggcctccaaaactgctgggattacaggtgtgaaggtgtgagccatcacatccggccctgaattgcagatgtttctaatctagataagttttgaactcccaagggctagaatttccatcagtagattgtcctgaggaaaccacctttccaagtgcgtagagtcagaactgcaccaatttctctaacatatgagtctcatgctaacacagggttcagtaaactgaactacacaatggaaagtttttctcaggtgacagtaggtgttgtgaatgaatagcaaattgagacagatgccacattgacatggaactctgaaagcccctttttttccaaaatggaagcgttctatctacttctaatagagattgcatgaacatttatacatactgaatattcatttcttttgagtattgaaaaatagctgggattaaatcctgtgagtgaaatttaactatgggatatggagtcatgaataaatctccatgaacctcaaatctccatggacctcaaaacagtaaaatctacagagtagtccattacaaaatgagacagaaaggacataggatcacatccttatactgccacttactagtagtgtactttggcaaatcattcaatctcactaagcctcagcttcctcatatgtgaaatggaaataataattcccactttacaggtttgctgtgaggtaaaggggttaatttatgtgaagtaattagcacagcgcccaacatatagtaagtactgaatgaatagggaggtttattacacaaaattgctgagagctttgttaattgaaaacaaatgaaatcaaattctataactagctcttggtctcatcataaattcaaagcaaaatgacaacatgaaaaaaatcttcaggaaatttctatcctatgatttgttgaactttatcttttttctgtcttctacagtgtatatgtttatttgctggacaaacaagcattcagttcacgttgatctttttataaataatgaaatacatgaagaagtattgggcaagcaaacattagtgggctttgcaaagagatatctctgtcttcaaatgatcagttagtataacaagatagaaagagcatagggtttggagttagataattttacatttaaatttcatctttggcattattagttgtatgaacttagaaaatttgctgaatcagtctgaacttcagcaccctgacttataaagcagaattaacatctaagttgtagcttagtacataaatatcatacgtccaacacaataagaattaaaaataaaaacaacaatcaatatttttaaaaatttgtttgttgctggtgtttcctaagttctttaaaatgtgttgtatatgtctggttgccctctatagtcagatactggttaaaatagtctcagagactggcctgtcaagttcttaggaaatccctgagatttccctttctaggagcgtcttatattattgcaagcttgtgagatactgttcattgcagccacactttacaccaaaaagcagttcagtgttttttcattttaatacggtggacaaagcccattctccaggattactgaaacaagccacagagtccaaaatctctcacatctgctcacttacaagcataatttaatccattgtctcttcttcaaactccatctctgcgccctacaactgttgttatcttagcatgtctctttatccaggtagccaagcactggatgtttcttagctctttgagtatctgcataggagacactttattatcgaaagtgtctttattattcaaaaaattttgaaaaataatctcgaactccagttaaacttggaaaagtttacgtaatgatcatgtaagtctacaaaacattagtgagcccctggagatatgataataccatagaggaggtaggaagaaaacccaatgatggcttaatatctatctacaataagtaacagtttaaccatgaaagagttacttgttaatatcatatagccttagttctacatagcctctgcaaagaagtcttcaactatattgaagatattttgtatattataagtgaataaggacacagatagttaggaactatgagtttctctatgggagcaaaaagacacacctactggatggaggaaacgagaaggaactgtgtgatgttggatttgacttgcggtaatcaagtagttatgggtacacctggtgttcagatgggagtttctaaatgctattccctatcaagttccttggagaaatggctgatgccatgtctggcagggaaagtataagaacagcattttattttgtcaggaaaaaaggaaatgcttcaagactaatgggaacatatcaaaaaggacaaaggagccacttcaaagagtttgtcctagacaaagagactgagatttttgtaaaaaagcacttattcacagaaatatgtcagataatgaatgtagatatgttagaacttttaaaatcaccctttggaaagccccaattaactcagacaaaaaccctaatagattgatgcaagaaaggactgatacacgatcttaaagcattgttctagaaattacttctgaattgcaaaaggcaatgcatatccttacaataaaagaaactaatggtcaaggtgttaattatgtgatcacacatggcttcttcaataacagaataaactgacataatgtctcttgaagtgatgcaaagctaagtgtaaaccatcacctacacagtattcttgccaaaaggattctaccatagatctacacctgcagaaaccataacctatatacaaacgtgagatattttacaaggtaattggttttgtctcatcaaaaatgtcagtgttatgagagacaattgtggtcagggttggaggggtcatcgctctagattaaaggagattaaagacaaataaatgaaattcttgtaccttgattagatcctggaccaaatcaagaagaattaaaaacaattagaaaaacttaaatatggtctaaaaattaaataatattgaggcaatgctacatattgttgaataatgaacatgcttctgatatgtagaagagtattatttttcttaagaaatacacattaaaatatttataaagagtcataatgtttacatcttacttttaaatggttgaacaacagcaaatgagtccaaatgttaacaactggtaaagggtgactgttgtactattcttttaactttcgtagagctttaaattattttcaaaacaagatggaaatgaaagttatatgtaaaatgcctagaaataggcatatgtgccaagtacctaagagttcacttctgatactgtggcccagagctcacagtttccaacatgctcctgtgacagccacacccacaatcccgggaaagctgtgccctcaacttattttaaagacctggacttgattcccttaatccctctccagttatttaatggagcaataaccatcctagactcataaaagaagctgaaatatatttaataaccttttcaatgatagaactacaaaacaaacagaataacattttccatcaaagtgatcacattttaaattactgtcaaggggtcagcttaagttatataaagtattaatatatataaaacatcttattttctcatatgctatagagatgaggcctagacagactcataactggaggcctgaaacataatttaattctattgctatgaaactaaataaattctcctctctatccgttcatatacaaatgcactgtttcctggcagagtatccctcagaatggataggcagataagcaaacaggatgaatatattagccttccatatatcctacagggaaggctggtgtgcaacaataaagatacacataaaactattaagcaagaaacataaaattacaattatttaaatagcttcagtaaacaagtgcattttatggcatgacaaacgctaacagaaatgacaagtatggggagaaggccatggtaaagatcactcatcaaatgcgtgtgcgcagacacagtaaaaatcccaactatcacacagcctgcaaaaaagttaaatcgtagtaaaaaaataaaacacaaacatttaaatgaagcattcaatcttggaggagagaggttgccaggcacatcatcactgtcattaccacatttaccagttatttatggaacaactcttgcatatgatagtctttttttttttttttttaacagaggctgactgtcgaccaggctggagtacagtggcatgatctcggctcactgcaacctccacctcccgggttcaagcaattctcctgcctcagcctcctaagcaacagggattacaggtatgtgccaccacacccaactttttaatatttttagtagagacgggtttcaccatgttggccaggctggccttgaagtcctgacctcaggtgatccgcccgcctcgacttcccaaagtgctgtgattacaggcatgaggcatggcccccagccagataggcatatttttaaggaaatgctattaaatatgcaaaaataaaaatatatatattataaggttgacttggggtatagtttagccagattgtatataattctggagaaatgtaactcaaaagaatttgtttacttattggatcttgttctaaatgatgaacgtcttaaagataggattatatcttcaagataatatgtttctaacaaaattgctgacttacacaaactcaacagatgtttgtttaatcaaaaagacaataatacttaatccatttttagttttattacttttaaaaatatatatattttttcttctttagacagtgtttcattctgtcacccaggctggagtgcagtactgcgatctcggctcactgcaatttccacctcccaggctcaagcgattctttcaccgcagcctcccaagtagctgggaccacaggcacctgtcaccatgtccagctattttttttttttttttttttttgtatttttgggagagatggggttttgccacgttgcccaggctggtctccatctactgagctcaaacagtctgcccgcctcggcctcccaaagtgctgggattacaggcatgagccactgtgcctggcctgatttacttttaatagaatttttattaaactcagactgtcttaatatcaaagcaagatgtacagagaagcctaatagaaactaaatgttttgaaaaacatataaattcttcagaaactaaatttgcaaacatcccatgcttaacagttagatgtctacacaattatataaattttatcatctggtgttttatttttacatattctcttaatcatccttcataatactttggagcttgtcaatattcagaatcggggctaggcttgctttgcccaatgtgatgatgagatgtggcagaaatgacatggcacaaggtctatctcctaggcctccaaggccttgcagtagcctacttttccccctcacaattcccctgaagccacataaggaagcccagagtaggtgactgaatcacaggagagtgtttttctttatacatatttggcttagttgtagactaaagtaagtttagataataaggaggctgttgtttatcaatctcaaaagtgtttttagtagacccaggaaaacagaaatctatcattactggagcatgaacatcatattttctcaattttacaatcaattttactctagcattttgggggaagaaagttaataatttaaccagtaagaccaaggaatgtgatgaggaatgcagattgtaatgagctgcctagttgcagtgagatgaagataaatcttcctctctgctttctagcagaaattttggtgaaccattctctttatttcaaacgaaattttattcggaatcttaatatagcagttattcataatggaaattctagagtcacaagagagcaaagacagtgccaacaggtggtcctgccatgacttactaccataggctatttctgagacacctctgtacgcctttcaaattctgtgtaaagcactgtgaaaaccactaaagacttcttaagggcagagactcaatttaattcatatttagattcttcctcactgctgaaatagggccatgtattacatagacccttggtttgctatctgttaagggaataaatgaacaacaaaaatagatagcaacagaatcttgagtaagaaaatccaaatagtgggatcccagtcctccatgtaatatgccgagtagccttctcacacatcttgttgtttttaaattttgtgtttccagaaaataggattttagtccaatgcatagtgcactctattaagccctaaaacctaaaatgccaaaaagaatatgcagagaaagagaaaatatgtttaactctgcctacttatgtattacaagcattcatggtatctgtgtgacatttctgactttataaaatcctttaacatatagtctcctaacattctctaaaagaaaacattgaattaagaagaggctgtgttcttccattgactgagctattcaacggaatttatttagatactttataaagtgcagtacttctttttgtacaactgagtttccatgttgcgtcctatagtgataatgaactgaaacagtttttcatttccattgctttaccttaacactgaagaatgacttaagcactgtggggaataacaatagaacaaagattttacaaatttacttaaaatatttctccaaacataaaatgctattttcattatttaagggcaaatttggatgaaaggagtaataataactgaaagttaaaattatgtcttttttgtccatggcctcatgggcctgcatcccttccccatcaggatccagaactaagctgcacgtagtcaccatttctcactaaacacacatcctcctcacttcaagagatgcgggagtatgattcactaattttgtaatatgctctcacagaacacttacagatggaggaagggaagaggactgcactcatcattcagaaagctgtcatatgaaacgagtctctgcttgtcccattttaaccactgttcatggtacccagtaagtcagtcactgacaaagggttcatttaagagacagaacaaagccaaaatattcctcacaaatcagacgaatatccagaaatggaactggcagcattatagatcttaaatcctgatcattattgtattcatatatccatatgtagatacgggctgaaatgtttaagatggttgaacactctctgatacacacacacacacaaacacacacccgtcatctggtaggtagaaaaaaggcaataagaaaataatgaaaataaatccgccgaataaaactaattcctaataaggaatgaagcatagcagaaaaacctttagggagcgagggaaaaacagatggagaaagacaaataatgatggtaatgataatgacaatgatgtgaataaaaaataatgagaataataatgaatgttcctgtgtatattttatccaaggaattcacaaggggcttatcatgtgaaaaaccctttctgcaaataaacaatttattatgggggaaaaatttgttcataatggtaagcaccacttatagaacagaataatgaggacagaactttttttaaaaaagttcaaagaccaacatgagatgttaaatttgaaagcaaaatctaattttatgtatcagtgctcataaaaggaaggagtggtcttttaaaacacttcaatggcagccaggcgcgatggctcacgcctgtaatcccagcactttgggaagctgaggcaggtggatcatctgaggtcgggagttcgagaccagcctggccagcatggcgaaacccagtctctactaaaaatacaaaaattagctgggcatggtggcatgagcctgtaatcccagctactcaggaggctgagtcaggagaatcatcacttaaacctgggaggcagaggttgcagtgagccaagatcgtgccattgcactccatcctgggcgacaagagcaaaacaccattaaaaaaaaaaaaaaaaaaaaaacccagcaacaaaatacttcaatggctccacttcttgctggaaaaaaaaaatagaatttatttctacaaggtgcaactcgattggactctatcagcgggtatgctgcaggcataaagatgcaactcagttggcctctatcagccagtacagtataggcatataccaccactcgtggttcctgaatataccatgctcccttgtgtcttcataactttgcattgtgcaccaatttgttttttcatttttaatgccccaatttgttttttcaaaatgaggataatagtataataatatttttataatacaataataattatatctattatatacataatatatttaacagatattcacgtaattgtttttgagatattcattacataagattgtttaaatacatcacgatgctaatctagatttgacgagttctagcagactagtagtgccaagacagacccatctgaaaaattatatgaagcaaatttttaccttcaatttgctaatacagaaactgataacataatagttcgtcaagcaatattattttgtgtgttgaataaatagttttaaaatgtaattattttctattctttccccagaggtcagtatattatttgggggtgggggtaaggagagggaggtaaactcatgtatgattgccataaggaaactgaaatattataaactatattaaatattataaagtatatatatggtttatgttctcacataaaatatcttaaatattataaagtatacatatatggtgtttttatgttctcacaatttgtttgggtaagcacagatttcacttgtgtgcacagatgtccattatgtatttactcattcagtaaacttttattgaacctgtatagtatgccataaagtgctgttgaaatgaagaataagacatagtatctgccaccaaaagttcataaccctgtgattgagacaaacacataaactaatgatattaatgaaatgcaaaaagtgctctcttaaaggcacaaataaataagtacatgcctgatgtatccagggaatcaaggcaaggcatcaaaacagaatttaaaaaaacaataaatatgctgtcaattgaatgaagccttgaaaaataaatagaatttgcctgacagatgaagtttccaggaagaaaaatagcttttacataaacacaagtacacttcaatagcttggctttttcaggcaaagcaaatgaacaaaaaacagagagaaaaggtcaagaaaactctgaaagttagagttgctgatcatggaatatatggtgtagtgtaaggatttgggtaaataaggatcatactagagtttttagatggggacagaactaactacccaaggcaaagggtcagtgcaatggaaatattgaactatttattgatagtgatcaccaaaattaagtgtgtgtttatatacctctgtgtggggtcagaggagagagggaaagaaataaacaaatattggattgtttcttttaaaactcagatctaagagtaatggattaaaatcacataggatatttgaaaattaagcttggcacatttatttttagggagtgtattgagcttcacatggctaaaaacatctcccttaactgtactttcaattacagaaagaaaatatttgattttttgttttacttgaattaccatatcagtttttcagttttccatatcacattgactatgtcaacttaatctaggttattttttaacttctgtagaacataaacaattgatttgctattggtatatatatttaaaataatgcattgtacaacataattaggtaacaatatatcatttaaactttcattcatcaagaagtctcaatttgtttgcaatcaaatacatttgggaagcagtggaatgttctcttcacgaagataagatcaagaaaattatgtttcacattccatttattttggggggtaagactgtcagtatttcaacccaaagatacattaatgataaataatttgcattgaatactaaatagtgaaaagatatttcttcatgaaaattcccatgtaatttgaatcaatatatttcaatttcaataaaaatgtttttataattgggaatgttttaacatcttatatatgatatctatttgatttcatatatagtcagtcccaaatttacaatggttcaacttgatgatttttcaactttacaatggggtgaaagtgatacgtgttcagtagaaactgtactttgagcatccatagaaccattctgtttttcactttcaatatagtattcaataagttacctgaaacattcaacactttaaataaaataagctttgtgttagatggttttgcccaactgtaggctaatgtaagtgttcggaacacatttaaggtaggctaggccaagctaaaatgtttgagatgtataatgagatgtattaaatgcatttaaacttagtatattttcaactcataatgggtttatagtgacataaacccatcctaaggtgaagagcaactagaataaactataagcattactttaaaagtttgtatgaaatataaatattttcatccatgttccctaataaaaataacacatatgactcttagtatttcttttttttttcattattatactttaagttttagggtacatgtgcacgatgtgcaggttagttacatatgtatacatgtgccatgctgctgtgctgcacccattaactcatcatttagcattaggtatatctcctaatgctctccctcccccctccccccaccccacaacaatccccagagtgtgatgttccccttcctgggtccatgtgttctcactgttcaattcccacctatgagtgagaacatgcggtgtttggttttttgttcttgcaatgtttactgagaatgatgatttccaatttcatccatgtccctacaaaggacatgaactcatcattttttgtggctgcatagtattccatggtgtatatgtgccacatttccttaatccagtctatcattgttggacatttgggttggttccaagtctttgctgttgtgaatagtgccacaataaacatacctgtgcatgtgtctttatagcagcatgatttatagtcctttgggtatatacccagtaatgggatggctgggtcaaatggcatctctagttctagatccctgagaaattgccacactgacttccacaatggttgaactagcttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagggatgatgagcattttttcatgtgtcttttggctgcataaatgtcttcttttgagaagtgtctgttcatatctttcaaagaacataatggacttttcaacgtgcctttaatttttcttgggcactaaattcttgtacatttcccttcataagttctcaaatgtaatattgattcatatctgaccactacaacccagttatgagagcaaaacaaacaaaagaaaacaagaaagtgcctttgttcctggtcgtgggttttccaacaagattattaataccattacgtatccagatggggaaagctgagccatatgatcaacatttcaaactcttctggctgcctactttctcccattctggggacagagttcacattcttagatagttttatgcccttctgctgtgacacagtaattctttagaagaaaaacagtgataaaaatcaaattacttctcctcttcctctatattgccaacactgcaatgcattcttttgcctcagagcaaagggagaagattaacatgcatcatacagagctgtctggctgatatggtgaggggcctccttctatctgtaaggcaaagtcagcagagactcttaaccaaggatgaaggaaaacactccacacccaattgcctcaattcctctgaaaactagaaccaaggcaagaagggaagtggtagacctatgactggagaacagtaggatttaatataatgtttttaaattttattttttcacaggcaattattttttatctggtcatagaatagccagaagttttcaaataagaaaatgactaatcaataaagcaaggggagtgacaacttggttggaccactcggctcagatatgcagtcaagcattattccgagtgtttttgcacgggtgtttttcgttgagattaacatttaaatcactggattttgagtaaagcagactgccctccataatgtgggttagctttatacaattagtctaaggcttgaatagagcaaatgactgaatttccctgagcaagagagaactgtgcagcctgaaggccttcagacatgaactgctatattgtctcttctctaagactccagtctatcaatccacctacagattttggacttgttagtctctataattgcatcagccaatttcttaagtgtcttttatacatactcatcctattgattctgtttctctggaaaactctaacatactccgcaacaggctatcatcatgtagaagttagttcatgcttccttcagttaacgtttaggattgttcacacctgtgtcccctaccagatagtaaatccagtgagatagaaaccacatgttgcagcccttatggcttctcccacatggtgtggaaatcagtctttatcaatcctcatggtattagaacaaagctttaaaaacaaatctgcattgaaatgaataatatgtgattctttccccttctaagtcctcaacagcctcatgtgttttggatcaccctagctttgactttgctcaaagtatttaagaaatcgctagcttgaaatgtggttaattgaaccaatgatcttcattagcacgaaggcaatatattcaaaccaacatgaacaagtattactatcctttcaaaaggttctctgttctcttattatcctagctgttttgcttcctaattacttcgttaactaatttactacctattaagtactcatttaattaccttacatgtaggtactggctatattaagggcctttgaaggttttaatctgacaatctaagaaaattgtcattgtagtgactttgactgaaacaccacataaaggaaaaaaatgcttgtatggaaaatattcaagcacataaacaaattattcacaattatagtatactaaattgtaaagaaaattgcactaataaaactaaacaaatgtacaaaaagggtgatggatcttggctagttacaacttcagctaggtcttatgcctctcaaacattacattactgtgtatatgaatcacctggagattttgtaataatacaaattctgattgagttgtttccagaccaccctttgagtagcaaaggtctagagtgtagagcccagaacaaaaaccattcagtaatcagcttctccttctaaatagtaatattgagcaactgcagagttctggtttcacacaattttattcataggaaaaatttcctactacctatcacaaagaatcattcacttacctaattattttcctacgtccccactctgtgtatgacagtatgctgagtagaatatttgagtgtgtgtgtgtgtgtgtgtgtgtgtgtgtgtgtgtgtgtacacaggggggaatagagatcatgaggaaaggtatacaaaatatactggttccaccttcatattatttataacgaattaataaaaatattatcaaacaacttaaccatataacacagtacatatgaggtacatgagtatatagagtttggttacatagagaagtaagtgtggtttggatttaattatatgcaaaatttcaagtgaaaaagatgtgaagtcattttgaaaagaaaggaaataaggttaattttcaaaaaggtaaaaattttgaaatcagaattggttattgagttttatttggattgatatgtaaaaatggaagagcacaggtgagtgcaaacagaacatctttaatgtgacacagaagacaagagaagtaaatacaattccaatatgtaaaacagatgcctgtgactgggaggtggaaggaaaaggaaagtggactctcttgcatctgggcttttccaaggtaaataagcccatcgtggaaacacagaaacgtcatcacatgtacaaacaatatcattatgaaatgagtatagaaacaaaatgaagacattcaaaagttaaaaaatggtgatactggaagagaaaaaagtgaactcttaattcttattttatagaatttaaaatgtggtgatttgaagcgtattttatatttttaagtttgctctttgatatggtttgactgtgtctccacccaaatcttactttgaattgtaataatccccacatgtcaatggtggggccacatggagaataagtgaatcatgggggtggtttccccatactgttattgtggtaatgagtaagcctcatgagatctaatggttttataaatgcaagttcccctgcacacactctcttgcctgccaccatgtaagatgggcctttgcttcccctctgccttcaccgtgactgagtccattaaacctgtttcctttataaattacccagtctcggatatgtctttattagcagtgtgaaatcagactaatacacttttttttctttttcttttttttttttttttttgagatggagtctcggtctgtcgcccatgctcactgcaagctcagcctcccgggttcaggccattctcctgtctcagcctcccgagtagctgggactacaggcgcctaccaccacgcccagctaattttttgtatttttagtagaggcggggtttcaccgtgttagccaggatggtctccatctcctgaccttgtgacccgcccacctgggcctcccaaagtgctgggattacaggcgtgagctatggcgcccagcccagactaatacacttttcaaagaaaagatcaaaaagtagaaatggttaaactcttcattgtgttaaaatactgaaataaattaaataccaggttatagactgaccacagaaatgttagaacaatcccttgatgtataccatggtaaaagacaatggaataaaatacaatttccactttgttgaatggcacccgaatgttcagacagcatcagaaagccagatgtagtccagcatgtattctatctgtgaggaggaatgtatgaatcccaagtgtggtgactctctgcagtgaatacagactgttatcagattatgtcactctggcttaaatttagtaaatgctcaagatgtggcatttgaaacatggacgtttatctaaagttaatccatcctaagagaaactagggcatttcactaaaactttcatcatgacgacttgaattagaacagtaaaataagaaatatgacctatattattctgaagccataatatataaccatgttataattacagatatcataaacgagtaatattaacgacatttaatttgtaaaagagaaagctgaataaaaaaatacgtcagtattttctatacacttcaggtgggaaaagtgattttaaatgattaacgcaaacgaacaaattaccacagtttaagaatattaaaattcgtttcattaatatctttagtagaaatccagtttgccttttctagttgaagatccaatcacagactgtatattgcttttagtcttcatgtatctttaatctcatatgttttgaaatgcttcattactggtttgataattacaatgtgatgcataagacatacgcatatccatgttcacaggaaatgtacattgaagtatttagaggacatgatgtttgcaacttgactccaaatggtttagaaaaaaagtgttaatgcatgtatgtgggtatgtgtgtgtatgtgtgagagagagacagagacacagaaagagagagatggagtaatagagaaaataaagccagtgtggcaaaatgttaattgaatctgagtgaaggatatacagaagttatttgtacatatcttacaccttttcttatgtttgaaattatttccaaaaaaaaaaaaaaaggaataagaacatcatttaaagaaaaaaattggagacagggtctttgttactcaggctggagtgcagaggcatgatctcagctcactgtaaccttcatctcccagacttaagcgatcctcccaccttagcctccctagtagctgagaatataggcatgcaccatcatgcctggctaataatttttttttgtttttgtaaagatgaggtctcaactgattgtcccggctagtctcaaactactggcctcaagcgatcctccctcgatctcctaaaggcctgaaattacaggcatgagccagctaaaaatctttataaattatattagttaacacaggcttttggggccttcaggagtacagaattaaggtgaaaaactgtcaccccaaatctatatttcagaataggatttctcaagagaggacactggtcacttgaggacctaaatgaatttcagtgagtccattgtattcttaaaatcatatgcatgaatttgtaaatgaacttttttcctgggaaaacagtccatagttttcatcagatgctcagactctactgtccccaaaagcatgggaattactgcattaatttctgttcatctaaagacaccttaaaaaaaaacagaaaagacagtgtatagtctagaaagaattttaaaatgtatgtggatgacaagaaacctatgttacggatatataaaacacacgtgtaaatcaataaggaaatgacaatctaatagaaaactgggcaaaggacattaatcaatatttcaatgacgaggaaacccatatgggcagtaaacattgagagagatgttttatttcatgagtaatcagagaaatgcagatcaagaacacagtgagatataatttatgcacatttgattgggataaagaaagaagatcaacaatcccaagtgatgaagaggatatgaattaacagcactttacagcattcctggagtgtaaagttatatcgccattcgtgaaaacacattaggaatatcttataacattaaatagtctcacactccatgacctagcatcacattcctagacatatgtgcaagagtgattcttacatgcatatacaaggaaatatgtacaatactatccacaccagtactgttaacaacagcaaaaagctaaatacaactcaagtgcatattttcaagagaactgtaatattcagcttctaacatagtcccgtgatccttgtcttttggtctccatgccttttttgagttcctcacatattaaatcatggtcacctatataaccaatagattatggctgaagtgattatatctgacttcccaaactaagaaattaaaaatatcacaacttttggcttggtctcttgattaacttgcactgcggcaaatcagttgccatgttatgagaacactcaagcatttccactgagaagcctgcatgcagagaagtcaattttccagcactaatttattggacagatgagtatgccctttgaaagtgcatccaccaaggccggtcaagccttcaaatgattgcaattcagctgccatccgaccctaacctcatgagagaccctgagcctaatttgcttactgagttgcttccaaatttttgatctacaaaaattggaagaaatgattgctttaagccactacgtttttatttgttaagcagaaatagatattcaatgaaaaataaattatggtatataatataaaattcaaaatcaactgaagtgaaaatattctttaacgtgcataggtattacatagaactttagaaagcaatgggctgagccatacaaaactaaagatagggtttagttggtgtgggtgaagcaaaagggattcaacagtagcagagcatataaataaatgaaagttattagcaatgttctgatgcttgctttgagccatgtttataggtgatcatttgattattaataattgcatttaattaaattgtttaaagattacatttatgtaaatttgaccaacgtatgatctagagattagaaataattaaattatatggatctgtgttcctctgagggtttctcacggacatatcaggaggaaataaataattgtcattctacagtcagagtgcctttctaacttcccttaagatgtaccctgttggaggctgactactgaagaagagaaaatgaacatagaaaaatacggccgggcgcagtggctcacgcctgtaatcccagcactttgggaggcagaggccgggcggatcacgaggtcaggagatccagaccatcctggataacacggtgaaaccccgtccctactaaaaatacaaaaaaattagcctggtgtggtggcgggcacctgtagtcccagctactcgggaggctgaggcaggagaatagcacgaacccggggggcagagcttgcagtgagctgagattgcgccattgcactccagcctgggccacagagtgagactccatctcaaaaaaaaaaaaaaaagaaaagaaaagaaaacaaaaatacaaccacttagtttctctgaaatatagacatattgaacctaaagaatttcatatagcctatcatgtgtcatctattgttaatccttcccttgtatctactaggtcatgtaacaaagagggcagacactttcaggagaacgatgggaaggaatgaaaaaaatactgaagttttcctggagaaacaggtagaataaagtgtatgggattcccaggattaacctctaagaagggagctgatcataaaacctcaactaaattcagatttaagctattaaaaaaaatttgaatatagaacaacaggactgattttgttttttaacatgggtaaccttaatttcaatgcccttaatatttttatccactctgttttcttagtgaaattagaagcatttcttttttaaattacttccagaggaatgattttttcttttggaattgaagaaatctacagcacacttggaaaaagaaacacttaaaaaaagcaaattttcaaagttaaagaaaatgagtaagcaaaatttctgttgccaaagatacagagaataaaagaaaccaggttgttgtcttgataccaagacctaaaatatttagtttaaactagcagacttttgtcatcattctataaatatttagtatggaattaagttagtgtatatgcctgagggatgcagtcagcattctgactcagtattaccatcatattacgtactaattagaaacatggcttattgaatttactgcctcttttttctaagcagttctacccccaaagaaattcaaaacacaaacagacatcactcctttttaaaaatataattactgtttttttcttctttgagacaaggtctcattgtgtcacccaggctagagtgcaatggcgccatcttggctcactgaaacgtcagcctcccaggttctagcgattctttctctgcctccggaggagctggagttacaggcatgtgacatcaaactcaggtaatttttgtatttttagtagagatgggtttttgccatgttaaccaggctggtctcaaacccctggactcaagcaatctgcccatctcggcctcccaaagtgctggcatttacagcctgagccaccacgcccagactaaaaatatgtttgattttcatcctttcaaaacttattaccaatgaatacctattattaaaaattgtttgggttattcttatccattcatttctaataacataatatatatagcaactagttgctacatatagacgttcctcaacttgtgatggagttacatctaataaatctcataaattgaaaatatcaatttaaaaatttgcttaatagacctaaattatggagcatcaaatcactgcctagcctaccttaaatatgcctacaacacttacattaacctatagttgggcaaaatcattgaacaaaaggactacttaataataaagtgtaaaatatctcatgtaatttattgaatgctctactgaaagtgaaaaacagaatagttgtatgggtattaaaagtatggtttctattgactatgtattacttttgcaacatcataaagtcaaaaacttgtaaattgaaccatcctgagttatggactctctgtacttgactagttgctgagaaatttgggtgacaaacttgtacaatgtccttttgataccgatgtatttagcaaatcacttcacccatttgagcccaatttccttgtctataaaatgaaaaaattggataaacgactactgggactgctgtcagaaacaaacttttgaaatctataatctatgctaaaacttattaagcacttccttaatataaagtaatatgctgagattatttgagtaaaaactctgtcattttaaggaagaaaatcagatttcaatacagtgtactttgtgtgcagtaaaagcaaattcctgacactcatctccccaggaacctgctgaatcataatgtaagcttctgttttgttttgtcttgttttgtttttctttttgttcatgtatctgtgtgtttggttttggtttagtatccatctaacttctaatgtttctttcctctgcagttcagaatacaaaactcaaagaaaaagacaactcacaaaatagtcaaagcattttgcagatacaaacgaattaaccatctggaaccacctaaacaagactcatttcaatactgacaatctgctataaacatgaataaacaatccagttgtgactcagattgagggaagataagggttttagatgaattattgagatggttatagaaaaaaaattattagcagatgcaataaccacagaaacaaacaaggaaccttatactccaaggatactacccatgaatcctaccctattctcactagtggttatcaatttaatatgatgcatttcacagacacaggcatattgcagatctcagagttatgccattaatcaaatcatgcatatgcttcaacagccaaatggtatctcatctaatctagaaataagatgtgctgaatcttttttttattacatgctgtttggatacatataatgcaggcaatagattaatggatattataaacttaaatattctgcagaataatttatgtatttacttggagttgtattattttaaattcaaatgttttacaaatttattctttacccatgagatttgggggcttctaatcatagaaaattgcaaataaaataaattagggaattccaagagatagaaagtaaaagtatatggccgggcacggtggctcacgcatgtaataccaacactttgggaggccgaggtgggcggatcacttgaggtcaggagttcaagacaagcctggtcaacatggcgaaagccagtatctactgaagatacaaaaattaactgggcatggtgctgagtgcctgtaatcccagctactctggaagctgaggaagcagaatcacttgaacccggtaggtggaagttgcagtgagctgagatagcaccactgcactccagcctgggagacagaaagagattttgtctcaaaaaaaaaaaagaaggaaagaaaaggaaaaaaaaagtagtagaagtatagcacagaagaaaaacaaaagcacaaactaaaatcacttcttttcagcttttctgacaatgaaaacaaaaatttaaaataactataacataataatttttttttccttcagattctgacaaccaattcctgctggtttcctttgtgagctaaaagatatttaaaacacgttagtggatttttccaatgccatgactaaatttcagtgatcagtttaagggtttttgctgttgttgtttgtttttctatctgggataataaagcttttagtcatttggaaataactggcaatctgaaagtttttttaatttcctgttttatttaatttcccaaagtttattcaaaaatcatttatgttgctcactatggaatgctaaaaaattcagaacaaagataagtggaaagtttcacaagtttagttttaaatttagtttgtaataaattgaagtttttgaagaatcattcttgttcttcagatttagtggtcaatttcacatatgagagttcttaaaataattgtaccctttaaataattctaacctttaaatttcagattgtaatttaatttaatgtttttttttttttttgagatagggtcgctctctggcttccaggccagagtgtagttgtacaatcatggttcacagtacacttgacctcgcaggctcaatatatcctcttctctcagcctccctagtagcagggaacacaggcacatgccaccgagcctggctaatttttttttatttttgtagagacaaggtctcaatatgttgcccaggctggtcttgaactcctgggtttatgtgatcttcccactttggcctcccaaatttctgggattacagacgtaagccaccatgactggccccttttcaattatgtatatatatgcatcttatacattgatttcatgtcacatatatcagaaaaaaaatgtcagctatatcagggtttttgtcatacttaaaaaatagtatcaaatttgggtaaaatagatctggatcagctataactcataatggtctctgagtgatgaactggtagtaccattactaattaagaagagttttcttcagatctgccatatgaaactccttagacaaggagaatgataagatgcatgtagataattgctttatttagatcatgcttgtaatctaagcactttgggaggccaaggcaggcagatcatctgaggtcaggagttcaagaccagcctgactaacgtggagaaaccccgtctctactaaaaatacaaaaatacaaaattaggcgggcatggtggcgtatgcctgtaatcccagctactcaggaggctgaggcaggagaatcacttgaacctgggaggcagaggttgtggtgagccgagatcatgccattgcactccaacttgggtaacaagagtgaaactctgcctcaaaaaaaaaaaatatatatatatatatatataaaatatatatattttttatattatatatatataatatatatattttttatatattatatatatatagctttatttagaagcagaaaatctgatcaagaaaaaggatttgtattagcattttaagccaaatgacaaaaagaaaattagtaataaatactacaaagtcattgtttttagtgatttttccatatcattttgccagagattaaataaaatgataatcccagtgttttatgtttacttgattgctatctggaaattgttataaagttcacaagtatatactctttgatacaatatttctactatcagaaatttatccaataaaagttatttcaaaaagaaccagacaaaaagttgtcctttctcaactgagatctggatttcaatgcctagctaaagaatgtgaaatattaaaaataaaacacagatggaaacccaagtttgcaaggaaactctgaaatctgtatccatatatatttttttaatttcacatacataacgataccaaaatttaaaatgcatggtataacattaaattagtctcagtgactatcgaaaaatacccaatagtcaatatagttgctcttgaaacttccctaatgcttcagtgagtttgtcgcaggtaatactaaggtggttcccatgtcctgaccccagcatgtggatctttaaccaaaagcttgacaatgttctgaccatttttgcagtaccataactttaaagatttgagtttaatttaagctatttatactacagaccatttgttattttctgatacgtccacttactttatcccaaataaacaaattcacacgggctttaacttgttactctttttgtacatttcagctttattcctaagcaggcgtaggattgtggttctcatattcatttttactttcacagagtttcttactttctcccaaggctaattgtggaaacttctatccctgctgtgccacttgcttttggttttttttttctactcccagaatccagttctcatttaaaaaacttatctccaaaaaaagtgactcacaatttgcagatactatgaaaacgaaagaaaatttctgtttagagatatatcccctttatttttaagactttattgtcctaatttctgaaattatcaagtaagtggtatactgaaaaaaatgagattattattttaacttctcaaatttttcttattccatagtatctaagcctgtcactacagaagaaaacattagttctcgttttgtctttcaaacttgtctttgacgagttttatcagacagtggtctttggtcagaatcatttgtaacatttcattaaacattttaaatacaaatgagcatttacaaaccatcaatagagcattgaaagacaaatacataagttccctaaagtttactctgaggaattagtatgtcctgtataatgagcccaacaatatatttgaataaataaagatttatttatgaaatgaaaggattatgaaatttccatgaaacttggaaaaatgaccatattttatcatggttcagttttatgtaccatgatacaacgtacatgagaatggtactatatagtggaatgtagcacttttcaatactaaccaattatttgagtgctgttttccctttcaactgaaacagctaagctatcttaagccattcactgtctcagaaaagagatgctgaagcctcccttaaataaatacacatataaacaaatatataaacaaacagaaagtctatggagtttaattggagtttatttttagaattacaaatatctaaagggaatcatgaaattacaatgaatatgtcataaattagaagcaaaatatccaaaccagagaggagctaaagatcccatgttttacaaggagtggaagagttggaaagcaggtttaaaaaaaaaaaacaaaaaacacatagattaagtaagtcttagataaagacagcccccatacaaccatgctgtatgataaattagaggaggggaaagggtagaaaatagatgtacctggatacctggtaggttgaaaattagagcaccagggactcttcctaaactctttcctacaagctcactgtgaatcaggagcagtaacatcataatcttgggactgggaatagcatgaaaatagatggttcattaacagctcacctaattttatgtggagccatatgacacagaagcaacagaaagatccccatgtgcagaactgagagaaatccaagacttaaaatccccatctgcaggggctgttacaacaaaacagaagaagccgaagacttcgggggaaatgtcagcacaagacaatgaaattcaggtgtatcctcccaataagtaataacttagagttgtgcaaacctcccaaacttatatatgggaggctagcgggaatctggtgctttatttatttcttgtagaaggaagaaatacttaatatacttggtaaaatatacttatggtatattattagtaataatatactaataagaaatataattagaaatagtaaaataaaaagttgtaaactttacaaagtgcaagataattagttcagtggaatcactctttaaaaacagtagtaactgagttttatcctaattaagaaggaatattccagccgggcgggatacaggttcacccctgtaatcccagcactttgggggaccaaagtgggcggatcacctgaggttgggagtttgagaccagcctgaccaacatggagaaaccccatctctactaaaattacaaaattagccaggaatggtggcacacgcctgtgatcccagctacttgggagacagaggcaggagaatcgcttgaactcgggatgcggagattgcggtgacctaagatctcatcactgcactccagcctggacaacaacagtgaaactccatttcaaaaaaaaaaggaatattcctattctgtataagaggaataacatagccaaatgtttcagtatcaaagataactatgattgaggcctgttcaggcaatccctagttgccatttagttaaaatatattaaatatatcagatgaccacgataatcagtcttctagacaagctcttcattttttattccaaaaatgttgctagattctggaaaaagatgcatcatatttaccaaaaggaaagttactgtgagtggtagaaagcattttgtgatatcattacctaaataacggatatatttttagtcaaaatttctttctttttcctttccctggggataaaggactaagtcttctatctgtcaaggtctctagaataaagcacataatgcagtaatatagggtgtctgttccatgctaatttcattattatttccagaaacatagacagtgtggaaagggcactgaacaatgtgtgttggaaagggaaccttgggcgattaatttctctaagtgttggcttcctcattagccaattaggaggaagaaaatgttccctattaccctcagaaatgtctgtggaaatcaaatgacacaaaaagtggaagatactttgttaaccgtgaaattttgttggggcagctattgttcctaccataattcttctggggacagtagcttaactttttaacttctaagattcttcatttaaatcatggaacatcagtaataataataataccaatctcacatagtggtagaaaagttaaagaggcaatacgtgtatatgcatagtaaatgttaggtattattttttaaataaatacatccactctttttgttaccaacaattatgttctatgaaattgtcatgaacaagcattagcaaataccgaaccattgctcctgcaagaaataaagcgctagcttcctgccagcctcccgttaaaacatttttgtgaactgatcaatataaagacttgttttagaccaggcacagtggctcacacctgtaaccccagtgctttgggtagccaaggtaggaagattgctcggggccaggagtttgacaccagcctgggcaatatagctagactctgtctctataaaaaactaaataataataataataaattaaatgcttgttttatatgtccttctgttcgaaaacaccttatttaatacatatttttggactcgttaacattggaatcacagccaacaaccctgcgcctcatttctgaacacagcttatctaacacatgcactctcttcataaggtacatcacactcctgttgtgtttacaaacactgggcactatgcacgatgcttgggggccattttaaacagtgaagtcatccaccaggagcacaagatgcaaaaaaagtgtgatactaaatataccatgaaaaaatgtacttgtttacagtatgtaaactgaaacaaggtagaatgtctgcctcattcaacctcatctgggaatatgcacatcagataattacaacattttaatattaatactctacacaggcacatgtctacaaatgactgtaatggatccccaagtattgatctttgtgtttcaaataaatttcagcaagtaagcaaattcacaaccacaagaattcatgaataatgaagatcaactgtgttagtttcatgatataatttccaaaatatatgagtttacaattttagtatctaaaacttacaaggctcttcatgctttagacctttcattctttctcctttcttgtggagtcatgattctctccctattcaagtgagccatcttcctctctgacccaggacctttgtacatgcagcttgtacttcctggaacaatcctactgtctttcattactaacttctttctctagatctcatcatgagcatctctgcttcttttattgttctgactagaccagttagtccaactatttttgtactctcagtacaaaataagtggtataaacttataccacttaccacagtaaaattttacatttacttccatgtatgtgtattccattaattttcgcttcttcaataaaatttcaggcccatgaaaacagagaatgttttcaatttttctcccattataacgtatgtttggtgttacataaatgtacattgattaaatgtaaattcatgtaaataacatataaataataaatgtaaattgaatacttaaatcttcagtggtcatatcaaatgccttagaaaaaaatactgtcaatttatttacataatcaagacagcattctgcccattgaatgcatgtatgtgttcattagaaataggaaatgtgaaagacgactttctgagggccagtgctttcaaagtggtttcaagtctgtccttaaatatatcatttacacgacatagataccaaagaccaaaaagtaattccactaaaaagcattgaactttcttgtaatcaaatatacgtaaattaaaattgcaaaaacagttattttgtaacatataattaaaaataatgacagcaataatcttgtcaatgaaactgtgatgaaatagcattctcacatatgactgatgcaaatgtacactgtatttcagttggaataaaatttggcaatatgtatcaaacgcataaaaaatgtttataatctaacccaatattctatttttaggttggaaaatagtccaaaacatttgttaacaaagagagtatttatagaatgaatgattctataataactaagtaactacatataaataactaagaattaaaggtaagaaacaaacataatatccaataatacggagatagttaagtaataagattgattccagtagacaaactggaagaataattgaaaacaaagatcataactacactaacactggaaattgattatgccgcagcagaaaatagtatacagccaggaacgttggctatcgcctataatcccagcacttagggaggtcaaggtgggtggattacctgaggtcaggagttggagaccaacctggccaacatggtgaaactcggtctctactaaaaatacaaaaatttgcgcagggtggtggtgcgcatctgtaatcctacccactcgagtggttaaggcaggaggatctcttgaacacgggaggcaaaggttgcagtgagccaagatcacaccactgtcctcaagcctgggcaacagagtgagactctgtctcaaaaaaaaaagaaaaaaaaaagaaaaataggatacaatgccatatacaatatgatcattattgctattataacaaaaatctctgagtgatagaggttttttattttaatattctatacttcctataatgtacatgttaatattttaactagaaaaataattatttttccaaaatctaactctaataccacatcctttaaattgtacattacttcttttagtttgccagagactgcttttctttcaagagtgtgagatcgaatttattctgacattgagcacatatgcatcccgtttgcattggatggcactaggaggctccattcacctcaccattgtgggagtgcgcctctaggagttatcctgagaagcaagtggtcagcagctaactggtatgctgaacaaatctagctcacacagaaaataaaagaaaaaaaaaaaatcctatttttcctttaaccacctaaaatccacatcccctgtagttatctatttaaaaccattcacctaatagaagtttctagagctgacaaaatcatcagtcacccactcccaaacccatccccaatttttacattacaatataaccaagcgtacagctcaaggcaaactttctgtttaaataaagctacacacaagtggcagcctctgctgttcacagcaacccaggagaatattatgtgcattattgctctgtagttctgatccaaccttcagtaatccccatgaagcaagagctataggttccaatgagcagttctgaatcatcagtaaattaaacctcctcaggacattctgttttaaaaattaggcaataataaacccatggtctgctttgcgttaaaatgatacagatgggttacctaaatcaattctagccgcactttctcaatgcaaagcacagcttcaagctctttattttgtaaaagagaagtaaaattatagaatgtaaataatgatgtaatccacttgaaaaaatcataaggccgtctagcatgttctcagtagtgtgattaaaaacagttgccaataaacaggaaacactgcattaagccaaaatttgacagattctgttttttcacctatggtcttaaaaatagcaacaatgcatagaaaggtgtgataaatacacttttcatagtttagtgctacattacccatgaagtgtcacaatatataacataaagttttacggttataacatatgtgattataaacatacattttttcttaatgattaagatgatttcagaatctctatagacacactaatcaatataggttacaacatctcttttgtgtttccacatatcgctcaggctgttaactctttatcaagtccccttttgtagaaaagaactgggtgtattaagtctctctttagaaacatcaactctctattcaactctttccattcatgcttctatcctctccactatgctagtcaagggtcacaataatcttcaaattgtaaaatccaataatcacttgtgccatcattttacttggcattttagcatctttctttttttattttattttatattattattatactttaagttttagggtacatgtgcacaatgtgcaggtttgttgcatatgtatacatatgccatgttggtgtgctgcacccattaactcatcgtttagcattaggtatatgtcctaatgcatctttcaacagaatcaataccccctttctctttaagcacctaaaggtccagggttttctttttctctcactgaccacttttccatacccttctgttgcttctcatcctcttctttgcccctaaagattggagtgtatagggccttgctcccagccttctcttcgatagactctcctcctaggtatcaagaagcttcatggttttaaatactattggcatgctgatgacactaaatttatatttctaactcagatctctcagtcttgaacttctgacacttacatttatttgacaatgctatttgaatattgacaagaattacaatataaaagatactaaatacaatatgtgatctatctccaccatgttcctatttgatttcttcctattttaggaaaactatactcacacagtcagatatttaaaactctagtctctctttccttcccaatatttgtcacatgaaattatgtccaaaatgtagctgaaaatacccactttgcttcattttcactgtctaccgctttgctcaaggctttgcccttttttgcactgactgctaaaacagccttgtaacagatgtccctgcttccattcctgccttttataatccaattttcacatcatgatcaatgttaatttatgaaaatgcaacccttgagctactgcactaagatggcacgtagcacagatactattaattttgctttctttcagaaaaacgcaaaagctatggcaaataaacaataaaaaattatccagccacaaatatcagagaaaatgagaggagacatagcaatacatttctggaaactcaaaaggtggtagatagaatgcttgacaaagctgcttccttaactggcagtagggaaagctgaggaataacccaatgcacagggcaaattcctcaaaatgtctgagatttgtacacccaggaactttaggaatttggggtaaaggggattgcaaatgggtaggcatgggtgaaactgtttgagaagcagttagaatatgagacacctgcacccacctgcctcaccatcccccacctaccctgcccaggccactggttgtctacttctctttcaccttggcagaagtctagagattttctatttgaaagaagctgaaatagaggatcttggaacctggaatatcatatcaatacatgagaaatgatgaatatatgcttaagaaatgcaaaattctaaaactctcagtctggttctcccacttggcttctagtactataccagccagattatatcctccaaaagaagaaaccaaaaaactggaatactgtactttggagaatatgatgtcctaataaagaagaacttaaagatatagaaaccactgttcctcattaagaagcctacaaagatcatcttcaaggaagttcaaaaatcaatatattcaactcctataatttgagctttataccagctacagtcttctactcagtcacgattagacaccaataaaaaattatccaaaccaaagtctctgatgtggaaggtaaaaaataatatgcacaaagctaaccaaagaaaacagtaaatagtaggatgcaatagagaagattcaggaaaaagaacatttctttaaaaattcagtcatgaatatcaagagaaaaagagagagatgagaaaatatactgcaggattatataaaagaaaagacaaaaagagctgttagaaactcaaaatatttttctgaaacttaaagctcaatagaattcgacagaatgaatgaaaggtaaattaagaaaattccccagaatattcccagaatgtacaacaaatatctgcaaagaaatgtaatatatgagaaaagactgtacaaaataagagaaccagctcaggaagtgcaacattcatataaaagtatttccattaagaaagaagttagaaaataaaaatagcatcatcagaatgttttgtaaaatttcccaagactgaaaggtatagggtccagactgaaaagttccaacgcaaaggatgaaaataggctcacgaaaagacatagcattgggaattttcagaacttggttataaagagattatgaatgtaccatagagggacaaatctgatcatattcaaagagtcagcattgaaatgccctcagatttctgaacaggaacactacagcatctctactattgagtcaagaaatgcctttaaaaaatctaaagaaaaataactgtcaatgaagaacagtatgtccagataaattatcagcagagttaaggagcacaataacatcactttcagacaaataacttttccggtatctcttcagatgcccttgattcagatcaaatggaggatatggtttacaaagatgagaaaataaaccaagcaagagttccctagataaaggaaacagaagacccaacacagaataaaggtaagtaggagggtttaaaatcaaaatggatgattgaatggttaattaaaatattgtttaacataggatacatgtgaaagatatatttgttccttagacaattattgactaaagcatacatatgtatattcacactaaattttatttagatgcataaattaggatttacttaacatagaagaaaatggttgtaagcccaggtaatatttcttgcatagatgacacccataattcacttataatgtatgacttcaatttcttctgagggagaaaatacacttatcacctgagtaaatatattcatactttggggtttttttttcatttgtttgtttttgtttctttttgagacaggttcttgctgtcacccatgctggagtacagtggtgaagtcataccttactgcagcctccacctcctagacacaaggaagcgttccacctcagcctcccatgtaactagcacatgccatcacatcctgctattttttgcgtgcaaattaagccctcatattaaaatgcaaaacaaactggtacagacttctttattgtttatttttttaaactttcatttcaagttcaggggtacaagtgcatattaattacataggtaaacttgtctcatggaggtttgttgtacagattattttatcacccaggttttaagcctagtacccattagttatttttcctgatcctcttcctcctcccaccctccaccctccgaaagatcccagtgtgtgttgttcccctctatgtgtccatatgttctcattatttagttcccacttacaagtgagaacatgtagtatttggttttctgttcctgtgttagttttctaaggataatggcctccagctccatccttgtccctgcaaaggacaagatcttgttctttttatggctgcacagtattccatggtgtgtatgtaccacattttctttatccagtctatcactgatgggcatttaggttgattccttgtctttgctattgtgaatagttctgcaatgagcatatctgtgcatgggtctttataatagaagggtttatattcatttgggtatacactcagtaaaggaattgctggattgaatgttatttctgtcattacatctttgagaaatcactccacaatcttccagaatggctgaactaatgcctgctgttttactttttattttattgagagacagaatctatgttgtccaggctggtattggaactcctggcctcaagtgatcattccaccttggcgtctcaagttgctggtattacaggtgtgagccagcatactcattctatttttgttttttttctaatattatatatttgtgtcacaaggtcacttatttgagtattttctttatgaacacttttgaaacattaactttcattaaaaaattaacatcttttctgtatatgtaaatattgtgtgtcttatgactcaatgaagataacatgtacattagaagaaatcattcggaatctggtaccttaaaccactcagccctcctgacactctctacttattttgagaatgaataagactcttagtaaacatcaactcaactgggcagaggtaacagatgtcaaaactgtattagccatgtgtccccatccaaatctcatctcaaattgcagttcctagaatccccacatgtggtggtagggaccatgtgggaggtaactgaatcatgcgttggtttcgcccatgctactctcaagagggtgagtaagtacccacaagatctgatggttttataaggggattcccccttcactcagctatcagtctctttcctgccacccgatgaagaggtgacttctgccatgattgtaagtttcctgatgcctccccagccgtgctgaaccacaagtcaattaaacctcttttatttataaattacccagtctcaggtatttcttcatagcagcatgagagaagactaatatggtaaattggtaccagaagagtggggtgctgctataaggatacctgaaaatgtggaattgactttggaactggataacaggcaggggtggggacagtttggagggctcagaagacaggaaaatgtgggaaagtctgggacttcctggagacttggagggctcagaagacaggaagatttagaaaagtttggaacttcctagagacttgttgaatgacttggaccaaaatgctgacagtgatatggacaatgaagcccaagctgagatggtctcagatggagacgaggaacttgttggtaaatggagcaaagaggacacttgttctgcttcagcaaagagactggaggcattttggccctatcttagagctctgtgtaacactgaacttgagagagattatttaggctatctggcagaagaaatctctaagtggcaaagcattcaagaggatggctagcataaaggatgggaaaatttacagcctgacaaggcaatagcaaagaaaaaactattttctgggagagaaattcaaacctactgcagaaatttgcacaagtgacaaggagctgaatgttattcaccaagacaatggggagaatgactccaaggcatgtcagagacctttgtggcagcccctcccatcacaggccctgaggcctaggaggaaataatggtttcctggggtgggtccagggcccccttgctgtgtgcagcctagggatttggtgccctgcatcccagctgccccagccatggcttaaaggggccaaggtaaagctcagccaatggcttcgtagggtgaaaaccccaagccttggcagtttacacgtggtgttgagactgcaggtacacagaagtcaagaactgagatttggaaacctctacctggatttcagaggatgtagggaaatacctgcatgtctaagcagaagtttgctgcaggggcggggccctcatggagaactcctgctagggcagtgcagaaaggaaatgttggggcccactggaacacagcacaatttaagcatcaaataaatactatccctgttttcaagatttccatgtcattattagttggccattttacttttagaaaatgttattatgtacagaaatcgttttaaaaactcccacccagttgatataaaaaatcattgacccaatgaggaaagtatagaaatcaatgaagaaagtatacaagtcctttttctaacaggaatttggaaggcaataatcctctccccacggttaccacttcttttattttacaattcatcttcttgagttctaaaactatttatcataaagtatgttacttacaggctttaattttatagatgccattctctggaagtacactggtttatcaaagttatcattacctaaatgcaacttacagaagacagaaaaataaactatgtacatgaagatggttattaacagcattgtttctgaaagaaaaaaagcaagactttggaaatattagtgccaaacactttggaaatgcttcagcactttatactgtactaacttgataaagtaatcccaccacttaaaccattattaagtctgtttaacaataattttaaaatacttacatattttaagtgaaaaaggagtatgaagtaaaatgtaccctacaatcacattattttcatttttatattagattatgtaatttaagacagcatgtacctaaataatctgtttaaaaagtccattctattataaaactaaaactatgtccattttaaataagcactgttattaaagccacctgaaatgtgtagtaaaaatatgggaataaaatgctttttaatatgttacataattaataaaaaatctttttactagagaaaagtctcatttctgcctacatattttacttcatatactgtaaataagattaccataatacagtagtggattctaaaaaagcaaaagtattactccattttcttgatctcaaaaatagcattatacaaattaaaaaattatttttatgtaaatattaaattaattttttaactgtactttcagaaattaaaaatacattttggaagaaaactaataatggaaaaaagatataacaataagacacttactttataaagatatttagaatccatttatttcttcatcatagtaatttaaaataatatttgaggacttaacgagatgacctttagtgatactgctaaactttttatttttctattctagttatatgctcttgagcaaaaagttggatgcattttgtaaaaatcaaccctttaaataaagattcactttaagaaaaaggcaagacagaatttgatttccaggagaaccccaattttctttcagtatctgatggagagtacatcagctacttgtaacagagccccagtgacctctggtgaaagaaagatccagtattaaccagtctaaccctggcatggtgattctgcaaagtcaggagagactcaagactcttccatcctttcactaaactatccttagcatttgacctctgtactcaagttccccttctgaactaagaagtgaattgcaagtccacaggacttcacctactaggcagaggaaggagggagcggcaagggcaaaataaaaaaaaatttttttttttaaatttaaaaagcgtagaaccctccagctgaatctactcctttgaagcaaccttctctaaaacctcatgcccctttgcctacttctcgctggcctgcagtaattcacatgaccacacccaaacataacctagcaaatgtagtcttatagctaagcattggcttcttttactagagaagaagaagaaatggaggttggatacacaaaaagcagtctctgcctttcgttgataagtattataaacagaggtatttttgtaaaaagtattttcttaaaacaattcataatgtttaacaagaaaaaatgtagataattggtaaaccactgttttgcacagaggttagctattccaaaaccattatgtactctacctataaagaatattcttcaggattaaatctcaccattgaaccagcatctacactttttcaagatgttaagttgtatattttgcctcctttttttcatggcacactataaatgttacctggtcatttggaaatatgtgatcctaacacatgtgtttaggaaaaatcaggtacattaattttaaataccaaaaagacataaaaatgtctatcactctagtgggtgtgtctaaaatttttttaatacttaacctgttgtacctcatactatagatagagcaaaaagaggaatagggaaggggttaatcctggcccataagtttatgtaaggtgcatatgaaaatggaaaggaatattttttattttgcatctctatgaatttcattagctacttgatatggtttggctgcatatccacccaaatctcatcatgaattgtaattcacaggttttggaggaggggcctggtggaaggtgattaagtcatgtgggtgaacttcccccatgctgttttcctgatagagttcccaggagatctggttctttgaaaagtctgtggtgtttccaccttctctctttctctccttctgccatgtaagacgtgctttgcttccctttccccttctgccatgattgtaagtttcctgaggcctccccagccatatggaggagtgagtcaattaaacattttttctttataaattacccagtgtctagtatgttttatagcaatgtaagaacagactaatacactatactactcaacattaaaaaattcaaaatatagaggtggaatgctagtctcactcatataccacacaagcaaacaaaaaacatcagaaaaaagatgacaaccataatggttttatcttctgcacatgttagtattttaaacaccaaaggatatcaagaacaaaggaaactagctccgaataccaggttaactttataactataatttcaattatgagtgtttctgaattatattgaatgactgataagttagaaagtctttgaagaaaagtgaccattccttccagccaatctacaaaagatctatgaataccaaataacgaagatcgcattggtcatgtatatgtgtgtatgtgtgtttgtgttgtgtgtgtatgtgtacacaaactcagtgtattgaaacagagaagataaacagaaattatatgggttggtcattacatcagcaaatatatgcatatgctactggcatttcattgatatttgaatatgtaatctcatttgctttactaaggaaatgaatcatttttatgaggaaaaaatcctatgaagtatggtaagtgatatacttattttagaatatttacaaagcaaattataaatttggaagatggatgtagcactatataatgtaacaataattttcctattaagattaaaatgcttaaactcctaaatataagaaagtacagacagattatgtttattttcaccttgtttacttccagggaaagaacagatcgtaaagtaaatggccaaggtaagaacggacagagatcagggaaacaccatatagaatggcaaaaataaatgtgaggaaattattatagacttgcatttggagttgggggaaaatcaggcagagactaaaggatagaaaacttgctagaaggatcaagatcatgtggtcaacaaattaagaaatgactgaaatgattcactgacaaaaaatcaaaatgttctgaggtaaggaaaaagagcaccaaatttttatgtgctttaaaaatatacaagaggatggttagaaaagcagactgaaatatggggaaacctggcaagtttcctaatgagaaactgacaaactggaaatcaaatcccaatcatagcacatggaaagcagtccaaatatgagagaagggatgttttctagcaaagctcagtcctgggcaggagcacttttaaaatatggaaaagaaattaggaaagagagtaatgttggaagatgaacaaatcttcccttgagagaaaagagcatgttggaaatgacgggttgcgttaactatgatttagccagaaggttgaaaatcttgagttgaatttgacctctgtcatcagcactctagaaaggcaaggggaaaaccttggagtcagctacctacaccctcctcctatcctttgcatgggaataagaaagacaaaaatttaaacccttaatgtgtatttagaaggtgcttccccatgaataaatcactaagctgccatgcctaggatatgactaaaaatataaataaaacataaataaaaatgtgttcttaacaaaagaaaacagctgcctggataattctagcattttggtgacattacactttaattcaaccctttaaaaagtaattttaagcagtgacacttcataaatacccccattcaggggatactcccatggaggaaccattttatgagccagtgattcaaaatcaccatttaattaaaatcagtaatgatcatttgctgccgccttttttatgaataagatggtctgcattttacacacatacaaacacagagagagagagacagagagagaaacacacaaatatatatatattttccaaaaatgattttcctccccaaaactaaatatacaaaacattgcttattgaaactggtatatattatggtgttttagcatgtgtattgtggagccctaaggagttaaaagacaaattgaaaaatgggcttagatgagataaagaggagcgaatgttccaagaaatagggtgaactgcaaatggctcattaacaccaaagcatcctgttacaggcactcaactcacagcccacctgcactgaagcttcctgtctgcaagcattcagctaaagcagcaggaccttataaaactcctcctccagccccattcttgtttgtagatagcagacagccttgactctgctgtcttgcccactgctcccttggaacgtattttttctttaatcaatctgaccttttaaatttattcctgtattactaaattattttaccacccatggggcctcaggcagtcactgaccatgacatatatgttaaggggacttgtataacaaataaaatattgcatatgaatcatttattttttaaaaaagtgaaataatcacctttaaaagaccaaactgtcccgggaggagccaagatggccgaataggaacagctcctgtctacagctcccagcgtgagcgacgcagaagacgggtgatttctgcatttccatctgaggtaccggattcatctcactagggagtgccagacagtgggcgcaggtcagtgggtgcgcgcaccatgcgcaagccgaagcagggtgaggcattgcctcactcgggaatcgcaaggggtcagggagttccctttcctagtcaaagaaaggggtgacagacggcacctggaaaatcgggtcactcccacccgaataccgcgcttttccgatgggcttaaaaaacggcgcaccacgagattatatcccgcacccggctcagagggtctgacgcccagggagtctccctgattgctagcacagcagtctgagatcaaactgcaaggtggcagtgaggctgggggaggggcgcccgccattgcccaggcttgcttaggtaaacaaagcagccaggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttcaagagagcagtggttctcccagcacgcagctggagatctgagaacgggcagactgcctcctcaagtgggttgctgacccctgacccccgagccgcctaactgggaggcaccccacagcatgggcacactgacacctcacacggcagggtattccaacagacctgcacctgagggtgctgtttgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactccgtgaagaacgcagaagcctcaggagccgatgcgatcaactggaagaaagggtatcagcagtggaagatgaaatgaatgaaatgaagcgagaagggaaggttagagaaaaaagaataaaaagaaatgagcaaagcctccaagaaatatgggactatgtgaaaagaccaaatctacgtctgattggtgtacctgaaagtgatgcagagaatggaaccaagttggaaaacactctacaggatattatccaggagaacttccccaatctagcaaggcaggccaacgttcagatgcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctacaagagctcctgaaggaagcgctaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaaccatcctaaatatatatgcacccaatacaggagcacccagattcataaagcacgtcctgagtgacctacaaagagacttagactcccacacattaataatgggagactttaacaccccactgtcaacattagacagatcaacgagacagaaagtcaccaaggatacccaggaattgaactcagctctgtaccaagcggacgtaatagacatctacagaactctccaccccaaatcaacagaatatacatttttttcagcaccacaccacacctattccaaaattgaccacatagttggaagtaaacctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagatacaacataccagaatctctgggacgcattcaaagcagtgtgtagagggaaatttatagcactaaatgcccacaagagaaagcaggaaagatccaaaattgacaccctaacatcacaataaaaggaactagaaaagcaagagcaaacacattcaaaagctagcagaaggcaagaaataactaaaatcagagcagaactgaaggaaatagagacataaaaaacccttcaaaaaattaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactttcccaagactaaaccaggaggaagttgaatctctgaatagaccaataacagaatctgaaaatgtggcaataatcaatagcttaccaaccaaaaagagtccaggaccagatggattcacagccgaattctaccagaggtacaaggaggaactggtaccattccttctgaaactattacaatcaagagaaaaagagggactcctccctaactcattttagggagttagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacaacgcttcaggctaaaaactcaataaattaggtattgatgggacatatttcaaaataataagagctatctatgacaaacccacagccaatatcatactgaatgggcaaaaactggaagcattccctttgaaaactggcacaagacacggatgccctctctcaccactcctattcaacatagtgttggaagttctggccagggcaattaggcaggagaaagaaataaagggtattcaattaggaaaagagcaagtcaaattgtccctgtttgcagacgacatgattgtatatctagaaaaccccattgtctcagcccaaaatctccttaagctgataagcaacttcagcaaagtctcaggacacaaaatcaatgagcaaaaatgacaggcattcttatacaccaagagcagacaaacagagagccaaatcatgagtgaactcccattcacaattgcttcaaagagaagaaaatacctaggaatccaacttacaagggatgtgaaggacctcttcaaggagaactacaaaccactgctcaaggaaataaaagaggatacaaacaaatggaagaacattccatgctcaagggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactatctgacttcaaactgtactacaaggctacagtaaccaaaacagcatgatactggtaccaaaacagagatatagatcaatggaacagaacagagccctcagaaataacgccgcatatctacaactatctgatctttgacaaacctgagaaaaacaaaccatggggaaaggattccctatttaataaatggtgctgggaaaactggctagccatatgtagaaagctgaaactggatcccttccttacaccttatacaaaaattaattcaagatggattaaagactgaaacgttagacctaaaaccataaaaaccctagaagataacctaggtaataccattcaggacataggcatgggcaaggacttcatgtctaaaacaccaaaagcaatggcaacaaaagacaaaattgacaaatgggatctaagtaaactaaagagcttctgtacagcaaaagaaactaccatcagagtgaacaggcaacctacaaaatgggagaaaattttcgcaacctactcatctgacaaagggctaatatccagaatctacgatgaactcaaacaaatttacaagaaaaaaaacaaacaaccccatcaaaaagtgggcaaaggacgtgaacagacacttctcaaaagaagacatttatgcagccaaaaaacacatgaaaaaatgatcatcactggccatcagagaaatgcaaatcaaaaccacaatgagataccatctcacactagttagaatggcgatcattaaaaagtcaggaaacaacaggtgctggagaggatgtggagaaataggaacacttttacactgttggtgggactgcaaactaattcaaccattgtggaagtcagtgtggcgattcctcagggatctagaactagaaataccatttgacccagccatcccattactgggtatatacccaaagaactataaatcatgctgctataaagacacatgcacacgtatgtttattgtggcactattcacaatagcaaagacttggaaccaaaccaaatgtccaacgatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcaaatggacacaggaaggggaacatcacactctggggactgttgtggggtgggtggaggggggagggatagcattgggagatatacctaatgctagatgacaagttagtgggtgtagcacaccagcgtggcacatgtatacatatgtaactaagctgcacaatgtgcacatgtaccctaaaacttaaagtataataataaaagaagaaaaataaaaaaataaaaataaataaaagagcaaactgtttcaaaggagaaatgtgtaagaaaatttcatcatgaatataagatatgccaggatcatgatgaaatgaaaaactttgttttgctggcactaaatgattgtttaaacaatgatgaagacattgatagaaggatatgaaatggtctttgccttgtgttaaaaacacaaagtgtcctgaagacaaatccagcaagaattttttcggcatagaaaccacttggtatggtaataaaaattaccaattctccattttatttccttaatgaagttttgacaatatttcaatggttgctatcaaattataacattattttgaggtagagcacagtagaacaaatactagaccctcaattgtctatagcttaaagtgaatggatttaagactatcaaaattcatgcatctataatttaaatctgaaaatggaaatgtacatccaaagaagtgaccgcagtacccatgagggaggactgtgcactatctgggaaaaactttctatgatattgataatacaacagaaaagtcaacattagcaagatactgcaaaagtactattaattctgatgtttaagaacgcaagccataagaaatgttttgattagttaaaaggctaagatttaagaaactatttacagctgattagatggatatttagatacttagaatctatttaactatatggtttttccttattttaagaaactcaagctggcatatacattaaacacttgacatataaatcaagaaaaagtatatcttttagatctgtttttaacataccacagactattttagaaaaagtgtgaaatttcagtgctgaaggtaaggaagtaatggcaaaaaaatttcaggattagagactaaaaatgagctcttattatcatggcatgttacataaaaaagaaataacaagatacttaatataattagcagattgtgaatttggtaaggcaatttttttctgttactgaaaatcaaaaattcaagaagttttagaactttaaatcaaattgtgtttgttagcctgaagtaaggtattgctatagatatttgaagcaatgagaaagatcatattctattttcctaatagaaaaattcatattaacattttttaagaaatggtgcagcagtgtgtatgctttgctgatttttttaaccaaatacttccactaacacaccatcatacttaaaaatataataatgtatcaggaataagaatgaagctccaagtttcagtaccacaggcacaaaaaataaatgtctgttttgaaagtgttatttattatcaaacaaaaatccaaggtatcaaaggtgttttacattataaacttaaacaacatcagttcattggatattgcactggagatggctacaatcagcaagagagagctaactggatacattatttttcaacttctggttcagtgacttcctggcagtagcttgaaatcagctatactgatagtattttcacaacagaaattggtaaacactataaattcaggtttgtttatttacttgtttgtttatttgaagagactcttattaaacattgaccaacacaccactgactataatacaaaatattttaaaagtattttgtgcataacatagagaataaatcctcctttaaaatgctatcatcaatccccttcacttggaaaacaattttaaaaggatgtcagtagtttatatcatttggaattaaattttgatgtacaacatttttagtacatctttcccccaaatttctagattaactgtagtgtcctgaaatagaagaaagctaagcttatataaaaaaagtttttaaaaactgtcaggattttctgtaagaaatatagaacacagaaataaactgcaatccaatcttaatagaataacttctctgttcatcataaacttagatttcaaatttgttgtgttcattaaaatgaattcagtgtttcatttagtgtccttataataaataaatgctgtgaactgaaacttacaataaaaatttattccaataaaatttaacttacatcagtttatacatatcaaaacccacctataaactttatttgaatgatgagctgtagtgctttaataaagttaaaaagcattgctctactccactggctttgtttatagatgaaaaataaaacagcacaaaaacaaaaacaaaaacaacctggagatcgtcagagatactaagtgacttgcctaccatgaaacattcgctgaaagacactgcatcttttttttttttttttttttttttttttcggaatcacactccactccttatagttgttatgggagagggccagaaaaagagaaggttttgtttgaataaatcaaattttcacataaatttcatagaatctggagaacagccattaaaagagtacattgtctcctctccccaaaagcacaggttctgactattagacgcactgccgtgatcatacagaagcaattccaggtaacagaaatgacacatgaagatattcactcaaatcattttcaaagctgctattccaattccctttcagatcaaatagaatcttggaaactgaatgtttttagtggaaccacaaagatatcactgcttttatttcaattatatataagcatttgatttttaagtaattataactattttctgcattcatcaattaattatcctgagctggagttctcatctgtaccctgagaatgatatgcaactcaggaatgggtatgggatgagtatggaaagggattataggggtaagacagggccaagcttatagtaaaggatcagcaaatattaatttcttaaattcaactgaaacagtacaaattttgaagcaatttatacattttaaagatattttaaaatattatatacaaatgtaaaatgttacataatgatattaaaatttatataaatatttttaaagcaattttttgggaaaaatatttacttgtaaatcaatttattttttccaacattcacattcatttaactttgaattggcatctacagaatattgtctctgccctgctaaaaggaacaaagatatacaaacatagttggcaataaatttaatattcaaattgcctatgaattgttacataaatctgttagccatgtcagatgttttgaatatatttattacagagtatttgtttgtcaacaaggtaaaacacaggcctggaatataaccccaaagaatgactcaggaaaacatcacacgtgaacatttcagtctgctcaaacgttggcttcatttgaattctttccataatttgagactgagtatcttgttttgtaatatcataacctaaatggcctccaaacaccctaaaatatattcagcacaaaactatataagtgagctaaaatatcatataattcttgcgcattataactgatgaataattaagatgattctggagacaatcagacggtttaaatgaccattcttcattcctgtcttctagaagatttaacttaacagtgcttttatagttattgctgtgagtcttatttattaatagataagcttccacaattatcaagcatgcttattaaacttgaaaaaagcattgcattttgcaaaccttctgacactaatgctgagaaaactcttcctttgaggatattccctaatgttcctgaataatatgccagacttatataattatataactcaagaagcatgttcccaaggccctggatgttatatctcagtaaatctgaagagagtctaaaataaatttgaataattgaaatgttaaatactcttaaataacaaaaattttaaagtttgaaatattttgttgactatgaaaacctgatgcattgcagatactgggagagccatcaccatctgactgcctcaaagagttcaaaaacgatgaagatttgttttaatgcataaaatgatcctaatatgctagcgatttaccagtcatctttggaagagtttctccctcaatatacaggaatacatgtacattgtattcacgtcgtatgaaatttcattttttaatataatctctattttaagagttagaaaaataaatctgaatgttaattgacccacttagagatgaaacaaaacagacaaaatgcaaccaaaagcttatggaagagagagtgggcaggttaactcattatagctagaaatgcaaatctgataaattgttcgttacacaactctgtttggggaaaatatatttttattttgttcaataaaatgaagtcaaataagactaacagggaaaatcgtaatacacacttttggactgagaaaatcttgctctgaaattccagctccagtacacagaagtagctagtctttccaactttgtaggtcaccattatgtcacctataaacttaaaataataataaagcaaggccgcgagcagtggctcacgcctgtaatcccaacactttcggagagggaggtgggcagatcacctgagttcaagagttcaagaccaacgtggccaacatgcagaaacttcatctctactaaaaatacaaaaaattagccaggcatgggggtgcatgcctgtaatcccagctatacaagacactaaggcagaagaatcacttgaaccctggaggcagaggttgcagtgagccaagatagtgccactgcactccagcctgggcaacagagtgagactatgtctcaaaactaactaagcaaataagtaaataaaaacacatacccacaagtgctacaaaagataactaaatcatgtctatggaggccctagcacagtatgcagcacttaatagacatgtcttttatgatgtgcctgttaaataacttaaaacagttatattaagaacaggatataggaaaaagcattttactttgagtttgaaataattaataagttacagaatagaataaataaatatttatgttaacgtctcatctcagaacaaataagccatatttgcgttattttaaaagccttaggggacctgactacgcctctacctccttaaatggtcagcctaaaagatggggtatagaagggactgaagctctaaaactagggccctgtttgagtttttcctaagcgtggagaggaggtagaagaaggaagggcaaagattcaaagagctacatccccacttgcacagaactaggaaggcagggccaatagcactttccagtataaagtaagggaaacaaaaggcaccggaggctcctaagagggcccccagaagtgccataagaattgaaggcaggaaccaagtatgtaaagcagcatctcatagccaaagaaataattgaccttctatctatcttgttatttggccctacttaagtataggattattttaagagttcagagaagatgggaggacgcaagctgggaatgaatttcttgccagctcggcaggtaggaacttggagaattttttgtttgtttcttgagttgacttctctcatcaccaaatctcatcatttccttgcagaaatcggttaagactatttcttttttcttgagcaaggtattatgactgaaaacagtactttttcagccaactatggtaattttataaagagggcaatgtgtccgtataacagattaggaatacttgtaattttaccagctacatatagttgctatttcatcctaattaatgtttgctgtttctgtaataggacattaaaaaaagaaaactactgttctgaactcggttacttcttctgcctccattttttcttgtttctgatgtgcctgatttgaaaactgagattctctgatatgtggtaattcactttatttattggagcaatttgtcccaacatgacatcctgtcaaaaggcagggtatttgttattattttggttatacttcaattagtaagtgtatgttgagaagaaagtgctcaatgtctttgtagactgctgaaatttttctgcagaataattcatttacttgagtagattatctcaattttcttttttttttttgaaatttagaagcaaataaaaaatagaaggcaaagaaaaatttgtttcataacccttatacatagcggaaagttgataaaataaaattaattattacatttgccagtttttcaagcaacttgtatgattttttttttttgcatgtggttcataactacttacttcaaaacaaaagggactagatggatgtagagatgggagagtaagaataaaaacaggacctttgtgatgaaaatatttcttccggcagtatatcttccaggaataaatcactatgaattctttagacattgtctgcacctatgccagcacatacttaaatgtcacaataatattatcactagtaccacacagagtatgtatagaaatatgcagtacctattcctgttcaaactactatgtcattatcaaggtagcagtgtgaacaactattccattcagcatgaggagtctaaccagacccaggaaacagaaaagtgactaaaatattacaaatgagggcaatctattatactatctgataatatgtgatgttatctgtggtattatggaataaaactgatgttatgtgtgaaaacacaggagattcttaagacttcacttggagtaactgtatgcaaaataaagcctatcaaaagaaagaatgctgtctacctaatttatttgatgttggtccaccctctttagaagcatcatccaataaaaatataatgtgagccattatacaattttaaattttcaaatcactttttaaaaaataaaatgaggccagtgaaattaattttaacaatatattccatttaatgcagtatgtcaaatatatttcaaccatttcaacatgcaattggtatttttaaaaatattgacatgtttacattttgtatactaagtctcgaagatgcagtgggaattagacactttcatcatctctcaatgcagtctcgacatatttcagatattcactacacacgtgtgagtggttattcgtttgagcagcacagttctacagctcttcaacgtatttctgcctgttctatgctctgatgaggctggaggaaacattaccagcccacagttccttaaaaacttttacaacactttgacaattagttaagtgtgttatgagtgtgtaatacaggatacctcagacttcactggttagtcagaaagtacaatgttatattcactgatttctgttcagtaattttcccttatatgtgtaggtatataactgtgaaattcaactttctgttcatcagtataattaactatgtaaataattatcataaaaagcatacaatggaatgatgttggatgggaacaaattctcaagagttattaatttctcagttatactaagttactctagttcagttgttggactctgaggtgaatataagaaattaaccatgttaaaatcacagaataatttggtaataccgaagtctccaacagaagaagtatactgataaaagaattgtaagctccatatatcctcctttatatatgtttatagccttaaaaatgaactaacttaattaaattgtattaatttaattcaattaccaaaatgcaccaaacagcaaatgtatctgccaaaaaggcaaagagaatatgttatattttccatgtctgcacttatcaattttagtcctaacaccaaaatacatatatcacaattactttttaattagactgtgtctaagctcacaattgataccagagtttcattaagaaactgaaggtcaagtggtaccatcattcctcaaatcacattaaaagttttgtccatttcatgatctatagagatagcttcttccacactattttggttcatctccccttcccagtagttataccaacacttcattacatgttgcacactcagtaacatccttttccttaagggagactgcctccttctgtgtgtcacagaagcccaggataacgccatagagaggggatggaggcacctgcctctgccacatagtctcacctaacaggatcagctcagcatcatggaggattttgtcttacagggaaaaggtaagcagatctccggtggtcatcactactgccacaaaatacaagcaatctttactataagagagcccccagtcctcacaggccctgaatccagtttgaagagtagccaggggctgcatcgcttcagagtaggaggccaacttaggagcccttacccttgcaacctaagctgctacagcacagcaccatcttgaaactagacccatttctagagtactttctgccctagggatcagtttcaactgaattcccattcctgagacaccattgtcactataccacattcacacaggtgcctacagcactacaactctggatgcctggagcctaggccagatggaattaccaagatctcaatgtctgaacccacatggcaccaccctcattccgccagggaacaactgcacttgcaacatggagaagctgctaaatagccagctgactgacttgcccatgtgcgctcattgttgtgcacagcccatgtacaacctggcaaaccagcacacagctacatccagttcaacagtcagccctgtggttccctatgccccaaccccagatcattgcagagccacctgaatccactgtgcctgcaaacactcacacctggctcaacaggcagtcccttagtggacctgtccactttaatatattgccaaagaggcacctcgcccagatatgcctgcaggtacatttacttatcccaatagtctgtatgacagcaattctgactctctggacagagtgccatgaagccatccggcccttctgtgcccagcccacccacactgggcagacctccaatcttgcagtgaccccaactccctggagagacagctgcacaatctcccagctggtcacactcacacattcatgagctcagcttaacagccagcctgtcaacagccactgcctccccagagagcccaccagccagcctgttaggcctctgtacacacacatgtctggcctgacgactaacctgatactctcaccccaagcaatactgtgccaccaccatcacaaactgtacagcctacccactgaggcaattgcagacattgctaatgagaattatagccaaagaaactgcacagagaccacagaggctagccagaaccaaaaccaacataccataacaaatcgacaccaaagaacccatccataggaaaaattcttcccctacaaaagttatatcattgtaaggaaacagcaaacacgaaaagtcaaggaaacatgatggcttcaaaggagtacaataagtctccactaacagaacccaaagcaaaggacatttacagaatatctgaaaaggaattcaaactgataatcttaaggaaatttcatgagatacaaaggaacacaaacaaataattcactgaagtcaagaaaacaatttatggtctaaatgagaaattcaacaaagagaaagatgtaattaaaaatatcttagagttgaagaattctatgaaggaaataaaaaatacaactgagagcttcaagaacagattagatcaagcagaagatagaatttctgattttgaagacaggattttaaaaataatctagtgatgggggcaaataaagaaagcctatgggacttatagaataccactaaacaaataatctcattacaggtattccagttgtagaagagatagaaaaaagaacagaaaagtcatctaatgaaataatttctgaaaacattctatgtattgggatatggatatccagattcaggaagctcaaagatctgtggatagattcaacccaaaagaaccttccaaggcacattataatcaaactctcaaaagtaaaagacagaattctaaaaaaaaaaaagtaaaagtaaaagtagaattctaaaagctgcaagagaatagtgtcaagtcacatataagggaactcccattagactatcagaagattgtgtagcagaaatcttgcaggctaggaaagaatggaatgaagagctgagaattctctcagatttaacttgtctgggaaggtctttacttttccttcatttacgacggacagttttcctggaaatagtactcttagcaaatagtttgttttttccttaagcactttgtatatatcatcccattgtctcctagcctgcaaaattggccttatagggaagtccaatcacaagactggccttatagggaacactcaagaaagtgctacaactgcaaacatgagaaggataattatcacaaaacacatgaaagtatgaaactctccaacaaagataaatgtataattcaatcttagaacaccctagtgaagtaatggtgcagtgtaaatctttcaatactccagtatgaaggattaaaaatgctcaaaaacaatagctccaagtagtggctaaggaacacacaacagataaataagtaaattagagcaacaaaaatattcattgtagagaagagggaaaaattgtagagtatttctatgtgaccaaagtcaagttgctatgaacctaaaataatccattttaaccacaagattttatgttagcacaatagtaaccacaaagaaagaaattaaagcagatacacaaataataaagagaaaggaaacaaagctagctccacagaaaaccaccaaactactaaagtaaacagccacagagtaagaaaggaacaatgtacctataaaagaaccaggaaacaactaacaaaatggcaggaataactccttatctgtcaaaaaccaccttgaatataaatgaattaaattgtccaattaaaacataaggtatagagtggctaaatggagaaaaaatggagaaaaaattagacctaactatacatagcatgcaagagactcacctaataattaaagacaaacatcaactaaatggaaggcatagaaaaagacatttcaggcaaatgaaaaccaaagtcaacatgaatagccatacttataaacagactttaagtcagagactgaagagacatcattatacaatgaaaatgggatcaattcaataagagtatataatagttgcaaatatatatacacccaacactggagcacccaggtatataatgaaaatattattacatctaaaggaatggactgcaatgaaataatagtataggacttgagttccccactttcatctaggaaaaaagtctacaaagaaaaattggaattaaattgtaccataaaccaaatggacttaatgaacatttgtacagctttccatccaacagctacagagcacacattcttctcaactgcatttggaacattttccaggatagattacatgttagatcacaaacgagtgttaacaaattttaaaaatctgaactcttgtaagtatcttttctagccaccatggtgtaaaactagaagtcaacaagaaaaacttcagaaaatttacaataacatggaaattaaacaacttgttcctttgaaaccaatgggttaatgaagaaattaaaagggatctaaaaatttttcttgagacaaacaaaaagggaaacaacaaaacctatggaacatagcaaaagcattcctaagagggaggttagcaataaacccctagatcaaaaaacaaaaaaagatttcaaataaaaaacataaaaacaccctaaaggaacaaaaaaaaaacactagaaaaaactaaactcaaaattggttgaaggaaggaaataataaagctcagagcagagataagtaaaatagcgattcaaaaaatgaaaagatcaacaaaacaattggtttgtaaaagataaacaaaactgacaaaccttaagatagacaacaaaaataaaagaaaactcaaataaaatcagagatgaaaaaagaaatgttaaaactgatgtcacagaaatacaaaggctgataagagactattatgaatgaacagcttcacatcaacaaatttgatagcacagaagaatcagttacattcctagacatacactgtctactaaaattaaattatgaggaaatagaaaaactgaacagaacaataatgagagaggtaattgagtcagtaataaaaattctctcatcaaagtatagccaggaacatctgttggttttactgctaaattaaaccaaacattaaaagaactaataccaattatccttaaactcttccagaaaactaaagatgagggaaaacttccaaactctttatgaggccagcattatcctgattccaaaaatgaataaggaaattaaaaaaatatataatataggctaatatccctgatgaacatagatgtaaaaattatcagcaagatattagcctaccaaatccaatagcacattaaaaagatcaggcactatgatcaggcgaacctgattctatgatgcaagaatgtcttaacatacccaaatcattaaatgtgataaatcactttaattgaaacaaagacaaacatccctatgatcattttaatagaggcagaaaaagcatttgacaaaattcagcatcccttcatgaaaaaaaattatcaacaaattaggtataaatggcaaataacacaataaaggccatacgggacaaatccacagctactatcataccgaatggggaaaaagtctacagttttcactctaaaattaggaactagacaaggttgctaacttttcaccacttcttttcaacatagtactaaaaatcctagccaggacaattaggcaagagaaaaaatattaaggacatccaaattgaaaacaaagaagtcaattgtccctgttggcagatgacttgattttaaatataaaaaaccctaaagattacacacacacacacacacacacacacacacacacacggttagaactaataaataaattcagttaagtttcaggacacaaaaatcaacattcaaaaatggatagcgtttgtataggctaataattaagcctatgaagaagaaatcaacaaaacaatttcatttctgatagctacaaaaaaaatgatagctaagaataaacttatccaaggaggtgaaagatgtgtacattgaaaactgtaaaactttgatgtaagaaattgaagatgacagaattaagtgtaaagatattccacattcatgaactggaagaattaacattgttaaaatgatcataccacccaaagtgatctacaaagttaatgcaatgcctatcaaaatacaactgacattattcacagaaacaaaaaagaaattcacatggaatcacaaaagaccctaaatagccaaagtaatcctgagcaaagataacaatgctaaaaatatcacaccacttaacttcaaaatatgctacaaagctatagaaaccaaaacagcatggtggtggtataaaaacagatatgtaaaccaacagaacaaaagagagcccagaaacaaatttacccacttacagccaattgattttcaaccaagatgccaagaacattggggataagacagtctcttcaataaattgtgctggaaaaaaaaaagatatccacattaagaacaaaaatagactgctccctttcatgatatacaaaagtaaactcaaaatgaattcaaggcttcagcgcagctcgtgaccagcgtgtgcaacattgtgaaatcccatctctacaacaaatacaaaaattaaccaaatgtagtgccatgccactataaccccagctgcttggctggctgaggcaggagaattgctggagcctgggaggcagagattgcagtaagccaagatcgcgccactgcactccagcctgggcaatgaagccacaccaatcctcataaaaaaaaaaaaaaaaaaaaaagacttctgtgtaactttcgtgcaaaacatgaaaccgtgaagctattagaaataaaaggaaaacagtggaaatgcttcatgacattgggctaggcaagaaatttttaaataagacttcaaaagcacaggtaacaaaagcaaaaatatacaaacagaattacatcaaacaaaaaaacgttttgcacaggaaaggccagtattaaccaagtgatgagacgacatacaaaacagaagaaaatatttgcaaacaatatatttaacaagatttaaaatccagaatatgtaaagaattgaaacaactcaacaataaaaaataaataattcaattaacaaatgggcaacagaccttaacacacatttctcaaaaaaatacataagaaaggccaacagatatgaaaaaatgctcaacatttctaatcgtcaagcaactacaacttaaagttacaataaataccacctctttccaggtagaatggctattaagaaaaagacaaaggaaaccaatgttagagaacttgtagagagaagggaatatttacacactgttcttgggactgtaaactagtacatgcattatggaaaacagtataggagttcttccaaaaaattaaaaatagaactaccatatcatccagcaattccattcctgtgtctatattcaaaggacataaatcactatattgaagagatacctggagttacatgttttttgcagcactgctcaccatagacaagacggataatcaaactgagcatgcagtaacagatgaatgggtaaagattatatggaatagatagacaatggtatatgattcagctttaaaaaggaattaaattctgtcacttgcaacaacatggatgaacacagaggacatgatgttacatgaaataagccagatacagaaagacaaataaatactgcagggtattgcttatatatagaatctaaagggaaaaaaaaaggtagaggatatcatagaagcaaagaatagaacagtggttaccagagactagggaagcaaaagaggagaggaggatgagaaaaggtttttcgagagaaacagacttacaaatgggttgaaggaataaattctggcattccactgcacagtagggtgactatatttaacagtaaaaattatgcattagaaattaccaagaggggctcctcaatgttctcaccacaaataaatgataaatgcatcaggggatggatacactgactaccgattattggatcattatacaacatagatttgtatcaaagaatcaaattatactccataaatatgtacaattatagtgtgccactttaatagtaataaattttaaaaattttcatgtctactcccctaaattactgacactaaaaccaataaaattcctcattgttacttcaaatatttccatatcataattttaaaaaatccaggatgtactcttgatatgacatcctatgtttctcatgccctggcttccataataaagaccatttgaacttttaaagccttcattatttattctcatcatgtgaagaccaagaacctgcctttacatcctgcttgactaacaaaatctaaatatgaattaatcctaaaatccttgtttgaggaatgagtgataattaagaaatttcactgcctatgctaccttgagcttacattcccctggatctccttatcccaaaatatcttctacataaacgcttaaattttcagcgatgtagtatagaaatccttcttctctattgatctactcactctaggtttgccttgaacaaactcttactactttgttttcaactgtgatttatatgcttatggataccaattttttgtcaacattctaaatttcttcatgtgagcctcagactctggtagacatactgtattacaagaccaacacatatccctaaattagcagagtcccaaactgaaaatactgtttcccacactatactaaactgaatttccttcaatgtttacttttcagttaatatcagttattgtcatcagcatccagctagtaacctactggtaatctacactacttcctctctcttaaattgatatttcatggagcgctgtgaattatctgttaaaaacaaaaatcttaacattatacattcatccagtaaagaaaaccttttatagcttcccatctgtgaaatccttagcaagatacatgaaatctctaattacctgttcctatgtgtatcgtcacttatctctcactattcttgttttcacactctagaacctaatagaatctttacaattttttaatacatgtgcttagatttatagtaatacggaacttactgaagaactcaaaaaatataaaaatcgtttcatcatttttagacaattaaaagtaatttgtgcattgtcaagtttatggcattatttaataatttttctatacaaaataattgtgactttaaatttttggtaaataaatattgtatgtacttgaacaacatgatgattttatacatgtatacattgtgtaatgattaccacagtcaaattaattaactcattcatccccacataagctttatcttagtacaacggaacttgcttatcttacaactgaaacactgaacccttgaacaacatctctcccattcttcctaccctccagtgtctggtaaccactgttctaccgtctattctatgaaatcaactttttaagattccacatgtaagtgagatcatgtggtacttgtctttctgtgtctggcttatttcacttaacatgatattcttcagactcatctgtattaccacaaactgcaggattttcttccattttatgtctgaatgacactctcttgtatacacatatctttctttttttaattttattattattatactttaagttttagggtacatgtgcacaatgtgcaggtttgttacatatgtatacatgtgccatgttggtgtgctgcacccattaactagtcatttagcattaggcatatctcctaatgctatccctcccccctccccccacctatgtccccaaagtgtgatgctccccttcctgtgtccatgccttctcattgttcaattcccacctatgagtgagaacatgcagtgtttggttttttgtccttgcgatagtttgctgagaatgatggtttccagcttcatccatgtccctacaaaggatatgaactcttcattttttatggctacatagtattccatggtgtatatgtgccacattttcttaatccagtctatcatggttggacatttggcttggttccaagtctttgctattgtgaatagtgccgcaataaacatacatgtgcatgtgtctttgtagcagcatcatttataatcctttggggatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgactttttaatgatcgccattctaactagtgtgagatggtatctcattgtggttttgatttgcatttctctgatagccagtgatgatgagcattttttcatgtgtcttttggctgcataaatgtcttcttttgagaagtgtctgtttatatcctttgccgactttttgatggggttgtttgttttcttcttgtaaatttgtttgagttcattgtagattctgaatattagccttttctcagatgagtaggttgtgaaaattttctcccattctgtaggctgcctgttcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctcggttttcttctagggtttttatggttttaggtctatggattaaagacttacatgttagacatatctttcttaagaatataccagaccacctttcagcatggcagctaagttccaagaatggaagtttcaaaaaaaaaacagactccaatgtgccaaggattgttaagtctctgtttatatcacattttcttttcttttcttttttttttttttttttgagacaaagtctcactctgtcacccaggctggagggcagtgacgccatctcagctcactgcaacttctgtctcccaggttcaagcgattcttctgcctcagcctcccaagtagctgggattacaggcatgcaccaccatgcccagctaatttttgtgtttttagtagagacagggtttcttcatgttggccaggctgttctcaaactcctgacttcatatgatgcacccgccttggcctcccaaagtgcttatatcacattttctaatgtcccatttgccaattccatgtcaaatggtcatgcacagagtcaatgtgggaaggaactgcacgggttgtgaaaaagaaagagtctgtgattgttttcatgccacaatgatgaagttgaatagttacaacagacactgtgtgccctgcagagccttaaatatttactatctagccctttacagaaagcatttgccaacctcaactctaatgcaatgacagaatataagtcatctttatatcatttaactacatgaaattaaagtaatacagttgttaatatatgcacacacggatacacatatacataaacacacattaataaacacacacacacacacagacacacatatcacccggtgtattttttaacctgtattgaatatacaagggatcttcaaatcattcatggaaaatatgtattatgaaagaactaggcaaagtgttcaaaaattttttgcaccaaaataaactcgtactacttgtttaacatgtctgacaggacctcaactgaaacactgagaagctgctgatcacacatcagcttgaaatgaatctctattagaaaagtaattctgctgaaattgcagcaagaacaaatacaaatttatggtgaagattaaatggaagaatggtgaaagcacggaatctttacaaaaagtttatgggagcaatgccccaaagaaatgaccagtttacaagtagaaactcattttaagaagggatgagatgatattgaagatgaagcctgcaggaacaaatgatttatgtcaatttgcaaggaaaaaagttatcttatttgtatcctaattgaagagaagcaatgattaaaagcaaaaacaaaagctacaacactgacatttcaattggttccacttacaccattcggactaaaaaattaaagttaagcaaactctacttgatggttaccaaaacctttgtacctaaatgagctgcagacaagtgctgagttttcgatggaaattttaaacaagtgtaatcaagatcctgaagcacttcctctaattttaacaggacagaaaacatgacttcatccagtacagttctgaagacaaagcacaatcaaaccagtggctatcaagaggtgtcagtggtccaggtgaaactgctccagtcaagaggaagggtcatggcagcagttgtttgggatgctcaaggcattttgcttcttgactttcaggagtgccaaagaccaacaacatctgcttagtatgagagtgttttgagagaatcatcaactaaagctttagcagaaaaatgcccatgcccgagaacatttcagcagagtccttctttaccataacaatgcttccactcatttctttcttcaaacaaggacaattttgcaagagtttcaatagaaaattagtagacatccatcttaacagtcctgatatggctcctttggagtccttttttttgtttgttttctaatcttaaaaacgaatctagaaaggacacctaaatttcttcagctaattttctttgaacttttaagttcaaggggtacatgtgtccctgaaacctttgtgtaacaaaggtttgttccaaaggtaaacttgtgtcatggagtttgttgtacagattatttcctcatccaggtatgaaggtcagtaccgattatttatttttcttgatcctctccctgcttccaccccaacactctgataggccccagtgcatattgttgccgtctatatatccatgtgttctcaacatttagctaccactagtaagttaataatgttttttaaaaaactgcattgacatcattaaattcccagaaacgtcaattcttcagggatagactaaatggctggtatcatcccttacaaaagtgtcttgaacttgatgacgcttatgttgaaatataaagtgtatattattttctttatcttttaattcaatttttccatgaacttcttgaagtccccttgtaagtagaattgaacatcaataggaaagtaagtttgaatagttatattcaagtagaaaatatagcataacctttgaacaagaaattaaggttgttaatgtaaatgattcctaagtgccttaaactgagataatttccaattttctgcacaaattttaaaatatatcagctacaatatacattagtccgtttcttctattttcttacgtcttttcttacagtagttagatgcttaactaaagttggatgtttaatttaactgattatttaagggtttttttaaaaaaaatcataaaacttgtaaagattaaaagttccctaacatgttttgttttgttttgtttttgttttttggacggattctcgctctgtcgcccaggctggagtgcagtggcgcgatctcggctcactgcaagctccgcctcccgggttcacgccattctcctgcctcagcctcctgagtagctgggactacaggcgactgcaccacgcccggctaattttttctattttttagtagagacggggttttcaccgtgttagccaggggtctcgatcgcctgacctcgtgatctgcacgccttggcctcccaaagtgctgggattacaggcatgagccaccgcacccggccttatgtttgtattttttattttttaagttgaatttcagttgtaaaaattgaattaaaaatatggaccaactttatttatttggttatttaattattccatcagttacttagaagtatattaggataaatgggtgtgtttggtttccaaatttttttttttggtttgccttagttaacatttactgtattatatgtaacttatatttccaagctaactacatgttgatcacagaagtactctgtatgacatcaatttgttatctgtcaatatgttttttagcattaaatattgtcaatttttacaattattacagtttaaagagtctgaatcattctttattcttcctctttctttctctctcttttgcagagttctacatatacctattagaataatgctattaattgtattgtttaaattgtaactttatatgtttttaataatcacagataactgtgaaagtccataaaattctagtgtgctatttattgttaaaagaggtctatgcatgcctattccagagtagacaaaactaataattatttttttcatatcacagtgactttagtttgcaaaggaatgctgctgatttatatgtcattatattcccagttggttatattacaagtcagccaataacatttagaatcaatatatatttggtcacaacatctcaaaaggtatgcaagctctctcggtatgcaatcacactaaacgaaaacatgttttctcattttttaaaaaaagtctttgaaaactggtgttacaaggaagaaaaggaaattatcagagctttctggatcaaagaaaaatccaaataaatgtttcctttctattttaatttaggaagtggaagtgtagaaagagctcttgaaaggagccagctatgtaaaaatcttatttgactcctaagtaataatgtgaacttggaaatacctctttacctcagtctcagtttccttgctcataatatgaggaagtcatttcttctgtagcctaatatgactctcttccaattgaaaagtgtatatgtccatgatggaaactatggatgactctggctaataaaaatgttatagagtacacaggtcaaagaaagattttcaaagtacatgacggcaaaatactcatggtgtttcagttgtagatatttgaggacagaaggtgttctttgatatagtacatggaaacatattgcttcactgttaaataaatagaagaggactatacttattcccacacatgcaggcaatcaaaacaagataatctatgtgttatctggggctaccatgactccaccaccagcctttcctgctgtctcctggatgctcataattctgggacacagtgctccagagttcaagagaatctgccatcagatagacatcgacttgaacttcagtctactacttattctactagacacacaactttgggaaacatgttcaacttcattaagtttctcctaaacatgtctacaagtgtgtttgtgtgtgtgtgtgtgtgtacacatagacacatatgtgtgtgtgtgtatatatatatatatacatacacttgtctcagtatacaattatactaaaacattttttctcattttctaaaaaacgtctttgaaagctggtgttagaaggaagatctgtataaacatatacatatatacacacacgtatatatgtgtgtacacatacatgtatatatgtgtgcacatacatgtatatatgtgtgcacatacatgtatataagtatgtatatgtgtgtatatgtatatacttgtatatatatgtttgtgtatacacacacaaacagtacatacacctaattcctgattgatttaatgaaaagtgttttaaaagaatagctgtgttatgttttattgaggcatatagataaatagtaattggtagttataatctagcaacagaaacagattaacaaacagaaagcagtttcaatgaaaacgacaataataatatcaactatgttgaaatagcaatgccttcttaagtcactattgaagtgcataataatttccctttttaaggcatttgcagacatcgtgacattaattcttttatttagaaggatcacattctaactattctatttgctttcttgtgttatttgatatgatatatggataactatcaataaagctattatgtggttgaccatgaactttaaatatattgctcatgaatgttgtcagcttaatattctatgctaaaaattcagcctaaaagattgctcaagaacatccctgaatttacacaaaattccataatgcccaggtggtccaagaccaggcaagaccaagaggttggttagaaataaaatgagggcatggaaaactgttttctaccaccgtatctaagagatgggtagcattttttttaacagggtgaatcttttccttctgtgtaaatttgtaattgaagatagaaaaagctaacacatatactttgtagaatttaagcaaatatgattttattttaaaaaatgtggaaggcaaaaggagacatgaaagggtgtctgcagttctggtaatgttctctttgttatcagggccagagtatatgggtgtgttgactttgggaaaattcatagagctgtatatttatgatctgtgtgctttcctatgaatattaggctcaataaaacattacagtgaaaatttcagagacataaataattcattaatccaacctttcaaatacaatgttttttctaatatgtatgttgcataaaataggtaggatgttttaataggtaggtttttttaactataatatcttgccaaataaatataatcttgcatatattcataattcaattaccatgaattttaaaatatttctatatatttttaatagtttgatcattccttttatttttattgtattatgttgaaatgcttaatctgtttttctcagttgattttttatatactgaagcatagtagaacctaaaacatgaattattggtaagtaaatgtagcctatttatgaaaagaacactttattccattacaggaataatgtagtattaatgtattcaggttttgaaatgtgaattaatatgccaaagtataggctctcacattaatgatcgttaaacacaaatgacacagagtaggtttaggcagagatgacaaattcaagcacctacagagagtcatatgtgagtaaaatggaggctgttgtcaactggaaagaaaaaaaaccatctaagcgcactgaaattcacattttattaaaatcccagagaagccaaacatacagatctgtgagtacaccttgtcggctcgtgtctttttgtgaggtattttaggtgaacttttctgacccattgacatgggtccaggaagcatgaggttgaaatatctgagcacttctgtgaactgacatccttgcctaggctgattgttcttaacattttagtacatggtttgatttgaaagggaggatagccttaacacctcaggtttttagttgattctcagctaatctgaattaactgcaaaaggtgaatgtgcttgcagatggggacgaaggaaggggttccctcagggagctgctttctatttttctgctataggaagaagcagcatagttgggggtggttggagcaagtggaggaaacttcaaagaagaaagaggagtctttcaatcttggaagaaagaagaaattatggagctagggatgatccaggaaaaaaaaaaatgtgttaaattaaatcaactgaaaataaatgggtcctctctaagaatatttatgaaaaattaaaggtcaacagtttggaggggagaaggtgaggaaaatatgtttttagcctcgcttagaaatattgtggaagctactttaaaaatgactacagccttagtcaataattcctaaaatagtataattgtgttctatttggaaatagggcaaatgaaaggagttactaacagcattgcagtaaggctgaatatataaataaattgaaaagggctttagatttttttttcatgatccgtgattctcactatgtcattgtaaattggtattttgtaattgattttttcctgaacaactgtgtccttccttaaagaaattcctgatgctgataaattaatcattacctgaatagattctatggatttatattttacaaaatcttttagaattttgagcttagccattttattcatgtcattaaggattcttttatctctttgcaaaaattattttggtaattcataatgtgtcactcaagatgggctaaacactacagtattaccaaatcaatttttaagccaaacaaaggtttatttttcatgctacatgttaatcgcagactgaatgaggtccctccttaacatagttgctcaggaattcaggctgccaaagagttccccacctgaaaagatgttactcctagcagcaaggagaggagacagagcattcccgatctgaaaagatgttattcctagcagcaagaaaaggagagaaactgaaaactattggatggcctttttatgatcgcactttggagcggaagtgtatcatttctgctcaaattttgctgggccagctttgtcacatagtcccaactaattttgaagaagtcagaaacaaacagagggaagcgtacagaatatttggagagcatgtcttccttgataaggtggaaagagcacagaactttgtgatcaagggactcggatactgatttaatctctgcaggagcttgagcaagttactttctctcccaggaccctcacttgcatcacctgcaaaagaaactgctccctctccctgctttttagcaacatcttcagaactacgataatgcaacagataaaaataaagtatctaccttaacctgtccctccaattccaatacatcagagccacctctacagatggtcctgaaacaactcttgtctaaaattaaagattcaaaatgatataatttcctgtgaaatagttagattgcaatctctcatcaaagacacaagtttactcaagacatctgtccaaaaatgggcctttcttagatcatcctaatatttttctttgaatgggttacaggtgtaggaaagatggttagcccctcagtgcttgagcatctagacaaagccttaggcacctgaaatattttcatctgtcatttgcgaactaacctgacctattatactaggattccaaataaatactaatatttttctgtagttatacattaaaaggttaaaaaccattaaccaaaatgatgacctgaatattttcttacttactttccagttatataaatctaattatattcccaatctacacgacagttctctcctttcactcacttgatactaaactgtgttttggaattgaagactgtgtctgcaggatactgcatttctctctggtttttacagcatctctccaaccttgacacaccgcttacctgcttttccagatcattaatgagagtgttaaataaggctgggcccagtaccaatccttgaggcaccctgctagacacctgttctaatttgatattccaccatttatcattacttatgtttgctgcgctttagccaatctgttcttggcctaacaacagaagcacagtgactcttggtaacgcgggctgtgtgaatgtatttacattcctgaggccaaaagccactgattctcaattcaacaggggatttctttatgtcagttgctgggaaatgttttcagtagaaacaatcattacaaagtcttaaaaataataatttgcaaaaattaagagttgtggaataaaagctgctgagtaatcatctataaattaatagctgaaattaaatttccaataagttgctattcattaaggtagagtaagatgcccagcacgtgagacttgaaataaagcagctgaaaccattactgccttccttggtaaatctattcttccctttaggccctctaccttgattaacgtcatctagggacattcacacattgcccccatcatttttactgcctcccccacacctcccctcccacctgatcatcagctgacagaccttttaatctcagaggggtccattgcactgcctaaaaacaaaaaatcaatttgtaaccacacaaatctatttgagccaatgaactctacaatcttgagtgaatcacttatgctgaattctgaaattcaatattctcatctgtaaaacagagggaaataatgtttctatcataagattattgggagaatatttaaagataggaaccattattaaatcctcaatactctgcttccaaaatgtaggtgttatgttacattttatttccctgtcccatacaataacctggtatcccgctttctagtctgtcgccctccctctctgcatttacccaacactcacaattgtgtttttgttttgagacggggtctcactctgttgcccaagctggattgcagtggcatgatcttggctcactgcaaccttcatctcctgggttcaagtgcttctcgtgcctcagccacccaaacagctgggatcgcaggtgctctcaccatacccaggtaattcttttagtatttttagtagagacacggttttaccgtgttggccaggctggtctcaaactccttgagctcaagcaatccacccacctcggcttcccaaagtgctcagattacaggcatgagccacatcctgggcccataattatttttctcttaatgacaaatcaaattatgtcacttccttcttaaaaatatcttatggctactactttcatggaaaacaatattcacagtccagaatgtcatcttgtattaacccacttgtccagctttaaattagaatatcattctgtattttctgagactatataaaccttttcatatatactcaaagaatttatagttattttcttctttaaaaataattatgccctcctcaacttctaaagccctaaatttaaatacctgtagctcttacaatttgccagacacaaattttgtcactgataatgcagcaggcaataaaacaggccttctctgcaatcatggagctttctctccttggagacagagaaaataagcagtaaatatgtgcaccagtcaaggctgggtgcttttaagatacagtgggtgatcaggaaggccattttgaataggtgacatttgcacaaagatcacaatgaagaaatgatccatgaaaaggtctgagaaaggtgtaccaggcaaagggaatcgcaaatgagatattctacgagaaaacattcttagtgtttccaaggaatcgtataattaaacgaacgatgtgtagaaaggtccacttaagatctgtactcctccttccagagtgtagagttgcttgtaggaattggctgctcatatagggactacatttcccaactcccgttgcatcaggtgtgtccatgtggcaagtttctatatgtacaatggaggcaaaactggtaagtgacattgctggaccaaagcagtgaagaaagtggtaggcctactccaccctctcttccctcatttggatgtagaagggtcttcattcttgtactgtcaatacagaaatatttttatttatgaacttatttatatattttttaaatttctgtatattacaatgggatgggtttttttgtgaagaatcgtacttagatttacgttttttaacttttcattttgagtaattatagacacataatagtcataatatatttagggagtgcatgtgatattttgatacaatgtataataatcaaatcataataactgggatatccatcacctcaagcatttactgtttccttgtgttagaaacattccaattccactcttttagttatttcgaattatacaataaattatgtagttagatatacacaatgtaatattattcagccataaaaaaaagaacaaaatcctatcatttgccacgacgtggacagaaatggagtacattgtattaagtgaaataatccaggcacagaaagttaaatctcatgttctcactcatatgcgggatagagagagtagaatgatggttaccagaagctaggaagggtagtgggaagggagcaaaaagagggcatggttaatgggtacaaagataggtagatagaatgaataggggctagtgttcagtagtagcacaataggatgactatagttgacaataatgtatattttgatgtttggtatcttaaaaaaacaaccctctctggctattgagagactgcccctcctatacctagtcagttctcagagatagcagaagactcaccttagagcatgccattgatatgcaaactaaccaatctggaggcatgcctcctttatctggctcatgtaccccagaagacaatattcctctgccttcatcatcccaggagcaggtaccatacaactaggtagcagcaccccaatagtgtagaacctgttggaattactcagactaggcaatctgaagctgtttacctcccctgccttgcttttcccttagaattcccagtgaaggctctagcctctgattttccctggctacttttgccttccttttctgctacctggaccaaaactggaccctttccctgtgacacggcttggtgtgccatgactcctctctaagaccctggagtataaaatctttgttttcttgtgcctcccttgtatcttttcgtggagctgcatctgactgatcatcacataaaagaacacaaaacagttcctccggactgatgccagagcattacatcaattaagagagtcagcatagcgggaacagggtaaccaaagtggttagaagtaggagactcagaaaggtgaccaggaagcaggtggaccaagcatggctatgttggacaaggtaggacttcaggtgatctcctcagtatgaaagaaagacctggagggtcttgagaaagtatctgacttagttttaaaagaataatgctggcaagaatagactttcaggtggttgggagaagactgaattcaggaagatcgaaaagactgatgtaacactccagctgagaattgatggttgcttaaactagtatgatattgatagtgaaatagcggggtgatatattttgaaagtagagataaaatatttgatatggggtatagaaagagggagaaagagagagaaaaaaatatgaacgatcactcaaagtgtttacgcaatgagtagccaggtaaagagaggtgcaatttactgagatgatgcacgcttgcagaggacccattgtgtgggcatacatgagaacctgtgttaggaaatactcatgttaagatgtctattagactctgtagtatagatgtcaagtatgcagttggatttatgtctggagttcaggagaaaagttaaatagagatttaaatttgagagttattattgtttttatgtaattataaccaaagcactaacatttgttttacaataagtttcttttattcatctacattatgtagtgcaataaacactttttttccaccatccaatgttctaatgaaagtcttgaacgctcttcctccctgatatactgtagtttctactctttttaaggacttttttgttaaattgtcctttgagatcgtccaatcacattttgaaagttatcttttggcttaagttctctcaattagttacgtatttcttgtaaacaaaaataattttatttggacacaaacatttagttatttatgtatctattacttcatctagcctgtcttatttactttcattgacccacttgacaaggattgaaaaggatcaatgtcattttaaatcagtagaaatgatattaacattttctatatttatattgcaagatgtatattctaatttgtagtattatgtaatcaacttgttttttacttttatattttgtgcctttgtttttacaccactttacactacaccagtaatgcggagaaaccaaacaacacccttagtcgtaacatttaaattaataaaacactgttacaaatgaacacaccttaaagaaagtaaatgttcaataaaatattgttaatatgatttgaatgtaattatctgcttaaaagtcaaggaaagacaattcctgcttaagggatttttaaatacaagagagatgagtgttaatcagggttgccagtgaagtctccttgccacctattatattgcaagggattggtattagaacaatattaaaattctaaacatatttattcacataagattatagtgtggtttcaaataatcaataactgaatcaataatcaaatgtgaattcacattgatttatttgaatatgaattaatcacgtttcagttgtaataatacaatgttgcggaaaacaatatatcaacgttccgtggccaggaaaagctgtgattcacagtacttcatcaaattctagaaaatatcatttctagtgttgccaattaaaaatctgtactcagataagtgggactaatggagggggaaatcagaatcaatgtcaaagaaaccaagtctcatttctccaaaatgagtttctcttgcactctaactatcttaacttagaagtagagcatgaaacatcaattgaggatatctaaataattttatcttgtcaggagctatattttataagccatttaatcttcacagaacttagttttacctaaaaaagaaggcatttgattagacagcatctactctttttaactttatgagactttttaacctcttatgagactcaagaagtgtcagattcattgatgtataacttttgtgttttatttacatagcaaaatagcaactcccataataatatttattttattttgggactctactatagcttattacatcaaagatgtcatcttaaacttcccattattactatgaagtcagtcttacaattttcatcctacaaataaagaaattttatcaatgtgtaaacattttgtttgaagtcttgtagcaataaaatggagaaccaaatccatgctaacactaagaataagcatttgagaagaacaaaaaaaaaatcaagttacaaaactaggttatttaagtttaaatgctgcatgtctgaaacattaaacccaaaagatgttaaaaacagactaaatgttatgggctgtatcaaccatcaaatgtaaactaaagagcaatccacctggtccttctcttctgctgcatctacaagcactggctccaaagaagctctcaggctaacctaacataagagataaataggcagtttcaaaaggctactatctagaatttcatttattggatttcaccttgcattcagggaaatgttgtaatgggaggattcatagtcatggtatttaaagaactaaaattctatcctttctgagaatcttactctccacataattgcatgattggttagtaaggagtttcagactctggagcaagaaatttaatagcttgggataattttaaatagtaggtttccataagaaaaaatacattttataccagatgagtaatttatttcggcgttaaactaaggaatacttggaatgttattatgtcgatggccaagagttgtgttatgagtgctattggaagggacaagcccatactaaatggaattactgtcagaaagcacaagtaatcaatatgttttctttaaaactgacataaaatcacagaatattaagggacttcagaaatcattttatgcaatgttgtcatcttacaagtgaggaaattgagacctggaaaaatttttccctatcacatcaaactgttaatgaatgaggacaagatgagaactgaggccacctgacctgcagccctgtgctcttcacatggatttggcttccataatagaatcaccatctcagagtacttattcagtacaggactgaattatgtgggtataagtatgtgtggacttcatttttattcatttagcaaataggtggtgaacatcagcttcatcaaatcctggggtagattctagtaagacgatgataaaacaaaacagaaactttaatgataaatgataaaacaaacatgaaactttagccagaacacacataactgcacatcaggataaatcttctgaagtaaatggagttcgaaggaccaacaagagagcagtgattagcaaatgttttcctgcctttctgatatcgaaactgacatctgaaggataagtgaaagaaaattaatcaaagtggaataaagagattcaaagggcaaaacaagcaaatgtcataggcaggagagaaaaaaaggaaggaaggaaacaagaaaaaagagaagaaaggaaggaagacaaaacaagagagagaaacaagaaaggatggaaagaaagggaagggaagggacaggacaggaaaagggaaaaggaaagaaggaagaaaggaaggaaaggaaggaagaaaggaaggaaaggaaggaaggaaggaaagaaaagcaaaaatagggagggagagagaaagcagggacacacagaacatagggcagagttatttgagatgatgtagagtgccaggcaggggaaacaaaacacagtgcttataagcctgtttaagaattgtttttatctttatgtaaagagtaacagaaacttttgaaatgctttaagccctggaagttacatgatgaaaatgtacttgaaaagattaccatgcttgggatttgtacactggattttaaaatgcacagactagataaatgaatgcatttcaggagaggctattatagctgttaaagttagcattgaaaacgggatgctccaggggagactgaaatttgtctggagccatgcatttttctcatctgccaatgagatttattctcttattagaacccttgcctgggcacggtggctcatgcctgtaatcccagcactctgggaggccaaggcgagcggatctcctgaggtcaaaggtttgagaccagcctggccaaagtggtgaaaccccatctctactaaaatacaaaaattagctgggtgtggtggcatgcacctgtaatcccagctacttggaaggctgaggcaggagaattgcttgaacccaggaggtggaggttgcagtgagctgagattgcaccactgcactccagcctgggcaacaaagtgagagttggttttaaaaaaagaaaaaaagaagactagtttctatgtacatagatattttatttgcaacaaggacaggaagttaagtctttttttttaatatgggggtttaaaacacgacctatgagtacattattaaaactctttgattatttctggcttaatgtcataaaactagtgaaatcaacacaggccaattagaatttcaggtatctattttctgaaaatgacttagtattttgtatgtaccttgtagaatgtctggaatcttgttaagtgcttactacatgcctgttcatcattgtctatccatttatctgtgataaacactaaattaaatagtgttatttcttctagaataaaatcaattattttatttacaataataaaaaatatattacatgtgcaagtgtgtttttgcccacagatacatggagacacatgatttatagacacacatacaaagcacatccaaaacataggatatgatctaaaaaaattgcaaattaaatgctaaagatgaataaacgtggtctttataaaacactgccaagaacttcataaatatttatagatagcacttttaactcattaattgccttacattgccttatctaattttaagcctaatcaaaaatcaatattacttgggttcccagtctagtcttagttctgttcaagagaaggccacccaaatatcagcctctgatgaacactgtactatgcctgaaataagaaaaaaatttaggaaggaaagaagatttgatatcatggggaagctatgttttgtgttccaggaaaatatatatttatatatcatataaataatatttatataattcacattttaaaaattatatgtacatattatatttatacagttgacccttggtattcatggtttcaggacctccatgtatactgtaccaaaattcacaaacactcaagtttctcatataaaatggcatagtatttacatataacctacacacattcccccatatactttacctgtttccactgtaagcatataagtgctatctagaaaaacaaccctacaacgattcactgttatatatcttctcacatactttagagagtggaaacaacagtagattcttttctttccctaattattctcttgtcccttccctatgagagaataatatatcctttcctactgccatgtgctttgccatacccctgtggaatgagtgtacttgtgttacaactatgatttccaacagcatgtaacaaacgtgacttcgggaaatagcttcaaatgctatggtgtcatttgttccaactgtttcacttctatcccctttaccatgaaaattgtttgccatagtatgcgggctcctctcatccagctgacatgaaacatgagaaataaactgttgtcctaacatgaggagatttggggcctgtttttttccgagcacatgagcctaaagatgactaatacagctaacaaacatatttttaaaacctaaatgtctaaaaacataaggtccttatttttgcttctagaagtatggaataacaggagctgagtttacctttctccctgaaacaatcaacagagaaattatctgaaacaacagtttcaacatttgggacattaggccatataggacagtgacctctgaaagactggaaacatacaatgcaagccttacaatgcaagtctcatcttacagctgtgacagagttttcagatgcagggagggaatacccaggcagagcccaggaggttctctgagttgacaagaatggctgagagtttaggtggaaaaggcagctagaatttacaagatagacttcagaagagacaagagctgcatagagggtgaattctggaaattttcaggtttccacttcagtattcacctgatcagtaaagaaaaccactgaaggacagggaaagaacacctaaatgaatgagatgatggtgcccagcactcacactgggctaagaaatggtgcctattcttaccagctaggatggaaaaacttatgactcatgggcaatcagtaaaacacacagatgcatcttgtctcagtagtagggaataattattcctacactgagtactgctccagacatgcctaacaattcttaaaggcaaaattgaaataacaatgtttctacataactcagttgtataccaaacaaagctttttgttatacaaaaatacaaaaagcagcacccaaatagtaaatttcacaatgcctgaaaactaatccaatattatcagacacacacaagcaggaaaatgtgacacataataagcaggaaaagatggcttacaataagtagaaaagtgaacagaaactgacctaaagttgacaaagatgttagaatttgtagacagaaacacgaatacagtcattttaactttatatgttgtaaaatttatgtagagacatggaagatggaaaaacgatgcccaaattgaactttcagagatgacaactacaacatcttgaatgaaaaattcacagaaaggaattaatggcagtttagatattgagaagaaaagactagtgaacttacaggtgcagtaataaaaatatccagataaaacaaagaaaaagaaactaccagattacataaaaagataaaaagtcagatataattatatgttttctacaaagaaagctaacatgaatcaaaacaaagcaaaaatggctacattaatatcagacgaagtggtcctcaaagaagactattagcggggataaaaatgcatttcttgatgataaacgggtcagttcacatggaatcattataagcttaaacatgtatacacccaaccacagggtttcaaatacatgaagcaaaaacagaaagaagaaatagacaaatatataattatagcaaaagatttcaaaacacctctctcaataattttattgaacaaaaatacagtaaggtagtcagtacataacagaccagaaaaaaatactatcaaccaacttgcctaatttatgtttatggaatgctgtatccactaaatatctatgttggaaaggaagaaagtttgcaaattgaccttggaattcacctgaatatatgaggaagtgttgattaaacccaaagcacatagaacagttataacaaaaacaaaaagagaaaaatcaatggaattggaccaaaaacttaatatatacaattaaaaaaaatcaaaagttggatctctgaatagataagttaacgtatcccagcaagactgatcaggaacatacaggaagaagaaataaatcattaatattagaaatgagaaaagtcacatcactatagactccacggataacaaaagaaaaattaaaacatatgaacaactttataccaatatgtttgacaatctagacctataagaaatggtcagatctctttaaaaatacatactacttaaaaatccctccagaagaaatagaaaatctgaatatctctgtatatatttcaacaaatgaatttgtagctaaaaccctttaaatccaaaaaaaaaaaaaaaaaaaaaaaaagtcagacccatttggctacagtggtcaattcaatcacagataagaagagaagaataccaggccagaagcagtggctcactcctgtaatcctagcactttgggaggccgagtcgggtggattgcctgagttcaggagtttgagaccagcctgggcaactcggtgaaacgacatctctactaaaatacaaaagaaattagctgggcgtggtggcacatgcctgtaatcccagctacttgggaggctgaggcaggagaattgcttgaacctgggaggcggagattgcagtgagccaagattgtgccactgcactccagcctgggtgacagagcaagacttcatctctacaagacaaaatagaagaagaagaaagaagaaagaagaaagaagaagaagaagaaagaagaagaagaagaagaagaagaagaagaagaagaagaagaagaagaagaagaagaagagaaaaataccaattctacaaaaacttttcaagacattaaaagaggaaagtcctgtttttccaattcattttatgaactcaatattaccctgatatgctgatatgaagacttgataaaggcattatctaaaatagaagtttgtggaccaatatccctcatgaacatagacaccaaaaactctaaattcattttagtaaattcagtccatcaaacaagatataaaatggataacaatatatgagtaagttgacttcattgcaggaatgcaaggatgactaaaaattctcaagtgaatctatgtaattcaccatattaacaagtaaaaaaaaaggaaatacataagataatatcaatagatacagaaaatgtgcttaataaaatgtctttttctattaaaaattatcagaaagtaggaaaagaaaggaaataactttataaagagggaaggaaggaaggagggagggaggcagggagggaaggaaggaaagatggagggagggaggaggggaggagaggagggaggggaggaggaaagggagggagggaggcgggagagagggaaggagggaggggagccgcagctaacatcatagttaatggtaaaaaaaaaaaaaaaaaaaacctgactgttttctctctaatatcacaagtaagtcaagctgtctgctcccaccatctctagtcaacattgtacttgaggtactaggcagtgaaatcaggcaacacaaacaaacagaaggcatccagattggaaaacaaagatgtcattattcatagacaacataatcatccatgtagaaaattaaatataacctacaaagaagttactggaaataataagtgaatttagaaagacaagttaaaatatcaatattaaatgtatttccatactagcaaacagctgaaaataaaattttaaaaatattatatacagtagcataaaattataaaattcttatggtaaatatggtaaataatgttagacactgaaaactataaaacattgtttagagaaatgaaagagggcaaaataaaggaagccatagctggtgttaatgggtaggaaatttcaatattatttagatataaattctccccaaatgggtccatagtttcaattcaatgtcaatcagtcatttgacttttctgtggaaattgacaaaatcacttcaaattcatatttaaatgcagagggcctaaaatagccaaacaacgtttaaaaagaggaaccaaataggaggattaacactatctcatttcaatagacattataaagctcttataatcaacacactgttgtattagagaaaataatagacatattgatcaatagaagagaatagacagattagatatagacccacacacgtatggaaatttcttgcaaagatgcaaaggtatttccataaaagaaggataatctttcaacaagtggtgttgggactactggataaccatatgtaagaagtaagctttgatcttctctcccactatctacaaaatttattacagcatttaagcaaaaatgtaaatcctaaagcaataaaaatctttttaaaaatcatagaataaaacttcgtcacaatggattaggcaaagatttcttaagaaccgtcccagaagcacaatcaataaaaggacaaaaggataaaatggatatcagaaaaactgaaaacttttgctctttaaatgacatggttaagaaaatgcaaagacaagctacaagctataaggatgaaatctgtgtaaaggatttctatcaaaatatgtaaagagctgtcaaaacacaataataagaaagccaacaatttaattaaaaatttagtaaaatatgtgaacagattgttcaccaaataaggtatatggatggaaaataaacgtgaggaaagatgtgcaacatcattatttattaaaatatgcaatttaaaatcacaattaggtacaactcacatactagaatatctaaaattaaagagactgcttgtgtcgaccagtgttaaatatgtagtggaactgaacttcttacactctactggtggaaatgtaaaacaagaaatcttttttaaaaagaatttatcaaattctttaaaaacttaaagactgtatacagcaaccatatgatccaaccattccactcccagatatctcaccaagaaaaaaataattgtatctcaataaaaatgatttcacactaattttcatagcagctttttttttgtaataacctaaagccggaaacaacaggtgaatagattccatagaatggaatactactcatcaataaacagaatcagaataaactattgatatatactacaacatggtttgatctcaaaataattagccagacattccagagaacatattgtatgatttatattctataaaactgaagaaaatgcaaactaatctatcacgaaatgaagcagatcagggcttttctcagctatacgtggggtgaggccaggcagagtggttctgaggaagtatcaggagtctttgttggtaatgcataagttccgtatcttacagtggtgtctatttaatgaatgtatacttatgtcaaaaagtatcaattagtacattttaaatatggaaaactgtgcttcaataaagttgttataagaaaaaaatgaaattcaaattggaaattatagcactccaagtactatctacgatagaaactttttaaattaggcactttttaaaaagcaaaatgtctcttttatttctttatcttcaaatcaccttaatacagaaagttaaacataaattttggtttctttttacataggcattgagaacagaacattctactgaatagccctattatggatttttgcaaactgttatacccattcgctctcttctatatataggctgaaatatatctctctttatgaccaaagaaaaaaatttattttcaatgccttcacactattagattcatgatgtttgctttacttcaaagtatctcatattatctcagtgttaaatttcattacataatattagtgtaagtttttcattcaaatgttcattcaataacaatttactgaacagttaaaatatgcatgcactgtgctgggccgtgaagttataatcatgagaatggcatagtcatggttgtcaaggagtctcaggactttaaaggagagaaggaggtaaagaaacattagcatacagtattgcatacacaatactcagtaactagaaagacagaagatggagaaaacaaagggatggttagttttgattggcgagatggtggagcacacaagtgagaaacgtgtgagaaggcttcatggaataagaaccaaatatgctgagttttaaaggataagctttgggaggtaaaggttattatatacaagacatggagctacttcatagaataggaactaaaataactaagtgaaaaaggaaagaatttaatgatcatggctaacatgtatgacatggttaggctttgtgtacccacccaaatctcatcttgaattgtaatcctcataatctccatgtgtcaagggagagaccaggtggaggtaattgaatcatggcggcagtttccccaccgctgttctcatgatagtgagtgagttctcaggacacctgacagttttaaaagaggatcttttgcttcactcagtacttctccttcctgccaccttctgaagaagatgccttgcttccccttcgccttccaccaggattttaagtttcctgacacctctccagccgtactgtgattcaattaaacctctttcctttataaatgaccagtcttgggcaattcttcatagctgtatgaaaacagactaatacagagtaatatgctattgctgtagagtatgacatttagtctgcaagtggaagaaagcttttaaagaatgtattcaaggctgggcgcagtggctcacacctgtaatcccagcactttgggaggccaaggcgggcggatcacgaggtcaggagatcgaggccatcctggctaacatagtgaaacgctgtctttactaaaaatacaaaaaattagccaggcatcgtggcaggcgcctgtagtccctgctacttgggaggctgaggtaggagaatggcatgaacctgggaggcagagcttgcagtaagccaagatcatgccactgcactccagcctgggcgacagagcgagactccatctcaaaaaaaaaaaaaaaaaaaaaagaaaaaaagaaaaaagaaaaaagtattcaaggtagtgatatgatcacatctatctggaaaagaaattaatacactgatatttaactttggcttcctgcaatacaacagtacctttaccaaaagactatcaaagatttattcaagcctttgtaaataatgagttgttgaagattttgaaacccaaatggttttatcatgctgtttactgtcctgtcaaaacacattaccaattaaatagatgggcattgtatttcacaaagaaaatatattttaatacttttgtatcttagaggtaatccatttatagaacatgattttccatttatatatatctatcctttgtgtcattattatcatagtctaatgctggagatgtttggacttcagagcgaatactttccagggaatctaagatggtggggaaaggatattgtgcccatcttctctcatttcatgacttttcctccgagaacaaaacagtgttatatgcaggataaccagttttattaaagaagagtgatgatagctgagattcttgataacacacagaagaagtgtatttgacataagaaagtttattaaactcatctttgacctttgtttttttcctttctaggaaacaaactttagcaatcaacttgtcccctcaggttaaagattccattgttttcattttttaagttagtacactgttggtccctaaacttctttgatcaaattattatttttttaaagaggcaatgctttaagacttctcctgccaagtcagctccagaaataaaatcacaaaatctcaagcgcaatattttttcagtgatacaaaataatttctgtaaatatttggagcatgtactatattgccttatgttcaagtccaagaaccatctgaaaggtagaaatagttcatcaaggtaaaatgtattctacagtcataatactttgtaaataatttataggacaaaaaatattcaaagatatctcagttgatatatggctacagaatattcttatgcttctaaatattaaggaaatagtaaactgtaactcaagaaaggaagctgtacttattatatgtgattgagtaaaagtctaatcaaaatcaaaaattaattcaacaaaagttgccatcgagtacacaccagcccaaagtaacaaacaccctaccaacaattgcctgaaaatattctagaattaattttcacctcagttgaacaatttattgacttttttccctgcacgccagatgcctatagtctcccctacaaacatcttgtcttttccatttttgttcatatttagtttttggcaaccacagcttgtataattacattatgttggagcaggaccatattaaggaaacattgcaaagtacaaaaaattttctttggctcacctcccatctgtagtgtttcatggagtaatagcctttctctgcatcaaagtctttcctggattcctgtggtattgttcccagaatctcctcgtctaaactctcctgaagcgttagctcctaaacacatatgttactatttctatggggcttttcctttactaggaatggaaaacactgttgagatgatcagatatatactgctgatgaggcagccacacttaccagccagaggccagctctgcttctgaggatacatagaaagtatattccaatagcggcctttgcatgtgtgcattatagcagcattcatatttgaagaaagtcaaattaaagcatgcatataaaacttgtactatttgcagtttgaagattttgcccatgaatttcaaatgtctgcatggaatcccaagttattttctctttatggtataaaaatgttaaagagtggggaagaggaggtaatgatcaaaatgctcatgtgaggaaacaactaggtattttatgagaaagacaagcttccaaacacaggttaaacatggcacttttcatctcacctgaagcatgctggccactccagtccaccaaatgcagttcccttgggacctacgctggatggatacccaaggtctcatgaggtaaaggctaggacacttgctctttctgaccaggcagtgctgtggctgattaatatccacccaaagccacaatcaccttctgatctgaggagcaggtgacggggagattctgaagtctcttgataaattatgcaaacataatcaaacaatacacattgcaggttaaaaaaaaattcagtcactgaagtggtttgctttgtcctttaaagaactgaatctaaatagattgtcatcaatcattggcagttcctagaatgacaacgctgagaaattagtattacatgggtaccatagaagagctattttctttcctagtgaaacgcttgggaaaggagagaggaagggagaaaaataaacaaggcttttctaactactgttggaattttcctttctctgttctttcttcagatgaaccagaagaccaatttagtcccaatatccaatgctttcacatgactacagcttatcctaagccttccttcctccttgccaatacaaaatacacacctttcaaggatctttcaaggcctatatcaaaggtcgaaatttgcctactcctaagtcattcattttgtaacgacatcagtttctatgtgattatattatatatatatatatatatatatatatatatatatccttttgtatatatattctaattttatatactctgtctaaagctacaatatctccttgcacagagtcacaaaatgtaaattgaaatacattattgttattagtttgatttttgtgttacctcatcttcactatttagtaatcatcttaaatgcagtaacttttgacttgtaaatgttgggcttttgacacagagttggtgttaacaacattatatgcaaaatgactcactttactatttcattcgcaattcacaaaacaaaaagttaatttgtattcattgaataagataatacatagacatatcaaaaatatataatttgtagtttatttagactcaacattgttccacaacatatctaaagcagaaagaaaagataaaaatatacacatttatttttacaataaatactgtcaataagttatcaactaaatattaaggcacttcttagattaataaaattaataaatttcacattgtgtaatattgttttcataataggaagccagtggttttcattatttttcaatagtcatcgtagatatgattattgcaaatataagatattttgaatacatacagtaatatagtttggtgttaaacagtagagagaagaaggatttactggtccttctgatttcttttttcacttttgttggattatttcaggaataccagcaggaattagtttgctattatcattttattttcatagagaggaaaggagagagtaggtcaattgggatcagtctcccagggcatataaacccggcagagagtggccctctttaatctctgctaccctagacatcaaaggctgcactgccactattcacagagatatgtcagcatgtccacaggggcctgaacaatcatgcagaggtccatgctatggcctctcttgggaaatcccgctcccgactttatctggtatgctctcccacctccctcaagatctaactttgatgcaacttcctaggcatctccattattttatttatttatttatttatttagagacggagtcttgctctgtcacccaactggagtacagtggcacaatcttggctcactgcaacctctgcctcctgggctcaagcgattctcatgccttagtctcctgagtagctgggaataagggatgccaacatgtccacctaactttcgtatttttagttgagacggaatttcaccatgttggccaggctggttttgaactcctgacctcaagtgatccgcctgctttggcctcacaaagtgctgggatttcaggcgtgagccactgtccccagccggcatctccattcttgatctgggtatcaagtctctgtacttcgtgctcactatatacctagcccattctgatttatgcttgctattcccatgtcaaaacattgccccattttaccctcaacagtgtccatacttgcaggatagattatagtcatggggttcagcttaaaatctgccttgactagaaggtcaattctggttctctcatctctaggcatcccttctagccaccaagtagattttgttttcaacacagactgaggccaactctaaaaagttatcaaaaatacttaaagaaaacatatggtcaaattgtggttgtattattgcaaatgccaacagaggcctgagtcttaggaatttttcccagaaatactctcccttcagttttcataagctcaaaggcagaacatgcccggtaacataatagtaatgttaaattccaaaggcagcctagtgatggtttttgccagcatgtaattcacttgatagaattctaaggctttcacttctgatgactcacaatgttggtgatttgagataagaccacaaaaggaaaagacccaacttttcattaaaggccgatccgaattttgcaagacattttccagtgataacaaacaatgctacaatatagttaccgacaattcaattcctgttcaagcacataatttctccaaaacttttaattgacgtttataaccctatgactaatacattgtaaattaatcaaaataaaacatataatatttaggtcgaggataggattaaggatggtggctaggatcaagatataaattccattttaatacactttttgtggtgtttaagatttagctaagattagttatttagcgaagataagttatgattcaatgaaaataaatagaagaatctacatactggcacatcgatgatacagactgtaacgaatcctatatttggcagtggcttcaggggagatttgggaaggacaggcccttgctctttttcatcaacctctaaaggttagggtttgaggcaagaaggccattcaaggaagaagaagtgtacttagatgataaacacaaaagttcagcactatcacatattcaaactattgcaaatttatgcatgtggccaaagttttccacactcagcttggcaaaggtttttaaaacttggtatgagtgactgctactgagaagctgagctctctcatgttccctaatgagaatgcaaatcaatagagtattctggagagcaatattaaagccctcccccaaataaagactgtgaaacccatttattccagtttctactgattgttccaataggaaataattcacaaattaaatcagagtcactgggcagggggcttaggcagcagtatgtttaaaagctccctaggtaattctgaaatagccaggttttacaagcacaggtttacgcagacagtcaacagcagggaaagaggttaattaaatattgttaagtaattaaaagcaaaccatacctcactatttctgaacattcagaaatgcacacccatacacatatctaagactgagtcaacagtcagtgtcaataacagttatttctaggtcatatggtttggatccgtgtctctgcccaaatctgaagtggaatggtaacccccagtgttggaggaggggcctggaggaaggtgatgggatcatggggcagaattctcatgaatggtttagcaccatcctctcttagtactgtatagtcagtgagttcccataagatctggtgtttaaaagtgcgtagcgcctccctcctctctcttgttcatgatccagccatgtaagatgggcctgctaacccttcacctcctgccatgattgtaagtttcctgaggcctgctcagaaacccagcggaagctggcatcatgcttcctgcacagcctgcagtactgaacctcacttaaacctcttttctttatcaattacccagttgtcagatatttctttatagcagtgaaaaaacgaatacactagataatgagattacagatgagagattttgcatgtgatttgtattacgattcttttagttaatttgcattttcccaatactctataatgagcttacattgctttcacactgctaaaattatttttacaagactagtattaaaactattatttcatagtaatagttcacagggcgttaagctttaagaacctcagaatcacctaaaatgtgttttaaaaaggtgcagattttagccaggtgcagtggctcatgcccgtaatcccagcactttgcaaggctaaggcaggtggattgcttgaggtcaggagtttgagaccagcctggccaacatagtgaaaccccttctctactaaaaatacaaaaaaattagcccagcgtggtggcaagtgcctgtaatcccacctacttgggaggctcaggcaggacaattgcttgaacccaggaggtggaggtagcagtgagctgagactaccccagtgcactccagcctgggtgacagagcaagactctgtctcaaacaaaagaaaaggaaagaaaagaaaacaaatgcagattttttggtttcaccccatactaacacacttgaatcttttggaatgggcaagattcaaaaatacttattttcagaaaaatcctcatatgattaaagtgtagaagataatttgagaacattatggtctgtaatgtgaactttatatttattagagtctctgttataaaagaagctaaaccttattaactgatctcctttataataaaatccagtgagtttcaagctttttgatcttgacaacccttacgttcttaaaattagtgaagaccctagagagctattgtgtatatatgtatacacatataaaatatatacatattaatgagaaattaagataaattatttaaatattaattaatttgcttcacaataatgaactcatcacattaacagaagtaatattttatttaaaaaattcttaaaacaaaacattccaattagtaagaagagtaacattgtttgacgctttttcaaatctctttcaaatcaaccttaacagaaggcaattgtagtgtgacaattatttctgattttatttccttgcagtgtgttgttttagttgaaacatgagaaaaatctggactcacacagatacaagttggatatagttggcaaaggaaagactattttagcctttttagctaattttgaatattcttctttgatattacaatgaaagccagcacaattttttaagattagttgcaatgtgtaatctgaaacctataaacgaacctttcctacgtggttgcattaaaaccactggtttgtctatttagtggaatttttacccaagcctgattttgtaacataatacattggtcatctggaaaatactggttcactgaattttaccaattttctaagtagtgacacatttcattatatgatatcaaaatgtccgctttgttaaatgcctaaccggtttaacaaaaaacgagttttatatcaagtatttgttgatctaatagtggtaggtgcaaatttaccaaaattctaatttttacatgaaagctcaatgtttttctttggcaacaaataatgtcagttttcctttgattatagatttactttgctaatttttgaaaaaaagacctaatattcatatctgaataacttttctgtcagttattattttaggtcaaaatggtatttcatgaaaagaaaatagcaacttcagtcaacatcccaaacaatgccagaagtccttttcctgaagacagccattgtgctctggtatgttgcagaagtattttatgcatactctctattttgtgacacagattattaagagaaacttacttgagggtcaagattcaataaaagcagtctttatcactgctttatcaaggatattctcaagctcttaagagtgtatagcagtaaagactatagtgaccactagcatattttgggaccattcatttgattcacattaaggtactagcaatttaatctaccataacttttgtactgtcattgaagtgtcataaagataaaaaaaaaggtagacaatacgttattactattataaaaactagtttaaccctaaactcccttgaaagagtctcagggacacattggactcttctttggaagactacactccccaaatcccagccctgatccatacagtaagattcatagacaaagggtttccttccttctattacaataatgccaattgtcccaatataatgaaaactcatcgctaatatgctccaaacctttggctcccaacagttcagttctgtgtttacccagtgtcctctaaagaaattcccaaagttacatctgcatgatatatgtattgcaatgattttataaattcatgaaataatatgtaagccagcgaaatatgagtgcaaaataatctaaaaaggaaatgatattggaatcgaagctccacaaaaagagatacttttactttttaatttactattgtaccctcatatcttgaatagtgcctggcatatagtagacacttagtaaatgtgcattgattaattgattttgtggtttctatgaaaattgactcagatgtcttgaatgactctataatttttaaaagtcaaattatgtgctaggaaagcaaaagtaaaagataaggaaagaattgataagaatcaaggaatcagcgttcccaatcctttaggttccctctccactttaaagaaacagaaactagaaaacataaagatgctctgtggctgtggtacacatacagaaattaaaaacttactctaattgactaaaaactcgaagaaaatgctacacaaagtctttttttttgtcttttttttttcttcttattgacattttatgaccttcgttcgaaaatgcttaccagatactgcctggatttctacaagcctttaaattcactcccaagagcaatttgacgctaactacattttacctttctgatgcatcaccaccatctagtgtctggaggtggtaactgcagactttaattgacaaactgggttttaacttcagaagacaggaagtgagaaaaatggagggagggagagggaaagagaagagagaaggaaagagaagagagtgagagaaggaagaggagaaagagaaagaggaaaagagacagaatgaaaagagaaagaaggaaagaatgaaagaaagaaagagaaaggaaaggaaagaaagaaaagaaaaagaaagaaagaagaaaaggaaaatgaaaaagacaagacagagaaaaagacaaagagagaaagaaaagacagaaaaagaaagaaagaaagagggaaagagagaaagaaagaaagaaggaaagaaagaaagagaaagaaagaaagaaagaaagaaagaaagtaagtaagtaagtgagggagggagggagggaagaaactctctctaccaagaacagcttcatgggctgtgaccaacatagttgcagaagaccccacgctcagaagggccttgaacttggtttaacactccaatgtttccattttaaaattcttaatcactttgtctttgaacttttgtttccaaggtaaagtctgatgagacaatggacatttacatgagcagatgagcttcatacagtaggtatcactgctgtttcttgccttcgcgtttaagtttagtgttcgcaatgtccctgcagcacagaattgcagtgagctcacgatgcttgagagttgagaaacacttgatgtagatgcgtacgaggtgaatgtgttacgtctgtgactaagacactacactttgtgttggaattaaaacttaccccaaatggagaaaacttgtttctaagaaacataaatgaccaagaaagactgtcacatccattcttacacatgttttccttgtgttaaccaatcacatgtgttcaaaatagtgacaaagaagaacatggaaagagtcccttcttatttaggtccttcctgaaattgaaggtagcagagagtgttggtggaatgcacatgtgttaacaagtgaaataaagaatagagataactttgcacagcggtaagaatgctcttgtaagaatgaaatgcgtatatatgtatgagctacaaaatatacattgtatatttcagtgatcttgcatattaatacatgatcttattatgcctctaaaactggcattgcatgacataaagaacagtaaaattcatgttaataattaaaatactaatttttctttacatggagtgatattaaatagcaaatatcattttgactacctgagagagattccgtaaaagatagaaacatgatttccattttagaaactttaatagcaattttctcctgcttgaacaagtggtcttgcattttcattttgcactgggacccacaaattatgttctttagacttgcacgtggtgttgctaagcttcccaacatcgagatattccttagggggtgtcaggctatcaaactgtcagttcttctttggtgaaagctgtaataatctgttcccttaattaaagagttcctttcttctccaaataggatggaaaatacatgtaatactaactgaaatggatatttttgttaatttataccagtgaatctttgcttccactataaaggcacattaagaagaaaacagagccaacacctgaattccaccattggaaaaaaaaaatagtctgtagtaacatttaaaaaatgatgaagacaaaattttcttttagcaaaatagtatttcctatcactagtgacgacattaagtcattcccagtgcctgagctaccatttggtaaaattagtaaagttttaaagaggtgttgatataggccaccagaagaccgtagaagggctttcctattattcaaattggaaaccaaggctctgagaatctgagggtcatttagtgattacctacttctgagcatactgcaccacttcctccatttgagggacctgtactttgaccaggagtacaacacagacaccttcccagtggcacaacagatcactaagtgtggctgttgtgcaaatgagaaaaatggagaacatcatctatgcgtttagtcaccatatgcatggtataatgcacgaattatttgacaaaatagaataaatttaagtataacaagaaatgagaccaaatttccaagtcgccttttatgaaacaaaaattgcatctttaagatatatatatatatatatatatatatatatatatatatatatatatacacacacaattgcaaaacatacattttatatatatatatgtgttgcaaaaaaattttctcaaacccacttttgtgtttggactcaatataaaatgactgctgcagaaatgattataattagaagaaataatgtagtgattataataaggttcaaagaggcctttctcacatctttgtgtactgacgagagcaggaggtgtatgagcagagagaaacctgctttcccctctagacacagtcactagtcactatagctggggacagcaacagctcatcttacagagaagccactagaggaaattcaaaatgaatacatgttctgcttttgagaagcagctcgttcagctgcttacagagaagatatgcttcagagttgacttataacttgtggccttccaagttgaagggaaataagaaggaaatcaatcaatttttgaaatcatattgattactgggatgattgagaagctacaaggtgagttcatcgctcggttatgtatctcacatatttaaaacatcagaaacactgacttgccttaggtcacacagccaggaatgggcagtgcagggcttccagcctggccttataccaaactcttaatcctttcactgctacatgcagctgtccgtactgatagccttgcagctctgccctgaggatatgagcctcatctgcaagcatttatgtaactagctaagaaatacagagttttctttttattaagatgatttttaattactattattattactatttttagagaaaggatttctctctgtcacccaggctggagtgtagtgacactatcatagctcactgcagcctcgaacacccaggctcaagcaatcctcccacctcagcctcccaagcagctgggactacaggtactcaccactatgatcagctataaatagtgaggtttctagcgctttaatttcaaataagtgcctgagtcacctagaaagaagataaaatgaacactgacagtcctatcaggctctaacactttcactgctttaaggatcgaggtcagggaaatcaactgcttttaaaaaatattttgttctgttttctgttgagtaaattctaagaacagatattattattttcttggactttaaactgctgctgctgataaaagcagagggagctgcttcagaatggagttactgcctatctcagtgacatggctaagtagatgaaattatccacatcatgtgaagactgggttgtaaatgctggaaatacactaatatactcaggggggcaattagtacctttcatggggagggctgtgatctctctttagatgaaaatttaatgtgtcttgcatggaagaaatgaccagaactttgttcggtacaaaataattccaaagacattcaagaaattactaactattcatagagagcctctgacaagtttaaaacagaacgcgaccttctctttgacctcaccaattcccacatcaatatatttcctggtagcataaagttactaaattcctatttcaacatattcttgaactagatgctcatttagaagggtaagaacaaaacatcattggattttcagcaatagtcaccatgtattctacgtattctactgtgctcgaaaacatcctccactttcatgacacttcccaccacttacatgtttcctattttttttctatttcatcctgtgttcatttgtataaacaaatctgtgtcaaccagtcttacaatttgtaacttactcaaaaacttgcaactagaaggtaaaatcactaaatagacatattaattttcttttccataacctagacttttatgtccttgaaaatctgtcagtaatttagtcaactacgatgaaaggcttactcaaatatctattagcatataacatacaatcttccatcttgagataacttctttggaataaattaatgttcctgtcccactagaatcttgtgtcccggtgacttgtattcacaaacaaatcaattaataataagatttagattgtttgtttgtagggtttttaaattaaagtcagagaaataataacaggtaacatgtacaaaaagagaaattctaatctaattaagatgaagacttcttaaactgtagaatctaattaaattaaaagaccattctatttttagctttttgaggatctccatacacatttttcataaccggtaactaatttgtattcccaccaacagtatataagagctccggttcctccttatcctcatcagtgtttgttatttttggtctttttcatatagctattctaacttggttgagatagtatcctatattggttttgattttcatttccttgatggttggtgatgttgagcattttttctatgtcttttttgagaaaggtctattcagatcatttgctcaatttttagcccattattattattttgctgttgaattgagttccctgcatattctggattaatccttgtcagatttgtgtgtgtacacacatatatatattcataatatataattataaaaaatgtgcaatagttcctgctacctataagataaaactcagtgtccttagcatcacattcaaggtccaccgtcacgtgactcccagctacaccaccaccacttcacctcctgcatctcctctcaacgtcctgcgtccaggtctcttctgccccttactctcatattccagttaactctgctggaactctcagaccatatcccttacttcataattgtcctgggttcttttttccactgcatttcttcttcctaaaaagctccctacctcaccttcctatgatgtctaccatagaaagccaaagatttctcctctttaaattacttcttgctctgccctcaggaacacaatcaacccctgtgaatgaatcaatctctgtattattctggtgaaaaagaaagttgggtgaggtcacctgaaggaagcgtggggtatctgtttgttcttggaatgcaggtataagcatgacacgttttgcattctccacgaattaacccatgaacccagcaagcaatgatgttcatgggatgtgcgctcacttcaattacataaggggccaggccaacacatctgcataaagacaatacttaatctaagaagttaaaaacggaaacaggataaacttctaaaaggagttgggaggcttagaaccttagcctctttcttttttacaagcacttagggaactagctaattaaaggaattctctggtgaatctcttataaaggaaagaattctctggcaaagcaaataatcaacccttaatttataaagtacttatggagttaggtgcttacagtatcaccaaacgacaccttggggaccccttgtcattaatttgcctctataaggacctaactcttaaggaattgctaagtttctggagaaaattgggttgtgaatgatttaaggtgttagttttgatttttttatagaagaatgttaataaggaggtatttgttctcctatttaggccttacaatgtaaagcagaaaaagaatcttcacaggtaacatattaatataaaatttcctctgttttaggcaaaaagcaataacaagtttcatatgattaaaagaaaggatctatttatgtatctctgattttggagcaaaattttcaaacttgttcttccgtctaagtgataattttttaaaagtttattgtgaagtttgctgtatttaaaataaaccttctctcggggccaatcaatggaattgctactacagattaaaaggtaaaacactggttttattctgagtatttcattatcaacattcagcatcttttgagactctgagaacaagcacagtcattattctggtactatgactataagaaagaaaaaaacacacatctatgtttgtttatatggtgctcttctttacaaaatatcaactccaaaatgtgcatatatatgagacttgggctgggcacagtgactcatgcctgtaatgccagcactttcggaggccaagatgggtagatcgcttgagtccaggagtttgagaccagcctgggcaacacagcaaaacaccgcctctacaaaaatacaaagaatgagctgggcatgatggtgcatgcttctagtctcagcaactctagaggttgaggtgggaggatagcctgagacccagaagacttgatctcaccattttacaccagcctggaaaacacacggagaccctgtctcaaaaagaaactaaaagaaaaaaaaggtttggagtttgtttgtctcaaaaagaaactaaaagaaaaaaaagtttatctgcttgcagtgggataaagcaggaaagcctcagaatgttgccttaaagttggagtttctgagagagcacgctgttttgtttgtttgttttgttttacctaggatacatgtatatgtagagtggtctgatggaagtaactgaaattctgtaggagctaaaatttcaccaaggtgttttttgttctcaatcctgtttcccaatgtctaggtcattcactatcctagacaaatgcaatttgtttttctgtctccactttctccttcgctcattcttttctttctttctttcttggaaaaacaagaaatatgtttctaaagcttgtttatgaattataagtttaaaaataatgttcaaacgcctgaagtaggataatggtctcgatctccatccatatccctgcaaagacatgatcatgtcctttttaagagctgcatagtattccatggtgtatatgtactatattttctttatccaatctatcactgttgggcatttaggttgatttcatgtatttgctatagggaatagtactgcaataaagatacacatgcatgtatctttataatagaatgatttatattcctttgggcatacgtccagtagcaggattgctgggtagaatagtatttctgtctttaggtctttgaggaattgccactctttcctccacaatggttaaactaatttacactcccaccaagtgcgtataagcactctttttctccacaacctcgccagcatctgttattttttgactgtttaatatgagccattatccttagcaaactaacacaggaacagaaaaccaaataccacatgttctcacgtataagtgggagctaagtgatgtgaacacatggaccgaggggaacaacacacactggggcctcttggagggtggagagtgggagaagggagaggatcaggaaaaataactaatagataccaggcttagtacctgggtgatgaaataatctgtacaacaaacccccatgacacaggtttacctaagtaacaaactgtacttgtgcccctgaacttaaaagttaaaaaaaaaaaaaagcctgaagaaggcatactgtgaaaaattttgtgggaaaaacattctatataacatgcaaaattccacatgattgagtccctgcctacctccttagaattagctctatgtttcagacatacttagctaatttgagcttcaagactgtgtcaaactctttcacacttgtaagcctctgcgttcgctgttctcatgacctggaaatcagacattcattgaatatttttactgaaatcaactctgtgtgaagatgctgaaaggtcagtcacgaggatacagtggtaaaaaacacagccacagatgttgccctcatgcaactcggtgacctccctccttggtaagctctgctcaaatcttgcatcttctgtgttcctttcactgtggcatgtagcccaaccattctaagcaacactttgcaaatctttctttaagccaccagtacagccaccatctatttctgctacattgctgaccaaaattctgttaatataattatatacctacccaattccattatgaaaccatgaacttctgtatctgtttcatttttgtgttatgaatagagagcttagcactgaatgagtggatagatgaaacaatgaaaagaatgactgaatcgagtaattgattttctggagagagtaattgaatttcaatctgaaatttgttttacatgtaccagtttaagccattacaaagcacatattgatgggaaagagacaattagaacagaattttaaaatgtgaagttacagaactataataaatgtaatctgctatatgaacatatcttcttataataagcctcaaaattcttccgtgtttctacttgaaatataaggacagaaatacaaactaccatcagagagtactgcaaacacctctacgcaaataaatttgaaaatctagaagaaatggataaattcctggacacacacaccctcccaaggctaaaccaggaagaagctggatcccagaatagaccaataacaagttctggaatcgaggcagtaattaataacttaccaaccaaaaaaagcccaggaccagacagattcacagccgaactctaccagaggtacaaagaggagctggtaccattccttctgaaactattccaaacaacagaaaaaaggaactcctccctaactcaatttatgaggccagcatcattctgatacccaaacctggcagagacacaacaaaaaaagaaaatttcaggccaatatccctgatgaacatcaatgtgaaaatcatcaataaaacactggcaaactgaatccagtggcacatcaaatagcgtatccaccacgattaagttgacgtcatccctgggatgcaagcctggtttaacatatgcaaatcaataaacgtaatccatcacatatacagaatcaatcacaaaaaacacatgattatctcaatagatgcagaaaaatccttcgatgaaattcaacaccgcttcatgctaaaaactcacaataaactaggcattgatggaacatatctcaaaataataagagctatttatgacaaacccacagccaatatcatactgaatgggcaaaagctggaagcattccctttgaaaactgacacaagacaaggacgccctctctcaccactcctattcaacatagtgttggaaattctgtccagggcaatcaggcaagagaaagaaatgaagtgtattcaaataggaagagaggaagtcaaattgtctctgtttgcagatgacataaatgtatatttagaaaaccccattgtctcagcccaaaatctctttaaggtgataagcaacttcagcaaactctcaggatacacaatcaatgtgaaaaatcacaagaattcctatacaccaacaatagacaaacagagagctaaatcatgagtgaactcccattcacacttgctacaaaggaaataggaatccaacttacaaggaatgtgaaggacctcttcaaggagaactacaaaacactgctcaagtaactaagagaggacacaaacaaatggaaaaatattccatgctcatggataggaagaatcaatattgttaaaatggccatactgccaaagtaatttatagattcactgctatccccatcaagctaccattgactttcttcacagaactagaaaaaaatactttaaatttcatatggaaccaaaaaagagccagtatagccaaaacaatcctaaggaaaaaagctggaggcatcacactacctgacttcaaactatgatacaaggctatggtaaccaaaacagtacggtactagtaccagaacagatagatagaccaatggaacagaaaagaggcctcagaaataccacacatctacaaccatttgagatggagaccatcctggccaacgcggtgaaaccccatccctactacaacaatctgaattcccagtttaataaatgtggttgggaaaactggctagccatatgcagaaaactaaaactggaccctttcttacaccttatataaaaattaactcaagtaagattaaggacttaaacataagacttaaaaccataaaaaccctagaagaaaaccaaggcaataccattcaggacataggcatgagcaaagacttcatgactgaaacaccaaaagcaatggcaagaaaagccaaaattgacaaataggatctaattaaactaaagagcttctgcacagcaaaagaaactatcatcagagtgaacaggcaacctacagaatgggagaaaatttctgtaatctatccatctgacaaagggctaatatacagaatcttaaacaagtttacaaaaaaaaaaagacaaccctgtcaaaaagtgggtgaagaatacgaacagacacttcacaaaagaagacatttatgcagcaaacaaacatacgaaacaaggctcatcatcactggtcgttagagaaattcaaatcaaaaccacaaggagataccatctcacgccagtcagaatggccatcattaaaaagtcaggaaacaggccgggtgcagtggctcacacctgtaatatcaccactttgggaggccgaggcaggaggatcacctgaagtgaggaatttgagaccagcctgaccaacacagagaaacctcatgtctactaaaaatacaaaattaggtgggtgtggtggcgcatgcctgtaatcccagctacttgggaggctgaggcagaagaatcacttgaacccaagaggcagaggttaacgtgagccaagatcacatcattgcactccagcctgggcaacaagagtgaaacgctctctcaacaacaaaaaaaaaagtcaggaaacaacagatgctggagagaatgtggagaaacaggaacccttttacactgttggtgggagtgtaaattatttcaaccactgtgaaagacagttttgtgactcctcaaggatctagaacaagaaataccatttgacccagtaatcccattactgcgtatatacccaaaggatcataaatcattctactataaagatacatgcacacatatgtttactgcagcactattcacaataccaaagacttggaactaacccaaatgaccatcaatgatagactgaataaagaaaatgtgggctgggtgcagtggctcacacctgtaatcccagcattttgggaggctaagatgggaggttcatgatgtcaagaaatcgagaccatcctggccaacacagtgaaaccccatctctactaaaaacacaaaaattagctgggcatggtggcatgcacctgtagtcccagctacttgggaggctgaggcaggagaattactggaactcaggaggcaggggttgcagtgagctgagtttgcaccactgcacaccagcctggcaagagagtgagactctgtctcaaaaatgtataatatgtgtgtgtatatatatatatatgtatgtatatatatgcatgtatgtatatatatgtatgtatatatgtatgtatatatgtatgtatgtatgtatatatatgtgtgtgtatatatatgtatatgtgtatatatatatataggacatatacaccatggaacactatgcagccataaaaaaggatgagttcatgtcctttgcaggaacatggaagaagctggaaaccatcattctcagcaaactaacacaggaacagaaaaccaaacattccatgttctcactaataagtgggagttgaacaatgagaacatatggaaacagggaggggaacatcacacaccagggcctgacagggcatgaggggctaggggagggatagcattaggagaaatacctaatgtagatgacaggttgatgggttcagcaaaccaccatggcacatgtatacctatgtaacaaacctgcacattctgcacatatatcccagaacttaaactataattttttaaaaaaacatagaaatataagctatctgttacttttctattgttctcacaaataatcaaaattattagtgtttttgctgtatattatttttattataaaagtggttactattaatatctaaagtgtttagactcttctgagaaaatatgctgtttaattagaaatacacaatggtaatagaatcagcatcttttatgagagctgaaaagttggccttgggggaattagaagtcttctaattctttatgagcagaatgcaatttaaaaattgataggaagttctttaaaccacacagtatgtctataaatacattagatttcaacataacctaaaggcaccatagatcctgctgggtttgtatcatcaactaaactaacttgtctttcttggaatattattttaaatgacaaaatagtgataactatgagatactctattgagttaattgtaagctccttgaatatggctatactattttattcatctttttatctaccccacttcccagcacactgacttaaccatagtagattctcaaaaaatatgatgcaatttgatttgcattttctcctgcttccaaaagtaatctggacaagtttcactgacttgagagttagaaataaagcagaagtcaaacgtttaacttgataggcgtctttagatatttgacataatcaattcatgatgtgtggttccagagagtcaagcagatccaagatgtaagttagaaggagtcaggttttggttaaatgtaatagaaacgattttaataacagcagttacttaataatggagtgaagtgtataaaagtgagatgcttcccagtggtgaacatagttatcagacagaatccatggaggtagtagaggaatagctttggctggaagactgagataaatcacctgaaatcctgtgaaactataactacactttaaaggctacaaaagaggaaagagcatagatgagttattcattgcatgtgttggtatgcccaattgccttaacagagtaatatcatattttttttatattttataatacatgccttcaattctatggaattatagattgcctctggataactttggagactctagagtcatatagtactagtcatcagttaccccagaagtgatcattactttatttgtaaggtggggttgatggaaacttgaaagtgttctttaagttggaacacacagatgtcaatcacttgagatcaagagtagccgttacatgactatgcattttcagaggtaaagcactgttcatggatggacttaactcatcagtagaacagagtatctacaatcaaccaaggcttgagttcagtctccagcaagaataaagatgagaataggtcaactctcattggaagtccatgagtaaccccagctccttccactgattttggttgacctatatttggatattgtttgaagaacaccattttacttttaaaaaaccttggccagatgtatacctaattaggaataggaacctttaaaaatggaaattaaattttagaagattgatttctctaaattatttggcaactgtctttctcttaggcttcttcttggaagtggcagagatttataactcaaggaaagaaagatatgaaatgcaaatatttgtccttgaagtctctgtagtcataggattagcaacattatggggcaaaaataattacgatgactgaaaaccatggaaaactgtgatttacttttagaactttgaagataaagactgaagtgtggtgagtcccacaaacttatactttaattgaaactgcagttcagtagtttgagaacttctaacttcatattcttctagttataaagaaaagtatgctctgtaataggactacttagttctctctggaaatattcatgcatttcaatatttttaaagataatactcttgctatagtcaatctgactgatctgctgtactgtttaattagacataatgatttaccttgggcttcttgaaagttgactgtccaacacttctgtactaaataggacttggctcataatttttccctggtgttttctacaagcacaactttgtagattatttttaattttaactttatcaagaaaatatgttactaaataaaaatccttggggatgggagatgaaattattctttatccaccaactgacttttatcaaacccacataaatattggcttaaatttaacttaatatgattaaaatgatttatatagataagtaaaatattaatatgtagattctcttctaatataaaattcaaattcaacttctacattgcctttcttaaattcagtgacagcagtgtatggcataataaattccagtgtggatcaagtgatgtgctatcttcagtgaatgcacaggtgcctgagtattcctctctaaaaggggaatcaggttgctctaaaaggaaaaaagacacatgtcttgtgttagatgaaattataacatggctcccaagattttcactttctgaggtatattcaccttcctccagttatccattcaagcagtatcccacaatgctcctgtaaagacatttttcataagtaactaaagtcccaagtcaatttattttgagaaaagaagataatgctgactgagtctgacctaatcaggtgcatcagctcttaaaaaggactcagatcttcctggagaaatttcaagcataaaagggtatctttgtctgtgtgtattgctataacaaatggagaccaggttatttataaacaatggaaatttatttctcacagttctggaggctgggaaattcaagcacaaggtgccagctaggtaggttttggtaaaggcctcatctccacttccaaaatgataccgtgttgctacatcatccagaggagacaacagatatgtcctcacatgacagaagacacagaaaggtcaagagggtacttccttttgtaaggaactttagtccttttgtaagagcgctaacccattaatgaggacaaagtccatgacttaatcaccttccaaaagccacatatcttaacactactgtattaaggactaggtctcaacatgaattttggaggggacatacattcaaaccatagcagaaggattcaatgggagggagactatttattcacagctttggataaggaagggacaaggtctgaaagcagcgtcagggagcagatagaagtccccacctgaaaaccagagagaacaatacgaaaagcacgtgttaagagtagctggcaataaaatactaagaaaagcactgtaccactttggactgtggttttctcatctgtaaagtgaaaggctaggacctggttatctctgagattccttccaggtcaagacatttaaggtgtaagtaactagtaataaagtgaatgagctgtgatacgggggaaagaatacagtagtagggcaagaagaaaaaataattggattaagttccagctatgttataaataaggagcctgaccttgaatagatgatttcacatctgggccacaatttagttggttgaaaaatggggataacatcaccctaatccaaagttgtctctgaagactaaaagagttattctggagctttcagaatagcagagtaataaactctctcattctctaaaacaatgggaaaatcagccaaacaccaaacacaaaccatttgggaactctggtaattaacaaaagccacagaacaaatgaaaatatagtctatgcaactattcccatccccctgtctccccagctcagtggtgtggtagccaaaagcttgcatcagtgtagacaatagagagatcggactgcctagggatctcttaaaagcactatctcaagagcacactcaatacattgcccatactttcaggcccctagcaaatttaaaaatacatagaaagtaaacaacacatttctaaataacccatgggtcaaagaagaagacagggggaaatggaaaatattttgagataaatgaaaacaacatagcattacaaaactgaaacgatgcaggtaaagctgtgcataagaagacattcatagctgtaaatatcaactttgagaaagacaaaacacctcaagtcaattacgttactttcattttcagaaactagaggaacaacagctaactaaacccaagacaagtggaaggaagaaaatagaagtttagactagaaataaatgaaatcaacaactctgtgactatactaaaaacaactgaaccgtacactttaaacgggtaaatttgatggtgtatgaaatatctcgccgtaaagctctaaaacgaagtaatattagtgagggtcacttaaagtaacttttttaaatggtacaaggtgccaataaagttattgacacaaatagtgagtaacttttattggctttgaaccaactggttgaaacagaattaagagagaggcaagaggaaatatcaagaattaggaaggagaaattatatgtaacaaacagcaaataagcagagctaccagatgacattcactaagttctgctgttcctcaggccacctctctgtttagaggtccccccgccctgcaatggagtgtggactaagcaaagagcattggagaggttccactgatgactcttagagattaacagtggacctaccactctaagagccttcatttttatttttttattttgagacagagtctcaccctgtcaccaggctggagcacagtggtgctatcttggctcattgcaatctctgcctcccgggttcaagcaattcccctgcctcagcctcctgagtagctgggactacaggtgcgcactaccatgcccagctaacttttgatattttagtagagacagggcttcaccatgttggcgtggagggtcttgatctcctgacatcatgatccgccagccttagcctctcaaagtgctgggattaccaagtgtgagccaccacaccaagccagagcctttattatgtaagtatctctttgtttaggctaaagtcttggctacatcatgtctgacaccattacgaagaaaacaaatatttaaaataatgtatatttatattttaatgtctaaaatgtattatcaaatctgctccatgatctaagcacttatttattttattgaaaatccaactgcttctaaatcatgataattgctttaattttatttccaggcaggcatttgatttgtattccatcatatgctacatgttttgaataaatttattgcacttgtcatctaagcatagatatttcttcaaaataatgaatagtgtaaagatattaaaggcataaaaaataatatttttctctatcatgttgattttcaataattctcccttttactgtcaaacacaaatgtacatcttttctttttaacttatccatccaagtttttaaaaggccaaataagtttcacaatgggagcttccaaagcattcattttcctacaaaaacgaatatatttattcgtttttttatgggacaaatgataaggaaaaactgatcactctggttacttacaatagttctaatggattttcatgttcctttctgttattacatttatgcaaaagggttttttttttccaatgtaaatgtgaaattggggaactttgttaaatcagtactgttgagaagtgggctgtactgagatgaatatccttttaaacaaatctctaagaaagcaaaggtcaggattgcctttcttcccaagtaaatgacagggatgttccctgtcctaagtggaagatcagtgtctcaattgcagttccctctttatttgagggtagatgagaaagaactttaagcacttaagaagtagacatgggtttacacttgaaagccaaatcaaggcagtcttctttttttctttttttctttttttttttttccattttggcttagtgctaacacatttaaaagacaattcgacacttactattcagaatcttttctaaaagtttcctatattaagaaccagccatgtttgaaacaaatgccatctataactttcccacattttgcagatatattatgcaagttaaaatataattaacaactgtgagaaaaaaaaagattggagtcatttggggaaaaaaaggaaagcacatatgtttccctgatctagtgggggaaataagtagtactgtggttctgatgtagcttgcccttggcctgtcttttctgatatctgattggctacaaatgagatgaggtggcccatatacaatattgaagttgaatgtcgatatcttccaaaatgatgcagcactgttaaggatactgttgatttaacaaacgtatgcatatggaatgactttcagaaaagctatgtcaagatctataagaggaacagagcaaacgaagtctataatgagaatgattcctgtggtgtctaagaggcaagcactaaataaagaatggcagaggcaatgaaacacaaatcactccaccttaaggagaaagtagcagtaatgagaagaggagtgtgatttctacttcagtaaaagagagcatagtttcaagaaacagatggacagtgaatgtgaatacattagtgaaagcagtactgtggaaggttcttacagttttgttgttgttgttgttgttgttgttttacctattccctataaaggtggtaggttggattttgaattactcatacttgtaatcaagaagttacagtacttcatggctcaaagtcctttaaaacctaattgtaggccaggtgtggtggctcatgcctgtaattccaacactttgggaggatgaggtgggaggatagcttgagctcaggaatttaagaccagcctgagtaacacagtgagacccccatctcttaaaaaaaatttaaaaagttagctggccatggtggcacatgcctgttttctcagctactcaggaggctgaggagggaggatctcttaagcctgggagattgaggctgcattcagctgtgattatgccacctcactccagcctggatgacagagtgagactctatgttaaaaacaaaacaaaacaaacagacaaataaaaaaagaccagaaaaacaacaaaacaaaagaaaactaatcatagaactagaaaaccatgaataatggaaatcactaaaaatatatataactagccaagctttttttgaatattttaaaattgacactcttgggaagtatctcctgattcagcccattgttttgctctgagtttcttatatatcacataccaggaggggctatgtcaatgaggggagatacacacacacagacacacagacacacacacacacacacacacacacactattgcttcattagtaacagttcctcgttgtttcactggtgatactttcaataagttttttcagttcccttagtctgctcctaaacacaccagcctactatgcacatgagatgtcctttcctgccagccaccagttagattctcacttctaccaacagtgcagctgtattgtagattaaaaaaaaaaaaagttgggtttttgtttttaggttttttttgtttttttttgtttttgagacagagtctcgctcttgtcgcccaggctggagtgcagtggcgtgttctcagctcactgcacctcccccttcctgggttcaagcaattctcctgtctcagcctcccaagtagctgggactacaggtttgcaccaccacacccggctaagttttgtatttttagtagagactgtgtttctccatgttggccaagcttgtcttgaactcctgatctcaggtaatctgcccaccttggccttccaaagtgctgggaatacaggcatgagccactgcacctggcccaaaaaatctgcatttaactcaggcattaatttgctcctgtatggcattctactctactaattgctcatcatcactggccatcagagaaatgcaaatcaaaaccacaatgagataccatctcacaccagttagaatggtgatcattaaaaagtcaagaaacaacaggtgctggagaggatgtggagaaataggaacacttttacactgttggtgggactgtaaactagttcaaccattgtggaagtcagtgtggtgatttctcagtgatgtagaactagaaataccatttgacccagccatcccattactgggtatatacccaaaggagtataaatcatgctgctataaagacacacgcacacgtatgtttactgcggcactattcacaatagcaaagacttggaagcaacccaaatgtccaatgatgatagactggattaagaaaatgtggcacatatacaccatgtgatactatgcagccatgaaaaacgatgagttcatgtcgattgtagggacatggatgaagctggaaaccatcattctcagcaaactatcacaaagacagaaaaccaaacacaacatgttctcactcataggtgggaattgaacattgagaacacttggacacaggaaggggaacaccagacaccgggacctgttgtggggtcaggggatgggggtgggatagcattaggagatatatacctaatgtaaatgacgagttaatgggtgcagcacatcaacatggcacatgtatacatatgtaacaaacctgcatgttgtgcacatgtaccctaaaacttaaagtataataaaaaaaaaagaaatatatcacagacaacttagtaagagcccaaaatacaaaacacagagaaagagtcttagttcaagttgtattatttactatgtgaccttggcctgtgacttaattctttgaactcatttccctcattatatctaatgaaaataatgcctacaacttattttacataagaaaacaagtggaaatacaattttcctaatattattagtatgtacatattgttgcatactaattttaataatgacaagtatgttttagaggccttcagattaatcataatcattattttgtggcatagtatcatgatcaattagtgcatacaccctattttattcatatttactttaaagaggctttatttgttttttcctttgctcctaacctgaatcccactccatttcgacccccatacaccatgtcggtggttgaattctccagaaagcagattctaagatagaatgtaatgaacaggatgtctatgtgggatatctcacggcagggagtgaaaagatgcagattgcagcagagggacagggacagcaatgattcaggcccacatcagcctcagccaacctcaagagaagctctggagtgagccatggccctttagagttgccttgcattggccaaatggctgaaactctgtatctcccacacaataatagtgggagactttaacaccccactgacaatattagacagatcattgagacagaaaattaacaaagatattcaggacctgaactcagctccagatcaagtgtacctgataggtatcaacagaattctccatccaaaaataacagaatatacattttctcattgccacatggcacttactctaaagttgatcacgcaattggaagtaaaacactcctcagcaaatgcaaaagaactgacatcataacagtctctcagatcatagcgcaatcaaattagaactcaggattaagaaactcactcaaaaccaaagaactacatggaaattgaacaacctcttcctgaatgactcctgggtaaataatgaaattgacagacatcaaaaagttcattgaaactactgaaaacaaagagataacatacctgaatttctgggacgcagcaaaagcagtgttaagagggaaatttatagcactaaatgctcacatcaaaaagctagaaagatcccaaatcagtttctatctgtaagtgaatgtgaggtcttagcaaagtagctcctatatctgaggcaatccctaatgggactgacatctggggattatctgctcacaacattttcagaagccggaacagaagtcattccttgagggaacctttgggaagcatatcatggtgtccaccacagactataaattatatgcatttaaaaaaataaaaaatattatgttgtatattttgggctgtctccctattttattttcacaacatgcctatcagatttatcgatgatgagagttgcaaatctagttaatataaaattattttccttctatctatgtgttagagtgaatatcgttggtactgtatctatagacacaatctcaacacacttattactgctatgtaataaagatatttttaaaataaaagatgttagcctgttccactcagagtgcttaggttcttagaactcattaaccaatcactcagatagcaattctgccactccagtttattgtccaccacctatatttctttttctcaaatcccattgtttgattacgacagctctgctgctaatagcaacacaactcctggtaataccttcctcaatctaccctctttttctatttttctatctccaggtccactctgtcttagctttttcccttttcgcacctgcactagaccctgtcggctcagcatcatttggatccactgactccaaatgtgactttgttatgttctccctccttcttccccctcacccagaatttaacaaaatatatggtgtggaacaagtgcacgataaccactgatttttaattttttaatatttctaattttattgattgcatctcattttacatctatgtatttatacataattcttaatgagtaggatcataaaataattttttgaaaataaatattatttttgaaaagaagcttcaaaatgaggtaaatttacatggtctcttctcctgttttagaggtaaactctttctcatttcatatcttactttaaaactatctcatctggtgatgaaacagaacagaacagaaagaagaaagtctatgaacctccctcgcctcaatgttgggctacttaaaaaaaaaaaaaaaccacagagtgcaaagtgagaaccagaaggaactttctcctgtatttttcagttttggcccttggaatcctgggttaaaagactgtttggtgttactccagggcaagagcctgaagagaaggcaagactctatgctcacatatctacttgtgctttagccatattcaatattatacattaaatacacaaatagtttttaaaaatgagtttcagtgcttaaaaaaaggaagaaaaaaaactaagagttactgatccaatccttattttatttagtaatgacaaagggccagaacagaattcacttgtccaagatcaaatgatgtttcacacttcatatttcattctcttcactctttcgggtctagttattaatatatgtttggttattagtttcatagccttgtgtctcccaaaatcttacccagcttggtttctagatttcatcctctactaagcaagactatgactttgacctggcctggagttcagacatgttccttatagctatctttgctggcatcctgttgtttttttttttttttttttttccaatagtacccttcttctattttgctgttgttgttgttgtttgtttctagtctaccttcaaatatcataagccttgaaaatagcattataggttctcatttctgtttactgaagtaagaatttgaaggcagctggataggtatgatgatagaaggagtatctccttacttatcatatatttagaatagcaatcaagtaacaacaaattgaattgtaatggagccaaccatttgttttgtcatccttaaatttcacatgtggagtttagcataaactcattcctcttgatgattatttgacagattgatttcaaagactttggaaagagataatttgaagcatcagattgaataaacaatcacaacgtttctctaagactctgattaattctaaatataagtgtcttgtttagaatccattgcactgagaatgtgcaatgcatatccttcccttagtgccaaagtgctttccaaacctggcgtgtttttgatgcaccttattgggctgagtatataataagttttacaatgacactgagttaaggaacagtgtgatataactacataaataagttcacaaataattatttatatatcagtataagataaatgaactatttatttatgccataagctataaataaatagaatcctcattcttagacattgcccttcttggtgggtagatggtaaagacctaacatacactgggtgtctattttagccaagacattttgcatatagattactaaagtttcctacaaaggagaaatcaaaattagagaaggaactactctcatggtttttaaaggtttctctggatgcagaaaaaatatgatagagatctcctaagtgtatatggcaccaagagggcattcacttattttaagaaagaaaaggtagatatttagtatttcacaataagtcatctatttttagtatatatttagtaacattatattttatgttacaaattatcaacatcacaatttatctaatattaaaagaaagctctagagatatctcttcttaccccatctcctttcaatcctccagtccttctggtttttatgatactaaactcactggttccaagtgtagacaggcagacaggcgcgtgtgtgtcccctctctctcagctgtgacttctgcaggatctttcttcattccagaaaaaatcgacagcattctccacccactgccatgactttttccttgtattagtaaattactaattgtattttatttctgttttcaaatgtcaccttctctggaaatactttgccaaatcagtcactgaaaatcccatcccaggtgggctttcacaaccaaagtctctctgaatatttctgctttgtatcacatacgaatctctatttaatatgtccatgtgcctgtttgtttttaaattggtccagtcatcccttgaggaaagacattgagttttacctagcattgtattctcagtaccagcacagtggatgattcatagtgggtgtttggggattaattaatacagatacggttctggttagagtagtatattatctacctatttgttatgcctagggactaacacctataatttcaaggctcttgagtgtgaattttgagtatgatacatcaatacatgctgctatgcaaaacatgtaattaattgggttggatccttctttgattgaaaaattctcaaaacaagaggaatgatcttattctcagtagctcagctggtcctctgacacttgcttgaacttctttcacagccggcattatgatcccttttcactgagggaaggtgtccttgctctcttaactgacatcttaaagtcaggaaagggactttcatctttatattccccacagtgcctggcacacagaaaaggcccagtaattgtaggactcaagtgatgcatgattttaaaaaggccaagcaaatgtcagggttattttgtttgttttaatcagtcttttaaaaataattgcagaatctttgaggggttttgttgttgatgatgttatatttttctgattataaaaagaagtgcaactcacagaagagaatttgggaagaacatgaaaatacataaagaagcagaataaaattcacccttaatacctagattgatctgttagaaatttagcatatttctgtacagtctgtcttttttaatcataaaggactttatgttatatatatatatatatatatatatatatatatatatatatatatatataaaattgtatacttagctttttcacttaaggtaatagcacattaatttctgttattacaaagtttgaccacttaatattctatcccatgcatgctcatatatttttaagccagaccgttagtattgaacattgttgatgattgtttataacttttcacaactgttcttagcatacttcatttcaacaaatatttattgagggccttctatgtatcagatattgttttccatcctgagagatagcatagaataaactagcaaaaatccctgctctcagagaacatatatcctagttataaaaacaaaaatataaacatgataaaataacatatggtttattagacagaggtgaaagctaaggggaagcaaaatatattgggaggtagggaataaaagggtcagagggtggacacatatttagcttgaggtggtgagagaaggcttcactcaggagatatttgaacaaacacctcagggaggtgagagaacaaataatcctgaaatgaggtggctgggggagggaagaagagcttcccaggggcaagtcctggggaaaagtgtccctggcatgttccaggagcagcaggaggtcacattgattgaggagaagaaaagaaagagatgagatcagacatatcccaggagggaagattttgtaggtttttaaactcactgcaatggcttggcttgttctactctaaatgagacgggaaaatcactttaaggttttaaaagagtagcaacatggtagaatttgagtctttagatcactttggcttctggggtggagcagactaaaggggcaagttggcacccaggatgcaagttgagaggctactgcaataaaagaagtaacggcataatgacctagggcagagtactgcagtggaggtgggagaaattctgaatgtattattagattacagtggggggtaagagaatcaagaggtcaacgatgacgtcagagttttggcttaagcagctggaagaaaggtgatgccatttagtgagatggggcagattgcaagaggaacaggttgaaggagggccaagactgtatcattctccacatccttatgttggatatctaagtggaaatgccaaacagacagacaaatatacaagtctggattcaaaggagaagtcttcactggagatataaattttagggtcctcatcatagagattatatttaaactaaaacattctcatgcagatatccttattcatatttttgtcatttgctttccatggataactatatatggagtcagtcaacattgactccaatattcattggattaacttgattcatacatataaattattttcctaaaacactgtgccaatttttctgactgcattatcattttacatctttaggtatgctaatgtaaagagaaaaaactagatgcatatatttttaggccttcattctgcattaatttgattactggtaaggatattattgggttaaatactaaaatgaaaacattccatcaaaaatagcaaaacctataaatatatctatacacatacatagctatacatatacatatacataaacacacatacacaatcatataaaaactatgaataattttgataactagatgcaggttagaggaaaatgtaaacaataatgaacatagcagctgtagcaatatgacaggaaagagttaataactgaatacttaaaggttaaataaactcactagaaatgtatgaaatcccttaagaaaatagacacgcaatatttgtatttatgtgcctggcttatctcattttccctaatatactccagattcatccatatagttgcaaaagacagaatttccttctttcctaaggctgagttgtatcccattgtgtttaccagaaactgggatctgagggaaataggaagatgttgctcaaagggtacaaagttacagttcaataggagggataaatgataagtatttgaggtgatagatgtgttgattagcttaattcagtcattccacattgtatacatctatcacaacgtcactctgtgccccctaaatatatataatttgtcaagatgtaataaaataaaaaagtagacaaagaatataaactgagcatcacatactttttcaaaaaagcaatacaccaaaaaagcaaaagaccaatacacatagtagtgacctttatccttaaatgacaaaagatggctaagattgcagggcaccgtctcatgggtggagtaagagattgagctgatgaacagggatgcataaagatattctgttgccaaccatgatttcataaccatctctagctcttattttatttattagggccatacgtgagaagctttgccatcttttaataaccctcttgcacttgaaccgtgactatgatttcaaagaattgcctgatcaaagcaatgtagaatgcaggaaaagaagtgaaagaatatagaaagaaagtatacataatcgtatcatgagcaacaatgaacaaagaaataagcaagaaacaatgtaagtccttattgtattcttgaaagacattgaaagtttataagaaaaatccttagaaatcattaacgtaagatccaaagaaaatattgactcctttcagataagtaattctttagtatattaaattgtctcattgtttatatgaagcaaaagaacattaaaatatcaatttcattccattttataaggcataatgccttgatctgctactgaaacacattgtctatatacattcatttgtttttctcaaaaatatgtaagttttattgtgaagtaaacattattttttcacacagatttttcaacaggttgtaataaatatggcttaaaatattactttaatgatatgggtacactgctacaagaattgtactctttcataaaacttggtgcatatttcaaataaatcacttaataagatccaaaatattatctagcacatttgccaattttcaaaacctacacaaagtaacattgtattttgtttctccaattcctttccttcaccccaataactttccttagaatggttataattggcataatactcctggaatctaacatatattcttctgctgcagtttaaaccatttaatttcctaccacctctgattcagtgaaaaaatggcaacagtacaatatatcatcatcatatcaatgtgtggtgcttgaggcaagaaactatttttgaattccaccctctcagctttctttcttcaagcttagctttatttagggaagactgaccaaaaaaaaaaaatgtagatagataaaaatcctgtaaaaagtactttacttcaacctgtatttaaaaaattgtgctcaagtaatatactctgaaccttaattttgtattgagaataaaacgcctaattagataatcctgaaacaggatgtgcaattcatgttatattaatgtattaagttgacatcacacttcatatgtgtaaactaataagacacagaaagctggagggtggttgagggttagaagagttgggcaagtaacttgacttggactcaaaattcttatctataaaatgatgacaataacaccagccctgtgtattacatatttttgaagtaaacatggatcaaaaaaatttgtgaaaatgttcacaaatatgttattatgtatttgaacatattaacatatactattaatgtagttattttaaatacacaaaatatagatattttgtgtatttaaaataactgcttgcatattttaaatatattttattttacaatattgcatattttaaatatgcaagtcacgatattgaaatttggtcaattcataacctatataatggcctctaagtgaaaggaagtgtcacacatctctcactttaaataaagagctagaaatgattaagccttatgaggaagacctgttgaaagcaggcctaaatgaggcctcctgcaccaagggaggccaaggcaggcagatcacaaggtcaggagtttgagaccagcctggccaatatggtgaaactccgtctctactaaaaatacaaaaattagccgggcatggtcgtgggcacccatagtcccagctactcgggaggctgaggcaggtgaatcgcttcaacgtgggaggcggaagttgcagtgagcagagattgcaccactgcactccagcctgggcgacagaacaagactccatcaaaaaaagaaagaaagaaagagagagagaaagagagaaaggaaaaggaaggaaaggaaggaaagaaacgaaaggaaggaaagaaacgaaagaaaagaaaaagttcttgaaggaaattaaaagtgttactctagtgaaaacataaatggtaagaaagtgaaacagccttatttttgatatagagacagctttagtggtctagatggatgaaatcagccccaacactcccctaagcgaaagcctattcaagtgcaaagccctgactctgcaattctatgaagactgagagaggtgaggaagctcaacaagaaaagtttgaagctagaataagttggttcatgaggtttaaggaaagaaaccatccccataacctgaaagtgcaaggcaaagcagcaagtgctgaagtagacactgcagtaagctatccagaagatctagtgaggataattgatgaaagtggctatttttattgacaggttttcaacatagatgaaattgccttccattggtagaagatgccatttaagactttcatagccaaagaggagagtcaatgcttggcctctaagcttcaaaggacaggctatcttgttaggtattcatgcagctgattactttaagttttaggcaatgctcatttaccatttccaaaatcctcaggctcttcagaattatgctaaatccactctgcctgtgctctagaaatggaaaaacaaagcctgatagcagcacttctgtttatagcatggtttactgaatagtttaagccctctattgagacctattcctgagaaaaacaagattcctttctaaacattcctgcttattgacaatgcacctaatcaaccaaaaggcctggagatacacaaggagattaatgtttccatgcctgcaagaagaacctcccttgtgcagcccatggatcaaggaataatttccacattgaagcctgatttaaggaaaacattttgtaaggctatagttgtcacagatagtaattcctctgatgaatctgggcatagtaaactgaaaaccttctggaaaggatttgccattctcagtactgtgaagaagatccatgattcatgaaaggaggtcaaaatagaaacattaacagaagtttgaaagaagttgattccagcagtcatggacgactttgagaggttcaagacttcagtggagagagtcactgcagaggaggtagaaaatgcaaaataactagaattagaagtagagcctgaagatgtgactgaattgctacagtctcaggataaaacattaggataatgagttacttcttatggatgagcaaagaaagtggtatctaggcatataatctactcctagtgaagatgatgtgaacattgttaaaatgacaacaaaggattcagaatattccacaaacttagctgataaagcagagggaggtctggagaggaatgactccaattttaaaagaagttctactgtgagcaaaatgctatcaaacggagagcatgctacagagaaatctttggtaaaaggaagagtcaatcaatgcagcagactttattgtcttattttaagccgttgccacggctacctcactctttagcaaccatcaccctcatcagtcagcatcttaacatgcagacaatatcctccacaagcaaaaatattacagctcactgaaggctcagatggtcattagcaataaagtaattttttaaaattatggtatgtatatgtttagacataatactattgcacacttaacagacatcacataatgcaaacgtaacttttacatgcactgggcaaccaacaaattcgggtgacttgctttaatgcagtgggctggcactgaacctggaatatatctaagatatgcttatatttacaatcacaatttattacgtatgtagttgtacatcattttacattatggcttccatacaatttcagaactcctgaaagactgcttacttgctatctcaagtcactttactttattaggcccaattaccaaacacgccctaggccttcaggtaatgtaacatgtgccatcaggatatatctgctgagtgtaggggatatcgcaacatacctcattccacctgctgatattcctgtcactcaaaagcgtgatgctcatatgtaagtaaatgtgagcttactgcactgaaataaaagctatctattctgtgtcactgatctctgtgagatacgactgtgataaaggaactctgtaacatttaaaaagaaatagtctggaaattctagcaagcaggaaaaatttatagcatcacgtctctttggataaagccaacattaactgttcctttttttgggtaaaaccaaagttaaatgttttaataatagtttattatttgatatattaatacatcattaaattttacacatgttgatagaacaataaatatgcaagaaaaaataaggattgtttatacatcaaacttccatggaactaagtaaataaaaattatgatcaacactttttaacagtataatagcaaattaggaaacatggtcatcaccattaaataattaatttccatgtatcacttgcttttgctggtggattgtacccatttcactcttaaaatagaaggtttgaactatatgatctctatgttctcatccaaatctatcattctatggttctaaaatcaggatatgattgggcactgcttagaccaagaagtttgcacaccagaaacaaaaactactaaaacaagggccagtcatgatgtagttattcttccatacagagcatatggtaggcagaagaatgacagacgtctacatcctaaccctgtgaatgtgttgcctaacttgccgagagggactttgcatatttgattaagtgagggtccatgagactgggaagttctgctggagtatcctggcaggccccatccaatcacatgggtcctgagaagtgaagaatctttccagttggggttcacagaaagagatggactacaagagtagggtcagagagatgctacattgctcattttaaagatggaggaaggaggctaaaagcaaaggaatgtggggagctcttagaagccagaaaagtgaaggaaatacactctctcctacaatctccagaaagaaaacagccctgccatcaccttaaatctagtccgatgagagccacgtcaaacttctggcctataaaatgataaggtaataaatataaggtgttttaagtcaataactttgtggtaattttttacaacagtaatgggaattaatagaggccaaaaaagtgacaaattggatttctcttttcaggggacgtagaattatattttaatgtatgtatgctagactgtgaataattaacaaccagcttattatgctctgatcgccataattttaggaatttctcataaagctttataaataatgctgtcatttatcagggattcaatactgtgtctcacacaacagacactatgaactatgctgataagcgctcatggctttaatgctgaaaaatataataacttgcctaccaaagtcacagagactcttaaacaacatgttaaacaattttatgtccccatttttgttagtataaaaggaaacatcactaataatcacttctttacaagacattaggatttttctaagatgtcaaaagtctaaagtactaactttacttagtaactttggctttattcagctttattattagagcatatgacagtttcctcaattctaaattctatgctgtttgtaacactttttaacccagggcagaagtgatatctatatcaaaatgactggtgaatggcttttttcctttaaatgagactcaagtcccttcacagaaaatataagaaatatttaattaattggcattgatttatcaagctttaattaatgacatgcatctgagttttaagatcttaatataaaatattcactaaatacagaagatgtgcaactgcctcatagtacttaaactttgctgttatttttttttcaattgtgttagctttcaaaaaagaactgctttccgaattaagttaagcaactatagttaatgaatggttctcccataacctctctcagttgacttttgaagagcacacttctaaaatatataaagcacatctgtcattagaaaatttatttccactgggcaaagataattgaatgtcaatggtgcaaagtgaaaggaaaagcttgactttgcttttacattacttaaaagaaatctgtcagtatccccttagtgatcgctctagacagaaatggacaaggactcttcaaatttgctccccaagggtctttgcttcaggtcacaatgaacaggagcttatctttgcttcagatgatcactgggcctctcacactgaagacacagtttttcataccccgaggaagaaataattgatctcactgggcaatcttttaaattttcagatgaaccaaaagaaagttctcaaatatggtcaaatgaaataaaagctttgttgtctttagaaactacttcaggtaaaaatgtcggtcttctttttgttataaactacaaaaaaaagtgaataaataaatgaatataaaataacaccctccctagcttcttagaatcaatcccaaacacaagcaagttacttctcctcagagtttctgcaggagacacaaacaattcaaatgctacagaatgaaggaaaactatattaaaaaatttgatttatgaaactgaggaccgaaaaacaagtggatgctaaatgcaaaaaaatctttatatcttccatacataatgctaaagtttgggggtccagggtaataatatattactttacttcagttgtattaggaataacatgaatgatctataattttggtttcagttgaagttgctacatagaattaaactaaggaaatatgtacttgctcttaatttatacaattaatcgtttagtaagttaataattattgattttattaataacagttgttgccaactagttgtgtcatttggtgtggtggttacttgggttcaaatcctacctctgccatgtaatcttgggtacattacctaattcttctgattgttagtgtactcatctcttaaatggggccaaaattgaatagctgtgaagatcgaatgagttaaataattaaagtaaccaggacagtacctaagacacaattaccaatgcacatctgtgtgtgtttttttgggggtgatacataacatttctactctcctggaaatcttatcagctgttttattagtgtgataagaaattcaaagatgagattaaagccttattataacattccccactccccccaaatccataaggactgatagaaaaccttattttgaatctggaagatcaaagaagatgtaagtggtattacctcttcataacagaacaaaatacaaaaataaaagccaagggacttgcttaataatattaataatttttaacttctactaaaatattactgtgtgccaggaactttgctatgttcttttcgaatgtgtgataagtctcgaaaagcaaattgcaaatgtagatgcagtggttcccagcccaagctacacactggaatagcctaagaagctttttaaaatatctaatgctgagcctcactgctggagattctaattgatctatgtagggtagaaatgggatattttatttattagaagttcttctggtatttataatgtgtatatagggttgagactcactttagtaaaatgtttgcattaaaaatacgtacatcccaggtgaacactacctggtaaggcaaaccattccctcagtccaatctctacttagatctttggaccagcccatgcttgctaacaatataaattaaaattacaggtcattaaaatcaactagttttctgcattcccaaaaatagaaagtgaagaaactgctatgggtaggtgagttacatttttgtcttattttggtcattttcttttattttggtcacattgttaattctcttcctctcatccgggaaagctgactttcaagaaagaggatatgctttttagttgcccctgttaacttcaaatgaaagatatctggggaaagaaggtgtgcaagatcctctctcttaccctcaaatatgtagaagttaaacataatgcctaatggcactgactctggtgtcaggcagagttactgggggcaaataatgattctacatttcatgttgactcatgatggaagacttttatttatttatttatttatttattttactattattatcattattatgattattttgagacagagcttcaccctgtcatccaagcttgagtgcagcggcatgatctcggctcactgcaaactccacctctcaggttccagtgattcttctgctgcagcctcctaggtagctgggattacaggtgtcctccaccacacctggctaatttccgtattttcaggagagacggggtttcaccatgttggtcaaggtagtctcgaactcctgacctccagtgataaacctgcctcggcctcccaaagtgctgggattacaggcgtgggccaccacacctggctgactttttttttctttttttgacacagagtcttgctctgtcacccaggctctggagtgcagtggtgtgaactcggctcactgcaacctccgcctcctgggttgaagcgattctcccgcctcagccctcctgagtagctgggattacaggtgagcgccaccaggcccaactaatttttttggtatttttagtagagatgggcttcaccacattggtcaggctggtctcgaactcctgacctcatgattcacctgcctcagcctcccaaagtgatgggattacaggcgtgagccaccgtgcctggccctggctgactttcttaacctccctagtccttgcttttcacatctgcaaaaaggaaataattattagcttgatagtgttattaaaagaaataaatgagagaatcatgtaaaggtattttaattaatctaatgcctgtctcaaaggaaatggttggtgaatataattaataattacgtatataataaactattaataaaattaatatctggtcttctctagaaagttcccatctgataaaaggcaaaaagtgaaagcactgcttaagaaataacatttagaaacaacctattatactgagtatcccactaggatggcttgtaacgtttagcccttcctcttaaacttgatgccgagtttctttggatcaatgtcttgtagttctggacggtttggctcttctgttctcacaggattctttcccttttcaacatgtcaatggtgaggaaggcatccaaattgcaccctcagtctaatcattgtacaggtctagtgtcagtgccttttctattttaaatgtgaattagtcacagctatagatcataatgaagtccctggagatcataaggcataattcatatgtccctgcatagactatactagcatgatactaaactctttacgttcttgcaactgtattatatcaacaaatggccattctcatcttttccaaaacatcctagcatgtgtgatgtctctatccttagaaatatctgattcacaaacatcaactgtgaagtcccctcctgtcattctgtgcatagtttataccctttctaccaatcactcaggaaacacttgaatacttcctatgtagaaggcactatccaggcattaagggatagaggcattttcaaaagagatgtatcccctaccctaataaggcttgtattttagtggtgaagaaagacattttaaaattattattttatagttgatttacaattcacgaacagatgtgtttagtatgtttatactgggccatccaataaggaactctgagaaaacaacttttattataaacttaaaaaaaaaaaagaatcaacattttttgcagagacaggtctcattacattgcccaggctggtctcaaactcctgtactcaagagatcctcccacctcaacctcccaaagcataggaactacaggtgtgagccaccatatgcggccagaagcaatttctaagatgtgtttaaaggaggaggaaagatccaggcaaagagtgaaaggaaggcaaagctatgcaatgtcaacagcctgtgccagggtgcagcgatgtgagaaacagccgaggctgccgctgaacctctgggtgtgatgggaaatgcgttgtaaggcggcctgctgcagaggttgggagggtcacaggtaagaatttggcactttattctgagaagatattgggccagggactgatatggttaggttgtgttcttaaaatattctttcagtttcagcatgaagaataaattggtaaaagcaagaataatgggaaagatggttattggacttgggtgacaggaatagaagtgaaaagatttgagaatatatataagcgagaatcgaaaggatttgataatggattatatctgagatgagaagagtcaagtttaagaataatttcctggtgtctggtttgaaagagcaagcaaaggtgctagttttcaagatagagaatactagttggagataagatttggaaatataaaagaataattcagtgagtgccaccttctgttcaagatgtctctatattgtatgcattgtgtgaggatattataaaggtagttgaataactgagctggggtttagagaggaaaattgttctgagaaaatatatttcagaattttcaaaatcaacaaataaatccatgatagtgaagacaatgtaaaataattttttaaaagtttccaagatgattcactttttgaatattgaactttttaccgtgttagagtttcacttttttttaagaagtcgttttccttaaaaaggaactgtaatttttttttcctggaattgaggacaatcgcataatagctgccttgatcatagtttatcaagaccctttacataatgtcaatttgtggcaatgaacatatattttaggaaaaactgtgggtgaaagtattttgtaaatctcatatccactttattaacttgcaatttaagatctccttgccggcaatcccttcttcctttcttcctcccttatttcccacttccctccctctcttcttccatctgtccaatatttgtacaacaactgttaacacatgaagatacatgaaatgaatgagactattctgaccttaaagattttatagtctacttgccaaaaactaatgttaaattacaaaaatagaagcacagaatgtgatttagagaaggtgctacaaagttgctaaactttgaacatgagtagccatttcctcaacagactagggaggtttgccaggcaggctggaaaaggaatgcccttcacacttcccactgcacaggcaaagcttccccatgcttggaggctccaggttgtaaattgctgtgctaggttcactacctgatcccgaaggcatattggtttaagtaatacaatcaggttcttttgacctcgggaggttaaatgggagagaggagggtagaagaatataccagcctatacctcaaaatgaggatggaaggagagaagggagaaaagacagagggaggaatacaggaagggagaaaagtgaaaagaaagaagggaggaagtgagagaggaaggaagaggaggaagaagaagaagaagaggaggaggagaggaaaatgcttaaacattgtaccaacagctaagagatgaagtgagtagctggtgacctgtacgtagttctagcagagggtacctgctgtgaaaaggtttaacgtggggtgttattctcattctctgagaggagacctttcagtgaaccagatttttctccagtgttctgtggaagttggatattttataaatataataaactctcccaagcccctacggtaatttttgaaacctttctataacaattttatcagtataaatcacatccacttgactgtagacagacaagggcggtttgctacacaggctggaatagtttttaaaaaattaaaataaacagcttacggtaatagtaaatactgagcatatctttaaggcaaaaagtactgtcagaatgtaaaatttaaaaatcaattggatgattttttctaatgaatgatgtgataaacccccaacggctctagattctaccatttcttcatgcatccattgagtgagtgaggctgaaagctaccccacagtcagttcttgggcaggaagtttggacccaatagcggtattctgtaacctgtatggcacagaaatcaaccaacgaaatcaactccgacccagcagaatggattcaggctcctaaataacaaactcaactataccgctgggtccaagctgaatgacagccctgattctacttaccagcccatatgcaaaatatctgttgaatcatcaataccgaaaaccttcaagacctgtcattatagactgaataccaggtttaatttcaattcagacatcagtgaaactcatgttgaatatcctctcatttgcagtttacgaaatctgaaaggtattttattattgaagtcagataaagatgcaaattgcatgaatatctttgactattatctacaattccaaaggtaacatagccaaaattcagaatctttccttaaaaacaggcatttcccatattggcctactatagaaatgttgaaaattaaaatgttttgattaatttgcactctaatttactagttttatactctgaattgcaaaccctacctataaagtatttatttctgtggactgtgatagtctagatagctcaggctttgaggtttgataatcaaatttattaataccaagatattctaataacatatcatttctgtttggaaagaatgcttactcaaaggaagagagcttgaactcctgttattctgaaacttggcacatttctggcataaatatcaatctaattatacatatggactgtaaaatctcagatcaaattgcaacttttagttgggagactcttctattatccttaatgaaccctaaattaggtgagcacacttaagaaataattgctccataaaatcctgtgatgactcactggtaaccacagttttattatgagttgaaggaacagaaaggcatctgtccattatgcatgggagtagctcccaaacacatctaatgagtcaccacacacaaggtcattggtcagtttggacctggccaatgtagtgacaaacaggcaatacattaagagaataaaacgtaggcgtatacgtttttcctttcacagtacagcacttttagttgttactaaaaatgtatctgatttgagattgaaaaaatatcaatagcaattttatttaaaggatgctgtatctgtaaaatgtgtgaaggactgttaggttcttcacacattttggggtgaaaattttcgggtgaaaaaatccttggtctatgtaaaatatcctttgtatatggaaacagtccttctcacattctggggtaaaaaagttacatatattttcggtaaaaatgcctaaagctgtgtcaagcaacgtacatgacaatgtatcctacaaatcagacttaacagactataccaagaaaatatctatttttgtatgtttcatgtgcaggaaatgtcacgctaatgtaaaccaactgtacaagaaaacagaatatcctacatacataagtaaaaataaagcaggaaacaaaacatgagaaattgattcttgtttacatcacctagcaagaacaaatgctgacagtcagccttaggcaagggggcaaaatcactcactaactggtataacatatcactaattgtaattaaccattttaatatgcaaattattatacattttagtggacactttatttcaaactatttggctccataaatgcctacactcaaatttggtgagtaaatgattcactccttagctctggtaggacaagggaaacacgaacaaaagccagacttttcatttctggagggttcattctggacctctcgtacccagatcccttgtcaagctccttctctgcctgtgttccatctactgttttgagtttctggtcttttacttgtttctcttgtcttccgttcttaatcttttcttctacagtttgatcctctctgctgatcaggcattacttggaatatttccaatcattttgacccctgcgacttggtcagagtgatctcttgcattatccaatgcctctgtctctccgaagtttttgcccaagaattccctgggcctgaattttccttgcctggaaaatcaagcatcagaaactatgtgtttaggtatataacctaaacataaatataaaccttgctttctcaaaattcaactaaaatggcaagagcatctttctggttttggtgaatacctttgtactcaccataacatgaatatgggatttggtgaatactatgccagcctcttcagaaagttgtctattgaaattagcctagtcctgacattgaatttgataaagaaagatataaatatcacaaaacaaacatgatttcctgcaattttctttacaattcttaagcatagacaaatattcgagtttactggggaggtcagttaccttaatcaggaatacatgctctatagtggttagctaatatttactcagaagtctactttcaattttgctataataaatactttagttatatttatttctaatgaatatacgtctccctgattaacagaaggaatgttagaaaaacgatttgtattggcaaaactgtgattttcaaaacatgtgaattgactggaaatatgtttaaagtatcatccctcttaaattaacagtatataaatagctctgaagccccttctcttgctcctgagacgatgccactgttctgtatccagttaacgaggcagagggttctggtttccttacagtaagtttaattaagtccttctctaaagtactatatcatctgcctcaatgactataatgagtggtcagaatacacacaaagacacagaactgaaatttcatcaagcaaatgtttttaaacattctcatgacaaatggcaaatacatgacagtgtagatacagcattatttctgagacttgctctcatactaaatacagatgcagcagcagagaaattttatgatcctcaccactaactgctgacagatatcagtaattatttaaaacaattaataattatgaataatatactggcttaggtttgtctgtaatagcattcaaatcttgaaatcctgaaaaaacaaaaaaagtaaatgcaaatgggttatctgggttactgttaaagtgttctctaagtatttgagtctatttattgaagaataaataagtaaaaacacagaaagatgacaaacagataaatgggtattagcctttaggttggaaaaaattagaaaagtttcagtcacttctatgaaataggaacactatcctggaagactgagaatttgaaagaacgtcttatgtattactggagacttatgtattatttattgtgtagtttttaagagcagtgtatagggacagtcagagtacattatatactagtcagagtatgagtgattatctcaacagttcaggaaattattcagaaacattagaaagaaaggagacatattgctgattttgggttaaagtgaagaggatttaaatagaataaatatacagaaatctagggaagattaaccttaggaaagctttacattaagagggttaaaacattaactcaagatacttcttttctcatgattagtaatatttcgtaacaggaaattgtggaccattcaataatgttagatgagctacaaaaaaattttaaaagtcaactaaaggaaataaggtattaacttgttgataaagctatcatagtcttcctcatactagtcgtgcattattatgcatcttaggggttttcatgaaatatgtttatcttaaaatatagtaatatatacttcatgaggaaaaagtgcaacttgaattgctgctcacagctttctctgaaaattcttccccctgaacttcttcctttgggaaaatacgcttgatttctccatccctgtggtcgttcctgaaaacagcattgttttcaaggacagaaaggatagcataatgttttggtataaatatcaatgtaattcctaaacatctcaatcctttccaaaaaagattagacgcagttcaatatagcacgcaaaacatctcattatcaaagaatacacgaacttatttctgtaaactagaagcataattttacctttatgtaaactagaatatacgaacttatttctgtaaactagaagcattttaccttgaataattcattattaaataatttctgaaggaaattttaaaatctctctgtaaaatggtattcatatccaaattaaattcatgatgagctcttaatttcaccaactgcacaatttattgagggttttagtgaaagagattctctcctcaataagattcatacacagcattctacttagaaaatattctctatctatattttataattagatttgatagtctatgttactgttctaaggctatctgggttttgatttattttacactttttgccagtaattctttttttctacaagtcgtcacagattttctctataatcttattcctttatgatgttttattattatttcttccttagataaccattctttatctttcaactctcctcctatgttttaaattaaagcttacttttatcaatatgtattcatataatgtatctttgttattatgaaaacttaagtcttgcctaacacaaaaattaaatcataaaactataaaagacaatattattggggcccttcatttggaaaatatttcttgacactaccctatactcacttcccagtcacaaattataaggagaaaaattgatgaattatatttcttcaaatgtatatacttctgtttatcaatgacatcatagatgaagttaatcgacaagattttactatctaaaatataacaaacacttccttaatcatttcaaaaaataatctggaatctcaataggaaaaaatagacaaaagctataaagaatgaacaaaggaaaaaccgattaaaaagacagtaatggtaaatggtagggatatttcacctcattaatactccaataaataaaaattaagaaaactacgacatgacatcacaccgctttccaggaaaacaataaagtcaggtagtataatactaagtccgagagagagagactaaggacactcatttactgctcattggaattgaaacttggagagccaatgtggaccgccatctccagtatttgataaaactgggtacatgtgcaaattagcactcagaaatttctcaaagtgcaccagagaaaaatctctgcccacacacaaactaggaaaattattctatgattaaattaattacagtgtttatcatagtgtcaaatagttgtacccaacctccgaatccatgtagaggaatacgtaagtgaagatatacataggtaaagatgtcatcagaagctataggccagatgggcagcagcatagacagacactcaattaaacattgaatgagacaaaataagaaaaaaaaaaggtaaatttaaaactcaaaaccattcgtacaaactgaacacatacggaaaacaatatatatttatatacacacatacacctatgtatacaaatatacacacttatattggaagtacctctacaaataaaataaagaatatacctatgaggaagatatagtgttaggaatgtggttgaaatattttttaaaaaaattacaaatatataaagtatatcaaaagccaaaagaaaggcttttcaaagattgatgctgatattgtgccattcactgagatcgacaaaaggctgcgtatttgagatataagagataaataaattaaacatggggctaattatatattaagaagattaactctctaggacacatactgcaggagctaattcttgcattaattttgaagacgctccctagagttttatataaggaactgtttgtggaaaatatgaggatcataatagctttgtagtccaataattcttgagacaatatgaatattttagaaatgttacttcttgaatactcttaaaaagagattatgtttaaaccaatacctgcaaagcttacaaaagagtaaaagtccaggaagacaccaggtatattctgaaccaatggctcttaaaccacgctctggaaaattctcaacttctgtagtgatatggcaggttacccacaattaaaattattgttttatatattttttcttttctacaaagcaaacgtaaactgctgccacttacaatttaatttaaacagatatttggcttctaagatgtttgaaacatcattctagaaaagaacaaatcactttggtatttgtactaaatccatattatacttacccctcaccagtactgaaatcaactaactaggatttacaagaatgaagatcaaacaacagaacttggcgtgaggcacacacagttctgagaaatcaactggagaccaacaatgagatgcttacagtcctgattagctctagaaaagagctagagctagaaaaagaactgggttcttatgagagaaatcatttctttctaaggagtatatatcacagatagagttacatagttaataaattagacaatggcattgttatggagtcaaagtattttcaaatacatatactttaaaaaaggtgatatttctgccactgtcagagaatttataacaattcaataaccttaaatcatatcccataaacaactcaaaatgttaccataaaacttttatttttgttctccctgaaagcatggtgctagttttatgcatgtcactgggtcactgaaatgtaaataatttgcctataaactgataatttagtttatccaggcacctctgtgatacagtctactattttttcaatgggtttcatatgttttacagttacccattattattttttgggacagagtcttgctctgtcactcaggatgaagtagaatggcgtaatcatggctcaccgcagccttgtacttatggcctcaagggatcctctcacctcagcctcatgagtagctgggactacaggcacaccactatgcctggataatttttattttttgagatgatgtctcactatcttgccgaggttagtctccaactcctgggctcaagtgatcctcctgcctcagcctctcaaagtgctagaattgcaggcataagccactgctcccagcctcagttaactattaagaagtgccgcttcaactattggaggagctaaatgcctccaataactaactattcttaataaagaataaaggctggacaacagtgatcccagcactttgggaagccaaggtaggagtgttgcttgaggccagaagttcaagtccaatctgggcaacatagtaagaccctgactcaaaaaataaaataaagaataaaaattgagtgcgtccattagggttgtcttccctctctctctacactacaacctatataagctacatgcacagaaatgagccacaattcactaacttttctgcaaagaagcgctaattccacctatttcaaccctactattaaaacataccaagtacatccaaaataatatttaggatgtatacaaccaagaacaaataaccatttgaggagaaagaatagttattaatagtacagtataattaactaatgcattttagaaagggcagtctgaacaaggaaaaattacatattaggttgaatcatgtgaaattggtatgctttttcttttctttttggtcagaaacagatacatagaaaccactgaaaataaaaatttctggttttgttacttatgtagcatatctaaagtcagggcaaaaaaggtagttaatagaaccttttctgtctctttgatgagttgatgggaataatttgtgacaattatataatatttttaggcattatggcaaatttctctaaatcatttttatctaaattacctcaattggtccgcaaaatgttcagtaaacttggagacacaggtatggtccttgttttgaaaatgaggggaaaaagttcaattattcaacaaatatttacctagtggccattgtatagcagacactaggcacatggcagagtctccatgagactgtattctaccaaggggtataataaacaaagaaatagataaatgggcaagttacagatttttgttaagattcagagaactggccaggtgcactggctcacgcctgtaatcccagcagtttgggagccccaggtgggaggatcacgagatcagcagttcgagaccagcctgaccaacatggtgaaaccccatttctactaaatacacaaaaattagccgggcgtggtgacaggcacctgtaatcccagctactcaggaggctgaggcaggagaatcgctggaacctgggaggcggagcttgcagtgagccgagatcgggccactgtactccagcctggtgatctgtcaccgttgcaaaaaaaaaaaaaaaaaaaagagagagagattcagagaacctaattcactataaaaaatattaatatgtcagagatacaaagtttctgatattctgaattcctagaattcttactgcatttatatgcgacgaatagtttgttatttaatttcaaagtgcattgtattaggttcaccaaatgtttttcttgcagattaaacttatctctataattatgcctatgtattttatgtcattatttctctcctaacacctgggacaatgcttgacataaaatcgggactctaatgatgagtcaatttttccaaaattattaagcagaggtttgcaaatcatgtgcatcaagttgattaagtatctcatctagtttacactattaatccattcagttaatcattttactttaacatccagcccactccttatatcaattactataattttcaattagcagagaccaaattaaaggaggcttgttacatgcattcacctgtcctcaaattatgacttgttagattgtgaagctatcgaaaaatcctctaaatccagttgtctacctggccaaatacatcccttttaaataattccttttttgaagtgtttacatatttttcttggtgtgaacttcactgtctttaattaatttcgtgttttaacgttacaacgtatttctcttactgaatagaattctgcctttttatataaattttgtttctttttcttttaaaatcttaagaggttatcttaaattatctgtgtctgatttatctgtgctaaccattcccaagtcttatattacgtcatactattttttagtaaattttataaatcaatatgatttgttaggctttcaataagtttaacataaatatttaagtcttttagtaaataatatgtcaaatttttagtttggaaatatgggaattttaattataaggcatagttctaaccaataactcagcctggtttgcatcaacaccaatttggagatgtttattcagctatttaaaatttattatacctcattctcttcaaagcactctggtttgtccatctactagttaaaagtgtccctcaattctgtcatccagaaaccaacaactctccatggtgttctttgaccagtgtagctatatagtggaaactcatattttgcacagcatatttctatgcttagccaaaaactgtactatattttaaccatttaactctatcatcccataagagaacttttcagttaatctctccatttttaatgcattggcctctatctagccacttatgtcccccaccctgtgctttaataagaagctgtcttatctaaatataaaactgtaagtttatcataattacatttcaccttatttgagatgttgcattctataaaacttatgaccctatttagtcttcaaaggcttgtaccatcttcaaaaccagtaacatatcttccatctactcatttaatcatttgttaaatttgataaggataattcccagttggttaaaacagtatttctctaatttataatgattttcaccaatacacattgatatatatttagtcagttaattaaaatttattaaacatctctcacagtaccatttaatacataaggacaccaggaaacaacttaaaaatggcttaactcagtgtttgtagcatttacctaaaacttatttttagtaaatttgaaatcttactaaatttattaaatcttaaatttagtaaatcttgaaatctgttttttttaaatgtacataaacatttgttaaaaacattcccaaaattctggctggtattgataaaccatttttcttaacattaatattttcttaatatttgaatctagaattctagttcattttttgggtatacactgatattttatgatggacattaacagaaaacatcggtaaagtaaaaataaaatgagctattgattcttttaaagcactttgcccaaaatttcttcaaatttatatatttttattatacctattatgaaaataggaagacaatgatgtcattttatgcctcataatacatttaagaaattattcagcttggcttatattgtacattcatattcttattaaaaaccagatggctttttcagaagcaaaagttgaatacatcctagaagatatataagcttaatcagtgaccttaaagtagatatactaacaaacatattctacaatctattccccagaacaattatcacacttctaacaatcatatcactcattttttcacgaataatacacatccttactttgagtataatgtcatatattaaagggatgcttctgcatatgtgctttactatttttataaactgtcttcatgagaaaagaagcattttgactcctctgacacatctcaggtttagttttcaccttttaagagaaaacagagtaagcagataatggctgtggcagggctgtaattcaaattgtcaaagtaatcaccatggtgtccacatctggcttcattagaacctaatgactcacatttcaaatctacctcctgtctactaaatcccaacaaaatcagcggattctgactgatttactgatctccatatttccttggaatacgcagacaccaatgcctatttttcttaggaaaagacagcatcaaaagaaatctaggacattaaatagctattgaatcaagagcagctgcacactgaagaaagtatttggtaactaagaaaaaaatatatagcttcgtgtcagccatataatcctagaaagctaaacctgggctaccaatcactagttaatttaaaaaccaaatacaatttttataaaaataaaatttcagaaatgataaatacttcactgagaaatgtatcttgaattcccataataaaatctggctgcagagtgctttactaattaatgaagtaatttgttacaatgagaatatatcttgaaatgtacacacctaggaccataaaatagtgcttgtttaaaaatatttatatatatgaatatatgattaccatttttacctctttcaatctattcctttcatttatttcctcaagtattaattaggttcagaaacaagacacatcttatctctacatggaaattcaaataaagccttgaaagtctaaataataaaaattaatataagtaatattttatctctatactgcaatgataaatggattttgcacaggtcaacaggttttaaaatattagtactattctaataaactactgcttacactatttctgtttctttgtccctatattcaaggtgaagagtagctgcactgacgctatgtaagctatttgcatctattttatttacacctatttgtttctgtttctagacacgtaagcaccaacacccaataaaatgtatgaaattgtgttttaaataacaaataatttacatggaccctagagatacaacaagaaaacattacctttggaagtccttctcagaagattacacacattaagagacagacccaccttgctctggcttgacttaatgactcaaatgcaaaaagttatggtttgtagtttttataatgcttaatgagccctacccaaaatgacagagatctccaatatggaaagacttcccaatagacacaatttataaaatgtctcctgagaagaaaataaaaatccatcttacctcagcatagaaatgattaaatattactttatactacatgttgagaactatacatatttagaataaagattatttccaatgcatcattttataaacatttaaagaaattgtgtacatcaaattaggacaacataagatggaatatagtagtgatgtttccaagttgtcatggttacttacttgtcaaacaatatttctaactcacacaccatgagtgtcaggaatagaacagcatagcaaaactctgaaagtcaccattcacctgtgaaggccaaaataaaaatgtcaaagatgatggcatatctacagagtttggcggaaatttgatgcaccactcttttgccagaatgcagaagcttccagaattgatgaaaaatgaaactttgagttaaacagtatctcaacaggaaatgaaatacatctttctatcttttggaaggttaccaagcatgtcttcttgcaactgatctgcttccaattcttaactggaaaaagaaaagactaacactccacagtgagagaataaattgagtagccacgcttttatttaatcattcttgtttggttttagttagtaattaattttgtttgtcctattttataaaaatatcatgacaacttttcataatgcatgctgtcataaatatatatgcccaatgtggtagaataaatagaaagaaaaaaatttaaaaaggtgtacaaatattggtaaatatctttttaattatacattctcactgaatgaaaaacagaaaatctcatcctaattattcagcatatccttagaattttgatattaacataacattcaaagacatatttgcatgaacttcatattgaaatgtaattatataataaatgcagataatgtgtagaaaaatatgtatctgtgtactgccctcttacatatctaaatatccagaacaacactgtcttaattgtgctctcacaactatatggtcttagagagtcaagttaaataaatttgagaaaactgcattcttaaagattcactattcatttttccataagagctatgagatgtttgtaccaaatatagcaataatttgtttaaagcataatatctttgttcataataaacttttattatgtaggcctaaaaagtttattgtttcctagaagactatgttaagatgtctctgcaacaaaggtctgtaacggattagtgtttctgacttttcttctaccataatatacattaatttaattttcatgatccttagaaaaatctattttatgcaactgttattttaaattatgtgtgggatatatttaataaatgataagattgtgttcatttaaaaatttatataaaaacaggttttggaaaattaccagtcacaaatcaatgtaggaaaatggcaccaggcaagaaaggcagcacatatttctttagtcataggttttccaagtgacgttgcttaacagaagaatctatgcagctctctggtcattagaatgataaaagcaaaactatttgtcagagaaatccctgaaagatctaattttcaaaaatgttagaagagaaaaagaatcaagtttgtagcataataaaaaaaaattagcttagaacacacaaaattcacattcttaatagtcagtttataaaatacaaatacatatgtatatagatgatctatattacatccttttttaaaaggtgtgagagattactcagaaataaacacttctaaagggtaaaatttacttagagaaactatataacctgcaaccatatatatctctatatataaaatatagttatacacaaacatcattttatatatataaatatgtatgcgtatatatatatagagagtgtgtaatgtcaattaactaatgtaataaacaaagtaaaataagatatcaccgtcataaatattttaattcacatttttgtatgtacatctctcaactttactcctaattctttctcacaatgacaactgtagctttttctaatcatcctgtatttatgctcctggttaccactgaaaactcttatgctctgttagaggaattttctctatcgctggagtttcgtggcccacaaagaaatactatttggcaaaaggtcgtttggaagcaggtaagagacagtgaaaaaaaaatgcatttaaaaaaggcttatcaagagcgttcttttagtcatagcccatacattctacaaataacatctatcaggaaaataattcaagatctaaatggagaaacataaaataacaaaggcacttaaaataattataaaatgttctttcaaatgctattacaaaaatcttatcaaaaagcaggcaaatccagaagaaaacagatgttccacaaatacaattcatttctttgtatacttctgaaaaacacattaatcctttcagtacactggagagctactgtgggaaagattgttatgcaggcacttcagaaggcctcacgatgtagaagagtttgctcctttgctgggagccagcccaatatccccccagatcatttttatttggccaccaacactgcaaaaacccttgcaagcaaaaggtggattcggagagaggcatcatttggcaatgagcatgacatatctttgctacatctaatttatgtatcttaccccagtaaaaatattttttttcagctagtaaaagctctttcataactctcatactgctttttctaccctctttcatgaagacagttcagagattcaaaaactctggatatcttcccgttttaaatatatataatgttggcatgcatttagataaataacaatttacaaatatacctgtaaattcaatatcaagcctttattaggaaagaaatctatttgaacatgtatatatgctgttatggtaattcaacttggaagattaagcactctagaaataaaacctagtcatattgatataggagttaagaaatcacttagggagaaagtaagggactaggagtcctcggtaagacttttctctttaatgaaaagcagccccaaatcgtttcctaacaatgagcagcttgtaaaatcaagctgcagacatagacaagcaagctctcagcttgcacgggtgaatgccagaaggaaccagggcctagacatgttcaagatggcggccccatcttccctcctctttgtcagccacgtgtagagtaaaaagcagacaagatggcaccgatcaactggaaagcccatttgtgttaagattagggcacggcgaccagccttccccatgctatgtaaacatcatcactgatcaaaccaatctgtgttcccttcgtagtaaatcaaacaccaccttctccagcctgcctataaaatctgctgtggtccctgcctccctgcttttttggaggtgtctctctggaaaggaattgctctcctctctccgttcttctgtctattaaactttcctctccttaacccacccacatgtgtctgcgtcctgaattctttctcagtgacagacaatgaaacccagggtatatactccaggcaaagtagccgtttcaatattttttgtaaatgttagccattttaacatgtgttccagcagactgttaaaaaagtttgttgggacttttaaaaattgcaagtagattttgttttagagtgacaactgaaacacgaatatgttaatatataagtcatgtaggtttgcagagtaagacaacagtagtaccacctatataagaattgaaatccttttgcgtagcagataaattttttaaatcagttttaaaaatgcattctaggagacatatgtaagtaacaaataatctgtgagatttctactaaaattctgatttcctatctattaccttaagattatataatgtaagtgtaactcaaacatagcagcagtcatgctgtgaagattatatacatatagcacagaaaacccaaatcacatttcttactcaggaaagcccgaagtttcagcacctcaaatacaaagaaatatttaccacatatagacatagatagcatggaagaaagaagggaaatcgttgaaaagtaagatcagatagcagaaatgtagatatgataatgtggtagctgttttttcaggaatgctccaaatttagcagaacacttaccacatgagtaaaccatacctggtgcaaggcagtactcaattgtgaatgatcctatttgtaagctccatataagttaacaaacttgcctttaaaggcaaaaaagcaacttcacttcatattttgtagttttataactaagattccattatgtgtgatggcaccagatcttgttttcactttgtcaatctagacacgagtaaagttcctctttttgtacagaaaactgttattgtgtaactagtcccacatatgcatctaagtggaattaatctacacttacgagtatgtaaatagagccaaggattcagctgggtactttgtaaaaatagacgcatagttattttttaaaaaaaacaatgtttattctgttatttatgaattttttttgtatttactgctaggttgatattgttactcagcgtcagagaaaaacagtcatactcaaagtcatccttaaagcataatatgaatatgactttgtataaagtaatataattttggaaatagaaacagtcacagcttttcaaacagacagcttgacatatacatcagactcattagataaaatatgtcctggtatactctgcaggtacagctattagctaatcaaaatatacattgccaggtaaattccccagggcctgaattgtcaatcataatttgtcagctttatagggaaaaggaggctcaccacaatctgattcttataattaattttatacagtgttctatggacaataataatgtaatattttaaatgttgaaaattccagtaacaagttagcctatttaagcaagagattttttttgcaactgacctatgattactctttttatttattcatatcgtaactttaaccaagtggaagggaaatttattgtgggatcctgaatgccaaattcattcctaaatcaaatctcttacagtttaatcaataaaattactgggcaagagagactgtttaaattattcctagtaatataacactgcaattggattctttatttgaattttcagttcttctattagtttcaacatttcatggtggtctattgatccacagcaaagaacctcttattagaaactgaccaaccaaacacagactctgccaactctgatctatgttaatagatcacttactttacatcctatttctacacaagttttcaggccactcataatggggcaaggaaagactatgtctttcaaagctagtatttttctccattgtgtatgctttctgtcttcatttggaaaaaaaactaaatgatttcgtgtcttctattttgtaccatatcacatgtgcctttctcacatcattaattaggaggttagtataagatatggaatgataatgcataatatttgacttttaacctttcagactgttttcagttatattacatcatgttacccttagtggtgttctgcaaaatattaggctagttgctattacacctgttattattattttatttaaatatgaaagacatatctatttttaaaatgccctcttggcaagtatagagatagtagcaaagccaagacttctgttaaaaatgattgcctactttcatacttcagatccaagaagatactgagcaatcttttaagatggaaaatgaggtgaatatcctcgtatttctttcttctccattttctttagtcatccctataacggagaattaaggcaatgagaccggctgaatttgaagtaaatatagcagcagagtatctatattaccatggttacacttgttgacctcatcctgctagttctcagaactaggtccatgatttctaagtggtatgaatttaagaacattttcttcttcatgaagaagcacatggattaaacacaactttctggggtaattttctcggggtctctcataatattgtttttaaataaaatttatcatttcggttttaaacaaattttacacagctgttatataaactcaaagccctctaatatgaaggatcttcctactcactagaaaagggcaatactcatttgaagtccaaggatatttgagtgtaaacaaacaaatgataatgcagtagccaatcaatgagagtaattcattatagtagaaacaacttagtattttacattctcactgaaactttctgtaagattatctcctctgactcaacaaccaataattttgtatcttactatgtttggggaagtcttcattattgttctgaagaggtcatgcaatgaaaaagacttcagttgaagttatcttcagagaatcagccttcctcattttaactaagaacagtagtgcagaccagcatacactatgtgcttggtgccaagaggcagctaaatacagtttttgaaaatatgttgaaaactgaatggatacataaatatcatcaatcggtctgaaggcagcatatgttttggttaacagcatagaccctgaaggaagactggggggtttcaaaacctctcccaaggtgccagctctgtgaccttggataagactttacccttttatcatgtcagtggagataatagcaatactcaccttttaagatgcgttgattcaattagttaataaaattattgataacactatatatcatatgttagtcatatttatgcttgttaaataaatacaattaaggccaggcgaggtggctcaagcctgtaacccccgcactttgggaggccgaggcaggtggattgcctgagctcaggagtttgagatcagcctgggtaacatggtgaaatcccctctctactaaaatacaaaagaaattagctgggtgtcgtggcatgtgcctataatcccagctactcagggggctgaagcaggagaattgctagaacccgggaggcggaggttacagtgagccgagatcgcaccactgcactctagcctgaatgaaaaagcaagactccacctcttaaaataaatacaattaaaatatttcagatgccagtgtcaatttgatacatattgttctttgctctcgtcttgaagagcacataagtagagtcacataaatgataaaaattaaaatacaactcctatttgaacaattaagatactaatattactccatagtaattttgacagtagtactatctattaaaaatcaagctgggtgcgatggctcacgcctgtaacctcagcactttgggaggacgaggcaggcagatcacttgagttcaggagtttgagaccaaactggccaacatggtgaaaccccatctctgctaaaaatacaaaaattagccaggcatggtggtgcacgcttgtaatcccagctactcgggaaactggggcagtagaatcacttgagcccaggaggcagaggttgcagtgagccaagatcacgccactgcactccagcctgggtaacagagtgagactctgttttttttgttttgttttgttttgttttaaagaaaactattagcaataattactgcgatgttatttttacatcgttgcatgcaggctcaccatactccttttagtagattttatatttctacttctaaaaataaggaaactaatgcctgtaaatggtaaataatcagactaactgccatttatctgggctgctttgggtaaattttgtatcatttacaagttgaacaaatgaaacaaaaacttggagtgcattttagcttctgacactgtggagggctgggattgctgcctagtggaacaggatgccagacactctggagaagagccttagaagatcatcataacccaaactgaagtagtgctataataagatttcaaagtggcagctaatgattcatggatcacatgccagcaaatctgtcacttcagataccactgtctgccttacaaagaaagctagacaacctgttcaaatgcactgtttttatcaaaaagttctgagccacttacaaagactgcatttaaagggacgaaatgtttaatggagttgggataataaaaacataggaagtcacacatccaataaaaataataataatttagagagaagcaatacaaagacagctccatagactggagggtaagtcaaagatgaatttgaggaaaaaaagataagatggtaacagattaagaagatatcatagaggaggctattaacatgcctaagccatataaactaaataaggaagaacaaatggagatacgagagatttaaaaatattatagactttccctaaaactgtaacaggaattacttttaatatagttaactatcattaggatacttaatttatacctaattgtatttgtttaactcattctaaaatagatagttgagagtttattctgggaggtttcattaagaattatttgtaatagcattgctatagtggcactgtgctgggcaccgcatgcctgaaccagaattgaaacaatcattttcccagccatcagcatagtggcttctacgctcagaacattgagacattgaccttgactgcaggaagctatctcacccaagatcacagtagtgtagcccatatccaatagtgttggatttagggtaaaaaggtccaacccttttatcttcatgagggaccatcctaaagaactatcccagcttcagagcttgcagtggagtggttgaggactgttgcgattggattaggcttcaagctctgaatcttctcaactcagcttcccgcattcccttaagaaagcttcccaagagcagccccaaacaatgctcctactttcaaatctccacatcaatgcctctccttcagacctaaaatgatctatgaggttgtcaaagttctcctgattagtatagtggttagattttgaaccctgaagtcagactaatttgagttcaaatatcagttcctcacaatctgtgtgatttcaggcaacttcttcattagaaaatggggagagcaatgacccctatctatcaagttgtaaagattaaagggcataatacatttttataacataaatgcttagttaataaatattcaataaatgtcatctaattttattatctatgcttatttaaatccccatttaaaaaaaaaaaagaaataagctactcagtgggcatttgctctcctagaaaaacaactccaatcagccatcggaatgctcaaagtataaatagtagtagccagaatttgcttgtaatggaattgcacaagtccctgacatcattttacagatgtaaagttagtaacagtcaaaaaattgaacatctgctgtgatgacaactttgtgttttttccatagattttgttacaatttagtaaaagttcactccttatataacccgacttttttcaattaatggcgactttagaaaagtaagggatggtgtgaacaactgaaagacaagataagaaaataaaagtgaaatggtgttaagcaattcgtatgatttttacataccaagcaacagtaatctatgaaaacgtgctttatataatgctacagaataaagcaatatttctggtggtttaagaatattcaaatcactttttatttatgtgaatacccttgattttattttccttaccatcaaatgttgatggaacttgaagccaagccaagtggtgcttaatccctgctttagctgcttgatttcaaatatcccttagtcagcttcagaccttggggaagggaaccagctgtgtaaaagatgatgcagtagcagctggagaaataccacaagcagaaaatgactgcgtacgactgtccttccttgtgaaataggtgtaggcacttattcttgggctaaccatgtcttataaaatatatgtgatactgaaggattaaagacagtctttcagtaatactgctttcaaactaaaaacatcatgcactcagatgtgcttacagaaaaaaattatttatataaataaatattgagaaaacagtgattcgagtgaatatgggctacctaatttttatgtttttgtattttttatttattgttattttttgagatggagtttcgctcttgttgcccaggctggagtgcaatggcgcgatttcggctcaccacaacctctgcctcccgggttcaagctattctcctgcctcagcctcccaggctacctaatcctaaactatattcctagattctcaatagaacttcaccttgagaatcatgaatacaaaaacacttacaaatgaaatagtttggggtattccactagaccaagggatataaagcaatctaagatatgattctaatcttctaaagcatttttgcatacattcaagataaaataacaattcagtgcaatatatacatattagagatggagaccaaaacaaatgttaccataaaaggaagtaaatactcagttacaaaaatcctgggaaatcaaggaacatttcttaggagaattatattccactgatttatgtattttacattcaaccacagaggaagacattttctcataaagttttctcatcagttcttagcattgactgcagtacttttataattgaatgatgagcttctacacattaggttttgcctttgttttgcacacatatttgaatttttttaaagggcaattacatgtgttttcctaaactgaaattttacagctagtgtctgcaaagtcatctcctgacaggaaaaagaaactatgagctcaagtaaaattgtccaaaaacttcagagtacagatttggttcctctactctcaccagcaaaacagcactggcttctagaagacattggccagtgtaggcagcctttattctactttgactcaatggaatggttgctattatctatttcaatatttctaataagatggaaattttttccattgagtgcatgtatttctactaaaaatacacaaatttaccttccttaatattcagagaataagaaatgagcctctctggaagtagataacagaagtcggatgtgcagagacaatgtagagatggtatcagttaactgaactgaaatggttcccatagtatttgctttttatagagatttttttacacagttacgaaatgtacgaaactcccaggacacatatattcatggtgtccctatctgttcaattaattaaaaatcacttcaagatttcttctctacttcactgcataaggtaagggaattcaaatgcaaagaacaatttaaagtacattggaaacataaagttgcatggaatttatatcacaggagaacaattgttgctgtttagtcaaaagctcattctttgccgtatgcttagaggctattgtttattttttaaattcatgtttttaaattgtattttataatcatcagtacagctggtgattctgctacaagcacaactaaaatgaaattacagacgttcaactgtagggatccattgagaaccccagagttggtacgaagattattttgaatgcaagggatttgagattcaacaaatacagaaagaagccttctcagagcttcccttatgtgacaaaaggcagcaacttctggaaaataaggctgtcataaattactcccaggacagagacagagggtaaaccttccctaaatcccctcttaaggggagtttcatggttgtgatgaaggcagtaaagccactcgcacctgcataaatgaacatcacaagtttttgtctcacgtttgttctaaaaatcctttagtctttaagaaaacctatttgttgttcccacagtagtgttttcatttcttttctttctcctactaatgtatataagcctctaactttaagcatttagtaagctagttacatcttctgttagttcctgtatagaaatgaagtttttcactcctgttaatctatggtttgtcaattactttgtagacctgctgtaaatgaacccaagaaggcagaataaaatgttttcctacatgacactagagatgaaagcacctaataagatttcaaatgtcaactataaggatattacagaaaattagctttgttaaaagcaaaatccattaataggttttatattttgtggtattctttaataaaggtgaataacttaaattatcatgaataagtacaaaaaaaaaagcacgccttcctatttacatcagaagcttatccacatatttctagattttttaacatggaaaaactagtgttcatggtgggcaatgtttgttagtgacatttatttagcatttactttctataaaaatgaatttcagaaagatagtaattagataaattccccaaatatttttcaacatagtaaactgagtttgaggctaaaaaacacaaaatgttaaaagtttgatttgttaaatagtcatattaacattatcattgttttacgtttaagtatggttcctgtatgtctttatctaggaatttaagacttttttttttttttttttttgagacagattctcactgtgtcacccaggctggagtgcaatgtcgccatctcagctcactgcaacctctgccttttgggttcaagcgattcttgtgcctcagcctcccgagtagctgcaattacaggtgcgggcctcaatgcccggctaatttttgtatttttagtagagccagggtttcaccgtgttggccaggctgctctcgaactcctgagcttaagtgatccacctgcctcaccctcccaaagtgctgggattataggcgtgaggcaccaggcccagccaagacattttctttactgcagcagttaagtttaaaagtcaattttcttttgtaatgcatacgtataccacaaactgtcttaatatggtctctatcactgtcgaagacaaaattttcttttgagtagactattattctaattcacatagcatttcttatggcttagtttattaatatgttaatttcttaatattttattgcattgtactcacagcatgggaatcccggaaaaaggaaaggacaattgcatgctaacagttttgtcctttatatttatgtactaagaatgaaaatgtccaggacttgacctaacagagtaatttataacaagatgcttcttaaaggctaagttttcattctcaaggagatgcattgcctataaacagataggcagaaattctggagacctacagcttgcccgtgtgggttgaaaagacattaagtgtaatggcaaaaaccacaattccttttgcaccaatctaacgaatccttcaagaagcatcctatgccagatccagtgtggcaaggtttgagtccctcagacacgacaatactttcaatttccagggtttgatctggcttcactttttcattgctgtaccagatggacaggaaaaggacagacaatcaattccatgtcccttattttccataagcaccagagaaggaaactaaggtctgataagaagggataccttgggaatttagaaaaaaaaaatgcataaaaggaagcctacctactttggacacattttatgggcagaatagtgacaacagggcagagatgttgttttttacactgttgaatagcaacagtatgatttgtaaacagatagctgaagtacacattatctcagtgagtcttaaagttaactatgtgaagaatgtaaatgaattcccaaaaggaaaaagataaatcaggattaatgtataggacaatccctaagaagaacacaggtcattaaacgcaaactttgatttcagtaaaaatatttcattttttcagcaacatagatattaatgcaaacagctttttaagtaatatatgcatgttcttatactcatttgtcgttcaaattttggacaattttatataaaataagcataaaaaataataaaagatcatcgaaaaaatattgtcatcatgtttcatttgcacaaattgttatatctaatctaggttattaaactaaactatgttgataaggtaaatacttatagaaccatcaatgttaaaaattcatattctttgattttgctaaatttttttggatctagataagtatcatccctatcaaacatgcacatttatcacgtaagcatctcagatgtactgtttctcctctttgttctaaacaaatgttgtactgaaattgtatttcaccatcctgatttcttggggttatatatttcttggggaaatatatttcttgggcaaactcagtagacagttttttgtttgtttgttttgtttttccgtgtgtgtggtttttttttgtttttttgagacagtctcgctctgttgccagactggagtgcagtggcatgatctcagctcactgcaacctccaactctctggttcaagcgattctcctgcctcagcctcccaagtagctgggattacaggcatgcgccaccacacccagctaatttttttacttttagtagagacagggtttcaccatgttgtccaggaaggtcgtgatctcctgacctcgtgatccaccagccttagcctcccaaagtgttgggattacaggcgtgagtcaccacacctggccgacactttgattttaatggagaaatgacatcaaaagtctttccttacatttccagaatatcacattcctatggacacagtatatagtctttcagtatcaactacatttttatagaaaatttaaatttaaaatatactatatcaaagtatcaaagttcctgattcttttttttttttttttttttttgtgaggcagagtctcgctctgtcacccaggctggagtgcaatggcgcgatctcggctcactgcaagctccgcctccgaggttgacgccattctcctgcctcaccctccggagcagctgggactacaggcgtccgccaccacgcccgcctaatttttttctatatttagtagagatggggtttcacagtgttagccaggatggtgtcgatttcctgtccttgtgatccgcccgcctcggcctcccaaagtgctgggattacaggcgtgagccaccgcgcccggccaagttcctgattcttaaactccaaaaaataaaacacttcaaaagtggattttacttatgagatacaaagtgtaagggagagagagaataaacaaggtagagaaataagaagaagagcaagaagaaggaagaggaagaaagaagagggagagagacgaaatgagagaatttttaaaaagagaaaggaaaaaccaaggaggaaggaggcagagaggtaggaagaaaaagatccagaaatatatttatttgatgaggttgttgaaataactttactatgcagttatttcatcttcttaatgcagtaaaacattgagaaaaagaatacattcattgaagacttgaaagcaaaatgcgttgactcggcatggtcttgccttattaaagggttaacttctagtctgaccctatgtttcttctttcaataattaatacatatagtaccaagatttccctacccataacagaaaagagggagaaagacgccatggaatgcaaccaacttcattagtaccatatttgatgatttttcaacatcccaagaacctggatgtcactaaggttcagtcaaagtcatctccttttttctggccttagctcaactccagattcttgagtgtttgtccagcatctgccagaggcctctgcctttatgaaattttagggtgcagtccttcctaactggcttgtcactctgccatccatgctgtgtgaaaatatttatcaaagccatgttgcagataaatttatctcttgctcagattatctctgagtaataaggaaattaatgtcaatgacatcattcaagaatgaagactgattacataaaatatttcaatcagaatgttggcataggacttctagttatgatcatacgccatggaatttctcattcatactcaacgtcaaatatgctagccttttgtttccataaatatgtctgtgctcagggagaaaagtgtggttactcttcttacattctacagagttctacactaactgaataatgatatggaggttaaaactactataaaacgcgatgacaatataataaaataggaagtatctcaccagaatagaggaaatacatattaccagacataagagatttgctgatttttacaatttgcctctaaatttagctttaaacgtggtgctaattaaggtttaaaaatgaaaacaaagtagtttacacaattttaatctcattaatttgtggagaattatattactggggtcctcagtggtggaaaattattccattgtatctttgttaagaacataattgttattcaaattgacattttaaaatacagaattgctataaatgttaaaagcataacagatttgaaggtatttctacaggtaggaattgtgacagctttgcgtatgtaatttttctggcaatctaatttagtatgcagacaaaatgtgtttattttaatatacagaaatgaatggataatgtgcctattataccatctctcaaatattaaatttgttccattatcaaatgcctttatttgacaggagcttgatgttatgaaattcatgactgcatttttaaattatttatttatttatttacttacttatttattttttcagacagagtctcactctgttgcccagactggagtgcagtggcatgatctcggctcactgcgacctccacctcccgggttcaagtgattctcctgcctcagcctcctgagtagctgggactagaagcgtgcaccaccacgcccagctaatttttgtagtttttagtagagatggggtttcaccatattggccaggctggtctcgaactcctgacctcgtgatccacccgcctcggcctcccaaagtactgggattacaggcgtgaaccactgcgcctggccaatgactgcatttttaaatgtgctcctagtgtagacactctgtgctgctatataaagtgagaggcatatgctttagatatgagagtaaggctgaattttcatactatgacagtttaagtgccaaactgatactctcacccagatatgttgttaggaaagtatcttaccgaatgcctgggaaataaatgtcctatagacattaggtgaacctgaggctgacgcagcctaacacaatgaccattggcctgtgggcctcaggggagtcaaataaattcaaatataattttggtaacttattctgagcctcccaaagaaggaatatacactcagcagatccccattagtctctatatctgcactgtggaaccaccttttgtaaggccctttgttatgtcagagataaactaggtataaaatccacagctgacagcagtggtatgaatgcaggttttcatgggtaattaatgtctttattgcccagaaacagataacaccttaacattagaaggatatgaaatgtggtggaagtagttttcctcctcattatttcaacagaatgacaggcacgaaatgtgacttacacttggtaattgttatttaccaaacaattatggccaggaatcatattattgagtttttacataacagcattttcactatttaaaacttggatgttcagtacaatttctcataatcaagataaatcctgacatccctgaactttgagagaaatttgttttggagtcttagcaagcacttcaaaaatttggagttgttctttattaaactgggaatgacttacgaatcatatgatattgtgaattaaatgtaagttatttgaaatttacaagaaaaaaacaaacaaccccatcaaaaagtgggcgaaggatgtgaacagacacttctcaaaagaagacatttatgcagccgacaaacatatgaaaaaaagctcatcaggaattgtctagagaaatgcaaatcaaaaccacaatgagatactatctcatgccagttagaatggcgatcattaaaaagtcaggaaacaacagatgctcgagaggatgtggagaaatgggaaagcttttacactattgatgggagtgtaaattagttcaaccattgtggaagacagtgtggagattcctcaaggatctagaactagaaataccatttgactcagcaatcccattactgggtatatacccaaaggattataaatcattctactataaagacacatgcccatgtatgtttcttgcagcactgttcacaatagcaaagacttggaaccaacccaaatgcccaccaatgatagaccggataaagaaaatgtggcacatatacaccatggaatactatgcagccataaaaaaggatgagttcacgtcctttgcagggacatggatgacgctggaaaccatcattctcagcagactaacacaggaacagaaaactaaacaccccatgttctcattcataattgaacaatgagaacacatggacacagggaggggaacatcacacaccagggcttgtcagaggggtgaggggctaggggatggatagcattgggagaaatacctaatgtaggggagagataacattaggagaaatacctactttagatgacagttgatgggtgcagcaaaccaccatggcacgtgtatacctatgtaacaaaccggtacgttctgcacatgtaccccagaacttaaagtataattaaaaaatgtaatttgtttgaatacattattttgcatatttttctcaaatactttatgttttctcagattccaaatctggtatgaggcttttaacgaggtgtcttagatattatattagctgcataatttccttcatcatttcaaattaacttttaccaatttccttgctggattcttgattacataatctgcacttaccatttaatcagaactaaggggtaaaaaaaatctcattttattcacttatagtttattaccttcctgataacatgaatttgcagtcattttataacttttcttaagttaaatttcaaatagtttgatctattcttgagttcctactttgttatttgtgttttaacaataaataatagataaaattcaatattccagaaagatatttacattgcaccttggatatatttactagtgtttctagagacccatctgtacattatttcaattctctcattagtgccactgataaaatcaagagcaataacaaaatgacatgcagcataaccttgaattttttagcaacctggcttttgtttgcaaaaaatctgattatgatagtcttttcaagtgagctctggagccatttagataattttcagatattatactgaaaagattgaataaattaatgttacatatgtgaattacggaacattataaaataaatatagtacttgacattctttcttctaacattaaagcctttagaagtcattaaaaagagctttgtccaagggttgaacatttaatggaaattcgtcagtcagccactcccaacattcttatttcacttttattaaactttttgtttcttgttatttattcataactgttttaaccttgacacactgtgaatccacctgaaacattatcttgaccaataaccaataagatgttttcttagtgtgtctcttcatggagacagctcgcataatgttaaaagtgagtcctgcatcatatttccataattaaatatacaatttgttaaatataaagtatgtccattttttcagtatttataattgaaattacaacatcattattaccataatgctggaaatagaatgtgacatataaattttactttttgaactgtaaaatatgaagaaaataacatagtacatagttctctggtgacaattgaaaatcattcctgcccctaataaaattaaacatatgttaacaaattataaaggttaaaatgcttagattttgaaagtttcaaaatattataacataaaatcttttgttataaaacttctcgatttcttcataagtagcttctggcaaactctagtaacagttttctcttttcatttcaggccattttccattctaatatgactggataaatgcaaaatgtctctttcatcatgatgtaaaggatgcaataaaactaattttgacttcaggctctataaagtaaagttggtgcattcgttctgtgtaaagaatttggtacttcaaattttcccttaattttaagagagaaagaagggaaggggcaatgacagaattactattatactctagctactgaaattataacatattttactaaaagaaccattatcctcagaatagctctcagccaagcaaggcaaaacaaaaataaatgtgtaaagtgctaatagtgtaggattgtggatccaacagagagcccacatgaccttcaagcacatgtgtaattttttaaaaaattaatagtctaaacaaactttccactccaaaacaactaatatttcttggtaacattttaataatcttttctaaatgcattacagagcttgaactaaaacaagaaaaaatgtcaaagtccaaaagtgtgatgtgaaaactgtgcatctagtggtaagtaagcactaaatctggcattcatttcaagaggccgttatcttaagttaattaacacaggaagggaaaaccaaataccacatgttcttgcttataagtaggacctaaatattgaatactcataggcacagagatggaaacaagagacaatggggactatgacagcagggagggcaggagggggatgagggctgaaaaactgtttttcaacacagtttttgactcaccacctaggtaacatagtgtttggctcactacgtcggtaacagcatcaattgtacagcaaacgtcagaaacacacaattcacccatgtaacaaatctgcatatgtacctcctaaacctaaaataagagctggaaaaaaagaatatctgccaaaacctagtaacttacagcctcatttgaaggttcatgcagacagagaaagaggacccagaaaacagggctcatctaaggtgagaggtttgacatgagctctctgcaaaaatggaaccagagtatttcagcaccattgaaggagttttattccatatactttttttttctttttttttttttttttggagacggagtctcgctctgtcgtccaggctggagtgcagtcgcaccatctctgctcactgcaagctccgcctcccgcgttcacaccattctcctgcctcagcctccagagtagctgggactacaggcgcctgccaccacactcggctaatttttctttctttctttcttttttctgtattttttagtagagatggggttctaccgtgttagccaggatgatctcgatctcctgacctcgtgatctgcccgccttggcctaccaaagtgctgggattacaggcatgagccaccgcggccagcctgcaggaatgatttttaaatagtatacactgatacagctatgccaatagctatggctaatatctagtctaattggccagtgctcgtaccataccaattgttaaatattttgatcaccatttatttttcaatggatgggtgaacattaaaaacacacagggacaaaatatacagaagaaaatgttcttaatctttacggtgggtggagaagaagaaaaattccaaaaattcataattaccaacaggccctcttatcgatgtgtttctcaattatcagaattttccctaaaaaatagccaataattaataagaattcatagccaataatttatactaaatattcccaagtcattagtccttacaaaaacatatcctttctagggcaatgtatttacaaataaaacttatggacagtgttctaaagaatatgtattcataatcagaagtcaccaaatccagaatggaatagggcaccaccgcatgaaaactaccagaaagaatagacagcagaataaaatctgcagaaatgttaagtactgggactactgtatataaaatatatgtgtctgtaattaatatatttaaattaaaagtattcatgaggttccaggattgaaagtataaataaggaaagggagatcataaaataatcaagattattgagcaaagaccaaagggaacttctagtaatgaaaaagtagattaacagaaaattaaatggacattttacaaaggagattagccacagatgaagatataattagccattcagaaggtagaactgaagaaaatacgaagactacatttcagagagataaagaatagagaaatatgaaataaggcttaagacacttgaggatatattgagaaacttccacatttctagaagcaaaattaagacagaatgagggaaaaacaaaatgttaagggataataataaaggataattttttaaagtgatgaaagatataaatttttaaattcaagaagcctaaataaatacatacctagacacatcaaagtgaaactaaaaacaaaaaaggcaggaaaaatgactaaatatatctgaagaaataatataggctacctacaaagaaacaacagctagacagacaggtttctcctaaacaagaaaagtaaaatcctaaaatcattgaataatctcccagtactgaaaaaaaaataatccttcaaagcccctcaacttagagttattcagagttattcatccacaataaacagcttttaaaaaggaagacaaaatgcaaaaaaaaaaaaaaacttttaaaggtgaaaactgagatgatttctaaaaattacaatatagctaaagaatattatgatgaaaataaaacacaaaaagtgcaagtataaattatatttaaacaggctgattttgttttttaaaaagtagatgttaatgtcttattaaaagatattttattttttataaagtagatgttatcttaaatccatacttttgcatgtttttaaatttcatatacatggtatcacatgtatccttttgcaacttccattatttgcttaatactacatttgtgacattcttccatgttgacatacataactttcttttatggtaagtctttcatagtgtgattttacctaaatttatttatccattcacctgttgaaggacatctgggtcactctgttatttttgtaataataaataatcctactgtgagaaaaaaaggtagatgttaatgtcttattaaaagatccagttatggtattggataacaatcattaaaattgaatcagagataaagtactcttaagatcattgaatcactttgatcaagaacaagagtattgataaaacttagatatttattaattaaaggtgcagataaaaagtcaaaggcaatttatagtaaatggggaaaataaaataaatacaacaaaattataattactccaaatatcaacaaaataaacaagaataaagtaacttttaaaaagtcagcaattccaataactataaattaactgaaatttccaattataaaacaaaggctattaagatagacgaaagatcaaaacagcaaaatacatataaagggaccctgctaaatcagaagaactcaaagtatggaagaaaaaatgatgaaaaccagaaacaaaataataaacaaagagagctgatttgctctatttgtatcagacacagaaaataatttaaaacaaaaatgtactaatggaataaggaagacaatttccatgcgattaaatgatcgattcactaagataatgtaacaattcaaaacttgtatgtacctagactttaaatattcaaaattgccatcattataaagaaaagtggacaaattcccccatcacagatcaagattttctacatgtaattcaggagtgggtagaagaggcggaaaggtatccaataagcctatacgatgttttaacaagtataaagcttgatttaataaacacacagatgctccttgacttacaatggggttacattctgataaacccatcataatttgaaaataccctaagtcttaaaatgcatttaatatgtctaacgtaccaagcatcaaatcttagcctagcctaccttaaatgctcagaatactttgctcacggttaggcaaaatcatgtaatacaaagcctagtttataataaagtaatgaatatctcgtaatttattgaaaactgtacttaaagttaaaaacagaatgggtgtatacatactcagagtatggtttctatcaaatcatattaacagtgtcacttttgcaccaccatgaagtcaaaaaattttaagttggacttttgtaagtttcataagtcagggaccatttatatataaaactttgaacccagtcattatagaatccctattattttttggttcataaggataaaaatagaccacaaacagaggctaaataaatttccaaagattaggtcatacataccacattacttggctttaaattagagtggttaaatacaaacaatgtcagtgtttgaaaatgagattcgaaattatgaagaaagtgtaactaatgattcaaaaaacaaatcaagataaaaataaaatctcaaaatattccattttaatgggactatatatcaaaatctgtagaatacactaaaatgatatttattaaactttactacactaaaggcttagattggaaaaataaatcctaaaaattaaaaaacacaatatttcaaattaaaaagtttataaaagaacaataacattaaccaaagagtgtgtacaggagactgtaatgataagagcagagattaataagatagaaaataagataaaaatgaaaagtttaaactggccaaaagttgattatctaaatacactaataaacttaaacactctttggcaacattgttcaacagaaaagagaaacagtaaaaattagcaatattaaaattaaagctagatcaaaaatatagacattataggaattaaagagatagttatatgttattttaaaaatgttgcatttaatttgacaacttaaataaaatatttcataaaaaagataactcaccaacatcaaatagtgaatagatgggaaaactgaattcttatgaacattagcaattttgaagttttaattattttcccaaaaagcacagatccatgttgtttttaaggtcagctttagcaaacattcaagcctcaaatgattccaatgccttcataagaaacaaaaattggaaaatcttacaaaaaccctacaactcattttatcaagttatctctttgttatatcagccaaggaagaaaaatttgagagggaaggaaaaaccaaactaactcatgaacatatatacgtacgcatatagaggaaccaatgcaaaatctcatttttattatgaaaatctctttcattacaatagaaaataacaatgaattgtgttgagctcttaaattacaattttgttttagatatcctttttctgtaagtttttttgtcaaatacatatttttttctcagttttgtttttaaatgttatgtaataaattcataaatgaatgcagattgtaatgaatgaaatatatgttgaacaatcaggaatgttataaaggcataacatctgatatttttaaaaattcatgatgaatgaataagtaatataagacattggatataatataatctagggtaaggtcaggattcatgagctaagtacatacttttatttggaaagtcagcttaagaaatgtttgattggaaataactttatgaacattcaaaattcactctgtaattcttgcacttttagaaaatcatatatacactaacacatatatacataatgatgcatattatatttgtaaaatgttttttggtgttgttcactgttttatattgatttatacaagttctgcatgttgaaatacattatgttcatctacttttatactgtagctgtaactggaaatagcgttagaataagccagaaatgaaaacagtagaggaagatatggattcaaaaataaatatgcagttggcccttgaacaacatactttcgaactgtgctggtctacttatgtgtggattttcttccacctctgccgctcctgagatggcaagaccaatccctcctcttcctcctcctgctcagcttacttaatgtgaaaatgatgaagatgaagacatttatgatgattcacttccactcaatgaatagtaaatatattttgtcttccctataattttcttaaaattttctttttactagcttactttattataagaacacagtatataatatacataacatacaaatatgtgttaactatttatgttattggtaaagcttctagtcaacagtatgctattagtagctaattttggggaagttaaaagttctatgtccatggaatactatttagccataaaaaagaaggaaataataccttttgcagcaacttggatggagctggaggccattattctaagtgaagtaattcaggaatggaaaaccaaataccgtgtgttcccacttataagtaggagataagctgtggtacaatgataattttttttttttacatctttacaagttcattacagatgcaacctcccatttttttccaagtatttttgtatccgcagttggttgaatccccaaatgctgaacctatggattcaaagggctaagggtactgcattattttctgctaagcccaagactgcctcagtgtctttcagtctgcgccctggcaaagcaggaccaaaacaaacagcagctactccatggagtagtcagaggcagagccagcacctcacttagcaaactcattaaagagctctaggacctttccaggtacttcaatctgttccaggattcctgatgatttctatttcaatcttggatgtgcttagctggttagaatcagattccaatgaacactaacactcaaagatagcattcaggacttgagttagtcctgacccagatctagggtacctttgtcagcagctggtattcagctaaagacactctgtgtctccatttatactgtaaggatctgaaaatcaaaacctagctcaaactgttaagcatctaccttgctctcaacatcttcaaaacatggtcaggattgaaattccctcagaatataacagttcctaaattaatgcttcctattttttgacatttcacctactaaaacacactccccaaaacaaatttaatgagcaaataaaatcaggcagacaactttttatcgtatgaggatggttaaattaaacaaaatgaaattactcaagcaacaaaacttagcacagtcgcttcatcaaagaaatgatattttaaaatgaaaaagagagtggatgtcatctcagaatactggacaactgacagattagtattatcatatgtaaatattcattttgtacgagctcataaaaattcatcaccagtccacagatacatttgatgtgcaaacatagaaactcccaggtaagaccggcgcaaacagtgttcactcaagggaagcagcttctacaatttccactcacacacaccactctcctgatttcctctcctctccagccttcaccctactttgtcacaattcaaagaattaaaaccacattgatgtcagctcaagtattcatcacttccttctctacctagtttaatggcatacttataaatggggctgttctttcattgaaacatctatttcaattcttagggattagcacagcagacagtcaatagaagtaattcagttaggtgactgtttacaagttttgtttatgttttttacaaggatatgttcttaagggccactcttaagtcactggaaaacatgttccttttgaacccatctatcctaccttctgaaatcagtgataatcaaaagccaaaatagcataacaacccaagttcttcagatttataccaggcaagacaaaaagcccagagatatcctgaaattttataaattacatagcagtaacatgcccacatttaactatagctacagtgacaaaaatatagcatcatcatcaaatgtttgccatccatctaatgcattatgcatcataaaatataactacaaaatgccctcaaatttaaaagccaatgatctaaatagacttacttatataagtttattgattagatgctatatttacacactcaaattatatcaacatgcagcaaaaaatatacaacaatatcattagtaaagttcacacatttcctaagtaaaatatatgtgtgtgtaaagaatataaatttgcaattccaagtcaaagcatatataattaaattaaagattggctaaagatttaaacatataaacaaaaagataaatgtcatgaaaaattcattaaatattctgttaagcactggaggccaggagatctttttagcaatacataaaacctgggcaccaaaaaggtaaaggaaaaaacaacaacaggtaagtgtatttgaccatatatgaatgaagtgtgtatgtgtgtgtgtgtctgtgtttgtgtacacatggtcaaagacactttaaatgaagtcagaagtgaaaccacagaaagggggagacgttttacgtgttttacaacacatataaaccaaaaagagactacattgttaacatataaagggctcctacagattaatacgaaaatggcattctagtaggaaataaacaattattagataatttataatatctgttgtatgcaaaaaaaagcaaatctctaataaacatgaatagatgtggaaactccctaatattcaggaaaatactaaatagacaggcaacaaataccatttttacctagcattaggcaaagtttaaaaaaagagttaacatacagcattggtgagaatgctcagaatcaggcactcttcttgtttgtgaaaatgaagtaccacaggtattgcagaaaattttccaatataactttctacattttgaaaaacgccaagttttatcatagtaataccatttagggggaactatcctacagatataaaagcagtagtgtcaaagcatctgtattcaaggatgtttgctacagcattatttaaagtggcaaaaaccaaaatgcagtgtcaatgtttaccacaaggaaagcaaacgggtatattaacgcctcattcatacagcgaaatattacgtggctattttaaaagtgtttttaaaacactatataattaacaggaaaataaatacaagttgtagagtaacatggatagtatgtttatattttcataacagcctcttaatcccctacacaatatgtaggaaattatgaaatataaagatttacatacatatacatttacatataacatattacatatgttaagcatttcctccaatgctggatgttaactctttttataaactttgcctaattctggccaaaaatggtattgttgcctatttagtatttttctgaatattagagagagtttgtacatctattcatacgtttattagagacttgattttttgcataaaacagatattttaaattatctcttaacatatgttacatgtcatatatatgtaatatatgttacatatattgcatgttatatatgtgtaaatatatgtacacctttattctatattttatatatatgttatatatatggcaaaagtagttcgaaggaaaaagttaaaatatataatgtaaaatgcatgagtctaatgtgagaattaaacactgttccatgtatatcatcatactatattggaatttggctaatagcccaacaattgggctatttaaagcctctgtaatgggtcaatagcatcattaggaacccccagcaggagacatgccctgaagctcgcctgtttccctagatacctcttagactagtatgcattgtctgggtccaggatctggtaccacatcttgagagtatataaacctaactcagtccccgtacagaaaaggacctaccctcatggaagagctcatgttcaaccaagggagacataaaatctgaataacacactccttaaaaatataattttaatcagaataaaatcaaaacactaatgtatacatttaccatgagaaataaggccaactgttctttcagtggtctgaagaaattagactggtaggatagctactagttagtagcagttagcaattaattcctggggtaactcttttaacaaactaaagaaattgtaatccacaagtttcctataggatgatataaattggagaataaatcataatcaaaagattccttggcatctaaataatcttacatttaaggccagttaaagctccaaatatttgaatatatctaaggaagactgttcattggaaaaaaacgacttctgtttggcagcatttgaatgaaccaaatgtatgcctccgtaacacccattttcccaaatttccatcactgaaaatctcttattcacaactatatttctcccttttgtatcttctaatatattcaatcatgttatagcccagtgttgccatgttgagaaccattttccctctttcaggtgctttgatatctatatactgattgattaggcatttatcttacaacttaactgtataaaaggccatcttattaccctcatttccaagttctcagaggcacttcattgcattccccaaatactgacagtaggctatattgctactcttcagagagtactatttaacatatgcaccattatttttagattgattgctgaatcatgccagtcttattgagacacattcaactcttacattttctaactgtgaaaaataaaacattatttacaaagaagaattgtcataatgcagtcatacttcactagaactcacagaatatacaaaaagtgattcacaacattacattcaaaatacttgccctgttcccttgactcactaaatctacactgtttaagtgtgagcaaaggatccatttccaaagatagaaaacacaacctctgaatgaggatgcaaccaacattctgaaaatgcggctatatacttcgaaaaaataacaacataattattttatccttctaccttaaatatttaacaagatgttgagtgaaacacttcggttgctccaaaactgtcaaacagggtcaaaaaggcactaagtaccttgtattctgagtggagccactaacatttggaacaaataaaatgttgactctttggatctatactgatgcctgtgaggcttgctgggcctcctccctgcacaggccagctggaagataactaggtgtctcatagcctctttccatctatgagaatggaacagaaaaagcaatgcattgcctgttttctttgttaacttttatttgggttctggggtacatgtgcaggtttgttcaataggtaaactgtgtgtcatgggggtttgggggtttggtgtacaaattatttcatcacccaagtaaaaagcatgccactcaatacgtagttttttaatcctctcccatcttccaaacttcaccctcaagtaggccctggtttctgtttttcccctctttgtgttcatgtattctcatggtttagctcccacttacaagtaagaataagcagtatttggttttctgttcctgtattagtttccttaggaaagtgacctctagctctaaccatgttactgcaaaggacgtaatcttgttcttttttatgggtgtgtagtatgccatggtatattacatttctttatccagtctactgtgttcttcataccattttctttatccagtctactgctgatgggcatttaggtgaattccatgtatttgctactgtgaatattactgtgatgatcatactcaagaattgcctgttaaactaataattcaacgtctaacttagccatcctctccccgcttcattcgaatcatataggcagggtggggcctgcaggctgaaggtagctaggtcttcacctctggctaagttttaaggaatgctgctacagttcttggtagatctcttaagcacattttagtcctcagttttaaaacccagttgtcaacgtggggttaatataatcccatgccaacagaaacataaatgtggctttgttgaatatttttgaataaccagtgtcctgaattggtgaccacattttctgaacaataacacaacatgatcttccctgttggagtatgattttcataaaaatggtcagaatatgtgagttatgagtatactggaaaactttaagctatgttgtggattcattaccctgaaaatgaactttaggccattctatcacattaactgattgagaaagtagttaaaaatgtaaataaaatccaacagaatgcagtttactagtaaaacaatagaccaatagattatatgggtcagcaaggataagttatttaagttgtatgaatagctgtaaatacattcacttatatactatgtacatgggctctttaacacagggttacatcctgataaacccattgtaggctgaggattttgcaatctgaaagtgcgtcccttttcaacttaagatgggtttattgagacttgaccccattttaagtcaaggagtgtactgaaggcatatccctctcacaccatcataaagttgaaaaatcattaagtcaaaccattgtaagttgacaattatctaaatctccacattataacacttcagacatgaaaatcaaagcacgagctatgctgttcacagttccttttaggcaacctgcagtatgtgccatcataagtggaagacataagcatcagtctttgaaccacagaagcctcacttccacttccatcctgtgaaagtttgtgctacagagaagcaccttattcaagtacaacatgcacaaggaaaccccatgagaatgagagacttaaaaacaggagctgacatggttaggcaatgttgtgtgtgggtgggtggggggggtgggcggggacagagtaatccttatgatacatttacaagctgaatttatggagaacacaaatcataaataagacaaactatgatacaagaaaaatctatatagatcaaatttgcattatgatcttcccatttcctccataacctttgtcaaatagtagtctttcctaattaattatctcacaccttgtgtgagatctatggtagatactcaattataacttataaggttgtgttttgtattactctaaggcctctgtgcttggcagtcattctaagcactatcatgaagagttggtcaaattttaatgattggcaagaaagaaaattctattttggatcaagactactatggtgcttaattttaggtgtcagtttgggtggattaaggaatggctagaaagctagtaaagcattctttctggatatgtctgtaagggcgtttccggaggagattggcatgtgagttgccagactgaggggggagatctacaatcaatgtgggcaggcatcatccaatcagctggggcccagataggacacaaaggggaattctctttctccctctcctgaagctgggacatccttcttctgccctagaacatcagaaccttattgtctccagcctttggactcaggaactaacaccagttaccccctcaggttctcacaccttctgcttcaaattcagagttacatcatcagcttccctggttctgaggtattcagacttgcacggagccatgctattggcatgccagattgcagataggcctctcatgggacttttcagcctccataatagcataagccaattcccctactaaatgtccccatatatatatatatatatatatatatatatatatatatatatatatatatgaatcattctgtatactattggttctgtcctataggggctatctctctcaagaaccctgactaatacaactacatttgttttgatttactactgagtcaagagcaagcagaggaaaggatattgatgtcactctcatggtgagtatatgcagaaccatgaagcctcctcagttcctcacagtggtcaatatagtcaagcagagcgtagactctaagatggagatgtcagtaaactgttcattgggctcgttctctcataggctgctagtctcggagtggccacgtatactcctcgcgcatcacagaaggaaacgctgctctccgcagtcccaaactttgcatttcatttctaactgccctgtagccaatagcagcagggtggtttttgcacacattagtgtgttcctccatgatgtgcctcaggtatttccacctgtgtaattgagttctccctctaagttatgaaccaccaggcagggaatgaatcatctttttcttttgtactctgctgagcgcctggcacaatgtatgcatacacagccggtgttcactatgttattctcttaacaggattggcactgcttcatactcaaaccagagaagtttgttagaaatctgtattttttttttttttttttgagatcgactcttgctttgttgcccaggctggagtgcagcagaacaatctcagctcactgcaacctccacctacagggttcaagcaattctcctgcctcagccccccgagtagccagacctacaggcacccaccaccacgcccagctaatttttgtatttttagtagagacggggtttcaccatattggccaggctggtttcgaactcctgacctcatgatccgcccgcctcggcctcccaacgtgctgggattacaggcgtgagccactgcacctggactgcctctttctatagttagggtttgaaacataaaaggaacttttgagaaggaaaaccaaaaaaatctttgtatttctttatccagcctctccccatctgaaaaaaaagaaaagtaaccccagtacatcaatagagtttaatccaactttgaaaagcaacactctcatctatcatacaagtgatagtgtgattgtctggggaaggacaagctgttcctgccgtaagcgaaggaatgagcacagagacaaaagcgaaatatcccggaagtatttcaaatttcttaatggaccattagcaaacacacagtgaggtaaatctctggatttggttggatggcaccgtttttatcagtggctgacatcaaacagtgagatcgatttaggcttatagtgcaccagagaacattgattggatcttttttatttatttgtccccttataactctttctttgtcctgatgtggacaacctctacaagacataaaagcgctcagtctctgatcctttataaaagatgctctgctactggaaaagtggtgtggtgctgaggtaagggacagtgttgaggagagtcagcatcactttataactgcactgaatataaaacttgtatacttccgttagtaaaggcgtagtgccccttcagtgcaaataataagctatgggccatgagcaagagcaaatatcattaagtattttattcactgtgtttaatccattatagatgacacctgaaagaaaagcattaaatatgatgttacctcacaaggatcctgtaattttaatgcatgagacatcagggcatctcgttcagtataactttgactgcaagcacagcattaatgttttaataagccatttagtttgccttataggcagctactgagcaacaggaatttctttataaaattcatcagattgatttttgaaatctgatgatgtgagttgatctaattatctttgttctacctctctccaacaaagctgtatctaatgatactaacagcattttaaaggcatttttgcattgtttgaagaaggcaagccttctgaaacttcttcattatggagaaggacagaagagaagcttccacagaccataggaggtacagggttaaggaggaagagactggtactattcttttctttaagcagaatgacagtatttattctcttactaagcctgatcctagaactcatcaagatttaaattactgagtgaaggaggcatatggaaaaaatatcataatcaatattgcctagttagttgaaacagaaactgtcaaaggactttgaattataataagatgatgagaactgggtattctctctctcctaatatactggccataggaaatttaataatcacaactcaggaggccatccaagtcctaaaattcactcataccactaagaaggaaacagagagattattaactctgtttgaatggaaaactactttgaaaagattgtcctcacactcatctgtcttatcttatgagagagagagagagagagaggtctccgctagatcaaactatactattattacccttcttcccttctcaataaaaagcagagcctggtagtcttgacttccttagatgacatttatcccttaacctactccaggtagtttccactgttcctttttaataaaagtgctcctgccaaggtcactaactacctcctattttgcaaactctgtgaatacctcaagcctaatgttactttcatcagcaacatttcacaagactaagccttctatccttcttgaactctttcctattctgacttccacacccagacactgctggtttttgtttgtttttgttttgcttgcttgctggttttcacacccgtgtgtttcttcacattcattctttaaccctgttacagcttttttctctctctctctctctctcaaaattccccttgaaagccaggatttctccacttttttttcttccttctgtctcttgtgttctcttttccctctgatttcccctgagtgatggtaagtacaggcatatccacaaagattcccctcacatactgccaaatcacaatatccaaagtacattcggtacatttccactgaaacttacaccgcccagaatttgctctctcaatttctcaaccagaaaatcaagaattagcctgaaaagataattaaaatagcagtatatatactaagtgttttagctggaagctgtgttttcacatttctctttaaactacgagatggtagtacggcaatgataatagtagctataaaatattttcgcctttcaaggaagaagatactgataagattctctagggaaaagtagtaattagaaatattgctgtacttttgaccttaaagtatgcaaattgaattttaaaagtacagaaaattaggtctgaaatatgtacctattcctttaaaaagaaaaaccttcactctatggacaggagaaaaagttactgtgtaaagagaagactgatttcacttcacatgactgatttgtctagagcatgaagatttattatcataagaagttattatttcaggaaactaaagataaaatcaatactttggagatcattaaatcttggcatgaattgagcactgaaggcaagatattttattgagacatggagacatttctattttgtgaattctggaggtcattttgctggcacatttaattttggcctaaataaaggcaaacaaattatctttttggattatctctactcaatgttttaacaatatgtgctactctacatttaattataaagttttgttttgctctataattgtgatcaataaaaccaaggcagatgagaaatgaagtaataaaggtttatagtcaatataataattctggaacaaaaatcgtttcatccaaagtataaaagagtttggcaaaagatcggaagttaaggtaattcatgtttaagactgctgttttaaatgtaaatagaagtgaactgttttttctttaagagtaaccaataataaaaacaccaggtcatttctttcttaattttatccttttcaaatactggacccagctactaaaggctttcaaaacagatttcaataaatcaggatccaaatgagtctaaaacaatcctgaaatactaaaactatactctctccaggggtagtgtattttcttttgcaatatgaattccatcttctggaacattcaataaataaatggctactctcaggtccatcttgcagagaaaatgaaagataggccagagggtctttacgggaaacaataagtaggaacaaaccaaatgatgaagttctgtattgccaagcacatgtataatgttttatgtatctccctccctctttgtccctcatttccttccttttttctttcttccttcctcctttcctcccttctttcctgttttgttgttcagtcttctcccctctctcctctttctcccttcccttctcttctgctcttcttctctttccttttatcagaagtgtcaagaagaccaagcactgaatatctttaactgttgataatcaccattaacataacatgttctttagcagtatctttgagcagtaacattggataagtcaagtgggttgtgttttcaacttggtaagagaaataatacttttacagttaggatgttggcaaaaaaaatcatagttcagaaaaaaattccagaaatacaggcactcatgtagaagcaagatttgagaaatgtgaatgtggtgagccaaagtaaaacataaagcaatacataagagttgaatgcatgaggatacgtagtctaaaaaaatttaaatttaaatctgtattattaatattacccataatgaaattggcttagaagtctaatcaaaaatgtaaaaggtaggttaaatagttcataacagaaataattagaagtcttaaatttaaatggaaagagccaaaattaatgaatactctaggctaaaattcaaagttttgaatgtagatgtaagtcagtcaaaactggagagcaaagggatacagtaaatagataaatgagtagtgcttctgttagcatcaacagtgtggagaaaataacatgaaggagccacattatttttaaaatctggttgttattgtgtttgggaggatgttaaacagatggccttaatgtaatcttatgtttagtcccatttatcacagaatttgaactaaatacagactctctttatagttatacctcaatcatatttgttatgctgacttaaaacatgaattattaatttcatgtaaaataattcatagaaactggttaggaaataagctgcaaaattagcattaagaacattctaaaattattttattttcctatatttttcttgtatgtgaactcaagatttctaataactgaatttaaatcactatagtgcatgtcaaattcgttgtcaataggtagaggaaggaaagaggctatttttacatactgaccataataacttattcttaaatacttctgtgggattatatggtgagataataaatgtattcaccacaaaatcattcctaaatgcagctgtaatatgtcaagaattatctgataaaagtgagtttatcaaaatttaaatgtagaaaacatcacagctggttcaacgtctcaaaaactaattaattaccagcatatactatgactaaatgatcatttgtaatttacaatgatcaaatgattaaagacacatgcttttataaatagcaataccccaaatttacaggttatttcaagaacatgagatcttaactttaatgtatctgtgcgtataaaaatctttgtgatcagatcaatggcatattattaaacccataaattagtcatgtatagcagaagaaaattaaccttttttatattaacattttcaaatctgtcctaaaaaggtaactattttatttcaaacaaataccatttgcttgcctagtgggcattcttaagcatctgattgatgtgcctatcataatttatgaattcatttgatgagaatttttttcaactaacataattcaattttatttgatactcacctggtgttcactctgcatcttgaagtaaaatatttttttctcaacattaagatttcatcaaaaatgaaaggtaagagtgctggggtcaattatagtttcagacctagataaactaacacactaaaatatattttttcataaatccgagttactcctaatcataatctgaattatcattactgttttgttatgtcaccaagaaaacaggaattataagcatctcttggcttacaggttagacagtattactctggctttggcttattttaaaaccaatttgaagttatatctatatatgtgactaaggtttttccttttttttcctactttcattttaggttcagcggatacccacataggtctgttacatggctcaactgcatgttgctgaggcttaagtgatgctgatttactggtaatgctgcagtatttacattaaagtttagctctaggtccatcactagggaggcatcattgagttaacctttgttcgataatgttgataaatttgcattaattttgtttttcacatttttatcctcaccctctagcaaataatacaatgattttgcaatgatgcttgttagtagaactatggccaggatgaaggatggtttatagccctcaggagatagtctctgtgactttggcctcattaaaatgagattctaaacaagtacaaagaagaagtggggcagggacattgattttcttgaactctaaacttccaaagtatttattgttacccgaggtattaaagacagagcttttagtagactgaaatccttgttagcaatagaaattagaagaaagatgtcctgatacaaagtgttcagcacaccttactgtgtgctggaaaccattctggagaaaacagaggcacttggattcagctacaaatgaaatcaacactgcaaaattctagagcaagagaaaaatatctcgggtgggttggtggattttgctgatcagggttggccatctaacttcttgaagataaggtgaataagcataggcatacacagggataaaacaaaatcagacgtttgtgtgtgttttatcacctctatgcgtccgttctcacagtgctataaataactacctgaaactgggtaatctgtgaagaaaagaggtttaactgactcacacttccacaggatgtataggaagcatggctgggtgacctcaagaaatttacagtcatggtgcaaggcgaaggggaagcaagtacttcttcccatggcagagcagatgagagagacagtcccaagggggaagcgctacgtacattcaagcaaccagatgtcttgagaactctgtcactatcaccagaacagcaagggggaaatctgcccccatgattcaatcgccgtccactaggtccctcccccaaaactgggaattacaattcgacatgagatttgggtggggactcagagccaacacatattatcacccctcccagcctaactcagaaaacatccaaagatgtagttttgatctctctcatgttagcactgccgtagccatggaaacagggtagcagaagtgcaataacagaggttaaggaccccagctctgaagacagatgtgtagttctccggttcatttcaccacttactcactatgcagacttttaagtcactttactatactgggactcaatttccccatttgcaaaaacgggaaaataatgacgcctctagcatgatgtgtttaagagactaaatgaattaattcaggataagtgtttacaatagtacttgatacaaaatactcaagcaatatacactattatgattacttcagagagttcagttctataattcttgtaaacactcaagtctctacttgcctaaaatatgtttatgtttaaagcatttacaggagatactggctaaatatttttttcatccccagtcctttcagtgttactgataagtttagttaagtaaactctttacacagtttaaggaaatttatatgacagataaaacagtcaatgttgaaaaaattatgaatttcttctgaagtatgctcttgaaatgctacttaatttagccttaaattcaaaacaataacttcattctatcagatagatgcataatgtagacttgtctaaagtacagctttactgtgcattttcagagaacataaaagattccttaatttatttatatacgctttctttgatcttccactatttgcaaggtacaatactactaggtatacatggtatggaaaaggtttataagtacaaaataacatgaaaattgatcaaagatttggaattacacacagctacagaagatgtggcagacagactctatctgccttcacatccaccttcaatcattgaaggttgtcttcaatgatttcctgccactggtttcattttcctggaggtttattttcctccactaaatgtgcacaggagttgcagcttgttaaaaccagtaaaagatggcaaagttatgtaatgcagcttccacgattgcattacacaaaattataactgttctcctgctcacagactctctttatcaatgtactcccctactggctttgatggagcaagggacccaaagaagaggtaaggggcaatgggcagcttccagccaacagccaaaaaagagctgaggctttcggttccacaatctgtaggaaccgaatcttcctaaaacctcagactgtttggattcttaactgattgagccttaggtgagactccaagcaggtccattatcttcattgcagcctgcgagatacactgaagcaaaggacccattcttattcctgaccagagcaacttgcataataaatgtgtggactgttaagtcattgtttgtgatgatttgttacagagtaatagaaaacaaacataaatttgtaacagcttataattcaagttattgctttcccaggtgctatgatatagtattattacataatcaaataagatataggacattttcctttatgtatagctttatttcatattgaattaacattctcagaacctgagaagtcttctctgtgcatctgctaaaccaccttctccttttttcttcaatagtaataatcattccctttattttccttgtagttttattggccatgcatccatatccagcgtaatttagtgaagttaaaaaaaagaaaacttcaaaacttcctattttctatatgcttgtcacttgcttcttttcttcaatgttatgtttgtgaaacccatccatgttgatgtgtgtagctatactgtttttcttttgtgttatgttagtccattgtataagcctatcagtttgtccttccaaacacgactggagatcctggttcttcccagctggggctcaaacgtacaatgtactttaagcattgttgtgcctctttcctagtgcctattttcacatgtgaagttcctcagtgacagggatgtgcatttcaacttaagtaggtaataccaagctgttttccaaagtgacagtgcaagaaacatatgacactcatgctgctccatattgttaccgatacatggtgttctcagatttcaatttggccaatgtactgggtatataatggaatcaaattatgatttcactttcctagttactaaaaaggttgattttcaaatatttaattgacatgtagattttcacttttactacttttctattggattatcaagaccttttttttcattcacagaagttttctaaatattttggatataatccaaatatcacttttgaatcatgtatatcaactcaaaacttttttatcagtttttgtgttgcaagagcccacttctactttatgagttgtcttctcacttcttatggtgtcttttgaataaacaagagttgttcattttaatgccattgaatgtaccaatattttgctgcatagttagagattctctaaaactttataattttacttttcacatttgggattttaatgcaatcgaaatttatttttagtgcttaatgtaggtaggacactacttttactttttttttttttttttttgagacggagtttcattccgtcatcaggctggagggcaatggcgcgatctctgctcactgcaacctccacctcctgggttcaagcgaatctcctgcttcagactcccgagtatctgggactacaggcatgcgtgaccacacctagctaatttttgtatatttagtagagatggagtttcaccctgttggccagcatggtcttgatctcttgacctcgtgatccgcctgcttcagcctcccaaactgctggaattacaagcgtgagccaccacacctggcctacttttatttttaataaaagtcccaatatcagtttttgcacagtctgttcccttcccaataatctgcaatctcagctctttagtatatcagacatttattaatttttgaaatattaaatagaagtttatattttacatatttttataacacttgccttcaggtctcagacaaataaacaggatagttttcatatttcatgcacagaatctcggtgcatacaatgtcttataagagacagacaaaaacacaaagtaacacaataacaaaatcacaaaaagtaccaaaagcacacaaagttatcttctagaataaaaatattttgaagacaaaattactgatgattgagtgatataaaagtcatcatacaactaaattcacatttccttgatggtcagatttgttgtttgtaaaatatttttaaaatctatgctcagactagaatgcccaggttatttttacattgttacattactaggaaaataataatacatttctaccagtcttctactttttagaaagagtaatgaattttaccttttgtctggtatttggaactggcagtcctttttaattgacagcatattttttctcaaacaaacttggctctgtgtgtatatacagacagaaacacacacacacactcacacatacacacacacaattacatgtgccctagcacgatagaaaaaaacaaccctggaatttatatggttaatttgaagtataagagaaaaattaaatttttggctacaagaaaagctacttctacataacattgaacttgattgcaattattatcattaaataaattctataaatatgtataattttgttttctctcttatgcaaatagccatgtaaatatggaaacagatggtgatattgttcagtagaatgaatatgtattaacatatgcatccaaatttatttgccaaatataaattttcatcttctttttaaatttaatggttaccataaaacttttgtagtaaagtaagtatatgtgaaatagcttcagtgtgcttgtgggaaattcatatctaccttttttagatgtatttttcataaaacttatggtaaatatattaacctttccattcgttgtcacttggtcttaccgattctcaaaaaatagattttgacatagatgcatattttatatttaatatacatgtttagtatctaaacctgaattttacaaatcattcacataattctcagtgagataaaactagcttacttgtcatgttttacttgaggtaaactcaagatttcttattatatggtgcccagatatattgttttaaagctactttgggatatttgcatttggagtaattattttaatccctctatttttacggcaaattttatatattgcaaattcaatgttacgtattgtgaatatacattcatgatggtgaattcaagttttcttctcatggtggatgctgtagttggaaatatacataaaacaaaagtcaagaaattgtgtctttttgctatgctgaaaatataaaatgacttacgtaagtaaatgttcattcatttactaagagaatgacaacaagacttacagaaaaatacttcttatgtgcaacactaagagtgtgaaataaatttaccaaactaatttaaagtactgaatcctacagtacttgaaagaaattagcacactaaaaagtcacaaaagtgaatttatcacatattcatctctattttagcattttactcatgaaagaataatttcaccttataacatgttgggtagaaccagtaggggtcctctggacttttttatttgaaattttttctttttcttttttctttttacaaacaaaaagagtaacagtttattttatatattctgatgagtaaaaaagggacccaagtttaccctcctaggtttttacccaagagaaaatatgtatccataaaaaatgcttacataaaatagttcatagtagctttattcaaaattccccaaaaacagaaacaaatgaaatgttggtcaatggataaaaggttgtggtatgttcatacaatggaatatttatacttagcaagaaaaggtatgcaatactgatacgttaggtaacatggtaaactctgaaaacaatgctgagaagatgaacacgaaaggtcacatcctgaatgatgccatttagaacttacagaacagaaaaaaacgatttgtggtgaaaaaaatgagaagtgactgtggaggtggaaactgactagaaaggataatgaaagaacattctaggtggtccagtctacatctcaataggagtttgagtaatactagttgtgtgcatttgcacaaactcagaaaatttacactttagatttgtgcattttatcacatgtaaattttatctcaaaagtataaaaactaaaaaatattgaactctatgatgttgcatgcttaaatatttaggcggaaacacacagatgtctgcaacttatttttaaatgaataaaaatataaaggttgaatgacagagaaaaagacataaataggcagatatttaggggataaaacaaagatagccaaacagtaattacagaatctgtgtttgatagacagattctctaaaactcttttaatctttctgtatgtttgaaagttttctaatgtttgaacaaaataaaacaaatcatgaactcctactacatagtaaaacaaacattttttcttccttatggcatacaaacactaatgccaacttactgtataaacattaccatcaactacatactttagacagatttcaaagacattttttgagcaatacaaccaaaatataatagcatacaattctaaacgtttcagaggtctgacagatatcagaagttattcacatgaagctctatgaacatgatatgtaattggtagataattatatctatagtgatacaatggagatggaaatgaagttagaatacatattcatgattcctttataactgatgatatgctttctttggttggttggttgtttggtatattagttctggtgcagcaggagtgaaagtttcaaattagcaagattataactaatccatggatatcgtacatagagtaccctccaaattaatgggtaaatacaatgttgcttatagtatatcagccataactttttcttaaaaacataggatgactttgttttaaaatatacaaaacagctgaatgaatcatttaacaatagctaatgcagaatatctattcagtgtatgggctttttcgttcttctcagtatccaccaacaacagcagaaagcactgtcattgaacactgaagcttattttacacacatattccagagaaaaaggtagtccattcagaacaaactgttcttaagttactttttaaagattctctgtaatcgttcacgctttaattctactggtttgtatatcttttctttcaccacctacttattggtaatcgaaatagtctttagtccaaatatacagtcactatcttgtttttagaaaaaggacaatgggaggacaacatacagggagcaggtaattagcttttcctgattttccagcacgcgctgagggaaggtcagttttaactgattaccatggggctgagcaaccaatcaaaactctgccaaaagtcttctatttcagagctcgtgctgccatttcaatactctagttttactttgctgccaaatctttcacacaactgtgaagcaaagaggttgcacagattataaaggtgaagactgacatgcatttggaaaatgaaaacataataaaaagaatttccataaattgttttcaggatttcatcttatatatccatgaataatttttaccaacgctctttgagggtgaatgcaatatttttttttctgtaaaaggcactacagtgtagactgtatttattgtaacgcttggatcagctgcaaatgcaataaaattctataatttccttggcttgattattttattgatagccacaggttgagacaccatggaatacaagtggcctctctgattttttttttatgggtttgggaattgtaccaaaacaacacttctgagagtaagaactagcatctgtgatgcaatgattcaaatgaaattttgccagtcagattttcataggctagaggtaccacaaagtaccaatctctgttgtatgccactgcaagcagctgaagaacataatcttcattttcttaatcttgatcagcttcatcttttcttgagcagctacaatagtcactgttctgagctatgggtggtgcaacaccagaaatgtgaagaaaattaagccatacctgtcttagagcttgaatattactgagtcacaaatatgaaatactcaagccataaatactgtaccacttctgagctgtgaagaaatagccaaagaagcttatttattcatataccatcaaagagcagtcatcatttctactacatcaattaaggaaatcactgattttttttacacactccacagctagtttagttctgtgaagacagaatcatgtggcctttgaaagtggaattgtattcacttagaaaagcacaaggaatattatctttctactgcaaggaaatggcacacacacacacacacacacacacacacacactcactcaagcagaaatcacaaagccaattttacattttacaaaagaagagagtgcattattgtttatccatggacgtccttttatgtgcttagcattttaactctaaattccttggcggcaagctgtgaatcaatgcatcagtggggcctgaaattcactgaattgtatcttttagcctatgggtactttttgtctgctaatgagcttaaacaatctgctgaccttcccagctccatcattttctttttatcaatatttttattagttggtaaatctctccgaatcctaaataccagcctagactcaaatggactgcctactgacctgttgtttactgtagaaactgaacttcttggaaacatcttggaaaatacgctggtttctaaatgcaagcgataaaagttacaggctggctacagaggaatagaatgtgtattacagtagattctcatggtccatggttttactttttgtaggctcagctaccgtggtaccatacaataaggtattttgagagagagagagagatcccattcacataatttttatcacattatattgttataattgttctctcttattatttttgttaaactcttacttacctaatttataaattaaactttatcacatagtatatgataaactttaagaaaaaacatagtacatatagggtccactaggatctgcagtttcagccatctactagtgggtcttggaatgtattcctgatggataaggaggaactactgtacaaatgacttcacaagaagagaaaaggcacgaataaaagcaatgatgtagggatacatcagaaccccacaagtagtgtaagcagttgggtagtacaggatcactcaacagacaacacagaaactgccttcaaggtatatggcaatagggccgcaaactactccctattcatagcaacacaggagcaagccaatgtatgtcataatttactgtggcttctgaatacttttcttattccttcttgcggagcactgattatatcatcctttaattattttatcatatgtatcattttccaattaatctgaaaaactttaagaccaagtaataagcattcaataaacataggacagaaagaaggacaggaaggggataaaaaggaaagaagttttgtctctttgctgacctcaacatcaagtgtatcatgaaattccctcaatggtatgtgaattaattattacgtcaaccagtttctgatttatttttccaaatctctgtttcactccagagctgaagacttctcatatagacaacagtttatatatttttattccttaatatattataccatgcatttaagaaaagacatattgcctcaaatgttgatagctattacccttttaacaaggaatatgaaaaaaggggaaaaagtcaaatcaaggtaattgtatatatatatatatatctgtacaatttatgatctatcatacacacaagaaaaatgaatgtgtgttctatttttatttatagatacaataaatgtcatagaagtttctcaaacaatactacttaaagaaatatacagcattattcagcttgaatagttactggtttctctgtattttattagttaaatataaacatattttctgatatgaaaatatagaaaattcatttttatgtatctgagatagtaactaagtaaggaaagtaacacagtcactaatcatttaagtaaatgctaaatcaattggatgtgaaagattggcacagagataattgtctaaacagcatgcttaaacatgataaggatcaatgcaacaaatgatgtttgcacttgggcaagtgtcccgcattaagaaattcgtcgtgataagatatgcagaacaagggagcttgaatcatttctgccatatattgtgagaacagtttgttcttttccattgcagacatgaaaaacaaaaaatccatattaaatgtcactggcaacaggggattagccctgttctagtaaaaagtaggtctcctcagggtttactttaggcaaaactgaaataggaggagcaagttaaagatttggaaagtttctggactgaaagtttgattttatttgatttctgaatgagatgacaaacaacctttccattgtatttctttactaaagccaaagcccagaaacttgggtcacaaatgagtatcacggttaatactcccaggaaaataggaaattaagcaggtaactacatcgaacaccatatatggcatacaccaggtactgtgtgtatatgtgttgcatgagcaaatgtatacagatgaaaaaatggaattagattggtaaatgtaacagttccaaacagtggaagctatccagtgaggtataaattcattttctttttcttctttttttttttttgtttggagacagagtctcactctattgccgagcctggagtccagcggcacaatcttggctcactgcatcctgcgcctcccgggttcaagtgattctcctgcctcagcctcctgagtagcgggaattacaggcgtgtgccaccaccctggctacattgttctttcttttgtatttttagtacggacagggtttcaacatgttgcccaggctggtttcgaacacctgacctcaagtgatccacccgcctcagcctctcaaagtgctaggattacgggtgtgagccactgttgcctggcctaaattcattttctaattttcaaatagtattgttttggaattcaagctagctctagaaaagtcatggttgttaaaattcaagaaaatgtatggagaacactttcacgcaggtcatccctttcagccgtattcaaatttcactacttacaagactgtttattcctctgtaggagagatcactcattgcaaccccaaagtttcacgctttccttcaaatttatttcttttcagtgctttctaaaataaaacttttcacctatgatttttttatcccagaaaaaattttttctaagttgtttaatatagccctcaaatgatagcacgtggatccaataaaggtcacaagcgtaaataaaacccttctcctttaaatcctatgcaaaggttacaaggctaaaaataaattgatcttataagccatgcactgaagaaacagactaagtcatacacatctgtaaatggaaaggtttgctttagttaatcccctccacttcttccattaagtgatttttgtcactactgttattgctagatcacttcttcaaacctttttttctctcacttagccctattttcaagattgcagcacaaaatacattagctcactaaaatgacacagataaaatctgttctgtcatatcacaagacatgtaaacaagatagagcctccgcatacaaatttgactattcctcatgtcttatttctcactgaaatgccttgatataaagaagaaagccttttcaccaatagatatcaggaagatgccctgcctaggactttagagcttcaaattttttggagctggtgatgctaactgggttacctctaaaacaaaaagattgtgatttgcatgcaggaatttcattagcgcaaactctcaggatcaccacttgctggagaggacagaaagcaggatggggtagagagaatatttgaattcagccaatcccacacgtagctttgcaatgggataaccctgaaaagtggtcctgaattgaaacaagcgttatggttcttttttaaataattctgcattgagtagttattggagatggcagttctcgggaaaagcagctccttgcagtccagcccagagcaattctcacagaactctactaggagctgtcagtttcccatagttctgaatgaggaatctgggggtgtaccacagaacccactacttatatacctgcaaaagggaggtaggaagctatgcaggttatgtgggcgcttctactggacatcatttagcatcttttgaactgactgaacctggtgaaccctaaggccactcaactcgcttgtgggagctcaggcagacagaccatttaccttttacccactcagttctaatccacccaggaggagactcatttgtgtcccccattcccgaggtaagacttctacatgctaagagtcacaaaatatgtttcttgggagtggggacataacagcctatcaggacaatcccgatactcgagaggggatccactgaggacaaatctctgcggccatagttcgcagaactcaaaaagctagttgacatcacaagctgacctgattatgaatctaacttgtttgatagctcctcctcaatagtgccacccaaatctggtccagtcaaactggtaggtgcgatgtttaacctccagccaatcacttttcctagagtgaagtttccagagctacatcccatttttgattgggatttgactggtgcatatttgagaaaatcgacatgaaagacggaaagtaaaggagtcgccaaagatgagtgagaaaacacaagcaaaagaaaatatgagtggcaatatacaattcttactttaaaatgtagaattttaggccaaaatattaaacaagaataagtgggatattatatgatgatcacaagcccttatgcacctagcaaatacactacactacaagaaaccaaaggctgtgagcaatagagagaggaatttaaagcattacagtcttaatcaagatattaacatagcatttttataaatcaatacattaagtggagaaaatataatatggacaatttgaataatactaccaataattttcaaatctgtattaatgtcaaatttcctatgtataatattttacttataaacagtgaaagaatataaatatccaatgctagtaagtacatatctttcaagatatatcataaactacagcagggcaaatctaataataataggattgtattaaaatttggaattaaaagaataaacaatactctacctctaactcatgatcgaagaagaaaccaaaactaaaatgggagattgtttagatttaaaaacctacagaatgctctcaagcagcactgaaaaaagtaatagtcttattgcttttattatgatgatgtgacttagttaactaatgaatttacttatgtcaacaagacttaaaaactgaacatgaagagacacctgaaaagctataagaaaggctttagaatacaaaataaataaattaggaaataaaaaatacactagaaaacagataaccaaaaatataaacaaacccaaggcaagaatgactcctataagaaagaaaggagaaaaacaggggaaatattgatgtcatcagagatgagaaaggaaaaataaataattatatcaagaggagatgataggctatcaggttaaaaataaataatctatattcaattgtatattattattttattttataaccaagaaaaaatttattcatattgtcccatcaaataactacatgtttataaaatatctaaaaatatataaattcttaaaagtgattaactctaggggaataaaagattacagaggattttgtgtattcaaatttttacaaagtccaggtattaattaaacgtaacaaaaatgtattccattttcagagaagaataaaagtatttaagagcctaattttactaatgccatatttactaatttccatttagaaatccagtgcataatattaatactgttttccttctgtaaaagcaccagattaacaacaaaaaagaaatgaaatgtaacatgatattaatgtgcacgcacctgctttaaaaacgctttgggttgttttcttttgttttaaacaaatagtatagaaaagatgtgttatccaagatggagaagtttagggaactcagcaatatttcaatagaatatttgaaagaaagggaatatatgacaaaaacatacgggaaagctgtaaatttaaactacaattgaggtcaaagttgaacaacttatttgaatttggggaggggaggtacagaaaaataaaccaattctcattcaccttccattctctcccagttgtgtatttattcattccttgtacaattattaaaaattttatgtatgccaggcactgtgttaagcaccagaaatacaaagattaagtcactctttcattttcattagctcacagacttgtaggcagtagaataagtaaactgtaacataattactcatagcatccagtgtcatacagtagcatacctaaaactgtaatacacattaaaattatactgggatgttattaaaatgcagattctaattcagtatatccctggtggtgtctgagacctggaaagtctaataaacattactgattcaccaaccccagtttcaagtgcaaagggatagcgcttctaactggcgctccatctctggtctaactgcccatggtgcacacacagattcttacatgacatcaaccttccctatttccatgcatcttcatgctcactctactttttcctcaggtgatcccatgcacacctctgtcttcaattatgacttcggtcataaagactcaaaataactatcaataaccctcttctgatttccagactctcatactcaactgcttatttgacatcaagttttctatccttcaaaggcatctcaaactcgccacgtctgaagctgaactcactgtacttttccatcccaaacctctcagaaagtactggtcatttcatatctcagtgacacttcttacagttgagattttcccctaaatatctatttaattgaagtatataagccccatagagaaaggaaccatgcctgattttacttgccatttatttccatttactagaacagcatttgaacaaagtagacattcaaggaaaacttggagtgaaatgttgattaaaaattactctctgcctaaatctgcatgttcacagtcagataactgagcatccccgaggtgaacagccctactccagggacagtcactcctattacacagacctccaaaagcaaattattttcacatataaagtgttcagtaaacatttgttttaagtaaatgaatgggcaatgcaataaaaacatcttgtacaaaatttaatccaactagaatttattgagcccaatctggacaaagctatataataagcataagaataaaatgtggccattttggtgtctcatcagattggttaaaatgattgtttgactctagtttagagattgaattactatcagaatcccccttccatatggctctttcatttgatttattcaagcaatttgtggtatctcatcttgattctatcaaacatatagtgtacaacacaattgtatttctattaagatttttgtggcagattgattaaaatcacttgaacagaccctctgggaacatctgaaacctcagaattttatgaagacttactaacatagatctacagagcagacatagaaggaaaagaggaatttttcaggatttgctataaaccagagaaatatccccaaacggatcaactttgttaacattttattcaatattcatcctatagcagatcctagattaggataagaagaaaatagcatactccattttcttaagatattaaaaatctaaagggcaagatagatcactcaatgtataattaaaatcaagggactcagtactgtagatgacgtgtgtacagatgattgagaaaacaagagaattatcaaaagtttaggaaagtgacattggtaagaggaggaggtttaaatacagctaccttgagaaaatgacttctaagctgagtgtttaaaggctaaaagaaaataacttcttaattgtgtggttgggaaggaaatttgggcagagaatataaattttgtgatttgacttgtgtatacactatcggtaacaactggaggccaaggcttttacattttatgaaggtttgaataaattattttaatgacctagatggcttttcattcgagcttttttttctcacaaatgatattttcctgtgcaaacaaaagatggaattgtaaagtgtaaaaaagcattttctttacatagtcagtatcagccttatgagaacatttacatcattgtgctactaatactaatctattttttgacaagtgtgatggattgagaaatatgtaaagctattgagaaactatgacccaattaacaccgcactctcatatccactaaaatgagattgcctgtcctctttcaaataaaaacagcaggttaaattttgggcttaaaatccaatatgtcacctacaattttcatcttcttagttattaaatcatgttattatatttgggtgtccacgagatattaaaattctaggccactggcctaattgtgttgtgacaccctactcctatctgttgcagaggactacacactgaaacatctactttcatcattattctttaatgttttattgacttgtaattgatataaacaaacagcacatatttaaagtatagaatttggaaagcttcgacatatctatacaactacagccgtatcaccacaatctagaaaatccatcacctccaggtattttctctttttccttcttaactcccctctcttcttgccccagtccccaagcttagcctccaagcaaccctaatctgcttgataacactgtaggttagttgacatttgtttttgtttttgttttgacttttatataaatggaatcatacagtatatacatttccttgtctggcttctttcagtcaacataattattttgagatacattcatgttgtgtcatatgttaattgttcactcttttctatcactgagtaatatcccattgtatgatgcaacactttttgttattcattcacctgttgatggacataagttggcgctactgcaaataaatatgatatagacatttatgtgcaagtctacgtatggagatactttcatttttctctttggtaaatactcaagactgaaatggcagacaatgtttcaacgtcaagaaattgccaaactatattccaaagtgattgtacccttttacctcccctagtgtatgagagttccttttcctccacataccctccaacacttagtaatcattttaattatagtcattctcatacagtcattttaattatagtcattctcactcattctcataagtgtgtagtgatatgtcattgcagttttaattcatctttctctaataactaatgatgttgagcatctttccataagcttgcttcccattcatataatttgtttaataacctgggttgtttacttttgttattgttgagttcttagaactttttatatactctgacacaagtccttgaatttacatataatttgcaaatattttcacttactctgtcttgtctttcatccttattaatgctgttctggaagagcagagcttttaaataatttgctccttggtagattttgatttaaacaaatatttgcctaactaaggcacagaagtttttttccttatgtttccttctaaaagttttataattttagacttcatatttaggtctatgatacatgctgaattatttttatatagtatgaagtatggactatttgtatatgaatagctagtaattccaacacctttcttgaaaagacttacctttgtagaattacctttgtatttctgctgaaaatcggttgttcacatatgtgtgcacctatttcttgaccatttcttctgttccattgacaaatttatctatctttgtactaatgctgtactgactttacttctgtagctttatgagtcttgatatcagagagtcttagtcctcctgctagattctccttttcaatgtaatttttgctactttagttttgtccatttctatatgaatttgtgtttgtcaattctcacacaaaaaaaagtcagttaatatattgattggcattgcattataagtatagatcaacttgaggagaactggcatgctaacaatgttgtatctttccagccatgaatactacatatctctataatataggtatttttcattccccctaacattttacatttttcagctttattcacatcttctgtaagttttgtctctaggacatatttttgatgcttttgtgaaatatatttttcttattttcaattgcttgttgctagtttatgaaaatacaattgattctgtatatcgatttttatcttgaatcttgctattattggttctagtaactttttaaaatattttgtctgattgcccacatgaacagtcatgttagtttcatgtcttctttttcagaagactccttgtagaggctttattaaattttattttatttcattttgtttttttgccttgtttcactgggtaacatctccagtataataccgaatagaaataataggagcgaatatccttgttttgttcctcatattaggagaaaagcattacgtctttcatctttaagtatgatgctagctgaagttatctcacagctgttctctatcattttgagaaactgcatttctattcctactttcctgagaatttttatcaggaaagagggtaggattttgtcaatgctttttctgagacagtttaagagcatttattctttattttgttaatatactaaattacgtagattggtttgaaagtgttaaaccaatcttacattcctgggataaatctcatgtggtcatgaggcattactcattttatatacttttttttttttttttttttaatgcgacggagtcctgctctgtcgccaggctggagcacagtggcacgacctaggctgactgcaacctccacctcccgggttcaagtgattctcctgcctcagcctcccaagtagcagggaccacaggcgcatgccacaatgccgagataatctttgtatttttagtagagacggggtttcaccatgttggccagaatggtttcaatcacttggtctcgtgatcaccctgcctcggcctcccatgattttatatacttttgcatgctatttgcaaaacttttgttttgaatttatgtgtccatgtgcataaggtatattggcttccagttttttcttttttcataataactgtgtttggtttcgggttattactggcttcatagaatgagttgtagtttttcttcttttcgattttctggaggatgttatgtagactttggtattatttcttccttaaatgtttgatagaactcttcagtaaatgatacggagtttgcctttcaaatttttaaatttcatattagtaatttaaaatatgggcatacatttacccataatattcccttattatccttttcctgtctgtaatacctgttgtaatgtttcctctgtcatttctggtactgataatttgtgtattttctttcatttttctgataaatttggatagctgtttattagttgattgattttcttttttccatgttttactgttaacttagttgtgccttcatttttaatgtgtgtttcttgtaggcagcatggaattgggtcttgacatttataaagaatgacaagctctgtcttttggtttgcttatgtagaccattaaatgtaatgtgactattgatatggttaaatttaaatctatcatcttgttgtttgttttctatttgttctctgctctttttctctttttcttagttggattaactgatttttaaaaaattaatccagttcttctcctctaccagcctactttctttaactttttatatcgttattttagaggctgctctaaagtttatgttattcatctttaacttaccaccatctaccttcaagagatataccacttcaattagagtttaagtcttacgatagcatacgtccatatctgcactcctgatctttgtgctattgtagtcatacaaattaaacatgctataaattctactctacattactaacacttttctttaaacaactatatagaaatttggctaaaaaatcttatgtatttatttacacttatcatttccagaggtcatccctttgtgtagttacatatttctttctggtgtcatgttccttcctccttctttgtgtgcctggtaatgtttattttatcacaaacattatgagtcctaatttactgtgtgctggatatttgcatactcttaacattctcaaactttgttctgggatacagttcttaaataatttactttagaaaacttgtaagtgtccatttattctctgacccttcagggtgtaaatcttttaaaaagtctcttgacagttttacagcactggaatatctttctcaaaaacccaggagccatccctttgaaatgtcatcatcgaggaagatagtaccccatcatctcccagtctttggctgggtgggagcttaagttgtaggcactgtgctggaattgtaaaatgactagagaaagtttactttccctttggtacttttccttgctggttggtaaagccaactagcaaacataagtgggcccatgcttttctcactacagcacttgaatgtcctactcagtactgctcccgcttgcctatgccaattgtcttgaataaagcctcccttgtccgtttaactgtgtgcagtttttgctttgacactaccgtaatgaatatgcattcttctctgacctaaaggaatctagatttaaatacttaagtattgacatccaatgcaactccttttccaagagatcagtgtcccacaatcaaaagctcaatggtttggaagatgacagaaataagctctaggatcttctactataacttcttacgaccttagaaaagttgctgagacatttgataaagggtatttttatctgaaagacgacacgttttggtaacaagtcctctttatttgcctgtgaattctgaatgtctttaatattattcttgcaggagttcttgttgatttatttagttgaacccagtgcatatatgattttatcagttaattcacattaattttatgtacatgacataagagactaggctttttttaaagcctaatggacatttccaaaattacaacaggaaatgaattaaagagacatattttctgagggtgaaaacaaggaataatttttcctctacctataaagcagctgctatcaccatttgctgatttgcaaatcattatcgaatgcttgagcaaatctttttacttgttgacactgtgcaaaatcagctttgaaactgcctataattgttggagtcatgatttgcttttttaaatttcagtgtagaaaaggatacaattagtagtataaattacacaacatattttatggtactttaaaaacgtatgttgtaatttaagttcttatgtaaaacagaaacaaaaaaattctattgtatatagtatatgtgatattgaacaatataatttctgtaactccattttgtttcctgatatgttttgaccaggaagttcagaatcacatagaacatacaactgggaacttgaaattagcatgtgatacctgcagcaccaaaactttcatcaggatacacctggaaagagaaatcgctaacctgatgagcatttcctaggtgctagcttagtgattcccaaactggccatgcattttagaattaatcagaggtctctgaaaacttccaaagcccagaccacaacccacaccaattaaatcacaatgttttgaagtgaaacccaacttcagtgttttttgaagctccccagcatgttccaaggtgtaaacaaatgtgagaaccgctgcactgaactctgtattaagaactcttcgtgcatgatttcatgggaattctcacaaccaccctatgaggcacacatccttttgtgaactatagtccatgatactacaatgaacaaagtacttggaaacaaaattacttttggcaaattcaactgggtgaaaacataagacgaatgaagagggaagtgattttaggaaaaaaaaaaaaaaaaaggaaatacagcacatcactctgcctccaatctggaccaactgtgggaaatttgaaattcccagtaatctgttgggaaaagggacttaaggttatctctctgctatgtctccaagatctagattatggcaatgttcaaaaagacacacatctataagaattccagcctcggatcccagcactttgggaggccgaggcaggcagatcacaaggtcaggagatggagaccatcctggctaacatggtgaaaccgcgtctctactaaaaatacaaaagattagccaggtgtggtggcggctgcctgtagccccagctacttgggaggctgaggcaggagaatcatttgaacccgggaggcagaagttgcagtgagccaagatcgcaccactgcactccagcctgggcgacagagcaaaactccaactcaaaagcaaaaacaaaaacaaaaaagaattccagcctcatccaaaggggaattgtgtagcagcgttccatcgaagcacaatgagaagaaaatcctctcctggttcttatcaaaagcctggatgtgtaaataacattcacagacaacaatctgaaagatatgtaggcttccatgctatcaatctagatttttccctaaatgaggagagctgacccacttgaacactgtttttgacccagtgagattgttttcactggattgtatcttaacacgggattttcagcttccactgacagatattatatggcatatgtgtagtatgctttgtaacctaatataggactcagtgtatatctcagggacaattacacagcagtgatttctccccagtttggtgatgataaaatgctgtgttttctcttacgaaatagtatgtttttaccttattgacaatataatatctgtaactccacttttttccacttttatatatatatatatatatatgtgtgtgtgtgtgtagaaatagttatgaactacttatcaggctttaaaatcaagaaaaattttacacacacacacacacacacacatatatatacacacacatatctaaacattgtttatatttttcaaatgcatttccataaacatatatatgtgtgtgcgtgtgtgtatgtgtgtatatatatatatacatatatatatatatacacatatatattttttttttttctgagatggagcctcaatctgtcgctcaagctgtagtgcagtggcacgatcttcactcactgtaacctctgcctcctggtttcaagcgattctctcgccccagcctcagaagtagctgggatacaggcgctcaccaccacacccggctaattttttgtgtttttagtagacacatggtttcaccatgttggccaggatggtttcaaactcctgacctcaagtgatccacctgccttggcctctcaaagtgctaggattacaggtgtcagccaccgcgcctgtccctccctatatattttgactaggaagttcagggccatatgtgtgacactttttagaaactgataaatctaaatgtgcaaaatcttatatactaatattccctgtgacctaatattactatctttagttatcattaccattccaatttttttatttttaacttgttagatgtattttacaagttgctttgttgcttataaatacatttaagatatctattcctatgacccttacaccctgtctatctctagctgtgaagtttctgacaacaacacataaggtcaaacacagtttcacttgtaacaacgtcactttcaccctagcaagagaatatttgtggcattcaataaaaagcacagcatagatacagagtacaaaaatatgacaaagcaagatgaaaaacttacaccatcccacaccggtgttaatcttgagctaaatgttaatcctactctacaattcatgaattacagaacatgtgtactgcttccattctgaatgctaacaaccaaaaaagtgtagataggccaagttcagcacttaacctaccatatgtagtggcttaagttctagaaaaagattggctttaaaatttgagtgacgtacattgttgaatttaaatttcaaatgattaaagttttctgcagtttcactttctttgtgagagatacatttcaaacatgcaatagcacatggagcatccttgagtctacaaacaccaatgtctttgcccacaaagaagtttacttctctctgttgttctggtaactccttttcacggaaagtatttattcaccaaaggatacagtttccctgacagactggtatacagaaacataggaaagagtgttctgttagaaggaactcgttgagggaaggcgctatgtcttcttcacagtgaagcctccaccccatccctccccacagatctctttactggtgagaactcacccttgctagcagctgccaccagcatggagaacagagcttggtcaaacaaaggcactaaatgaacatttgcttaatgactaatgagacaatccatgtacccagcactaaacagctatttaatatttacttaatatgctgaaaaacattactttatcaccaattctaaagagtagtgctttatcattttatctaactactacattactttctttcatccacatcatctaatattttcttacattttaacaaagagagtttattatgttccaggctcagtgacaggtattttacaggccaatcaccttaatcctagtaacatcatcatttacatttagaatacaggaaaataaaggcttaaaaatatgcaaaatcttgcctgagactacaccacaagaacaccaaagaaaagcccaaagttttgagaaaagttcaatcccaagactcaaaactctctccctacatattttttattgtctcagacctcttagggatgaaactttccatatttttaaaccaaaaagctatctatgattttaagagatatatttttctaaaaatattcatcatatcatgaactagttatcaggctttaaaatcaagaacaattttacacacacacacacacacacacacacacacatatatacacacacatatatatctaaatattgtttatttttttcaaatgcataaatttgattccatttctttataatttggggatgatgtcatgctatcatcttttgtcctctgttgacctcatatttatagctctgaagtttcttttcctgtcgcggctaggtgcgtactttcatgttctcatatgctacctccattctactctatgtctttgcatttttatgttagtttcaaaagattattttgtatttgtttctttaaaaattgtgcctgctggccgggtgtggtggctcacacctgtaatcccagcactttaggaggctgaggggggtggatcacctgaggtcaggagttcaagaccagcctggccaacatggtgaaatctcgcctctaataaaaatacaaaaaattagttgggcgtggtgccatgggtacctgtattcccagctacttgggaggctgaggcaggagaatcacttaaacctgggaggtggaggttgtagtgagccaagatcgcggcattgcactctagcctggaggaccgagtgagacaccgtcacaaaaaaaaaaaaaaaaaaaaaaaaaaaaaaaaaaaattgtatctgcttgcatttggtgtatttcaccttaaatttctgtcagagagacttttgcttgatcttgtaaaccagattttatcaccatttcgcctaagttaggttttgccagctgcatcccaacttccactaggcctgaaacaagtcttcaaatctcactttcctttgcattctatgctatgaaatacctttctttaataaagtaaagcttggtgggccatctgtatttctcaaacactaaagaagaccgataaattgatgacggatttcctgccatcagagtttacaattttttgttttgttttgttttgagatggggtctcagtctgtcacccaggctggagtgcagtggcacgatctcagctcactgcaacctctgcctcccaggctcaagacattctcccatattagcctcctgagtagctgggactacaggcatgtgccaccacgcccaactaatgtttatatttttgatacagactgggttttgccatgttgcccaggctgttctcaaactcctgagctcaagtgattcacctgcctcagccttccaaagtgctaggattataggtgtgagccaccacactcagccaagtttactattttcttacagaggcaaggcatatatgaaaaacaatggaaaatattaaaaattatgaatacactaaaaggcattaacttgaatatcatcaagcatatcatctcaggtaacatcaaaaacaaattttaattactcctaattcttgtcattaaaaagttaaacatgtatgactgtaatactcacaaatttcatcccaacaggcagatgtttttggaattgctaaatttcatcttcaatgtatttatattaaactatctgcatctataattcaaaaaccaggatccaggaaatttgtagccattaaaaattaaagaatctacaaggatgggaagtaatgtacaaggcttacataatctcttttggaaattttaatggatatgccttattatgtctttctgctacagttgttcagtgttgctttttaatgtaaactgctaccttattttctcccctgagaaaactttacttgatgtaaataaagcaaccttggccataaactgcattttagaaaatgttttctaactgcacttgaatcaaaggcactgttattaataccacatatgaattcgaagctgtgccttttaaatcaaccaatattctacactaaaaaagttcttcatttctttttcctaaatatgttagactggttattaggatatgaatagacagtgatagctttgggcaggtgatgacaagtaatccttaaaatgaaacaagtgattgaaaatgcagctttgtgttttccctttagggcatagtaaatttcgtaaatctagtttccatttatttattttgtattttttctcactgtgtgttaaatgctagtaataacatatttgtacaaccttgttaaattttaggaatcatgcttaaaattattacctcaagtatccttcatgacaaacttaggaaatagggaaacactgatttaccaatgcagataccaaaattttgaaaagtaaagtgatggagatcctatcagtgcaaagagatgagggcttgtgctttctggtggcaagacatggccatgcagtggaattcttacctgtggtctatggtggatgtaaggaaggaaacgatcactagcttaaaatgaaatgttttggcctgactgtgctctttccctgatcctaaggacggaaattgagccagatttgatcacgaagaacagagacggtccagaggaaggcagagtaacaagtaagaaggaatctactcattaatcagagacctgggatacccaagtattgacttgacatcagaaataatctcccacattttgagggtctaattttttattacatttttatgtttgtcttcattgatatagaaatatctatctatctgtgttagtctgttttcacgttgctgatgaagacataaccgagactggtcaatttacaaaagaaagaggtttaattggacttatggttccatgtggctgaggaagcctcacaatcatggtggaaggcacagaggagcaagtcacgtcttacgtgaatggcagcaggcaaagagagagaatgaggaagatgcagaagcggaaacccctgataaaaccatcagatctcatgagacttattcaccaccatgagaacattatgggggaaactgcccctgtgattcaatcatctcccactgggtccctccccacaacatgtgaggattatggaagtacaattcaagatgagatatgggtggggacacagagccaaaccatatcactatctattaataatctgtctctctatctatcttttatctatccatgcatacttgtgctatccattcccatctttagtctatctcgcttctcaattctaccacctactccccaccatgcctcattactggacatccagatgcacaatagcattccctttgctcaacttgccttgacacaattcaccaaaaatcggactgccctactaaatcttaattaaatatggcttgtataaaaatttcttcccttgctcagaaatctcctaccaactcatatttgctgtggaatagagcacattcccttagcctttcactgaaactcctcctaatgtgaaacccttctatccttgtttaaatttcccctcagccactcagttcaaatcccatctcttctaacaaatcttgcccaattaactcagctttaaagtaaatcagttacataatagttcacattccttattattatcaggatatatttcaaaactgaatacgttgtcttttcacctgtgttaagatgctacctaaacacagtagaatttagatttgttttcacttctgtgagtcactgagagaagaatcaactggtaaaattttcatgcctactgaaacgaactgagttaattcttcaagctgcctatgagaaaaatcaaagggaaacctggcttcatttcgcaataagaataatcatcagcatgaaatttccttaaccatttaaacaatttattaaaaactaagattggaactatatccctctatattctcttctatcccaacttaaatccaagtggctttttgttcatgtggtccaactcacatgatggtgtcaactcaccacagccaatgtacatgattctatgaacaggatgtgtataaatatacacaggagaaacaagcatgacaattaatagctccgcttatagccccaaagaacgagacccaccaaatattttaatcatagtgcatattctacttaaaaatataacagccagataaagtatattctctactcaaacatcatttcaaaagggaatgacattaggctgaaggtggtggctcacacctgtaatcccagcactttgggaggctgaagcaggcagatcattggaggtcaggagttcaagaccagcctggccaaaatggtgaaaccccatctctactaaaaatacaaaaattagccaggcgtggtggctcatgcctgtaataccagctactcaggaggctgaggtgggaggatcgcttgaacccaggaggcggagtttgcagtgagccaggatcacgccactgtactcctgcactccagcctggacaacagagcgagactctgtctcaaaaaaaaaaaaaaaggaaatgacattatttgaaaatacaattaagactgaaatggatcatttttgctggacattagggctgctggttattgtctcaagggactgaatgcaaatactaccattacgtgacatattgccaagtccgtggagttcaaagataggccaagccagatttcaatacttgctttatgattcgttcgttgtgtgatatacacaaattatttaatttcactgaacctcagtctcatcatacagaaaaatgagataacatatttctcaaaagattgtaatgagagtgtaattgtatcaatgggctttggagtcaactctactacatttcacagtgtaaacagctttgactcctcccacgtgatatgctatctggcaaattattcactgtcttctacctcctctctcctcatttaaacaagaggcacagtacttcctaccctatttaacttctgagactattgtaaatgaactaaatcgatctaggtaaagcgttaagtgcagttattcttacattgtaagtggtcaaatatatcaccttttccattgctatagagaaaactaaatcatagcacttttttaatctttattttgaaaattctagatataattcaggggtgggtgacgataatgaatacaacagaaatattcacttatttggcccgtcctaccactataagcagcaactgctactgatcgttcaaacttttattagcatttactatgtgccattttgctatatggcatatacttggttaaaaagcaaattccggagacagaggaagtagttggaatcccaatttagccacctattagctatttggcctggagtaagtcattgaatcatttgggtttggtttcctcatctataaaaactgataatacaaatacctcaaggggttgttctggggattcaatgagttaatacatgttaataagattttgagaacattgtaagtattatgtacctgctggtgcttatttcattgtattcggtgctgtcactccttttttttttcttttttctttttttttttgagacaggttctcactctctcgcccaggctggagtgcagtggtgtaatcatagctcactgcagcctccaactgcaggttgaactggtaggcttaagggatcttcctgcctcagcacaccaggtggctacggcaattggcacacaccaccacatctggctaatgtatttttatttttttttatttttattttttggagacaaagtctcactccatcacccaggctgaagtgcagtggtgcgatcttggctcactgcaaactctacctcctgggcttgagtggtcctcccacctcagcctccagagtagtatttcttaatttttataaaagtggagttttgctaagttgcccaggctggtctcacactcccagcctcaaacgctcctcctaccttggcctctcaaggtgctaggattacagatgtgagccaccgtgcccagccttgtcactaattgttaaatatccacaatattcctttgaggtgaattctcacaaccatttttacagatgatgaagttgaggctaaggaggctcagtggctttcctaaaactagacaagtagcaaaggagggtactgggccctggttttctactgcctgagctcctccatattttactatatcataataaagcccaactgcattctatatctattatatcttttgagtacctttatatattcaactatatacaattatgttttattataaatgtaccacaaactcttattatctcaggttgtttcaaccaatactcgcttttaatttagacttatacccaatcagtacttaacatttataaagatgtactaaagtggagtgaaattggaatatttagctgaatggcagtgattcatcaaaattaacttgaaagacatctttactcttttattacagaaaatacaaccacacacataaatatagagagcgctgtagtataatggacccacatgtacaattatcaacccagagccactactgttttatccatactctccaatcctctcaaattattttgaagtaaattccagacagcaaaacatttcatctgcaaccatttcagtatgaaatagtggcaatatgatgaaacataacagcaattctattattatacatagaaccataaaaactgtagcatatcaacaaatcacaagtcagtatctacatttccctgattgtcttatgatattttaaagtacttgttttaaaccaaataaaaattcatttttagagattatttttatgtctcttaaatctcctttaatctatagattttttttcctctctatttcttatctgatattgttttataacaaaataggcttttttccttctataaagcgtgctatagtctggattttgttgctgcaaccacacaatatcatttaacaggtttttctgaccattgtatatcctgtaactttggtcattcgatccaaatgcttggttatattcaggcatgattttctggcaatacatatcttttgaataatgtaatatgaaaaatttgaccgaggtttctaatttatgtaatgttcttccaagacacttttaatcattgagctacaattaaattactttggcagggtatatttatatttttagttttctgtgtagtgtagtttagcattttgtgttttgggacgttttcaatagcaattttgttgctgtagttgacacagagattttgatattctggagtacttgtgccaccttcataactttttttgtggatttttctgggccacagtatctgtagattccaacaacaacagtaataatccttgtttttctttaaaaatatcacgatgctttattaaactgacggtaccctgatttctttactgccaagctctgtttatttgaaggcaagccaatacccaatggtcaaatacgaaagaatgacataaatattcttgaaggatttagagtttgaaatgaatacatttggatgcttattgttgtctcccttctcacttcctagatgagcaaattttactgaaattaaagaaaactgtatcaaggtgcctttttttctatattatcccttagaatggagagaataaagcatccaaaatcataaaatgtcactgaagctggtgacagcattggtatactctcatgccccgttttatacatgagaaggcatattttcatgctttctctgacgaaaggagaaagaaaggcattgctctgtttcctacactcaaataacacacatgaagtcactttatttcaggcaactttccactaagaggcagagcaaatgagactaaaaatttatgagaaaaccaggggctaaaatgcccagagattcagagtctgacctcagtgccttgaattagaattcaaagtaaacagaaagcagttcagaatgcaggatgtgtgcttaatatattccattcagttcactgccagaaatgaattgttgcattgtgtgcaagtcaaagcatccaggagtaattcaaggatgggctcaagtagagggcatcacagtagtccatttaggacatcagaaaaacaacacaggctatatctgcaaggccaggtagctgaagaacattctgtgaaacaccaatgaacatctagacttactcattgaatatttagttttttaggactaggattttagaaacaataaatctttaagtcaaaaggcaaatgccttgttttcaaaggaaatgaatgtggcagaaaacagatgaaaactttcagaattggtctttggtgtgggctccaattaccatgaaattctgaaataactagagatggggttattgaattagtaaccactcgttaaatatgagcaatatgtacaagtatggaacatttttaagtttgatattatgcattacagtaaattacactaaatatatgaacaatatatacatgtatggcacatttttaagtttgatattatgcattacagtaaattacagtaaatatgtgaacaatatatacaggtatggaacatttttaagtttcatatgcattacagtaaattccctaaatatatgaacaatatatacatgtacagaacattcttaagtttgatattacacattatagaaaactcttaatatagcaaactggtaattaccactaaggttcttacagtaaattgtagaaaagataatttacttcggcgcacacaaaatatctctaaaaacccagcttttaaatggaaggcaatttgactgatacgcacagcattttcaccattgactggtacaataaatagctttgagatttttggttatcacatttcaaatccccagcagtaattgaacaaattagaagggatttgctcttggtaaagtatttgatcttaggtaaattataatttcctttcgaacaggtagaaatctgaaatagtattttaatgttaaattatatatatatgccaattacacatttagactaagtgttacaatattcaatgttttaaaattttatacaacagttttaagagacttctaggttgagacctaattggagaaaatgttctaagtgcaagattatctctcctgacctggttcttctccatgtaaaagtgagctggagaagcctaaggcaaacttctgtgacctgtcaatttaataataaaagtttgttatctatttgagttttccataaattgccactgtatttttgtatgtgggataatggattaaaattttgttataaatactcagtaaggattaaatataaaatgttcttaaaacgtaattgtggaaaaaattaaaggaggagaataaaaatggctaatttatatattttaattgagattcatcataatataatttccctgaaatgaatttaaaagatttttaaattaactattacatgtctgaagttcaaatttaactatttgttctgcataaagacagtatagcaaagaagaaacattatttaaaattactataattagaaaactgtttaccacagtgattctgtgatttctgaagttatctttttgcatatttaagtattataaaatagcaccaaaaagtacattatagataagaatgaaatatactgtataaaagtagagatactgtggcactacatcaaaacactaaaaatttccaacaaaacttatccaggagaggaaatattcaaaacagaaatgaattcatttcaaatatcaaaataacttttgtacagacaggaaaataataggccttcttctatataaatcctgttattgtttgtgatgcattttatagtatcagtttttcatttttgtgccaataactgatcatctttctgctgtgaaatattgtactcactgtattaagcaaatactgtaatagttgttgaatattttacctgactctgcacagaaatcccactagtaacttttcttattagtatactttcatcttccacttacatacccagtcatccttctccaaaatattagtagaagtattccaagaatcttttgggaaaatattctttgatcctgggcatctttactggaagaaacttacctgcattattaatgaacacaatgtaattaaatctaaaccatttacacttttaatttgaagttgtattgcttcataattaacccaaacggaggaaaaggtaattaatttttcaggcaacaatttcattgcataaagttacatatcaattaatacgtgtattaaattgccagtagtgttttgaaaaattaatttgctcccaaactttcagagcagcagaaattttgtcagtgtcgtctcaatgtcaagtaattcacaagtaaaacacagagtgaatttaattacaataatcactatgaatataattatgattctatttaacatttcttatttgagcctaccatcctcatgtttaaggtataaccagataggccctggaatgcacaataagttttccaggagtgaaatggtgatttaaaatatattgttttggaggatatttaggggatacatctcattctttagaaaaatacagtatctgtgatatccaaacagtataatattcatttagtaatattaacaaaaatcaatcatatccaatataaaggtatacaaatactccatcttctaaaaaaactctgaaaacaaaggacaaacatgctaagaaagtcacccacattccccatcatataagatataccatactttctttttttttaagatatactatactttttaaagtcaatggagattacataaaactaacttcaacatctcttccttagtgtttctatagaaacttgtatttgctagtgctgtcttgacaagcttcttttatctatattataaaattcattattggcctaaatatggattgagaatagtgttttccttccctttactataaggtagaaatgattatatttcaaatcgtcttttcatttctatgcagctgatgaagctatgcctttttcttaacattttcaatgcagtacaacatattaaaaaaaaactgttattctaatagttagccaaggaattcctaaaaacgttattatatatattgtcaatacatcttaatagaaatgtttccttgtgaaaatactgcattctgggataacgaaggaagctataactatgcattttttcctaagatatgtagaagaaaaataccattgaaatactaagagagaaaactgctaccctcatttatttctggatatttaaagttgccccactggccctctaacaaatgaatcaataacatttgtggggagggggggcattgattacgaagcctggaaaaatgagtaattgctcaacttagtgattccaaaaacaattttgtatttaataggctcttaaaaatgaaaagctatttcatgggactctaagagtgtggatttctcttaagaatccagggaatcaagtttgcactgtaaacactcgatgggagaaaaaaacctcccaggacagtagaaaccccagttaagtttatgggattcccagaggagaagggtctgtggactacttttgagtggtaacttgaaagacacaaaattattagggaacacatattcaaaatggtgtctgagaggtatgtcagtagtaatggagaaaattacataggaggatgattgcaagggtccccatatcactgttctgtactccccaacaacgtaccagaaagataaataattcattagccgagcgtggtggtgtatgcctatagtcttagctactcaggaggctgaggtgggaggattgcttgagcccaggaagtcaaggctgcagtgagctacgatcacaccactgcactccagcctgtgtgataaagcaagaccagtcctctaaatactaatagtaaaaaaataaagataagagattcatatgccctgagaggtctatcaaggtgggtaagcaacgtgctcagagcagaagaggcctcagggattctttcctttaagggagcatgaatcatatgaaaatcataaaatgactaaggaaaaccctaaactaatcatatgtcagtacagaaataacctagtcaccctcacttgtcaaggttagcttttctgtcacgagcagaaatgagtgttctttagttaagcagaaagagagatcgaaaataagagaaatagagtttcatctttttcatatcctgtttttgttacaaaaacatccatatccattacagacataagtaggaacctggaattctggatgaacaatgaagtgaagggaggaggagaatgtgtggtacagagacaagtgaactgtcctgggttaggaactcttccttctacgtgtagggatggctggtcaaaagtaccgggaggtacgcatgactgaggcactattaataaaatagctgcctacattttaattgtaagcactttcctttgttatttgctgataaccaatgccttaccctcccagtgctaacccaaaatcatggtcaaacgttgccctgcacacagcctggtcttctgttactttataaagtgaagaaattgaagcagtggcaattaacgcaacatgctgccaaaatcaaagcctcgtgcttagagtagaaaatcaaaaatataaacccaaaatttagtgtgatttagagtaagaggcaacataaaaaagaaaataccctgcatataccacatcccttttaaaaagtcccttgaggccagggtccctaatccccaggtaccagatccctggcctgttaggaaccaggccgcataggagctgagtggcaagcaagccagccaagctgcatctgtactttcagccgctccccatcgctgggattactgcctgagctccacctcctgtcccatcaaccacagcattagattcgtattggagcgcaaactccattgccaactgagcatgcaagggatctaggttgcatgctccttatgagaatccaatgcccaatgatttgtcactgtctctcatcacccctagatgagaccatctagttgcaggaaatcgagatcatggctctcactgattctacattttggagagttgtataattatttcatcatatactataatgtaataataatagaaataaagtgcgtaataaaggcaaggtacttgaatcatcccaaaaccatcccagtgctaactcggtctgtggaaaaattgtcttccatgaaagttgtccatccctggtgccaaaagggctggggaccgctgccttgaggtacagggagagaaaggagtgcaattcaaatttatttaaatctcagaggatcctgttactcccaacccagtcccagtccagcatatgatttagagttacccaggagggcagaaattgggttaaacttaaaaataattctttgtcctaacattgcttacacatgattgtttatttgcattgaaaaatgcaaaagactattaaaaatactgatcattaaaaattttcatgagtttaaaccactcataccactccaaaacaaatatttttaacattttggcaagcataaggttgttatccgtcatttttgtttgcttattttaaatcttgtatgtgtatgattttcagacattaacattgttaattgcattctcattctggggaaggtctttattctcattccattcagaaactaaacaggctcgatagtaataggtactttgctaatcaaaatatgatacaaggacaagcagcatcagcaccaccaaggagtttgttgaaatgcaaagtgttaggctcacttctgacctattcaggcagactctgcattgtaacaaaatctgcaaatgatgtgtatgagcattggagtttgagatgcccaggataaagacactgcatatacctaaattctagggctttgagtggctcataaatgtctaccttcggcccagctcaactttcatgtcatctggccacgtgatgctttccttgaatattatcaaagcacttatgcccagtatgtccatagcaaactcacaagtttctactccccatatctggtcatcttctagaattccttgtgttagtgcaaggaaactagtgataccctggaaatttacctctcacccatcctcctcatccaacctactccccaaattagcgtttcccttaatacttacctctcacccatcctcctcatccaatctactcccaaatctactccccaaactagtgttaatcttgatgtttacctctcacccatcgtcctcatctaatcgacacacaaatctacccccaaaactagtgttatccttgatatttacctctcatccaatctactcccaaatatactcccaaaaccagtgttacccttgaattttacctctcacccatcctcctcatccaatctactcccaaaactagtattgccattgatatttacccctcacccatcctcctcattcaatctactcccaaatctactcccaaaaccaatgttacccttgatatttacctctcacccatcctcctcatccaatctactcccaaatctattcccaaagctagtattaatcttgatgtttacctctcccccatcatcctcatctaatctactccccaaactagtgttatccttgatatttacctctcatccaatctactcccaaatctactcccaaaaccaatgttacccttgctatttacctctcaccctcaactattcaactccaaaactaatgttggcattgatatttacccctcacccatcctcctcatccaatctactcccaaatctactcccaaaaccaatgttacccttgctatttacctctcaccctcaactattcaactccaaaactaatgttggcattgatatttatccctcacccatcctcctcatccaatctactcccaaatctactcccaaaaccagtgttacccttgctatttacctctcaccctcaactattcaactccaaaactaatgttggcattgatatttacccctcacccatcctcctcatccaatatactcccaaatctactcccaaaaccagtgttacccttgatatttaccccccacccatcctcctcgttcaatctactcccaaaacgagtgttacccttgatatttaccccccacccatcctcctcattcaatctactcccaaaaccagtgttcccccttgatatttacccctcccccatcctcctcattcaatctactcccaaaactagtgttacccttgatatttacccctcccccatcctcctcattcaatctactctcaaaaccagtgttcccctcaatatttacctctcgcccatcctcctcatccaatctactcccaaatctactcccaaaaccaatgttacccttgatatttaccccccacccatcctcctccttcaatctacccccaaaactagtgttacccttgatatttacctcacccatcctcctcatccaatctactcccaaatctcttcccaaaactagtgttaatctttatatttacctctcatacatcctcttcatactataatcttctcccaaatattataaaatagctcttgaatccaccttcttctatctcctgtcttccttgaggttagtctgacagccctttaactcacgaagagtaacctttgcccattattcttgtatgccaggtctctcctaccacaagtccgttgtatgtattttattactgctgtataaaatgttcctccttatctgctcatatattcaacaaatatttattaagcatctaggatgtacccaaaaaccacaggctattctaggaatggggcttgagcagcaaaataagagatgaaaatctctggcccatataacacaaagaaatcatggggctgatattctggtactatcaagatagaccataaataaataaatatatcatttcagaagatgatgagtgctatgaagaaaaacaaaggaaatgaaacaggataggaaattcttgggctgaaagagggatacatactcaaaatgtgatagagaatggtcagaaaagtgctcaatcagaaagcataatttgagcaaagacaagaagtaaggaagggagagagaattctagccggggcagtgagcaaaagtcctgaggtagagattgtggatggcaagtttgagaagggtcaaccagaccagtgtacctggcgcagcatgaataggcagaagaataatagggacaaggtcaatgttaacagacgcaagataaggtagggatttatgggcctctgttgggatttttgctttttctccacatgagttaggaagccatcagagagcactttgaataaagcgtcatatgactttgcttagattttaatggtatgactctagctgctgtgctggggccagactgtaaagaagcaaggtcagaaggagaaagaccatttggtaggatacggcagcaatccagctgagaatacattgggggctggatgcgagtcatggctgtggaggtaatgagaagtgattgggttctgagtatattttaaatgcaaagctcataggacttatctttagttcattcatttctgtctttatttaaataaattcctgatcaattttacttccttagaaaagcattctctgatctccccacatttggtctcatcatgggctgttacagaaccatgggcatcttcatatgtatctcaattacagtggcggttccacatttatttgtgtgattgctttaagatgcatgagggggctgggcatggtggctcccgcctgtaatcccagcactttgggaggccgaggcgggcagattgcctgagctcaggagttcgaaaccagcctggacaacacggtgaaaccctgtctctactaaaatacaaacaattagctgggcatggcagcatgcgcctgtagtccaagctactggggaggctgaggcaggagaattgcttgaacccaggaggcggcggttgcagtgagtcgagattgtgccactgcactccagcctaggcaacaagagcaaaactgtgcatccaaaaaaaaaaaaaagaagaagaaagggtaaccatgagggatggactgctcatggtagattaggggcgtgtgtgtatgtgtgtgtgtatactcactacattcacagcacctagaatactgcatggtctactcatctgactcaatgagcatttgttgagtgaatggatttatgttctatttatactataaattcagaaaaaaatcttcatttttagataactcccagcttcatttctcaaatattatacacgttttttcttaaaatactaggcatattgtgttgaccctccccaaaatgctctccaaaactgtctgccaacaaattcctcaacacctttcctgccaaactatttagaaaataatttaaccagaaagcttcccctaatattatgtgttgttcttctgttggagaaaatgccaaagaaaaaggcatgctgtgtttcttaggaccatgagaaatctaacatcactaggacatactgtttgaagtccagggaggtctctaggagaaatgcttgcagaagtcaataaagggagtgccatcagaggccttggggccatggtgaggcatttggacagggagacactgaagtatatttatcaggagatgatttggttttatttctgctttggaaagctcacgctggtagctctgtgcaggatggattagaagtatgggagacaagagacaaagaactaataaatgaatgaagaagtgtggggatgatgacctgatcaaagatgacggtggaaaagagaaaggaagagagaaagtaaaactccattaatggttggttaggtcttgggagacgattaatagggatgggttcaaggagttttcccagatggttgcaggtttctatttcagatatttgaaaggacagtggtgtcattaactaaagtaccaggagttaggaccacatctagagagctggttagtgagatcagttttgggcatgttaattttggggttcatccaaatgggaaactgcctctttatatattcatgtcataatgcacagggaatgcaatgaccattcacttgagagaaaggaggcgtgtccttagagaatgctgacctcagtcccttatccttccttaagttcagcgtcttcacatgtaaaatagcataataacaactgtatcttaaagcatttcacacaaagtgttaagtatcaatattactactaaaatgtagggctctaaaatatctaatatgcattaatctcaccagaaaatatttctagactatcagagttacattgtaatcctatgcttttatggcatccgtttcttacctcttaagaggtcagcaccattttctttgctttttttttgagatggaatcttgctctgttgtccggggtggagtgcagtggtgtgatctcgcctcactgcaacctctatctcccgggttcaggtgattctcctgcctcagcctcccgagtagctgagactacaggcgcccgccaccacgcccagctaattttttgtgtttttagtagagacggggtttcaccatgttagccaggatggtctggatttcctgacctcgtgatctgcccacctcaacctcccaaagcactgggattacaggcatgagccactacatcagaccacttatttgcttttatgtcaatggtcattactgagaaatactaatctatataaaaatgcagcattctgaaccgcatgaaaccatttacaaaattattgaaaagcatgtctctttaaccatgcaccctgacaactggtgcaaccaaatgaggggtgatgacaatgaaagttgttgtagcagcctgatgatattttattttgtttttgttttgttttgaaagatggtgtccctccctgtcccccaggctggagtgtaatggtgcaatcacagcttaccgcagccttgaactcttgaactcaagtgatcattgagcctcagcctcccaagtagctgggagtacaggtgcatgccaccatgccaggctctgatgatgattctaattgtcattgaggaagtcagatggtggaattcagaactgactctacagttataaccaagaggctgtgtattcttccagtattctctcaaagttctagatatggttagcaaactgcatcagaggaactccagacatcttctggatctccttccaaggtcttggttgtccgtggccacagcattgacatttgggctaagaaacactatatgccaaacaataatttgtgccacactctgtatttgatagttattcaccacttggatccttggccaacttgagaggcactgaaacttctgccgtggcttctacaattcagtcagttatttgcagtttacccctagttattcgtgggttaatagagggcccctaattactactctacatagtaaggaagacgctcttttgtgttcatttgaaaagggtagttatgttgtgggatttctcctttttgaaggctctaatgtcttccttagctttctctttaaaattgaatcaatttctccttaaatttctgatatttctggctaagcatttactccacgattgcatatctctttgcttttctcttcttcgtcacattcacatatctgtcccgtatctaattctcagtgttatatttacataattaataggttaatagtattcgattctaggttcctttaaaattattaggattgtaatcaattatggaatgttatttctttgctatgaaacattattttgtgaattattcttgcaaaggactgaaaatatttccttctttattcttttataacaaagcatatactaccttatctgaatcaagatcatattaatgcagtaaagacatctctgtgaacaaacatcatatttctgtaagtgaattaatcactaagaaagattaaaccaaaaatgtattaacatgtaggtcacttttattatggcaaaatttatgcaaagatcatataatcgagctgcaatgcttcaactgaaagttaattagctgttattaatatgtaatgatattaatcaagaacattagcttttcatgattttctgcaccactaaaaagtaaagcatcattatacttaagattcagacaattagaaatagtcctggcagggtgcagtggctcacacccataatcccagcacttttggaggccaaggcaggcggaccacttgaggtcaggagtgagagaccagcctggtcaacttggtgaaacctagtctctactaaaaatacaaaaattaggcaggcctgatggcacacgcctgtaatcccagatactcaggaggctgagacaggagaattgcttgaacccgggaggcggaggttgcagtgagccgagatggtgccactgcactccagcctgggcgaaagagtgagactctgtcacaaaaggaaaaaaaaaaatcctagtcatgtcattgtttcagcacatgaagtaaagaaatgcaacttcccagtggtgttcctcccttttgtcagaaacattaagaagattcaactacgaagtaacacacccattaaagtactgcgtctttttcaaatgtataatagaaaaatagtgtaggtagcacgaaatcatcaatacttaaaagcccagaggcactacctacaaaacgaaaaagaagtaaacatctgtacataaacatctttgcctcactcctcagcaaagataatgaataaaccgttaagaatataacaggcctgttgaacccagcctaaggcatcttttccatgaaaaatacaaatactccttgatagaaagttacttctgaatacagttctgggttgtagctataagctttccagtaagctgatgatataatttagtttatatatacatttgttacataaggagcgtgactttaacagcagaaaatgatgacagatagatagcctggcatcactaattacctatatgcagtgcatttcaattaaatccttcaaacagttaactttttcttaagaatcaatcccatttaccatgtggagtaaaaactcatcttgacttctgccatagttttaaagtagcttcaatttgccattacaagtttcaatagcaaaagcaagaagaggaattttactaggtataaatgtctccttgaagtcaattattcataattcttatcagagtttggtcctgtatagagttgcaatgcttgcataaaacagggatctagatgtagcaatgtgttgagtggttttctgctgaaactcaactcaggtctatatataactatttattcttgaaaagtacgccaaagaaaacctattataaatgtctctatatcatcctagctattgatatgggttactgagccaaagaggatcactatagaactaaaattattgattgaatttaatgctctgttttaggattaaaagcaggaatttagctacttctataatcttgggtacacttggatttaatatctagtgaatagtttacccacacttaggggtgttgtgtcccaggtgatgttggcagaattatgtatggacaacacctttagggtgttatctcttactgattctgactgattatttcctgttacagaaaacaatgtgtgaatgtttccatgtagccacacatatatgagaaacggttcaaaccagtcacttatctaatacatggggtttctcttaagtgcaaaacattatggttgaatgaaacaaggtcaagctatcttcagaaacacaactaaataagctagcagttttattacacattaatacttgctgagatacgtgttaattctagcccataggattatagtcagaaaaagagaccaggatagttccaaagaataagtaaaatgtgaacttaaactttaaagtgagaatgggttagccaggcaaaggaggaggaggaagaggaggaaaaagttctccaataaaaaagtaacatttgctaaatcaaggataaccaaaagacaatggcacatacagaggatgctgcaatacttattagggtcgagaaaaaggaggaagtggtgagacagaggctggaaaattagtcagaggctgcatgagggttagtaacttctctctatgcaatgtggtgctgcaaccctgcttctattacagtctctgtcagcacatcacaggacccttactccggagcttcttcatagcctaacaatcttcagtgcacaccccaggcagtctgagtcaattcatttaaaaaagctatgaaggccaactcccatgcaccatgcaaagtaatggggaagtaacctaaagacaatcgcggaacagcaaaaagttaaaatcagatggttagcaggatgagcatcctgttttaggaagatcactgggataacgtgtgaacaaggtattacaagggtgttacgggctgaatgccttcttccgcctacaccccagaatgcatacgtggatgctcacactctcaggactagaatgtgactgtatttgcagataaggtattaaaagaggtaagtaaggttaaatgaggtcataggggtgagccctaattcaacctgactggtgccttatagtgaaaataggacacccaaagaggcaccaggggtacactgacaaagaaaaaatcatatgatgggacggcaggagggcagccgtctccaagtcaaggagagagtcctgtaggaaaccaaccctgcccagcaccttgatcttggacttccagcctttagaactctgaggaaaatatttctgttgtttaagctactcagtctttgtttctttgttatggcaaccctagcaaactttaaaaatatgggataaagccttcatgaatggaccagtttagagggtgtcctagtgatataggagttaaaaagaaatcacttaggcagatagtaagggttatgcgagtcctacataaggccttcctctttaatgaaaattattgtctaacaagttattttctaacaaagagcagcctgtaaagttgagctgcagacatagacaagcaagctaggagcttgcatgggtgagtgccccaggaaccagggactagacatgttcaagatggcggctccatcttcgcttctctttgccagccacgtgtacagcaaagaacagaggagatggcaccgctcaactggaaagcccatttgcataataagattaagttggggcaaccagccttccccacactatgtaaacaatatacccgatggaaacaatctgtgagccctgtgtaaatcagacaccgccttctccagcctgcctataaaatctgctgcagtccgccatctacccgctttttggatgtctgtctgtctgtcttgcaaggagctgctctcctcactcctttcttctgcctattaaactttccaccccttaacccacccacatgtgtctgtgtccttaattctttctttgtgcaagacaacaaatcccagagtgtatactcaagacaacatagccacttcaccagtatcaaaggtgagaggaaaatggaaaccaaaactgaagctctggcaaaagggacaacaacggctgagtgacactgctggggcagctcagtgacagaagaacaactggcctcttggaattcaatgccatgcccaaagattgggaggatgaaattgttctctgagtatcaggatggaatcaagtcaggaataactcaatgcaattttgacgagagagagagagactgctaacgtgaggatgaactgtatcgtcacatttctgagataagacttcagggagtttcaaacaccaaacttcagcccttagactcatctttctgcggctgttggatgcatcaagagctgcctttgggagtttctgctttgcaggaaagtcttgcaagtttactgggatatttgtcacaaggtatctgaatcagtcgtgtgcattctagggtgaattaaagagtggagggtaggccgggcatggtggctcacgcccgcaatcccagcactttgggaggccaaggcgggcggatcacgaggtcaggagatcgagaccatcctggctaacacagtgaaaccccatctctactaaaaatgcaaaaaataagccggacatgttggtgggcacctgtaattccagctactcgggaggctgagggaggagaatggcgtgaacccaggaggcggagcttggagtgagccgagattgcaccactgcactccagcctgggcaaaagagcaagactccgtctcaaaaaaaaaaaaaaaaaaaaaaagagaaaaaaggagttgagtgtaataatgattaatatttattaagcactttcatgaaatgcatgccattattatcttcattttgtatatgtagaaattaagacccagagaagtgaaaagcttgttcccagctgcatggttagtaagtggtcaagctactgccatgctaggcagtttgattcctgatgataccagcttttgagggttgaataaagagcgaagaagatttgagaattctgcgtgcttgaggaggaaatagcacacataaaagaacataaaacataagtgttatccttctcaaaaattgttgcatagagttgccgtgaaaatggcagtcaaatgtgctttaaaatgagaagtaagacacatagagatgtaagccacagaacagcagcataaccataaatattattgacaatgcttcaggaatgacttaagaatatagtcagctctaaaaaaaaaaagccatcaataataagtcaatacaaaaacctagtgcagtgatatttgcctttaagaaaactgaaagataattaatttaattcctaaaattaatactttaaaaagatagtaaggaaatgtatagaatacagattgcacggttggtgccttctgagaagagaagacatagtaagaatttaatcatatagtacgttttattttaaggtttctgaggcttcttaatcctatataaaggagaagagctgtcagacacatttctgggaatgtgtgtggctgtgtcattaccctagaaataggaacccagcagcctcatggataaaactgacaagtcgctggtaggtagcacgaaacacaataaaaattgaagtgagaaataagactgactccagaagcaaaggaaaaacctcataagggtgtgagtgctcagctcatcaccttctcaagctttttggggggaaatctttagtttccattttgtccatcttaaaatagaaccaccgtcacaataaaaagttcttctctcctgcatctgcaaatattcttttgtaactcagaataattgctatgcaaaatcagatgtatgccagctgatatgatttggctgtgtccccatccaaatctcatcttgaattacagatcccataaatcccacatgccataggagggaccctgggggaggtaatggaatcatggggttgggtctttcttgtgatgtttccattatagtgaatacatctcacaagatctgatggttttataaaggggagttcccctgcacgtgctctcttgcctgtcaccatgtacaacgtaactttgctcctccttcacttttcgccgtgattgtgaggcctccccagcctcacaatcatggcaaaatttaatattaaaagaggtatattgtcatggtgaaatttaatattaaaagaggtatattgttgtcttgggagaaagatttctgccaagagataatttagccagaaataaaatttactgaaggaaaatggagagcagagagtttatatagggagaaacagtatgctctgaaagacgaagcagagagggttgctgaaatagaatgagaactgagtggaactgtgagtcaattaaacctctttttatgtataaattactcagtctcaagtatatctttattagcagcattagaatggactaatacagtaatcctttcacctccggaattggcaacccttcccagaaatgactgatagttacgaaattatacaggtatgctataaggtgattgataaaaaattgatgctataataaatgatttggttacaacactgcaaaataagttagtcaaaccatacaattaaaaagtagaaaatggaatgtgttgacttaaataaatagaccaaactattaatacacaaatagcacgtcaaatagaaatctatgaaaacataacatgtttttatatgactcttcagcttttggaagacttggctgtgtatatataaagatccaactggaaataaatcaggatttatgacaaaaactccaacttccagagtggttccagagaactaattttttggcaagaatgtaaccccttcatgcccaggcccagtgagtaattatttataatccctatctcgtaagtgttgctgatgaaaacaattatgaaagtaatttctaatttagaaaccctaccggggtcaagtcctttacaacaacgcagttaatatgaaatacatctcatgctcccacaactacccttcaatgtgttagagtaggaaaacaggtcaacatgagcaggaggggggaagcccctgagaaaagtgaggtctggaaaatctaacgccccagagatcacccaaaatgtgcatgctacatgtgaacagagaggaggagaaatacctgtgcagaaagaaaggctccgtaagacccccagtaatcgctcactctgcagttaacgtgccagaatggagctagatacatgctgttaaggacggcaagaggagaaaggagaaaagtcctaagagatacgcaggtgcaccaagtatagatttgactgctacacaaccttcctgaggtggcgataatgagcaaggcagtcattaggtagaatgtgcatgcaacaccaggcccacgcatgtgcaccaactaatagtaagggatgatcccgcaagcctagggtggatactaggtggggaaaaggcagggactcaaggcagaagtgggaaaattagaccaaaaaaggcagacacttaagatagaggtgggaaaactagaccaaaaaaggtggagacttaagacagaggtgggaatttcaagaaaaaatctgacatcataaaaacccaatgcagaactcctgggttgcagtgtctcattctgtttcagcagcctgctctgcttcatctttcagagtgtaccgtttctcgctatataaactctctgctctcccattttccttcagtaaattttatttctggctaaattatctcttggcagaaatctttctcccaagacaacaaaagactgaggattcccaccttcccgataacaaaagtatgtattataaggaaggaataagaggtggaaaactagtaaattgtaaagagagacgcaaaagtttttctgactcaacactaggtgacaatgagggttcccaagtgtttatcgcaatgaactgacgggttctttgtgtgctgttcaaatacagattctcaccactgccacacctccacccccaattctgaatcagcatatctgaggtggtatctatgcatgtatttttctaaatattcttccaaattgatactgatgtatgcagtggtcaggttgaaaactgatgttctatactctgctcttctttctagatcacttcacacggtgcgctagatggcagaggcttcctaagggaaaggaagcctcatgccggctagtaagttactcatggggagatccttcacattacttttcataaaacgtagtacagtctctgaatgtggagaggcatcaaaagttcaaaaggcatggtaccaaaaggcaccatttagcaccatctcaaaatgatggtagcaggtttcaaacccacatcgtctgtttccggagccccctccccacgccccctcccccgtttttttctttttcttttttttttttttttttttgacatggagtttcattcttgttgcccaggctggagtgcagtggcgtgatctcggctcatcacaacctctgcctcctgggttcgagcgattctcctgcctcagcctcccgagtagctgccattacaggcatgcgccaccactcccagctaattttgtattttcagtagagatggtgtttctccatgttcgttaggctggtctcgaactcctgacctcaggttgttccgcccaccttggcctcccaaagtgctgggatgacaggcatgagccactgcacccggcaatcccccattttttttcttttaccagagtctctgtaaataatacagccctagaacgtggcttcattttatccatattaatttaaagtcttcataagaagcaaattgaaccttagctgatatttaaccttattatcaaaagacttaactagtctttattatgctgacaccagtctcctaaaataaaatagttctgaccttataaggtttgactgtttcattgtaatatgacatttcagattcttaggaataattgctgtgctattttattttaattgccatgcacaacataaaacggaatgagaaattcttctcccaccaaacttgaactaacagatacttttttgataatgaatcatggaattttaagtgtttggttctgttttatttattttgtcattgacggtaatcacattgtttatattagcacgactaggctgactccacctgtgatatcaccatatatattattgtattttatatttatgcattgtgggaaagagagaggaataaatacaaaacatattttaatgtctgtttagaaattacacaacgtggaagaataccctaaaaatagcactagacatactgatgatgagtacacttcagtctccagaacggaatagcaatggccatgattttctataaaagcttccagttattcatttgcagtaattcagaactgtgtccccatttgagtggcactcaaaaatcccttggtactgaagcaaaacaagatattgtgaaaattctgctatccaatagctggatttagaaaaggatttaaataataattggacattcaacactgaagaacactaagggaagaaccttacgaagcctaattttgtttagacaattttgaatttactgatgttaagggaaagcctgatcattagccattgtttaccccacgaagaaaatatagttcataattaaccagtctctgctgctcaaaagtcccccaaaatgttaagagttaataaatttacattaaaaatataagaaatcacaggactcatgttggaactggtactactggtaatccaccaatggtgggatctgtcaaaagattaattagactctataaaaaaatcttgacgagattacatttttggcccattgatatattcatagatgagttgtaaaagcctgtctcccatgtttgaacctgcattcgacaagattattaatactggaaaccatactatcaggggattttaaatgtgcctctttatacatttttgtaacccagagaaagctagcaaaaatgttgacttttgtatattgaaatatcaaggagaacagtgctgtgccatgcatttgaagaaagaaattattatttttcaaaaaaggaaataactgttgaaaataacaaaaggaaagggtagtgtgttaagttagtacttagactagtatatttaactgttgcaactttagcacaaaaattgaaggactgagtgaaaacattccagcctatgacagacaagtaattagctgctccaaaggaagagatatatccacaaaacataaaagctccattatatagttaatcccaatattaaaatgcttttaatgtatttgtaacctccaatacaaaagtatatttagatattaattttcaccaccttactatgacagattttgatactatgttacaaaaagattgcacaaaataccgtcttataaaaaatttaaatgtaacttttgaaaaattctgagtctcaatcaaaaatatcttgcaatttgttaaaaactcttgaattcagcattgtagttctctaaaactctgattcgaactttctacaaatagtggtaaaatgtgagaggcaacagagggtaatattgaagccacggtctatgagccacaaactgggtgcatgttctggctttgccattgactgacagcgtaactcaaggcatatctgtgtttctcaatcgtctcatccgtaaaatggagattcatgttcctgatatattttaagttcttgaaattagctgtaattctataattacctataatttcattaaatggaaaaagaacgcatttaaataaaagggaattcttagcatgcatgtgtcataatattaaaataagttgaaatcatcaggcttaagtatcacattaaaatactaattgaaatataattactgtgtaaaatagatagcagcatttattattgttattaccttgaggagataaaatcatttcaaacttacatatgagaactatgtcagatataatcataacgtgttataaatgaaatttttaaaattagttcaaatatgtttttattgtagttcacatttcttttttaatctattcagcatttccatacaaaatattaattttatactctcaagttacagtaagtcaattctaacttgataaattgttgtctttttctctgtattttctgattttctataaaaatatcaaaaaaactactgtaaaagatctttagtctaagtcttcttatcaaaataatcttcaagaaggatattatcccattttctctctctttacatatctctgcacctacttgaagcactcattcctggaggcatgtcctcttggatttgctattaaccttattttatctactctggaaatccctcattaattcgtagggccttcctatttcttttgccaaatgagtccattaagtttctgtcatggtttaacaatggttgtgatattttcattgttttagttgtttcatttttattttttattgaaggagccttagaaatgttaatagaaggacagtagatataaccacaattaggaaaaacaattcaaagaccttcaaattttactttattcacccaataccttcaactgtggaatgaaaaaataaaaataaaaaacattaactgggcctgtataaagggagggaaggaaggaaggaagggagggagtgagggagggagggagggagggggagggggaggggagggaggaaggacagacggacagactgatggacggatgggagggaaggaaggagggaaggaaggagggaaggagatgggaggggaggagatgggaagagaggggaggggagaggagaaaaggggaggagggaggggaggaggggggaggagggaggggaagaggggggaggagggagggacggagggaggggaggagggagggacggagggaggggaggagggagggacggagggaggaagggagagaggggagggattaaaacttgaaactgacaattttaagtccctgacaatcacatttttttatttttaaggaaaaaactgtcctcatagtgagttggttaataacatacacaaacacacatgcacacacaagtgcacacaatactaggttataaaacattatctcctgttttcacgtatcctggcccaagctatacaattgtccctcctgtaaatgaaattagtaaaaatcgtcatttatctgaatcacagtatattaatttgttctcacactgccataaagaaatacctaagactgggtaatttataaagaaaagaggtttacttagctcatgcttacacagactgtacaggaagcatggctggggagcctcaggaaatttaattatggcagaaagcaaaggggaagtaagcatgatttacatggcttgagctgaagagagaaaggtggaggtgcaacacactttcaaacaaccagatctcgtgagaactcactcactatcacaagaacagcaatggaaaaatctgcccccatgacccaatcatctcccgccaggccccacctccaacgttgggtattacaattctacatgagatttgggtggggacagaaatccaaaccgtatcacatagtttacaagtttatctcaataagaaggtttagacagagccagttcagctttctcattatagaatgaggaaaatggcatccacttagattgaaggtgatgcaatgtcatataacaagtgagtgaaaatcatggaaaaaaactccagttaacaatcatttttagcaggtgactgtcaatgatatcgagaataagtcctaagaaagttctggttctcggaagataactctcaggctcctgaaagtttattccttgatctgtgtccctcacactcttcatatctatatgagacctatgcttgtttagcaaacgcaaaatttgaatgacctggtatttctcatatggataagcctctgtccatttttttaaattcttaaaataattttaataatgtgtcatacaataatttcctctgtagcaaatttatataactctgatcaaaaccatgcacaacttttgaagtcttctgctatctttctgtaactcaagcttaaatataataaaatgtaataatatagcacaaagagtccgctgctttaagtttttggagaaaatatgtgttagtgtatattttttttctgctacctttaatacaaaaagaagacatgtgatgttatttgagaaatagtcatctcctagcaacaggaataatgttagcctgttgttcataatggtgagaaaaaacttagccttgaaattcaatgtctacatgagagaacacaaactaaacatttgttttacatataaaaatagaagaatgctttcaatgcaaataatttcttaatttaaataattcttaatttatgacttttatgttttatgtattgatgaagcagaaaataacattattagtttctgcaattttacaaaagatataattctacctcatctatcatttatagaaatctcaacagaaaacacttcaagactttcagagtacattatgttactatgttttcattttatctataccctagctttttaagaagccagcagcatttatttatttacttttatgttggtggtcatttctgagaagtgatttaaattaaagttcaaacttctgattaagacaaaatccacttacaaaattatcaaaaagcatgtgtccctaatcatgcgcttagacaatggccacaaccacatgagggttgactggaatgaaagttcttttaacagcctgatgatggttcgtgtactgtcagtacaggaagccagatgaagaaagtcagaactaatgtgatatagaggcttggtatcattctggcattttctcacattctaggtatggttagaaaagcgtatcagaagaacgccagataccttctggatctcctctcaaggtccttgtcacccatggtgacaatgggacacttgggctaagaaacacgacgtgccaaacaataatttgcacagatgctgctccctatacattgtaatccttcaaactttagatccctggctaacttgagaggcaatgaaacttctgccctggcttcaaaaattggacagtgcttcatctattgtgcaggtatgttatctattaatgaagctgaaaataattaaacgaagattatcagtttttgcaattttttctttaaatttccaaaatggacaaagccaatcttatcttcttgtttgcttttaatttttacatctttttatgtcttcaaggcaataagggttatttagagagaaattttgcttaaatgtttagaaaattatcctacatagttaaagtaggtgaaatttcattacacgctttttttaactggatattttggtacttcactgtagttcctacagaatgttccaggaggtatgtgtctgttatttatattctttgtctatttgaacttgaaaggaaacaaaaacggccattacagagtccacaaggaaagcatcctcacggttttgtttgtatgtttgttaaagcaattcaagtacagctttttaaaatattcagctgaaaaatctaaataaatcagtaaattagaatttttccaaagattttataaacatgttaataaaaatcaagaaataatttaaatctttaagtttacctcattcataagaacctattgaaaactgcagattataagatagttttcactgtcacagctgaaattccatactaaattattaactcccagactatctcaattttgaataaattcttccatcatgtattactactatctaaatactgtctccccacaaaaggtatcattgccaatctgtatgttctgtactctgctaaaagaaaaatcatgtctgcttaaaatatcatttaaatgtgttcctctaaaatgtttattgtatgaacttatcactgcaaatatccattgtacataaaatttgacaaaattaattatattgatggtggcttttaaaatcacaaaattatcggtgcatttgtactataagtttattcttttctcatttaactgtggtgcttataagtacaaatatattatctaattttggcataatttaccaagaaattacgtcaaagaagagtagctctattagaaggtcacatttgcatctatttttgaacttgcacacagaattctgtttaactactcaatcgcattattgcaaacctcttaaaatccatctttgtccttattaatgaattgaacaatattttctgattatactgtacatgcacatatgtttattaatccaacaggtgaaggtataaaataaatattttattgctgggcatggtggtggatgcctgtaatacccgcattttgggaagatgaggtgggaggatcacttaagaccaagaatttgagatcagactgggcaacatagcaaacctccacctctacagaaaaataaaaaattagcatgatgtggtgacatatgcctatagtcctagttatttgggaggctgaagtgagaggatcacttgaccccaggaggttcatgctgcagtgagctatgatcacctcactgcactccagcctgggtgacacagtaagactttttctaaaaaataaatataaatatatatatatataaaataaatgtataaatatatatttatacataaacatatgaacatataaaaatatgaatatttatatataacatataaatatatatttatataacatataaatatatatttatataatacatatatgtttatataatatataaacatataaaactatatataatatataatatatatttattatatatttataatataaatataaatattttatataaatgttataaagagaaatatataaaatatgttatagaatataaatatgtttatatataaatgtaggtatatatttatttatgtgtgtgtgcatatatatatatacgtatacaagaatcactgctcaacatttctttttcagtaattttcagcttttttttcctttctattcatttgtaaggccagaagatggtatttggttttgttttctcatgtactggtgaatgatcaggtcatgtttagaatgtttaaagttatcttgctcttaggtttatatttggaaaagctgttctgtagtatggtgtctggtgccaacttcttaatggcaaacaggtggatttttaagaaatggatttatggtaacattttcaaaatgatacctggtttgtattaaaggaaaatgcatgcatcacagggtgactcattaagtgaaaatggagtagacttatctcccttatttgattatttgatgtacagatatatatcccatttctgaaataaaaatccatatggattggattgcctcaatacatttctctctggctgtactgtaataaaattcttgctatgaacctttatgaacaagccaacagactgaaaataaaatgacctggataatggaatcataaagttgttatggatggaaaggacttcgttgagcatgtattttattcccatgaattgaagtggggtgcatttaatcttgcccttagcatctataacggaaaggaatatatggccacaaatagttcctcaaaggcacgtgaaatcacttaagtaatgcctatttccttttcctaatgttctcctccctcccctccttccctttattccttcagtgattcctcctctataggtatctaaaagctaaatgtgaaaggctgcatggtgttgtggaaagaacccagaatcagaacagacagacctggtttcaaatttggactccagcacttaccaccaagtctgtgcacttggacaaattacttaactttaataattctcagttttccacattgcagaattgtttatgtaaaaggcatctgttatacatcatatgcttaatgaatagtagttataattaagaaaaaacacacatacattttacaagttatactgacaagaaaacagcaaacgaggcatgtttgtgggaagcatagagacaaagcagttggtttctactgggctcgggcagctagattcatgctttctcagtttaatgctattattgtaattgatattttttacctcaagatgggataaacggaagaaaaacctcaaaggtagccacattttggagttcaatcccaaacgggtgaaaatccactcagtttatcaggattagtgagaataataaatgctgtttgtttgctcaaacatctcccttctgaaatgacagaaggtaaacagtccaaaggtgagtgatctcatgaaacccttcaagaatgcactgaaaacaagcctggagcactgtggtagctgagaagctactctagttgtcaggatatgctggaatgacgctgtcaaaaaagaaatggctcagccattctgtaaacaagccagttccatggaggccaagggatgtgctgggcgtggtgtcagccccccaaggcattgatgccaggggctgttcacagtggttttatgtgtggccacaggtgccagtcccaaataatattatccacttactcaggaatggtagcttcattttgcgtgtgtctttgtaaatgaaggctggtttttattcatatcttccctaagcacctaacaaagagttactttataccttcacttattgctaagaaagtttcagtgcaggtgttctggttgaccttaagcaccaacatgtttctactcaagaaacatgaggctctggtcatcagctgcccatgtctatgatcaggtatccatagcatttggctactcagcatggacactttatccaaaacacccttcacatttgagagccatatggctagtccttcagtgcacactaatcaccaaagctgaaggtgtttccatgaccaggagtccatactgactttataaaaggcttgattccttcaggataggtgtgagcattgtgacagcctcacaattctgtccagacaattagttttatacaagtgagcagctgaagttaaatactgctgcagatctactctctttaggcaaaaataagctggcccaagcagccttctgtaaaaactaccgcaaacctggtcttctcattaggggcctcaaatttctgaaaaaaggcgaccagcatggtgactcatgcctgtaatcccactttgggaggccaaggcgggtagaccacttgaggtcaggagttcaagaccagcctggcaaacatggcgaaactccatctctactaaaaaatgcaaaaattacctgggcacagtggtgtgcacctatagtcccagctacttgggaggctgaggtggaaggattgcttgaacctgggagacagaggctgcagtgagccaagatcacgccactgcactccagcctgagaaacagagtgagactccatcttaaaaaaaaaaaattctgaagaagtctattgggataaagtgtttataattagacttagaaatcttctttgcatcaattgacaaatagatgatagatggattatttatgaatgtctgaaaaacactgtaaaataagacagattataatatactttttgttacttgaaacatacacgtggctgggcacggtggctcacacttgtaatcccagcactttgggaggccaaggcgggtggatcacgaggtcagcagatgcagaccacggtgaaaccctgtctctactgaaaatataaaaaattaggcgagtgtgatggcaggcacctgtagtcccagctacccggagaggctgaggcaggagaatggcgtgaacccgggaggcagagcttgcagtgagccgaaatcacgccactgcactccagcgtaggcaacagagagagactccatctcaaaaaaaaaaaaaaaagaaaagaaaaaagaaatatacacgtgtgtgtgtgtgtgtgtgtgtgtgtgtgtgtgtgtgtgtgtgtagtttaagcaataagaaatagcttggttctgatatcagtttccaatccctcccttctagccaatttattaaaattcttacttgcaacttattgattgcctttttcatggtcttaattttctgctgcttctgttgcttccatatctcctttttcatttccttctttccattttcctgacatgtatggactaatactatttgtaaaaattatttttctctctatctccagttgctagaagtttacattcatttgacagcctttattgctaaaactaatttaactcccctccattatatcctgctgattagccataacgagtaaaatatataggtcttgctcccaacattaatccagggactctattcttttgcaaaatttcctccaaacatttctggaattcctctggaagcgccttacatggacttacacctgccccattccatcccttcccatcccatcccctctcatttcattaattccaatctctctcactggtttcactgcttgtccactgctttgatactcagagcagatcctgctaatggatcttgatctaacagaatacacagcagatgctaagccacatggccatctgatccaccaggggaataacatggcgatggtaggtggatgggtggggagggcttagaaatggctctctcctgtttgtagcataatctcttggcaggatcccaatagatgtctcaggtaaaagagagaagagacacaaagaaagaataaagcgacttcttccaggggcgtagaccaggaacgcactgttatcgcagacgctcattgaatgtattcccagtctctctgggctctatactaggttaagagcatagtgcctcacaagttgctttacagaatcttgccccagtacgtttgataattatttacataagtaatgtgttagtctattttacattgctataacgaggtatctgagactgggtaatgtataaagaaaagaggtttatttggctcacagttctgcaggctgtataagcatggtgccagcatctgcttctggtgagggcctcaggaagcttttactcatggtggaaggcaaagggaatgaacagccatgtcatttggcaagagagagagagagagaaatgatgtgccaggctctttttaacaagcagatctggtaataattaatagagtaagaaatcactcactaccctccaagtaggacagcaagccattcctgaaggatccacccccatgacccaaacacctcccactagactccaccttcaacaagagggatcacatttcagcatgagacttggaggggacaaacatccaaaccatatcaaataatagtttaaaaaatcagtttatggattcaagcctagatttgagttctggctttaaaactttagttacttttcagtagatacattttttaacctttcccacaatttagttgcctcatcagtaactgggagtaataattattcccatatgagagaatttttatataggattcgataatgcatgaaaatgacagtttcccaggcaaatagtcaacagagggcagacacctgtattgcaactgctatgctcccattcactgcacacgtacagtgaggcctgatccacagtggaccttggttgagctttctcagcatgccccttaactttttgtaaatttttaaaagacctatttttctagttgttaggcacctaaattgcataccataggtccaaactgatattagcatcacattatttttttttgagacagggtcttactctgtcacccaggcttgagtgcaatggcacaaccacggctcaatgcagcctcaacctcccaggctcaagtgatcgttcctcccaccgaagtctcccatgtagctgggaccacaggctcacatcatcatgcccagctagtttttcatatttttacagagacagggtttcaccatgttccccaagctggtctcaaattcctgggctcaagtgatctgcctccctcagcctctcaaagtgctgggatttcaggtgtgagccgtggtgcctggccatcatcacacttaaagtttatttagttgggctccactaacatattcagaaacagaactggtttctcacaaatgctcttatctctttgcaattcaaaactttttttctaaaggagctctctcacaattttgcccagtctggtcttgaacccctggcccaaagtgattctcctatctcagcctcccaagtctctggagttacaggtgtgagccactgcgcctggctcaaagtcaaagctgtatgcaaaagaattccatttaagacactggtactgaaataatatcaaacacaagaaacaactaagaagaagttaattatacatattctacccttccacataagccaccccccagcacaaaacctacatcctctggaatattttatcgtgcatacacaaatttactcattcggcacatgtttctaaactttcacgataggacagacactgttctaagctcagagatgtcttcaagatcaaaaataaacaagacagcttatttttaggtgggaagagataaaataagcactgagtgaatggatgaaggcaataaatgaaaacaaataagcaagaaaataccagggagtaatcagtattacagtgaaatatgtcttgatgaaaatgacgaggcagtactctaagttagtcaggaaatgcctctctgaggaggtgatatttaagctgagacaggaatgataaaggaaaccagccctacgtctggtggaggagcagtctaggcagagggaagagctggtgcaaaggcccccaactcaagaacagtttgatgggcttgaggaagtaaaagccaactagagggctggaatgcagggacagaggggagaaggtaagtgatgaaggcaaaggtgaagatttatggaagtgactgagtcagcctacaaagttggaagccactggaaggttgtagaaagggatgttgtagtagtccgttctcacactgctataaagaaatacctgaaatgctttaatctataaagaaaagaagtttaattggctcatgcttccacaggctgtacaggaagcatggctgaggagatctcaggaaacttacaatcatggtggaaggcggagaggaagaagggatgtctggggaggccttaggaaacttacagtcatcacagaaggtgaagaggaagaagggatgtcttacatggccggagcaggagaggagatcaaagcaggaagtgctacacacttttaaacaactagatctcatgagaactcactcactatcatgagaacagcaaaggggaaatccgcctccatgatccaattacctcccagcaagtccctctctcaacatggaagattacaactggatgagatttgggcagggaaacagatccaaaccatatcagctgtgatttgatgtgatggactggactgagaatgacttatgggggtgaaggcatggaagttgaaggtcagcaaggggctatggttgttttccaggtgcagagaaatggaagaatttggaatatgtcttgaagacacttgaacagatgggcaacaaaggaaggataaagggcaaccgtggatctgtggcgtatgcacccgagtggaagttagagctgcttaatgaaacaggatatgttaggctgatttctgatggattcacatttccaaattgtgcagctctctttcctctttcagccccagcactcctttctgtggggtggtttgactcacctgattgataaatctaggcaaagataggcctgagggatcagtcccttcctttcagcttttcttgcctgcttggcttcaacaggcttacattctcagctcctctgacctgtgtttgctggacaaagggaggtggggggcattctcagctcactctgagagcagtgcagtcacaggaatctcactgtgatgccacaactaagtcatgtcctccaatctgactggcatcagtgactctaatgatctgactccagcatgtctccatcaattgatttagatctcaggatcatctggagaaatactgggaaagcagcatatttaggaaaactaagaagagttctgcttcggacatactagattcgaaagacagttttctgggtattcaagtagtctcatgcagattagctttgcattcagggattaggtagaactggagacttagaatcatcatttatatattattaaaatgcatatatgattttactagcaagtcattgttatataagtgcatatattttatgagcatttagcgcacgaaccaaaatggattatagcatcctccatcaatatcactgtacttttaacatagaagagacgagactccccaaactagattgggagtcaccaaacaaactgaagatctgaggagaagatcatctctactgagtcatgctaccccaaaaggctttccaagtttccttcttatagatcagtcatcagcaatttaagcttggtttgctcaatataaatgatttgatgcaaataaaattcaattaaaaatcccacacactttatctctgactcatccaaggtgcacattgccatagtaattgaagacatctgtcctatgaaacaatacaggaacaggctcgtgcagctgaatctcccacactgcctcaattgccacctcaggtagaactgagctggggaggaaggctggggacatgggtgcatatatatatgaggagatgttcttatgcatactgtcaatgcggctggctctcattattattcttgattaaaatataatcgctgtcagctcgccaccagaaaatattaacttgcacttttgaagtcacctcaaccagatacacaattctattatagtgcaggaagggacaatattaaataatataactggcatgctcctttctaatagagtgaattataatttatcttaattacaagatagttatttgcattatggtcagtacttcacctgtcaagttcttagcgaatatgtcttaatatacagtgaaaagtagctaacacaacagtgcttatttaaactatccacacttgtgttcttctataaacataagcctttcttcacatagtcattctgtcaacatgaagatgtcaggatttacatcattttaggtaaaatttagaaattcagttaaaagtggttattttagtggattaggaaatgaatctacatttttaaaatgcttggtctcttgaaatcaaatcatatcctgaaaattttgctaaaagagacatttatgtacagaaactttagacagtgttttatcccagaaaattcatctgggatcaagtgctttggatataaatgaaagaattaacaaaatgccccaacaagagagactattttatttctaaaattatccatatcaaaaatggtattaagctaaaatgctgctgcacctgcaaatctaatagatttagaactggtatcaattccatgtatcataggataaagaaaaaagaagtgcaatttatgttttgctgcaaattaatttgattatatctgactaatatggtgaattcaggcctcatggtactctctacaactggaaaaaaatattgccttgtatcttctgaatgtgtgacagatttgtagctatgtgtgaaagggcccgttcagacttgtgttctagggcctcacttacgtggctattacatagcatacagatcagaatctgttggcttatctgaggttgtacacccctctgacttccaacttataagtcaaaaagggaattaacaaggcttacttacgttggcacaacaggatagaaattgagatctctcaaccaatctactgaaacactgtatggggttaagggaagaaagaaactaacagttacggagaacactactcaccctgcgtgggatgtgacgtgttaatccacatatggtttctcaccacaggatccacacttctccagtgacttccattgattaggatttatcttgaggcccttctttcactgctgaggcctattctttctagccaaatggtctatatttgttattgttattgttgttactggaacttaaaaattagcattgatgtctctgaccttctagatacaccttgaccacctcctggaatgcccttgctaattcttagaattactgaaatatactgtctctttttgaccccgttcacactataacttttctaagaaacatcctgatgacccaattttatggaaataacataaatagaaacataaccttgtgcataaattacctttcacattttgccctctgtaataatgctataaactggtccttctggtactgcacatgcaatcataatgagacaggcacaaaaccgttaaggtgacctgatcaaggtaacaatgataatttcaaactcttctatctgtctttatatgaatttcatataaatgaattactggaatttgtttatttatactttcattttgttcaaaaacacatgtaataaaaaattcagtgaggtaggtgaatattttaatcatgtaattctgctgctttaagaagaaaatgttgagaaatttagatccaatttttctaaaatgaaatgatatcttttttttaattttatttatttatttattttttgagacagagtcttgctctgtcaccacactggagtgcagtggcacaatctcggctcactggaacctccgcctcctgggttcaagcgattctcctacttcagcctccagagtagctgggactacaggcatgagccaccgcgcccagctaatttttgtatttttagcagagacggggtttcaccatgtttgccaggatggtctcgatctcttgacctcatgatgcacccgcctcggcctcacaaagtgctgggatcacaggcgtgaaccatcgtgcctggcctaaatgatttcttaaatagaacaacacataactcatcttgatgatacaggatcagtatgctagcaatgcaattctatagagacaaaacatggcaatagtaataactattataactttcatattcaatgtagctattttaccaattacaaaataattttatgtgttattttacttgacattcaaatagtcttgtgcaagaattactattttctacatttcatagataaagacgttaaggtttatagagtttaagtaacgtacgtttcacagccagtgtgtggcagaacctcacattccgacagtaagccttggacccgacaggtggatgggatttgtcagccctatactaaatgaccttaaactactgtgggcattttcttcatccttttgtctgattagtcagtcagctatcaactcctcttgttgccagagaacagtaactgttatttcttcctgctgccagctgtcatcatctgtttctactctatgagctggaaaatcagataatcacgcttgctgaaaattgaacatgaaacagattaaatagcatctgagaggggcttcttctgtgaagtcaatcaagttcatgactttggtgcacaagtttaagattgactatcatggtggctcttgagctttccccagcagcctgctggtttgtggccaggtttgggaagggagtgtctaccgtgaaacctgcttcccaagcaggtgaaatgtgatgctgtttacagtttgccatcaagtggaagacaacaagatgcaaagactcgcgccttctctcccacacacattcctttttgttccgtttttctgaaatggaccattaatggacacattaattccttctatgtgtgtggctgttcatgctactcaaagtatgggtctcagtccactgccagtgtctgaaatgtttgccaccagtcaacaaaatatgtacagcaattaaaactattcagaaagctttatagaaatgtgatactgctacaacatttttattatattttttaaatattggcatgcaagagaccggaaattatctaaaaagttatcccatgccatggagaatttgagaataatcttcggtatgttcacaatagagtattgaatagtggacagtagacaaaaaaggttatgtgagagagagtcccatttggcctgtgagcctgccaggatataaaacactaagtgatctaccatttttcaaagttaacctgactgacttcttctgtttattctggttacttctctgggattaagaaaagtttcccagtcggctttaatgacgtcatttgcaacagttaaatagaagattatggagtgcagaatacagggaccaggataagtgatatttaagccattaagtaataatattagaaaaagatcattacaaaagttaacttgactatcacaatcatgtttcttgagcattataagaccaaagcaattggtatgttattcacagtggggtttttgtttgtattcttagtatatcttggaaattggagacaatgatttcaactatggactttgcagataaccaggcaccataaacaaatacatgtttatagtaaagttttcatggtgcttttgatgttgctaaatatgatggccatgaaatattaacaaatttatataaaatcgacactttctttggtttatatccactggaaaaaaaatctcaatttgtttatagaagcataaatttgaggagacactgctaacatgtaaatttttattctgcaaatatttagtgagagttgtgcctggcatttactttttagctccttgaaataaatcactgaataagaccaataaaatccactggttctgtagagttatactctcgaaattgaagaactagagacaataaataggagacttattaaacacactatttatatggaatgttagaaggtgatcaatgctgcagataaaagaaaaagtagagcagtgtaaccaggcccaggttaccctcgttagcagaagcattagtaataataatacagtggtcaggccgggtggtggctcaagcctgtaatcccagcactttgggaggccgaggcgggcagatcatgaggtcaggagatcgagactgtcctggctaacatggtgaaaccccatctctactaaaaatacaaaaaattagccgggcatggtggcgagcacctgtagtcccagctactaaggaggctgaggcaggagaatggcgtgaaccccggaggcggagcttgcagtgagccgagatggcgccactgcactccagcctgggcgacagagtgagactccgtctcaaataaataaataaataaataaataaataaataaataatatagtggttgaaagatgagtttcaagcaaagtcctgagcaaagatttcagcaaaagtttggaactagacagtaacttaaaatactctctaggtttaatactcacctaaaagagactcattttaatgactacatttaacataatgtttatgaatcaaatttgttggaatgaaatgaaattcatagtctattctaagtttagaaaccaagaacagtataagcatttgaacaaatgatgtgagcttcccgcacacacacaactgcaaggttcaatcattcctgctacaaatctctctccatcttttgagagagaagtgctgtattttttttctaattgagacaagggagacacatgagtttcaggctgtcatctcaaggacacataatttgattttttcctcttttttaaaataataaatttctgctacagttttaaagggcaggaaaaactgaaaaataaaacctttctgcctcaggcagatttttcttttgctagctgagaggtagagaggctgtaaaggtgataaaagagagtgctaaaaaaccacaggttaagaaagaaagtatacagtggtcaaaggcttcttagtttgaaatcccattctcctgaagtgtcaccagtgatttgatgacaaccaacacctgaaattctagaactgctaacatgccatgtaggacttacatccaagaaaggattgagattttggtcttaaaaatatattatcatgggtatggagagagaaaattagtcttagagcaatttctgacatatgagattggaaattagtgagaaaagtaccagattatacatagatatttatttaaattttgttccatttgcatcaactctacatgtaaagtaatcctaaactgtaatttttatataagtaagactatatacgaatgtttaatacatactttcatctgctagccttacattcctgtagcatatataaactttacctgttgtttcgaaccacacaaaaatattacatatatcatagagtctgatacacctagttttaaaatttatctcttcagaagtaattctaaaaacttaaatatacaaaattaacaaaagtcatactccacgcgttttctttttagactatttactttgacttccatagtattccaataaggtttgtttaaaaaaaaaaaaggacttttgatgtttatatcaaatctaatttgaatgaataaaacatttctttaggttggccaaagatgaagaaaattctcagactggttaatttttcttttcaacatttgaaaaatgtgttcaatctacttcctgaaagaaatacctaggatgatagaaggaacataatttctgaatgtcctacaaagttatatttgttttcaaacactgacattttccggaacagaaaagagtcctaaatttttaatcatcaagagattttgaaatgctggtgtagtgttgtttccaaaaagaaaaagaaaacaaatcacagattaagataaaaattacagacaaaaagtttgctcttatgcatcaaaataaggcataaagaagttcaaacaaaaatgcattgattcccatttttatgtattgtcaacgctgtaatcccagctgtgctcagataccactagagattggtacacagatgtgccattataaaagggactcgattgccaatcagagctcagcttgagagattcattgtccaagccattctctaataaagcttctggaactctgtgtgtgcttcagttattgtctccatgaacaacccagaattgtgcaaataaaggcattgcagaatttctccattatacttaattatatattgtgagaagctctagcttttaaagaaagcccaacagtagatttcttttatcgttctacaattctctttttgaggagacagatgaggtagaatattgaagcgctaacagcataagtcccttctgtttactcagcaatcaccaattgtgctgatggttaatatgtttatccccttttcaaagaaaaatacttccaacagacaatggttccaccaatgacagaatcatgaatgagggtaattgtcaatattattgtttcgtacctgaaatgaagtctcaactgcctaacacatactggctatatgccacaaatatggcagctttctcagaccattgtatctctgaaattcaggcctggaagatgttgcctctcaacaagcatctttggtaaaatgagtttttgacccacctcttacagactcacaatatgtactgacatttttgaaattccaggaagttctagaataaacaaacatattcacttctattctagaaaacattgttttgctatggaatccttctctacatagtattaatcaacaacccagtgctttatttaatacagatgggaaagttatttcaggagttaatttaaaaagaaatatgtgttggctcaaataaaaaaagaaataatttgtgagaatataccatatccatgacactactatgagaagattccactttccataacacaggttatattgagctgaatgtacattctgagtaaaattctgcctttctagaatatttacagataagtggcttatcttctaattttatataattattatacctaaagatgtggagaagtcacacaatagaaagtggatttccgttaatctgaagatattgcaagatataaaattgtggcttcagatatgaacatcagatagcatcttcaaagttccaaaacatattaactactttgtcctttaacaaatcaacattcctcattttatagactagtttcaatttgtgaccataattcttaaagaaagagaagggagagggataaaaaagtactcataattttttatttaaaatgtaagatatatttatagtgtatatttatttagctcttcctctgtgtctgagactgtcctaagcatgtaatatctattagcatatttattcctcattaaaaaacctatgaggtttgaatcttctcacctttatgttaagttaaaacaaacaaaagcacagataatatctttcctaaagacacataactagtaagtaaatggtagagtcagattttgaactcagttaccactgccttccgcattcacacactcctcaatgctacctaacaactttcctccactaataaagaccttaggacatcactacaactgtccctggacttgtcagataataaagatttgaataatcattataagaaagttttcattccatcagaatttagaatgaggttgcattaaggaaagtgctctcatcttcagactatagcaattccgtagctttcgtgaaggctaaaacgtcatgggctttccttgttttcttctgacgtctttcgaagttgaagtcagtttcataaggaacactatcgtctttctaagttgaagtcagtttcataaggaacactatcgtctttctaagttgaagtcagtttcataaggaacactatcgtctttctaagttgaagtcagtttcataaggaacaccatcgtctaagttgaagtcagtttcataaggaacactatcgtctttctaagttgaagtcagtttcataaggaacactatcgtctttctaagttgaagtcagtttcataaggaacactatccagataaacttgctggttgcttcacaggctccctcagtcatattgattcaagtggataaaatgtgaatcctgaaaatgatagaaatgctaagtacattgatctcacagatgactcttacaaatagctttaatcattccttttctggatgcgagagataggttcttttatttatgaggttaagatcttcctatctaactcaaagactacatacttcttccttataaaggactaaaatgaaatcaggtactttcatggtgtttacaggtctgtaaatcctccaaattctattcatttagaatatattcaagataatttaaagaccaggttgcaaacatattcataatcaagttttgtgaatgaatataaatgtgcaaacagagaaaaacattttcctgcatactgatgaactaaaagtcaccctcctgcagaaataactacctgttacaacatcaatgcctaattgaagatgattgggagactcaaagattagcattccaaaccagttatttcatggaacgaatcttgatttgtagctagatacgctatatataaaatgcatatgctaacaaaaccaaacagcaagcaatacagcataagaacagaaaatttaatgtgctttggtaccctactttaataattttgaagattctgacaaccttgacttggaaaattgaagttgaaagcacttagaattagcagtggattttatatatagaaaaaaaccatatgcctgtaggtgcatgtatttagaatgatattgcatttgggccatataccaaatatatgttatggtatttttctgtggactttttactggatattgtgtgtgtgcatgttcatgcatgtgtgtgaaaaagcttaaagataaattagcttgggcccttaaaatcagatcaaagaaagttagtatgttaactacaattttgaaacgatttcccagtgaatatttagttagtatgttaactacaattttgaaacaatttgtcagtgaatatttaacaatgtatgttaaataaattttgttccctttactcataagggggaaatgttacttgaggatttacagaccaatccagaaatcccttgtccattgtagaataagaaaaaatgctgaatcccatttttgtttctctacaagtttatcaatttttgattatactttctctgttttgggtagcacagtttcaagccaaaaactttataatctatttcaacacagcaaagctattatcatgccttctgaaaataatggcttccatgagatgattataatagatcatcttgaattagaaatcctttgtgtagtctctttcaaagcaagcaagtgatctgaaatggaatgtgtgcctttttgttccattcactgtgccatacacttaattcaacaaaagtcccaagtacctattctgtgccaagcactattctctgtgcaagggacaaaaaagatgaaagctgttgtcagaaagctagcactcttgttaattgaggagatggacatgaaaaataattacagaatatagtggttcttgcaatagcagcattgtgtacaagatgggaaagcagcacaggaattggaaggatccccttaaagggcgctgaaaataaatgattcataaggggttatctaaaatgggttgtgaaggatgaataagagttttcaaaatgccaagatcttattcatccttaactatgatttaattgccatcttcagaaaatagcacggtgaaaatctttctattctaatatgggaacagtaataaaatttaatttcattgttttactatccttaaagcagtaaaaaaaaggtttttactaactatgtaataatgttaacctcatggtaaatatttcatattttcagggtaatgactgaaaaaaagttttaggtgaaaatttgtgtctaaagcagtagttatcagctgttcaaaggacttagaggatgtggaagaaaccatgagaagagctgtaaatgcagaaaaaaaatgttctatgtgatctgacttaggtaaagacattcgttaagtggagtatttgttgagtatctactgcgcacaagggatgattccaggctcctctaatacaaatacaaagcaacttcctttcattagagagtttatgatatggttagggggataacttactaactcatgatttcctggttaaggactacggcggaggtaacccacaaaaccagacgaagggatactaacaaagaaatgaaaagtgaagcagggcttcccagaagaagggctatttgaggcaaagctaaagagagttagagttagccacttaaaagaaactaggaaacacagtttaagtaaaggaaatagaacttactgacaccatgatgcaggaggccacaccaatttttattttggagattatatatgtagacaagtttcctggaggattatccaggaaataaatccgaattttattttagtttgtttcaattttagattctcaaatcatatttcgcgtgtgtgtgtgtgtgtgcgttttctcacttaaagtattagaacagagtttcataaaaccaatctgcattgaggtagctttattttaaacaggatgctatggcacttttattcttagtgcataatgttattaattttaaaaaatttatttcccaggatggcagaataggtttattcctacaagccaaacacaatttcttcttagttatgggttgaagcatttggaggtaaggatcctcatgcctcgcccaggccttgaggtaaagagtggtgtatttgactagtagtgtctgccactcatcaggcagtagagagtgttgaatctgaacttaatcccttaagaagctttttgttttgcattaggctaagatccagggaaacaaaatccatactatcaatgatagctaacatttattaagcacttacaacatgctcgccacccctgaaggactttacatgtattaattcattcaatcctcacaacaaccctgtgaggtggaaactaatggccaagaaagtcaaggaatatgtgcaaggttggcagctagtgaggcttcccacactggcagtcaactccaggggaagcgctcttgccagctgtacaacagagccttgctgtcaactatccatgctaaattattcataggacaatgtcagctatatcagtaataccctaaagagtagtaatattacatatttaaatgctagtcaaataaacagtgaacaggatacatgaggacatagcagcttctctttagcatctctacgttgcagtcggccagcgctattttcaataactctaactctatactctctatattctataccctctatattcctctctctctctctctctctctctctctctctctctgtctgtctgtctatatactccatatcctaacccagtttcatttttgcatacaccaaatgtcggacagaaaaaagtatggtttaggagtttcacatactcaaatccccttgtctatgattttgcacaaacaacttctctgatcttcagtgtcctcattctaaaatcagaatatatacaatagcatatatttggtattgtcttcagacatcagtgagatggtggactaggacattcaagcgctcacaccccacagaaacatcaacttatataactatccatacacaaaaaatgtctttgcaaaagctaaggaaaccaagtgagagatcacagcacctgggtgtagcaaagaaataaaaaagaaattaaaaaaagacacattgaagaggttaacaaaggacagttttacatgacgcacatcagcactactccaaccctacataccatggtgttatatgaggtatcatccacaaaggggaaggagagtgaagagagagccacactttgccttggacccaacaccaggcccactctagtaaaatgcagtgccacccaggccccagatgccaggctgggacttatggactgagcccccaggtccaccctggtagacctacagacccgggatgcaggcctgctcagcagactcagtctctgggacaccccagcactgggctgaccccagaaactccaggctctatgctgcccacaggggccttgggcttaggacctaccccattgccaggtcagcccccagagattcagatgcctggccaacccctgaactacccttggcactactttggcccccacagccccagacgtcaggcctgccctagtaccaggtcagctcctacagccctagacatcaggctagcacccacaaactcaacttctaggccagcctctgtggatacaggctcaaagcctactcagttccaagctgtcccctgtggccccaggctccaggcctaccccagaatacagaccagcccaaagcccattcagtccacataaccccaggattttagcatgccccaactctaaatcagcacccctactccaaggcaacaggccagcgcctgtggacacaagctccaggcctgcccaatgccatgccagccctacctactaggcctattcctatgacctcaagctctagtaggctcaggtccaggcctgctttaagagtcccagggtccaggcccatcccactagaccccaagtctgaatgaatcatgtgaaccaaggtttcaggcaggcccctgtggccctaggaatcaggccagccctcatagacctagcctccagcccaacacccacacacccaaactccaggtcagccccagaataaccaggatcttaaccagttcccacagcctcagactccaggaaagcacccatggctccaggaaccaggctagcacaaataatcccaggctccagactagcccctagtagccccagactagtcccaggctccatgcctattccagaaccagtctggccccagggtccaggcaggctgcagaagacctagggtccaatatcaccttagtacctgtgtgacccccctggactcaggctccaggagcaccactagagaatgaagttccagacaagctcctgtacaccaagactccaggacgagtcctatggactcaagctccaagcccaccacagcatcgggacagttcccatggcctaaagctccagacgcatcccagtggacctaggcataaggcttatcccagtgcctggttggctcctgcagactccaacttaaggccaaccccagtcccaggacagcccctgtggacccaggattcaggttgtctcctgaggatacaagcttcaggcccatctgtaccaacccaatcaacagattgactccagtggattcaggcaccgtactcaaccccacagacccatcagaccaacctccaaaggactcccacatcaagccagcatgcaggccataacagacagcctcctcagaatctctgcatgggctaagtggtcaaggatttttccagacaaagccaatctttaaagactaaaataatttcctgcttctttaaatgtacaggcttcaacctaaattaagaagaaatattaaaaaacaaaaagacacaatagcacaaaagaaaacccacaataatctttgagtagctgaccccaaagaaatgggttctaccccaaacagtctgacaaagaattcagaataattgttttaaggaagatcagtaaacttcaagaaaatacaaagaaacaattgaataaaataagggaaataataagtggccaaaataataaatttagcagagatataaattttaaaaaattaaacagaaatttgggagctgaaaatacaatgagtggaatgaaaacagcaagagaaagcatcactagcagaagtgatcaagcagaaaaaagatcctgtgaacctgaaggtaggttactttcaaatataaaaagaaaacaggaaaaagaataacaaggaataaaaaagtcttaaaagatctatgggaatacaagaaaagatcaagtgttagagttataggagtttaaggagaagagagaaataaagaggtagaaagaatatttgaagaaataatagcagaaaaactttcaaatctgaagaatgatgtaaatatccaggtacagaaaggtcaaaggtctccattcagattcaatccaagcaagactacaccaaaacatactataaccaaatggttgaaagtataaaaccaagagaggaccctgaaagcagcatgagaaaagaagcaagtcacacataagggagtttcaataatgcaagcactgaactttccagcagtaactttacagacaagagagagtggaatgatatatttaaagctaaaggacaaaactgtcaaccaagaatattgtatctggcaaaaatattcttcagacattaaggacagataaatatttttccagataaacaaaactgaagtaattcagtaccatcggacttgtctcctaagaaagcctattgggaatttttttaagctgaaacaaaggagtataattagtaatgaaaacacctgaaagtattaagatgactcataaacaagtacatagtcaaattcagaaaactagtagtctactggtggtatataaatcatttgtatttttagtatgaagggtaaatgacaaaactattaatgataataatagctataataacttgctaggggaaacacaatataaagaggtgtcaactgtgccatcaaaaatttaaaatgttgagggaagttgaagtaaaagcatacagtgtttaatgcaattaaagctaatttgttatcagcttaaactagcctgttgtaactataaaatgctttatataagcttcatagtaaccataaagcaaaagtctacagttgatgcacaaaatataaaaagtaaagtatcgaaccatgtcactagagaaaaccatccaatcacaaaggaaaaccataagacaggaagaaaggaacaaaggatctgcaagacaaccagaatacaattaacaaaatatcagttgtaaatcgttacctataaatatttgccttaaatgtaactggattgtattctctaatcaaatgacatagagtagctaaataaatgaaaacataagaccgaacaatatgctgcctaccagagacctaacctttcaggacacacagactaaagtaaaggctgaaaagatattccatgcatatggacacaaaaagaaaacaaggttagctacgcttcagtaaaataaaattgaagtcaaaactgtcaaacaagacaaaaaggtcagtacacaataataaagggatcaatttatcaagagaatataacaattattaatatatatgcacttaatattggagcacctaaatatatcaagcaaatattaatagctccaaagagagggatagactgtaacacattaacagcatgagaactttaatattgcattttcggtaatggatagattactcaaacagaaaatcaataaataaacatcaaacttagcccaaagatagtataagacaacattaaagatcagagcagaaataaatacaatagaaactagaaaaaaataaaaaacaaagagagttgctatgtgaaacgataagcaaaaatccacagacctttaactagactaattcagaaaaaagagaaaattataaataaagttagaaatgaaaaaggagatgttacactaatactacagaaataaagtagatcataaaagtctacattaaactaggatacataaacaaattggataacctagaagaaatatgtctaagaaataagttcttagacacatacaacctaccaagaatgatttaaaaattaaaaatctgaatagaccaataaagagtaaggagatcgaatcagtaataaaatgtctctcattgaacacatggacacacagaggggagtaacacacagtggggcctattggagggtatagagttggaggagggagaggatgacaaaaaataactaatggacattaggcttaatacctgggtgataaaataatcagtacaacaaacccccatgatacatgtttacctatgtaacaaacattcatgtcctacacgtgtaccccgaacttaaaagttaaagaataaaaaatataaaataaaataaaatgtctctcatcaaagaaaagtagaggaactaatggcctcattgctgaattctaccaaacatttaaagaattaataccaattattctcaaattcttccaaaaaattgaagaggaggaaatgcttccaaacttatcttacaaggccagcattactctgatactgggttaggacaatatctagaaaaggacactacaaaaaaaaattatgggccaatatccctgattaacataggtgcaaaagtcctcaacaaaccactaacaagttgaattcatcagcacattaaaaatatcattcactatgatcaagtagggtttatccgaggaataaaagaatggaataatatacgaaaatctttaaatataatcaaacacattagcagaatgatgaagagaaactataagataatctcaacagaagcagaaaaagcatttgacaaaactggacatcattttatgatacaaactcttgattaatttggcaaagaagaaatatacctgagcacgataaaggctatatatgatgatggggtttggctgtgtccccacacaaatctcatcatgaattgtagtctccatgatccccacatgtcataggagggacccagtaggagataactgaatcataatggaggcggttacccccatgctaatctcgtgatagtgagtgagttctcacaaaatctaatgattttataggggctttccccaccttgtttggcatttctctttcctgtcaccatgtgacgaaggatacatttgcttccccttcagccagaattataagttttctgaggcctccccagccctgcagaactgttagtcaattaaacttctttcatgtataaattacccagtctcaggcagttatttatcacagcatgagaatggactaatacatatgagaaacctacagcttatgttatactcaacaggaaaatgttgaaagttttcctctgagatcagtacataaagagagaatgtccactctcaccacttctatttaacatattactgaaagtactagccagagaaattacacaagagaaacaaataagaggcattcaaattggaaagtaagaagttaaactgtccctgtttgaagagatgacataatcatatgcatgcagaaaatgctaaagactctaccaaaaactgtttagaaataataaacaaattcagtaaagtgacaggatgcaaaatcaacatatcaatgtcagtagtgattctatacactgacataaacactttgaaaaatcaataagaaaacaatcccatttataatggctcaagaaaccagaaataaggcttaccaataagagagaagtgtatactgaaaattataaaacattgatgaaagaaattagaaacacaaacatataaaagattcatgttcatagaatgaaataattaatatggttaaaatgtccatactaacggaagcaatgaacagattcattgcaatccctatcaaaatttcagtgacgtttttaaacagaaatataaaaaaaaatctaaaatttatatggaatcacaaaagacatggaataacaaaaacattcttgagcaaaaagaataaatctgaaggtattacactgactgacttcaaaatatactacaaagctataacaatcaaaacagcatggtagtggcatagaaacagactcatagaccaatggagtaaaatagagagcccagaaataaatctgcctacttacggtcaattgatttttgacaaagtttgcaagaacacaaaatgaggaaaggatgatctcttcaataaatgatgttgtgatgactgaaaatccacatgcagaacaatgaaactagacccctatttcacattatatacaaaaataacatcaaaattgactaaagagtttaatataagaccttgaactataaaactactagaaaaaaaaaacaagggaaaatttctataacattggtctggtcaatgacttttttagatgtaaccccaaacgcacaggcaaaaaagcaaaaataggcaaatggaattgcatcaaattacagagcttctgcacagccaagtagacaacgaacacagtgataagacaacccagagaatggtaagaaaaaattgtaaattatcacttctgataaggagttaatatccgaaatacataagaaactcaagcaatgcttaagcaagaaaataacctgattagagaatgggcaaaggacctgaactgacatttctcaaaaaaaaaaaaaaaaaaaaaaaaagaaagaaagaaagaaaacaggccaaaagatatgcgaaaaactgcttaacatcactaatcatcagagaaatgcaaattaaaactatagtaaactactacctcatacctgctaggatggctattactaaaagggcaaaagataaacgttggtgagaatgtggagaaaaagaaatatttgtacactgttggtgggaatgtaaattagtatggccactatggaaaacagtatggaggtccctcagacaagtaaaaatagaactgccatatgatccagcaactcactaccggtatatagccaaaggaaattaaatcagtaagttaaagagttatctgaactcctatgttcactccagcatcattcacaatagccaagatatggaatcagcccaaagtgtcaattgatggatggatgaataaagaaaatgtagtatacaatggaatactatccactcttaaaaaagaaggaaatcttgtcttttccaacaacatggatgaacccagatgacattatgttaagtgaaatcagccaggcacagagagacaaataccgcatgatattacttacatgtggcatctaaaacatccaactcagaagtagagaatagaatgggggttaccaaagtttggaggatcagtgggtggggttgggaaaatcaaaggatgcaaaatgtcagttacagaggaagaataagttcaagaaatctattggacaatatggtgactatagccaataacaatgtactacagtcagtcaatatttgtaactttgttgagaatatttccatatcttattacactgcttccaaaaagagtaaagtgtatttcaccagcaatacaacagaatctatttcactcactgactatgatattttttaaaatctcccaactgtatggtgaaaataatgttttattattgtttgtacgttttcatttccttgagaaccaggaatacgaatattaattatatgcttacttccattttacatacgtatgtgtattgcacgttatacagtatttggattttatggttaaaccgcagcttttcatttacactactaagttccaataccattttattctgtttggcacactactgacttaaagtagcagggaatttattataacttatgcttcatatatttaacacatttaatttgcaaaaaaagttaataaccagcaagtgattgactattttgaaaatgcaaacttaatgtcatacagataaaaggatttctctattcaagctcatacagcagctattacacaagaccatgagacagcaaatttgttatttaaataggtacatggagagatctaatagtactcaacaaatgtttaaatactaatggttctaaagcaaacaaaagtttagctttttattatgctatctttccttactcccttctccatgttaacgaatatagtaggaatatatcatacatgactgatacattagtcttaaatgtcctatggtctttttaaaaagtgatttcgttggccgcgaggtggctcacgcctgtaatcccagcactttgaaaggccgaggcggacggatcacctgaggtaggaattcaagagcagcctggtcaacatgctgaaaccctgcctctactaaaaatacaaaaaaaattagccgggagtggtggcaggcatctgtaatcccagctactcgggaggctaaggcaggagaatcgcttgtaaccgggaggcggaggttggttgcagtgagccgagactgcaccattgcactccagcctgggcaacaagagcaaaactctatctcaaaacaaaaaagtgatttcacttccaagtaaaatgaatatgattatatttagttgatcgtactgcttttatttgaaatactgcgcattattataaatgttttccaataaaaagggctacgtatctatccaatactggaaaaagtcacgtcactagggtgagctgcacttttttaaacatatcaaaagataattttttgttttctgtttccatacctatcaaagtcaggatgtactgataaaactgtggactgataaattgtgttagaaacttgattgaaaagctatataacttaaagtatattattagataaaaggtaaaaaagtgtctaatacgtttatctacagaatcgaactaaatgaaatgatacaaaaatatcagaaagtaaaaacttctatttaaataatagagtaaaatataagttattgtttttaatgtaatatttttaatataatactaaaacatatcaaactattttttagagtaatgaggtggcttccataatttaaaccttataaataatagtcatttattttttttataacatagagttaaattagatcacattaatatttcctcatgatctggcgccataagaaaatatttcttaaatgaaaagaaatgttttaaactttttagataaaatcagtatgtttatgaatatttgggaacccttgtttacatatttcaaatataacctagataagcatataattgttaataattattaaaattgtcataatatagaatgcattttaaagtacacatagtccttttgataccatatgaaaagtctatgttttgcaataaagatgaatattatttcatagtaattacatgatttatataattttatatggcttattttctttatatggttttagttaaatatgcaatttctttatatggctacatacacctagaaagcgggttaatcaaacaatcatgagaagtatttcctagtcagattcagagtatttgttgcagagaaatgcatatactgattttaatatattttatagctttccttaatagaaaataagaacaaatcatttttattacagaatctaagtgtgaatacacacatatacatgcacaaacacatgtataattttcagattgggaaagactttttaattcttatatggggaacaaaaggatgtcaacaattccattgcaatgaaatatgtaaatcagaaaatataacatattaacttactacgccaaaagacaaaagcattagtcaatctattatatattctgttgatttttaggtctggtcctgagtccttctactaccttttcaacgatgaaactaattctaccatacaacacaacgctgtacataagataaaaaaggctaaaggaagaaaatgaaaatatttagtatgtatattctttgggtttatttttagctgcattctcttctctttttttgcaggaaatgctcattttgtgagaaaagtcatttgtattcatagtaagatgataaagacactgtctttaccagcacattctggctctgagttaggatgatgagaaactttctaaaaacaagcctaaagttacctacagaaaagtcaaccatgtgtagaccagccttcattcctgtgatcgaacccaccaatggatcagaagaaagctaatgcctagctgacggcagttcccttttgtgctgatgcctctcttctgggctccacagcctctgtgtcagctccctgtctctctccatcttggcttcacatttctgatagagtaagtaaggttttaaatcaggccacaatttggggagctgccaagtcagctgcagcactacagggcactagaccccactgtgccacaaagtaattcatttctgaatagctcattatatttcctctaaattagcaagattcaaaggtgacctaaaacaaaccaacaaatacgtcctttataaataatattccaaatctacaaccagattattacttgatatgggttaatacatgttgccacttttggacagttttcttcctcattgaaagactatacattctgccatctaataaactagatatttgctgtgaaaccctttatgcacatgtctaaatataaatttatatttaagatgcttttcagaaatactacataggacatcacaaaattctgtttagtattacagcacttcctctctttccacatcaaacaagaagagttttcgctcggtcaaacccaggcttcccacttgcagaaaaagatgggaatgtggctttgcttatcacatggggcatatattgtttgttttattatttaatagtgtttcaactgcaatctcctctgctcccataatgcagtcataaacggtttctccaaaggcatagaacttcatgattagctattttgttatttctgctaatttccctcaccacctaacctttaacccatggagcaccactgtcatggtaacactctccatccagagcaagggcacaaaatggtttacaacagcatcctcaaccactgtttgggagtcctaaggggtatctctattaaggaagacaaggatgttgtttgatttcatttctttaatcagctagtaaaataagcatttatttgtttttaatctcttaaagcagtacaatgtggaaacttaacaaatgtgtctctagaaggttagaaaattcagtgacaacattggtttgacatggataaactttctcggtcgttttgacccttatataattttcagttaatctcattcttagttgaatttatgtccataatggtataaatctatgctggtccattttagatggcccatcaaatagataattcacattaaacataatagagtgggttgtttttggatatatacttaagtaaatcatatttttctgatattgctactctgagttaaattagatagtgcatgctactttccaaaaaagaagaaaggcaacatcatttttcctgttatttttaaaacttgtgaaaatagtataaaataacattaaaatacaattttaaagtatgtaacaatcttttctatattaaaaaattgttaaaaaagtaatttcttaagcttttcatatacaaacatgaggaaatacttttggaattctttagaataatcacaagataatattttataataaaataaaatttgtgagccaaaaaaatatttagaatcattttctaaacgttttcctaagtttcagtaaactgtggctctcagtgctttagtgttataagtgaagtagaattcctttcttcagttgaaaaccaaacatactattatataggatcttgctttggtttaagttgacatgctaacctactcccacaaggttctctctggaaaagagtttgaaaatctttggtgatcctcctctccttcaatgcagagaactccaaaccactctgcctatattgccatgctttcctgcaaaataaagcttaattgctatccctgtatttgcatattatttagatgttgatttatttacaaataaagctttgattccaaatgaatttatcccctaatttataatttataaaatatatattcctatgctatattgaataaatgtcagtatcataggctacaaaacctcacactgcacttcaaatttgcttgccacatgtccatttgacaagggggcactgttaaacttgcttctccatcaattcaacccttctttttctgcccactttatcaaggccattagaaaaattcactttacatttgggttcattagcttattaactgccccagtgagaaagctgaaactctttggcaggcatcctgtatgcagttttctgtgacagtctgcctttgccttttggtgaaaatatttcacttacgaatagatgaaaagaaatattttccccaaaaatacatacagaatcaggaatgattattttaaaacatagtaatacttcaaagatttctgaaaatccacctttgataagagacttttattaggattgtgtaagatgcagtaaaactcataattgtgttcaatgaggaaaatgttcactgaggataggttatacgaaaatgattcaggtaggtgctatgagaatagcaaaacttggtaagatggagggttaattaggagttaatgatgattaggagttaattagttcccctgtggcctggtgaggggtgggtagggttaggaagacctacctcctaccaagagcacagcttgagtgaagacaagaaattctatgagtagttttgtgaaggtaattttatattatttaattctagtaaataagagtggctataatagtatgaatgaagagtaatagtaaattatgatggttttgtttggttgcatgaatttgtactacaaaaagtaaagctcattaaaatcattttggttcatgattgcaagatttatacaggatgctgaatgcatattttggatatcagatatataagccatgtacacaggaaatctcttgagctttttatatttatttatttatttatttatatggttaataaatattacacttgggttatttggcattgtaaaatacccaaccagaggaagaaatacacagaaaaagactgtcattcaagacagaacatgtaataaacaatatttcagatggacaaacaagagacatgataaaattcagatagattgggagatcagagaccttttacagagctgatgaaaacttagctgggccttaaatgataggtggattcaggatgaataaaaatgactttctcttatccagtggtaaagcaattaaaataatattttatagacaggtgcaaaggcaaatggatatgactccacaaatctccatatttttagacctgagttaaaacatgtttgtatacatgtttcaatcagtaataaccaagttgctttccttggggttgagccacagtaatttgggtttaagattgagattagtttagtagaccagtgataaagtagttccaagatttcatgtttcagtttatctcttattatttatgccagcaaagcacatttgtttatgtttatattcttctcttgcaaatatagaacaagtatgatggcactgatatgcatccccgtgttctgctacactgacaaaacagattctctcatcagagttgaagaccctatccatcagccaaattgattgcaagtgacatttgacaaagtgggtaatcagagcagtagtcaattcccctcagtgcagacaccatccaatcaaacagactctcactggctaaggggaaacaaaattggaagaaaaggaccaagaatactctccaccactctttaatgagataaactaatatccagatactgggtaatacatttttcccatttaaatatattaatataccctaacatgaatgcagaagactttcattgtctttaacatccattcacacattaataccatatagatttcattctattacattatattgttagtacatttacatacattgaagaatttctattttggctacttgccttcagactgatttccattctatagtgaacagcatttttaatataatatagagcacatgttttttaaactaaagcaatggaaattttactttccaattaaagcctaatatcttccatgcctaatactcttcacatataccatggaacactgaagaacgagtaagtgctagataaacaagtatttgagttattagtaaaacaaatatttgtattagctaaaaataaattaaacactaaaataatgaccattcaagttaattcccccaaatcatttttcatttatttatttattcacttatatcaacacaacctttggatttttacttttctatgagttgtaatctattattagtattatttatcttgatgctaaaattattccagatttggccagtgaagcctctgccagtttgcagtgttctttttctatgttcccgtcattctttgaacactttcttcccttccagtggagtaagatattctagacttatcttgtttccctgatgccccagtccaagagtcatgatccctttccctaagtactgacatccagaaactaagatcaggatgctagatgtgctcattgttactgatgtggcattgcttctagcccctttcagcagacatagctaagataaagatgatatagatgtggatatagttacagatatacaaatgtctgatgctaatactgccaaaaccaatctgacgttataccaaacatgctagcctttcccctttacatatttgtaactctcttctttaacagtgagaaaatatgtctcctactattctctatataactaatttgctccatcttagaatatacaggaaaaactttcaaaattgttcattcatatcagtgaaaataaaacaatgaaaaagtaactacagttcaatgtttgttaatagttcatttaagatttacataaattaatgtaaatgtactctgtcctttgatagttctaaggctttgatggatatatatcaatgtataatgcctgtccctcctgcatccttaccttgggtatatgcaatgtttctttttatcttgtatatttccatacatagtaatggactaaaaatattaagtgaaatactatgtatatgattgttcaaaacaaactgtctctttcacttagaaaaagtacatcggataaagtttgacaaaaggatatactcatgtaattcacacttctatcaagactttgaatgttttcatttcccagaaattctccttgtgcctcttccaagtcaaatcctgtccttgagggaaatcacttttctgaatttttctccataaatttcttttctgtagaacttcatataaatgcagtcatacagtatttgtccaaagatgatttttggcagtatatttaactctgatttaaaatgttagttatgaattcaaagagattatgtggacctttaaagtcttctactacaacataatacaaaattcactaagagtttgaatttccctcaactagagagagagtacagggatctcaggagtgtttatgccaatgcaaggatctcataatctatgctagtctgtttagatactataaaaataaatctgaaattctgagaacattctattattattgtcactgcgcataatctgaatgtttctatagctgcattaacaagcttttataaatttacttatacaattatataacttttatcatcgtaccgcagttaaagtggctattatcaaaaagacaacaaacaacagatactggtgaagatgtggagaaaatgtacactagtacactgttggtgaaaatgtaaactagcacagcctctatggaaaaccgtatggaggtttctcagacaattaaaaatagaactaccatatgatccagcaaccccactactggatatatatgcaatgaaagtgcaatcagtatgccaaagagatttctgtatttccatattcattgcaccattcttcacaatagccaagatatggagtcaatctaccattcattggcagaatgaatgaagaaaatgtggcatataaaaataatgaaacaacttcagccataaaagaatgaaaacctgtcatttgcagcaacattgatagaactgtaagtcattatgttaagtgaaacaagccaggcacagaaagaaaaatatcacatgttcttagccatatgtgggagctagataagtggatcccatgaaggtacaaagtagatgatggttaccagaggctggaaagaataggaggaagaagaagatgaagagaggttggttaatgggcacaaaaatacagttagagagaaggaataagttctagtgttcaatagctcagtagggtgactatacttaataataattcattgtgtacttcaaaatagctagaatagaggatacggaacatccctaacacaaagaaatgatacatgtttgaggaaatggaaattccaattatcctgacttgatcattacacattgtgtacatgtatcaaaatatcacatgcaccccatagatatgtacaattattatgcatcaattttaaaaattgtgaaaaagtcagatattctccaattgggatcaaaatttaaactgaattcacttttgaccacagatctaaaaataataagaatatctgtttataatctacttccaaaatgtcaaataatccatatgcattttttatatatagacatatttatcatttgtaaactgtgtgaagttgtttttttaacgtaagaaaagagactcttcagaaactcccactgaatggacaagtgaaataatttacaccctgaccatcttccaaacaaaaagttgctctcctcaaaaaacttggaataatttttgctatcccaaataaaattgaccaagacaaacgtactttactgaaatttagagtcatagttttctaagttttcctcaaaagatgctgtatcagtatcctgagaaatcatttactcaattaagagatacctaacaaatctctgccacatgtaatgcacagtgctacacaatggagccacaatcgtgaatataaaggatatgaagatcttaaaaagaaataaaattctgtggcagagaataactggaaggagaataggtaagtgttgtaagggataagctttggcctttgggctaagtaggttaacagttacgcaaacggcatagggatgagcatttaagggaggaaattcaatatatacaaaggcctttctttaaggaggagtttggtctattcaacaatccaaaagattgctagcatggctagaagagagggaagagcaagagcaggaagagatgagtgtgaagaagtagcaagagcaactaggaagtctgtagacaatggaaagggattttgaattcattctcagagcaaatggaagctataggggagtttaagcaaagaagtaacatgatctacatttttaaaagattgctctgactctccaatattgaatgatttagagaaggccaggagtggaagcatggagaccaattaggcagagatatgtactgccaccatgcgcagctaggtaagttatgcagtgcacacatgctttagatatgacagcaggttaaagtgagagatggtgatatagtttggctgtgtccccacccaaacctcaccttgtattgtaataatccccagatgtcaagagcagggcaaggttatgataactaaatcatggaggcaattcccccatactgttctcctggtagtgaataagtctcatgagatctgatggttttataaatggaagttctcctgcacaagctgtcttgcctgccaccatataagaggtgactttgctcctccttcactttctgccatgattgtgagtcctccacagccatctgaaactgtgtgtccattaaacctcttttactttataaattacccagtctcaggcatatctttattagcaatgtgagaacaaactaatacagtcaatagttgggactttggtgatggctgtgtaaagggggagaatgtaggcacacacagacacacatgcacacatatgatgaaatgaataagatttacacgtacagtctgtgtgggtaacagaaaatgataaacaatagtgtctatttttctggcttagactcctgaggaattgatggtaccatatgtaggcatgagaaatcatgcctaactttgaacatatgaaagttgagatttttataacccaactgtgagatgatatcaaagatacatgaacttgtagttcagaggagaggtttatgtggccctctctgtgaaattgggaagagctaacctatttatggcacttatgaccttggaagaaaagggatcgcctggagagtgtacactgaaactgagaagtattgagcttaggcataggatctattggtacatgtacattctggagttgcttagagaaagaaaagtaagcaaagaagacaacatgtgacccatgatgtaagaagagaactatgagtatgcgcagttgaagccaagagaagtgagtgttacaagtaagagaaataacctgtgcagaggagtgatattgagagttttcaacatggaggtcaacctttcatcagagaacttcagtggagcattggaaatgcaagccaaatcagagtgaattgatagtgaattgaagctgatgtgtggagaaggggaattgggggagaaagcatgtaaatataatacaaagaagttaggctctgaagggaaggataaaaatgaagacaataaccagaagtggtagataaagagaatattgcatttttagatgagagatattagcatatgcctgaatgtttattggaattctgcaccacaacattttcttttttcacctcctcattatatgggaaatacttgcctctttctgggattgagtgccatttgtaatgtgttgcaaagtcaagaaacatcacatatttgtagaacaataatcactgaaattcagttaagaggttctcatcttggtagtttaataggtttgatagtcatagagatgatttattctgaaatcaaactgctgacagcttctttcttcttcagtccttcttcacctgcagaaattcaaagacttcttcagatgcatccaaatgaaaagggaatgattcaccatctaagtcgaaaacgtaaagaaagaggcacaaaggggtaaaaatggggaaaggacatggggaggaggctaaagagaaaaagaatatttattcttaatgcatctggcttctttcactccacataaggtcttgaaatttatccttgttgtttatctgtagtttgttcccttaaattgttgtatagaatgaataccacaattttttatttagctatcctcctctcgatagacatgtagtttgtttacatttgaagcctgttataaatcatgatgctgtgagcttttctcatacatctcttggtggacatatgcgtatattttccttgagtacatacccaggattggaattgtggagtgctagggtaggtgtatgttaagctttaggagatactgacagagttttccaaagtacttgttccaattctaggaatacggagagtttcatttctccacagtcttgcccaccgttggtgttaccattttttaaaaaaatttagctatcaccctgactgtgagtgatatctcattgtggttttaacttttgctttattgaaattcatgtttatttaaaagctccctaggtaattatactatgcatgtgggtttgaaaccagtgttttaaccatagcatcaaaaagtcaaactgcacttagaggtgtgtttaagcatttgagctggaaggataggaagtgtaagaaactggaaggagatagcacaatttgggcgcgccaaaagactggaaggctgcagtggaaaagaggaagaactaatgagagatgaactcgaggccaagatcattgagaatgttgaagtcacaacattaatgtcaaagcttggatggtgaagggaagaatcaatctgagccgtaatttagactgttcaacgttgagaaaagcatggtttgagttgggttctttattcccaggagtctatcaagatttcatcaagaggaggagagaaagatcaagagcaagggatttttaataaaagaaagcagaaataaattggagctgagacagttaccctaaccttaggtatgcaaggagctaaagaaaagtcctccagctgtgagggcttcatggagagtgagtttccaagtacacattcagctttcagtgaaatgaagaagatgaaaagaggagataagggcatttgctgaaagcaggttagaaatcccaaaaagcagtgggaagaaagtgagtgagggtggtgggtggactgagtcatgcaaaggttaggacagataacatgcttccggatgtcctggctatgggggagtagagggggatctgtgcatctgacagtgtcgcagtcagtggaaggcattgcactgtgggcttcgttctaacgctccttccttgagggtggctttctagtctcagtagtgtattttctgaggctttcctcgtcatgtggagatgttccctaaagctcgtttgggacatatgacagagattgggaaatgatttccttggaagaaaaaaaaattaagactttatggacacgtgcattttagaaatgctaaacacctaataaatttcatccttaaacattctttggaatgtcaagtggttaaaaagcatatccaattttaattttgcttgaccccaaattttccaagatatttgatttcagaacacgttgaaggataatggcttccactgaactctctatgaaaaacattgacctaatatatttattcttgatcttaaattacctacttgacactcttctccacatcactccaatccatatagcttgattcctttgaccacactcaaggcatagttcctacatttccaacagcaaaaacctaaggagaacaacttcaaaatccagcattcctctgtaataactctaaatctatactctaacccaagctcagtaactgagctcctaccttgaccttgtgagtgtgtctagtttgcaaaattccaagtgtcctctctttcctatttgatgctttgatttcacagcaaatcttttattccagcccatccaaacactaataccacaccatgttcatgtcagttcttctggatggcaactttgtctttcttcctgcttccctcataattgtgaattttcacagtttttcttttatttgttttcctgatatagtcgtcactatatcttactagataaagaatctacactattttcatacagcctttctgcctgacttagtttcctctcctcttccgtagttgatttcacatgagtacttgcttgcatggtgcacaggtctgttccatgttacctcctgaactaacctgcaatcctggtcctgtgcatccaatgtgaatggtagctggctgcttattttagaactgagaaccacaattaactaagagcaggctaataagagtaattaggtgaaaaacgatatatcccattccgagtttcatgagatttactaatcataaaaaagaaagtcggaggtgatattggttttactcttttcacttttctttatttgggggggttgggggctcagtgaaaatatgagataaatgctcttaacagatgctgtgctgacacataggtttctcttgtcaatgatatttacctggattaccttcattcaatttggatatttcttagcaaaaattctgaagaaatcactttctaccatttatacacacacttatgagtttgacataaactggcatttcatgctgttctgtgagtgtcagaattctgacaccaaaacccaaaatcccccattcttaaatcatgactgccttatcatccttgacaaaattgaaagcaagaaacaaattttggatctaaggtatgaaactaacatgacatatttgacctttgcaaagtggatgtgatgtgcagacagtaaagggatgtagcaaagctttagagtctagtaccttgacaataactaggcaaaatgacattgcccatacattctccagatattgataagaatctgtgtataagtgaatatttagttcttgctcataatgaaatatgttaataccaaataataattgcttattttcaaaatcatctcaacattaatgaaaatatttttaaaatagtcacccacattgatttatcttacttcccttctgatgttaattcatatgagtcagttcagctcaatacagcttcacccatgtggtccttaaattccacctaaatatcgctcaggcagaacgtagcttggaggctattaatagcttatatgccagtgcagatcctggtgtcacccccacaccacacaggtaagtacccagaattactaacccctggagtgctgcaatgagaaacaatagtttctactccttgggaagacaacctgcctatttgaccctttattccatgtcttgggtgaaacgaagccgtagtatataacagtttaacatgctggcgttgtattaatacttgaatgtgttagctctaccattcactaggtatgtaacctttgaaaaaattatttatcttctttaagactcaattttgtagccgggcgcagtggctcacacctgcaatcccagcactttaggaggctgaggcgggcagaccacgaggtcaggagatcaagaccatcctggctaacacggtgaaaccccgtctctactaaaaaaatacaaaaaaaaaaaattagccgggcattctggcgggcacctgtagccccagctacttgggaggctgaggcaggagaatggcgtgaacctaggaggcagagcttgcagtgagtcaaaattgtgccactgcactccagcctgggcaacagagcaagactccatctcaaaaaaaaaaaaaaaataagactccattttgcaatggctgccatcccagtttgtatatgaacatgtcacttctcttacacctcctaagtagctcccctttacctaaagaataagtgccatccttgtggtagggtacacagggctcttcataatatggttcctgcctttccaatccacactcagactccagctaggcccaatctctaaccatgacttgctgtgcaaacttgaatacatttctggcctctctgaactccagtttccatatccataaaacagatattttaatactgtatacctaccatagatattatgctcaaaataaagcctggttcacataaattctcagaaaatattagttatgattatcattagtactcaattatttttattctttttgttatcctttcatagttatggcagaccttgtccaaacatgactgtggacaaacacagatggaaaatatctaggtcctaacaatgcagaaacaggtaatgcatgactatgtacgaatttcaggaaaaaaacatgaaaattaggcccaagaatgtggcttgataaagagtagcattactggtttacatggaagcacgaaccatttccaggcaacagtatggtttttatgggactgagaaggccagagcctgggaccccctttgccaaaggctcctaggaccatgtggatatctcacttgtcaagtgctgctggctgccactgtcaaccaacgagaattaccagggagaccttgagaagcaatgcttgcgcagctctccaagctctatcacatccttgagatgcctaatgaagcttgtgagcaaaatccatcactgtccttgaggtgcattttcatccacgaacccagcctgataacttggatgtgcctccccatgcctttgctgctccacctgcctgaaagtccagttcccctgtgacctgctctttttcatctaaaaccctgccatcctttatttttccaacaactaaacttaatagcaaacttcagtgaaatctatcgatcgtaaagctgggtaaagcagtgatgtgataagatatcctcctgctgttcatttttaaatctgtttagaaaatgcatttaagcagtttgctgtccctgaaaaaaataattctttaaaaggcttagttctaactgcatttgtgagacagctctcccagccccttactcccaggctcagatcaagaattgctgtttataacactaatcgcaaggactctttccttccagacccttggatctaagtatcctttggagctttcagctgtaagcatagacttcttcctattcttctctttgctgacataagataatatgaactgatctgagaggaatatgttattgttttctgttctattgtgaatgttaattagaaaaaataatgatatcttttctcttctgcttctcattacattttctgcaacatggaaacaggaactcttactccgggattcaaacagtgccaggcccattgtaagttgaacaaaaaactcactattaatgaataaatggatgaatacatgaatgatgttgtttttctgtcttctttgccttaatgtaggtgagcaaaaaaaaaaaaacattagaaatgatagtgtctaaatgtagatatgaggtgcctacatttctttctttgtaactgtattttaatctaaatgttttttccactcctaaataaagttttctgccatattcgcagctggctaaaggagattttgcacaaatggttgtatatgcatgtttaacttgagctaagacgtcaatattcatacagctccacctcattaaatccaccttccaagtgacttgaactgtgtaagatgtattttttgagggtctccaaattgtgccagtgtcagcaatcaagcacctgttagtcatcatgggcccagttcacctctctgagctattgctcaccgttctgacaggcaaggtttctgacaggcaagctgaaggtgacaaggatgggtgttttgagagtggaatgcagcagggcactcacctctgccagattgcgtgcacgaggctctgaggatgtgaggtcacactgccaacagccatgatggatgtgtgggccgcagtgcccttaattgggtgcacatgctctggcatcgctgttccccgattaccactgtgtgggccgatcagcactaggctggagcacagcactttcaggggaagaacatatgggaagtacagatgttcaaagggtggcttcaccccttgtgcagccagaaaccctccttcaagaattaccataccctatgttgagcaagaatatgcaggaaggttccaaataaaagtgccatctgaggaagaatctgatcattttcttttcagggactccctacttggtgttcctattagacaccatgaccttaaaagttgttgtcattgaaacacacaaacacagtctttctatgaagaaaagaaaagatttcaatactattgcataccagagataatcatcaaaggttcccccatagcaagtagagttgaagcaatccacatgttaccaggtcacataatttatcaatatatattattacattattcattacctattcatgtattaattaaacaagcttatgaagcatttacaatagaccaaaaatagtaaagggataatagacgtaggcacagagtaaaatgaagactaaaagaagaaattcattcacttacaaaggacacaatgtggcatagtgaaatgtaaattagatgacagctaaataattagtcccaattcttccaagaattagctgtgctccctgggcctcagttttttcactcagagctaatcatattcaactaaatgattacaaatgtcctttccagccctaaaacgttatgaatttatatcctttatctttcttatcatgtagtcaatgtattcacccacttgtgagttttgtgaatctcatcacctaatctgggccaagcctagttctaggtggtgaagatactcttgccataagacacctgagcttacattccggtgcagcaagctgaattttcaaatacaagtcaacaacacagattcaaggagtcattaaaacagtgaataaaagtaaaacaaggaaattgaatagagagcaactgttaattaatttcacgagggtggtcaagtagatggagctatcacattttagtaggaaggtaccaaccatacacatgaacactaataaattaagataatttataacagcagtatgtctcaataagtctttttttaaaaggggtggaaccatagctcatgttagatatgagttaccttcaaatattctccatgtatcttttctatactgtgatctgtgttgaaagagaaggtccaatttggaacatgccactcatggggtgaaaaaatggcaagttaagctgaatcacattcttacatttaaagtttctgctttgatgggatgggtgtcaccatcttttgtcggtcaaaccaaggtgaatatactactcctcccttcagaaggaggacgtgaagtgtatatttgtctgcagtaataaatactataacaaatcttaaaaatcttaattttccatgcaccttaagctgattttactaacatttcaacagatttgtcaaacaccttttgactgtgcttaatagacaaatttattagattgtgtgttaatctctttggctttcccctggagctcttcttcccagatgtttcttgagtatgtcaacccaaatagttgttgacaactaggatatcctgtcaacactttttgtgttcgcttaggatccttggatcccatgtcttcttttaagaaaatctcgtgtcaaaagttcatcatacaggttataggatatgttacattttatttttacaactgcaattggaaaatatttgaactatccttagtatatccaaatgtatgttatacacatagatagaatattgtatttaggagtggaaaaggaaattacagataattaaaaccaggtgtttttaaaagaaatttattaagttgaaacttctttttacatatagcttatctaaaatgtctctctgggtcacattttttatgttttttgtatctaattattctaccaaaatattagtttcttgctatgctggaagtattatcagctagattaaaatgtctaaagttgttacgatatgtttcctgtttgacagcatgataaaatatttttccatgaaaaaatatctacaattatactctttcagtatagatattctcgattaaaatttacaaaatatttttattgccttccttaattgattataattattctaaactaacaaaaatattaactgtctgtttcttaaatagtttgtgtaagcaatcagcaaagtccatagactagatcttacctcctaaggagcacatgaactcaagttggcacttgttaaaagagcggatatgtcattaaaataagtttactttttagtgaataaattttctaagaatgacaattaccagattatttacaccaattattatgaaatggtttcttttagatcctccataaaagggaagcaattaaaaattgctttagaattcagtcgtagattacatttagaaaataatcaccaactagtttaatattgcaaagttataagaatgtaagaaatcattacttgaaattgaaaactgcataattaggtttcaaatatttgaaatactgtcttcctaaattaatgatacttaacttatatatttgtgtctttgcttatattgaatttctgaacataatgaatcatcaaaagtatgggattaggaaaatattacctggtaaaccagttagcacgttttgaatagttaggagaattttcctttccctcatatagcccaagaactcccggttaatgccttcagttctttccaaggtcttttcatcctttgtctcagtaactttttctttcttaccactgaccactttaaagtaggggaatagaacaatgggtgtggagagaggcaatgtgttctggctctgagagtccctgaacaagagttcttacaggaaatgacaagcattcaagccctgacatctctatactaggccattctcagggctttgtttgcagcaagcaaccttaagggatgagaaaacgtctccctttgggaactagttcaaccattgtggaagtcaatgtggtgtttcctcagggatctagaactagaaataccatttgacccagccatcccattactgggtatatacccaaaggattataattcacactgctataaagacacatgcacacatatgtttattgcagcactactcacaatagcaaagacttggaaccaacccacatgtccaaaaatgatagactggattaagaaaatgtggcacatatacaccatggaatactatgcagccataaaaaaggatgagttcatgtcctttgtagggacatggatgaagctggaaaccatcattctcagcaaactatcacaaggacagaaaaccaaacaccgcacgttctcactcataggtgggaattgaacaatgagaacacttggacataggaaggggaacatgacacaccggggcctgttgtggggtggggggaggggggagggatagcattaggagatatacctaattaatgtaaatgacgagttaatgggtgcagcacaccaacatggcacatgtatacataggtaacaaacctacacactgtgcacatgtacccgaaaacttaaagtattaaaaaaaaaaaaaaaaagtctccctttgggaaaaagagcaagcttgtattcttgactttgggacctgtaggtagtcaacattctgggttcttacattcttctaaagagggttgttttgtttttgttgttttagcaggcattaattaataatgtacctaatttcaaactgaaaaatctgtctcctgggcaatggctggagctcaaatttcagtttagtttttagccttggctggattgcttcgatactccaccatagtagaaggtacagggatcagccagaaatttgggtagagtttatacaaaagatatgggtttcctccctgccttctggatctttcctttctgggatttcttccacacatttctactggctatgattgacccaatcgttgttccctagttcttcaagccaccaaaaatgagaaatgttatcaaatgttagccagctactataatctgaatgtatccccccaaactcatgtgttgaaattaaatagtgtgatagtattaagaggggggaacatttcagaggtgattaagtcatgaaggcggaactctcatagataggattagagcccctacaaatagggcttaagacaaactaacacaggaacagaaaaccaaacaccacatgttctcactcataagtgggagtagaacaatgagaacacatggacacagggaggagaacatcacacaccggggcctgttgggggtgcggggctaaggaagggatagcactaggagaaatacctaatgtacatgagggattgatgggtccagcaaaccaccatggcatgtgtatacctaagtaacaaacctgcacgttctgcacatgtatcccagaacttacagtatataaaaaaaaaaaacaggaaaaaattaaaaataaataaataaaagggcttgagagactggattcattctgtcctgctcttctgttgagaactcagtgctctttccttttttgcccttctacatcttgccatgtgaggataccatttcaccccttctgccatgtgaggacagaggaagaggaccctcataagacaccaaatgccagtgccttgctcaatgacttcccattctccaaaagtgagacagataaatttctatcatttataaactacccagtctcaactattttggtataacagcacaatcagactaagacaccaccctacaagttgttcaagttaaagccgtaacaatggaaatttcacacaaagctattttcatcctccaggtttgactcctgcccagtatctagctgatttttgtggcttgccaaagctttagataattttcatattttccaaagtttattatctatgaaagaattagaccagtagcagatactctgctgcaccagaactggaatatctactcttcaactttagttgaaagagtaaaaattttaaacattcttgctgtaacctctccctaaacatcctatagtcttacttttcatatgtgatcatttcacccctttataagaactactctcactttaaaagcattaagtttttattatagttaatgaaaaggttagcttcttacagcaataataaaaaatagaatgaccttctcaaccaagtaatgacacaaccattatgcaacttaagcttataaataaaacctgaaaataaagcctcttcttctattaaaataatatcatatactttttaaaattaaaatttaagacttataaccaaactactaactaaagtaggttttcgtctgtctgtacatttctagaaaaagaggcccaccacttccatttcaccattcctatgcaataacgatatttaggacttgaaactactacaaatagaaatagtcaagtagtcatttgaacatatctgtatccattacgcacacacagctatttcacttactttgggaaaatcagcccatctgaataataaacttagcttgaaaaataacattttgatttaaaaatagaacatttgcaacctaacactttcatatgattttaaaagaggagcatcagataaagcagttattttgagaataaattgaaaaatacatactttgttttataaactagtactacaagctgaattatcaagatggatttgttaaaccctttttacagtcttacgtatagtaaaatatcactacatatgattaatcgatttggctccttttagtaaagatatagaactatgaaatgtattcaaagatatgcagttctaactttttaaagcatagttaaaatagacctaagctaacaaagtactgcctagtaggagttctcagaaagatactaaaaagaatgtcaattgtgtttaaaatggtactcacagtgtacctgaggatgacttgaagccatttaatatatttcccatatttcacatacatctttggtttgcctagtaaaatcctgcctttagagaataaatcaaaagtaaacttttttctggctcagcattaatgaagttccacggtgctatgtatgatttcccactagttcgatagacttcattttctttggaactttctaattgaaaaacagagtccagagaaattgactatagtatattaacaataaaaattgtgatgtgccaatgaacataagcacatttaatatgcatcactggtccccatccaggaatgtgattggttaatgattacttatattgttcttctattgggatgatttttgcatagcttttaaaaaggtggtctacatgaccatttcttacatggagaaaaagttatattacaaagaaaacaacaatattaaagtgagacaaaataattcagaaactcgactaacaaatcatttggcaataatttaagttttattacagtgaaaggatggcccaacttattcctttatgaccaccaatgatttttaaaaatctctttcaaagtgcagatctctttaatgcacttcaacttttgccacagctatactgtcttcattattctgaaatgactttgaatattgcttttccaaagatttaaattatttttacacccatagtgcttcacagaagaccagtgaaccagaatgcatgactggttattactgtcataatttgaaagacatccagaacaagacttaagtgaagtcatgggatagttctacttgaaattgagttattagtacttttaaaatttaacttactatagtttcttcataagaagaattttcactgcttcatttttcttaggtcatttcatgcctaaggcttacagtcgagtgttgccctgagtcaaggtttgtatttctctacacatcacacacaaaaatggttatcttattttctgttattccgatattttattctggtattgtataataagctaggccttcaactatgactcaacttttctatatttcaggatatttcttttgggtttctttcagtgctagtgttccgcaaatgtttctcacttcagaagttcttgtctctttcttcattttattcctgggtgattttatttatggccatgacatgacccatactgtacttctgtgctccaaactcttgcatctgaatacttccgggacataactatctatatttctcagaagcacaaagccacaaacatatgaagcagaattcatcacttaccaccctaggtctctagcatgccatatcactatgaatgacatcatcattttttgtcactcaaccctacaatttatctactctaacattttccctctcctatccccgcacatatattatacacaactgaaatcgatccagtagtcccataggtagttttctagacaaacaaagaaattaaaccttctggacttagagcttcaaccttgtatttattttatctgagttccttcctcaagaacaaacctccaggcctctcaaaaaaaaaaaaaaaaaaaaaaaaaagtctgagtttcagtggaagaactgaagtttcagccaaagaactgaaactcaccagatcaccacattcagacaatcaagatgctggacctctcattcctcataattgcttctttgtccctccctagttgctgttctcacacattgttacatttcttccctgctctataaacccctagtttggggggatcagtgagatagatttgaaactgagctcccatctcctgcagggcccgattaaatccttcttccttggcaatactcatagtctcagttactggctttctgtgtagagagagcaggatctagaccaaacccctggcgtttcggttggctctttggtgccaattttcattactatgtctacttgacatcagttgcggtttacaccatcttcattttttcctgtgtcatttccagagcctccatcccaagtctccaggcttcattttgctaaactaattcaatacaacaccagcaagggagacttccaaatgcaaaaatctgatcatgtcagtcctgccaaatctggataatttccccttggtctcacttcctgccttcctgcatccatgtatcctccaacaagacggaactgcttactccaagtgagacccactccgctgtgccttgctacttgctctggactccatttcaaactccattttctcaccccttcccctgcacacatgcatttcctatgattcagtttggtattccttcctcattgtcgaggcagaattagaagattctttccatgttaaaattccttcctcttcctctgacccaggaggcctagttaggaccctatgcttactgctattatatctatggcatcacttatcacatggtattgtaattattattattattattattattattattattattattattattttgagtcaaggtctggctctactgcctaggctggagtgcagtggcaggatctcggctcactgcaatctccacctcctaggctcaagccaacctcctacctcagcctcttgagtagatgggagtacaggggtgcacccagctaacgtttttgtattttcggtagagacagggttttgccattttgcccaggctggtctcaaactcatgagctcaagcaatccatctgcctcagtctcccaaagtcctgggatcacaggtatacacactcagatggtattgtaattcttgagtcacttatccaattctctgaataagccatagatgtctggaggtcacgatatctatttttataaacccatgacttgctagcacttagcacgtggtagggccttaatatgaagtgcagtaatatatttttgaatgattgaaattttgtttcacatatttctgtgaaataggtgaaatatgtgaaatttcacgtcttcctttttaaatcttaagttaattacaaactgttagtgactttattctagtattcatattaatggccttagaagtccaccttgggccgggcgcggtggctcacgcctgtaatcccagcactttgggaggccgaggcgggtggatcatgaggtcaggagatcgagaccatcctggctaacaaggtgaaaccccgtctctaccaaaaatacaaaaaattagccgggcgcggtggcgggcgcctgtagtcccagctactggggaggctgaggcaggagaatggcgtgaacccgggaagcggagcttgccgtgagccgagattgcgccactgcagtccgcagtccggcctgggcgacagagcgagactccgtctccaaaaaaaaaaaaaaaaaaagaagtccaccttacttttcactcttttgttacttctgagttattttcaaggctctcatttcccttctgtggtatattataataactgttccaatagtctaattctaatgttttatttttaaatctgtaaagataatgcacttcaaaaagctttatatttaaatttttattttcgggtttatctttcactttctattttttaagattttcatagtcaacttttataattctttctgctttatttgtatctcctgacatactaacattttcttcaactcaaaacatcctaccagtgtattcaattacctccacttcttccattttaaaatattctttttacattgactatatcgcttttttctttccttcttttgagaatgtgcatcactaggcttttagaccagctgatttccatttcataactctcgaattctgccacctagtctcttactaagatttttattcacagaaaagttgacactaagcccaatacattatcatggagaagtattatagttggaaagcaagaggatttcactgtatctaaagtatggcctgaactgacaagcaaatacaatctctctcaaaagtaatacctttatacatatcatctgtattcactgagatttgcataagataggaatagttaatatctagggaaataaaaccttcttagatattgaaataaacatgaactatatatgaatacgcggtcatacacatcacaattaaacttttaaaatacctatgtagatgattgtgtgtaaatgtttataattttttaactgaaattatatctgtttaaaatttccaattttgtataatctccagtcatttatttccatataggatcctctttcatcacaaaacccatatcctccggcttgcctacacactccaccaaccctgcacactacacccaccctgcacacactgtactcacagtggttactttttaaatatgcatacagaattttttaatctaactgtcttcaatttcacaattggtctaaaaagccatgtgttttagaactagaagaaattattttattcaaccttctgttttcaggtacgtaaatcttattatccctactgtactgataaacctaccatagataagttaagtgactttacagaggttattcaatgtgtattaggactgggtgtcccaggagttagggctcttaatcctattccctagcgcccttggcaatgcttatataagtatccattattgctatgcattgatgttgccaaatcatcttttaaaactttttatatttgtaccacttcttagtgttgtcaatttgataaaataattccacattattttctttgattacccttatattaacctctatctacctcaaaactcattcattttttctttcatctataaatatctattagctgcctattctatgccatgcactgtgcaagatacagaaattaaaggtgagccatcatcacagagctcacagtctaatgaaagataaaaataatcaagcaatgcaatttgaaaagcatgcccattcctcctgtgccaatatataggaacacattagacaggtaatgggaagaataaaaatgaccaaaataagatgtaaaagatgatttagaaaagccatgttaattatgaaaattatgttctcggcacagagtaccatgcaaaaggccatggtacatctttgtgactaaaagtagtttagagtggttgggtcataggacatacgagcagtgccgtaaaagatgccactagaggtctgaacagaaatcaaatcttcatgaactttgaaactcttataaggaaagttggattttattctaaagaaaataaggagtagaggattaacttctcattctaacgtaccattttgtggtaagtcagccttccaacatcattgtgatactcatcctttgtttctgatttccattctaaagagacttgtttttatgatcatcaccctgcttagaagttttccaattcaatatctcttttcagtgaggcccacactgtaacccactggtaagcatttagaatttagagttgaaatatgtaatcattatcacatttattgagcagagcacttaaccatgtcagggattgggctaaattcatttgtcatcctgacttgtaactatgaaaacctgtgatataatcctctttatctccaaattacagatgagaattttgatgttcacagaagttcaataagttgccaaaaaaatatcaaacagctagtaaattttaatgtcagttttacatccatgcttgcatactcaaactttccttacacataacacatccttgcaaagaatactggaaatccaatatgtgaagcttgaaaacaataagtggatgttttaaagaagaaagtatctatttgcaaaaatcttcaaagatacattaagaccatttaagacatttccctaatttaataaattctctcatttaaaaaatgtcctcagcaatatacacagtcaacccaattaaacccagcaaaccacagagtctaaatatttgttgatttatttgagtccaacatttctgtatagtattaagtttatgtggtctgtgcttctactactaatgttagcacttccatttttctgttttacatttattctttaaaaacagtaagaacagaatacaacaaaagctgatcgccaaaaaatactccctactggacaaaaacgggctactgctgaagttaaagtattggctgacagacggcaccaatattccagaatgttctttcatttaataatcaaagtctttattctttttacctaaattcaatggatagattttactccaaaatttatgacaatacagaggtttttttggggttttgttgtttcttgtttgttttgttttttggtagagacagggtcttgttatgatgcccaggttggtctcaaactcttggcctcaagtgatcctcctgcctcagtctcccaaagtgctaggattacaggcatgagccaccaggcctacccacaatgcaaagttttgaaagtgtattggtcaaagtctagaattgcttattatttacaagcttattgtgaatattgcaaaaaaatgcatgtaagggttgtattttccaagtgagtatacctcaagattttcaagatcttatagcagtggaatttgctttcatttttttcctgattttcacgttaacaccacccagcagtatactggcccaatatgtttgggaagagcaacctccaggttccatttctgaattccccacttttaattcactctgacagttctgatcatggtagcctaaaagcactatcttacttttgcttaccgcatatgactttattccaaacttacagtcttctccatttattgtgatcatcttggcatataattaacagaaagcacttaatatcccagagaactcatttctcacacaatattctagattactcatacaaaatgcaatacattacttaaaaatgcaatacatctttgactttctacttttcttatttcttagctgctttaatacctgtgctcttttctttatgagagaagtgtgtgtatgcatatctgtttcattttatatatctattaggcacagacacacacacaaagacacacacacacacacaaacctgcaagaaaaaaagaaagataaagtaatttaggcaaataagtatgttgtttttggtgttaagattccctgcctgatcaaaattattagcattcaataaaaattcttccagtgtgaaacattttccttcttgtgctacatgtcattcctgcactaactagccaatgaaagatacctcaaattctgatgattatattagttattctcagcaagcttcaaagtactcctctgatcatcataattagaattttgggagcactgcaatacataaataattgcattcagaaaattataaacactaaattcggtttcattttaccatgagagctcatttttaaggttcatcttctctaaaggctttcctacatataaaagcaactggaaaatttatatatacatgcttgtttcattgttctgcaactgataatatgcaactgacacttttggtaggtacagcattttccgtaacagcaaagcatttatccacataaaatgaaaatcaatatataataattgactgggacttgattttaaggtaatagactaagtccctctaacaatgaatatcttagcactcagaggaaagaatgtaacgagtaagaattgcatagggcccatgggccttccagaaagactttgaaatcctctagcttgcatatgaaaatttattgcaaatggatttttacagcacagggatgttacttaaagagcaattcaaggctcagtgtgatatttagatttaacattttacaagctttacagttaacttcttttaactccttggaaatacaaacaggatatagtcttctagttgaatgagtgtattagcttcttattatttatggttttagagaacaacttagtagcatagtagaaaaagcataggatttgctatagaaacactgaggtgttcatctcggatctgccacttagccagaagtcctcagacaatttattagagtgctcagttaagtggagaaataatctcttagtaggggtgagatgataatgtgaacattactaagtaggtgctcaataatgttaggcaacttcccaagctagtaatacctaagaagaaatctgacttctcatgaatgctgttttatttttcaagggaaagagaaacatttttttagaaaaacttgatttgttaagcaataataacttaaagttccctatttaatttatagtctttagtaatgtggcttaggctttataatgtttaagtaattagaggagcaacttgatgaaatcagcttatcataaaatatgaaaagagcatattcctccagttaggtttacaggaaaagactgtgtgtttgttgtttaatctgaacaattagcatatatttccataaatctttcaaataattagctagatttctttgataaatccttaataataactcataagaaaggagcaagactggactttggaaaacctatgttctactcacaagtcttcaatttattatgcatgtcatactagacacatacttaaagtttcctgtgtaatttgattcaaatatttgtcctgcctacttcacagggctatgccaataaggatcaaataaaacattagaaatattctttaccctagtctgaaaggactatgcaaccattctcatcttacccattcatgacatttctttgaattcagaaaaatcaacattctaaaattcacaatatagacaacttctgaaatgtaatggtgtaatttttgtttgggtaccaacctcaaagttaaaataaagaccagcttttgtaaccttctgggagtagcataatcagatgggtagtcgggtatgacctgagtgactcttcccacaaaaaaaagcttaggaagatggtagaagaggggaatataaagaaggagaagtgactgaaacagaggtgagttcgctgaagactccatctcatctgggcctcccacaggacaaacagtggggaactataatagtcagaggcagacaacttctttccggaaacttgtctgggacagcctcatgactgggaacgacttgcacccagctccacggatctctactgccttgcattggccccagcatcggaagtctgcttgtatcttctcggttttcataacccattcaaagtctgttcctccttcctcaacaactgaactggctgcaggtgaagtactctccatcttcctggtctttattttctaggcaacctctcaatgctgcacatgtctcgtccccagtaaaggaagggaattcagattagatctatagactggccacctaggaagtgtgcctttaggtacaaaactccttcatgcagaactcacatcttgtcaaggtggacgtaagtctttaaaaaaactaaaatttacagttgaaattatatatccatggtgtggtttgaagagtacacaaaatagcaacatcaacaaaaaaccccagcacatcccatcagatttctttggaactccaaattcctcccattaatttcatcctagtggttaaagcattttttctacaaacacgttaaaaagctttcatactgccttaaatataaagcccatcaacccaacctgacctgtcctataacctattgccacatatcaatgttgttgcttttctagctaagctgtgtagaaattggatatagaacattaaatttgggacagaggccaggaatttatgacatggttttaaccagaaaggtcaagattaagtaaggagtcacaatgggagttttgaaaaatagaaaacctaggcctccaaagggaaaagtgaggaagctttgcaatacatttcatacacttgataattttgctaaaataattggtgtaatggagatgattcaaatctcagagcatgaaattatcgtattttagtccaaacccccaaatgcaaaactgatttctagagagcaacatacgactcttagaaggatgttctctctagggtccagaaagagtcttacatctttgcttgcaatgattgtccacagagatgcagcttgtctcatgctgctgggagtgattttaggaagcattagagtgttaaatgcattaggctaagaactgctgaacagaagacttgttttaagggcagagacatgttcggtttcctgtatactgatcacagctcatgtcagcatgggcttcatgtgtagatcacaaatactaaaggccagtgctgcaaagctgaccaggcagtggaggaagggagctgcaatcatgctgtgtcatggtgggatcccttttggtgctgttatttttcactcagagaagtgatcttttatactgttttaataatcatatcttcacaactgctgataacaaactaaaaatattgcttggctaaaatttcatttcctagtgctatcctaattttattttccgagttgctgagtgaagaggaaagagagaggatgggggagagagagaatgaatcacatcactcacaaatcctgagtaacaattcacaataaattaatacataagattaatgaaaatgcaagtcatgatgcttacatttatgtgtcagcctggctaggctacggtgcccagatgcttggccaaacaccagcatagatgttactgagaaggtatttttagatgtgattaacattttaatctgtaaatatccaggaaagcaactgctctccataatgtgggtgggccttattcaatcagttgaaggctaaggtaaggactgaagatcaaagaatatgacctcaagactgcaacatagaaactctgcctgagcttccagccttgctagcttacccttgaccctgctgtcctaaaatgtggactagctggcccccacaactgtttgagccaattctttaaaatacacctgtcttctccctctgagaatgagagttttgtaactgaaaaagatgcctagcataactaactacatattgctctaattcccccaccatgtggtggtatgttttacatcaacagcctctgtatgtgcttatctctgcacataggccaacctaactatgggaagaatttagtttctagtttaactttaaagcaaggatgataatagtcccttcccaaaactaactcacaagaaaatagggtgtacacaaaagtaacacgagtaacgatgttatgtgcaagatttataggagcattgtggcctaaggacaaagaagtttcacaaccccccatccaaccgtcactgactcccagatgtctgtgaccatcagccacttgctgacctcaatcctttcctctcccccttctcataacataaaaggagcctaaacttctactaacttaagatgattctttaggacgttagtccaaaatcttctcagtctactggctctccgaaaaaaagtcaccttcctcatcccaacaccttgtctctcaaattactggctgtcgtgcagctggcagtatgagctttgaattctgttacagttacaactcattatcatctttaaaacagacttttacaatgggctcctgactgctgtaggagtctcttgcctccaccccattagtttattctccttagtcttttaaagtaaaaattttaaaagcgccccattcataaatttatttccacattcccggatgtatacggggtacattctaagctccataatacagcatacaagccattctttgttttatacctccttgcttgctttcttctctcctctcccaccatgaaaatttacctgtcgtttattctgcagtcatagagaaatgctcacgtttcctcccgactcacgattccatttccacatccggccttttcccatgctttgtcatctattgacaatgttccttttgccctcctcctcttggaatacatattcatgcgtggaatacatagttttatctttcctaacagaattaagacatcatcttatgcagtcactcacccccagtacactgactctactgtctgggccacccctgaatctgagtacctgtgtatctctgtatctgaccctatcccttactgctatatctcagtatcctcagctagacggtgaatattcaagagcatgaattgtatccttcctctctgcatcctcagcacctaacccaaaagcttgtcacggagcatgccctaagcaagactgtgttgaatagtcaatcactttattcttttggttcagctacttgaaattaaatttcacagtagcttatgtaaataaacatctttctttatatatctcatcttcagagttcaaactatgcaaaagtatcttgttatttgttttggaatacaattagtttatgtagtagtcagacaaaaaaaaaaaatggattatcattcccgcttagggttaggtacttctagactaagaaatacacttctcagatttagagtgaatctaaataatttagacatagaatacatttaaattcccaaatggcattcatttttaaaatgccctgacattttatggggtcattttcttttaaaagcatgctgaactttaagaaggaaatgagcatgatgatcacttttgtaagtatctttttttaaagttacatggtggcatagagctaaaagaagcattgtggttccagcctaacaccctcaatttttagcaaatgaaacagttgaagcctaaggactttgagtaatgtgaccaaaggcagaaaactggttaggtggagagcctggactagaaatttgcccaagagagttctatcagatcagttactctttcattactctcctatctacctgtctattactccaggcactaacataagctacttatattttaaaaagtaattacacaaaatgcctttagtattacatgccaaagagacaaatccttctaatttttcacatatattggtaatttgagacatttttctgctatgaagtctaatttgctcaaaaaattttatgcttgcctaccaatatttttctaaagcaatttaagcatcagtgaatcactgataagtactaggcagaaatacaaatcatttgaaatatcccagaccaaaaaaaaaaacattttatggaattaccaagtattgactttttcatggaactaatatcatacagagataaaatgtcgagacataacttttggtactatgagactatagcttctaatagatacttaaaatatgaagccaggacatataatagataccttttttccttcctcacatctatgaagatgaagaaaatttaaacacattacaaaatatctgaagatattgtgagccattttttatggccattcttagaaatttttcatgacttctattttttggccagtctcagaaatttgtcaggactttttggaaagagaggattattataacaaagagagcagaaagaaagagggaagtatatgtgttagaggtgatatgggtaaacacagaggctacaaacaattgaagcgagacagagcaagggggtagcaagagaaggatgggagagagaaaaggagagaaaactgtgattgcagaaagagtttgagattaatagcaaatgcaaggaggaaaaaacaggatgaggaaatggatgtcgtggaagcagaattcacttttcttgtgtaatttcaattcagtctgaacacaccatcccttcctatccttttgtcaatgagataggcttttagctttcatttcctgttgtttaccacatcggactctaggatttggctgccttctttgtctcctgctacacccatcaccaccaccaatcccaaaccagccagaaggtagagattgctccaaggttatacctttgaacttttctgtatcctgaaagtacttgagtacactcaaggaacttaaataagtctctctcattttttttttttttttgcttccctcctttctctgcacaccgcctccctccagcattccctttttcgttactattctcttctgtctcaaagagagggaaaaaaaagagatttctttggagtgccaccactcaataacaaataccattttggcaaaaaccttcatagaatatgcttcatgtcaattgattgggactttaaaagctatgagatttgacaagttgcgcttttctacataattgcagcgtgtctcaaatagggttttaagttacgacgccaaaaggaaaatgatttgaacaacttgaaatgttagatgacttgtttggaatattcttgttggagactcactgctgtaatgaagtggattctttttttcatgaataacagaaaaagtcagaagttcactcgatattttgaagatatacttgaccaaactcgactttatcagaaataagcattacaatggcttcagtgttaagtacaattataaaaccatttaaaaatatgaatctgacaagaaataaaccaggtaaattgacctattaacattaaataaacccatgcagtaaaaataagtgcatttcatgtatttacagctgttattgcagtaatttggagtgctctgcctggcagattttctcttataaactaagaaaagtaagaacttgttgcaagaattagattagcaaaagcactagacaatccttaactttttagcatatgtaaaatttagtgtgtgttccaccatatggcagtcaatcaaagaaattgaatttttctaactgaaggagaagaaggggtttttttccttcccatttatcatttccattataactttaacctccttgtatgttgaactctaggaatagccccaaatttcattttcatgtttaacatgtatttcagagataaaacatgaaccttatcttactccctctgctgggaaaactttcaaattagtatcttcctcctatacctgcacaccaaaatttagataaaggtagacactaaacatccagcaaatctacagagatagctccatagacccatgcatctcaatagaggtacaagataaaatgtaccatatttctctttaaaaaccttttgagagatgcaggaggcagacaaatgcctaggcagataaggaagtgtccccagagaatcttcgactggtcccacaagtgtttacacgagatgtttttgtgtggataaggaacctgcacagggtcttgcttgggcatacccacactggactggaggccccatgcactgggggactgggatagagccaccaggaattcatgccttacgtgggaggaggagcctgtcctctctgggttgtgtgtggtggcctgattttcagtgtgaggtgacagcctgttggcaggaactcttctttttttttttttttttttttttttttttgcgtaatgaatccaccctcctcacctttcaatgtgttcctgtgcctaatttttcctggtcatgagacaagaacccagatttcagcgaactaagcagcaaaaaatcctgcatcaatattcccctggtatgatctgcctcagttgatggtgcacccgtaagaaacctaagagtcactctccctctctctccataccatactcagtaataacaaattctttgaatgtactctctatctcaggtcaggactccattgcctttcttgtgaaaaactggtatctttttgactggtcttctatttgcatacttactctttcaaatctagccttcacatagccatgagaaggatgtgatatctcccagatataccacaggttagattttacattttgagtccattggtgagtgcttttgtttaataggatgtttggtctgtttacaattatctccacttagtaagtgatgcacaatgtttgctcttagctctatcataggttatatgttctctgatataaatatatgtgtgtgcatgtgtgtgtatatatatacacaaatatatatatacacacatacatatatatacttatccactatatggtctttgacttatctggatttcctctgagaatttaggttcatttttgttctcatagttacatttataactataattttatatagtattctaatcctcctttctcttcagtttctctactataagcaagaatttagataacattttccttccccctcaactttatggattataccattttcttaatgtttatattaagtatcctaatatatacactgcctgatgtgtgtgtttcaaattatatctttgagccttggctttatagatccaaatccttacagagtctcccagcattgctcctccttcttcctcccaaatctagcctctaaaagatccgtaacttttacattgtcaggctttatgacttttacattcttttttgtaactatgattctcacacctgttttagtttttcctcctatatttacttgtattcactaccagtctttattaaatttattataggcaggaatgtaccccaagatttaatcaaagaccatggaaattatgttcactgattttctttttacatgttcaaaaacagcctatctgttgtctttatatctgacagtcattttggttgccttggcctaaacttcagtcctatatttttttctttgaggacttcatagacattgttccattttcttttgggtcctgactattgctattgctaactataagatgaaattattttttctggcttatagataacttgggtttcacctgtacgcttaagcaaataagtttgccttgagaatttagtaactttactaggctatatttctcaactgcaattattgtctgttaatttctcccaatatatgtttggtgcattcattttgtagattcaaaccttctatttctcaggaaaatcatcttcaaatgtattgttcaaaggttttccgatccattattttggtgattctattcagagattccaacaatgtccatcatatttatttagaattccttttaagattcagggagtccatgtgcaggctgattaaataggtatattgtgtgacactgaggtttgggcttctaatcatcctatcgcccaagtagggaacatagtacccgataggtaacttttcaatcctttcttctccccctccctctccccttttggaatccccagtgtccactgtttccatttttgggcccagcaacatacacttttgattgcctgctcttttctctttaatcctctccaacccttcatttctgttccatttcttctccagccggtcctctatttttccttcgccattttttttatcttctgtttttcttgtttgtattttctttcagcatctctgtaaagacccattttcaattatttatttgattcctggacgagatatttgcagtggaggcagagagggagtgacttctggccttgttccaggcagatattcagtgaaattttttatgacacaagatttccaatagaattttttttttagtgtctccctagccagctccttagaagctccaatactgctcacaatgcctggccactttgcatccatcctgcctcaccgaaggactctgtgggtcaatctgacctaacctacatgcactcagcgtcaaaggaagtccacggaagttcctaccaccagcctgagcatcctgcccctctccaaagagctggttggtagtgtgcgttagggactgaattgtgcacccccaacgccagcctaaaatgtatatgtcttaacctccagtaccccaaatgtgactggtttggagatggagcctttaaagaggtaattaaaaggtcattagggtgagccctaatctaatatgcttggtatctttatttatttatttattttgagacagagtcttgctctgtcaccaggctggagtgcagtggcgcaatctcagctcactgcaacctccgcctctggggttcaagcgattgtgctgcctcagcctcccaagtaacttggattacaggtgcctgtcaccatgctcagctaattttttttgtatttttagtagaatcggggtttcaccatgttggccaggctggtctcgacctcttgatctcaagatccgcccaccttggcctcccaaagtgctgggattacaggcatgagccaccgcgcctggctctggttgatgtcttgaaaggaaggagacaattcagacagacataatgcacagagggaagaccacgtgaagacacagggaggagaaggcggccacctacaagccaagcagagaggcctcagcagaagcaacgctgccaacaccttgatcttcgacctccagcctccaaaatcacaagaacataaactctgttattgaacgcagccagcgcatgctactttgtatggcaaccctagcaaactcatatagtatgcttctcaaaaggtgcttcctacttcaagacactaaatttttttaggtctatggtggctaaatcgtctttctgtgtcttccctgaaaatgaagcttttgtccaatttttgtatttccgcatttacagtgtgattttcaaatgacaaaaggagtaatgtcatttatttgcattttaaaatcagaagtctgagatgcatttttacttttaagtttttctcaattttttaaatgttttaacgttttaaatgtttttatcttaaagaaacctagtttatgacagatggctacccctacttttatcagagatgactagtggagatgcacatttttggaattggccagatccaatggcttttttttttttttaccctcaataaagcatgagaaagataaaataaagaggtgaaaaagaaggtttgaaagaacagaaaaaaatagaggtttgtaataagtattaagtagaggggaagaataaacaagtttgacacacacagtgacatttccagtaggtgttgtgtacctgtttgtaattagtgataatgaagggaatgtacacaagctgccaaattttcggatttttcttaacaacaccaatttccttaagaggagcttagaatgtgagagaaaaggcaagtaactggatttatccagggttacaggtgtgctatgcaagctcaacagagacagagatacaaaggaacagatcattgtaaggaattgatttcaaaaaaggaaaagaaaaccaaagttgaacgaggaaaaaagtaaatactaaagctgcctaatgggttgagatactataatgtcctgtacagttctttagatttgttgcttttattattcacgcttcttaactggaatgtaattttcttaagaataagaactgcgaccaacctggccaacatggtgaaaccccgcctctactaaaaatacaaaaattagctgggcatgatcgcggccacctgtaatctcagctactggggaggctgaggcaggagaatcgcttgaacccaggaggcagagtttgcagtgagccgagatcgtgacaatgcaccccagcctgggcaacatagcgagactctgtctcaaaaaaaaataaataaataaaaataagaacttcttgttaaatattttatatatttgatagagacaaagtagtttagtttatttggaatccttccctcaggcagcatggtctatattaggtactcaataaacacatgttggttaattaacagatacatatatatatatacacacatatacacacacacatatatatgtgtgtgtgtatatctctaagtgtgtgtgtgtgtataaaactgttaagagagagaaatgggggagggtggtggagggaatttccaaaacactgagttacagaaattacaaaatccatgcaaaggtcagaaagactgagatctcttttttcattcttgtacactgggacacatggcatagaatataaaaacgtccagtgcagaggcatggcaggttgaactggaagcaggaatgacatttcaatacttatttgtctgcaatttacatctattatccctgagaggacctttgttactttgaggttgttttccttcctaccttcttattaagtcaatatgacctaaagaaccattaatggagctataattgaataaagcaacagttctttcattattgctcagttgacttcctgtcatatctaaaaatgaccttactttgaaaggctgacttcgaagactgtttacgtacaaaaggttcacttagacagtattcaattttctagcatttttttttctaaactgcagatcaaagcactagatttcacagtctgattttaccttctttattcattgaatttactacagacaaatttctgcatgaaaacaggaatgctcatgtatctatagcttatgaactaatagtcgtgttcaaatgaaatatctaccagtacaaggagatagatcttaacacaaacagaataacacaaaatagactgacagatgcccaaggaaattggaattgtaaaatgaaactaagagacctacagattataaacattcatatcaatttcccacctttctctggttaattacaaatctattaatttcccatgtttttaataaaagttaaaacaaattataaaccttataatcaatgtagaaatagcatataaacagatcatctctccttagaataacggtatcaccgatttcaacacatataattcatatagcctaaacttttttcattaaacaaaatatctaaggtaaattatttgccaaattaaaaatttcctttaattctcctaaaatggcctctataaacatgggaatctagttaacatatgtgtttactgctttattaaagtaataacttttttgctatttctatatatgagaaattaattcaatgttgttattattattagagacagtatctcattgtcacctaggctggagtccagtggttctatcacagctcactgcagccttgacctcccaggctcaagcaatcctcccacctcagcctccagagtagctgaggccacaggcatgtgctttcatgtccagctaattgttttggcgtctgctgttttttgggttttttgttgttgttgttttgtcttgttttgttttgagatggggtctccctacgttccccaggctggtctctagctcttgggctcaaacagtcttcccacctcattgctggggttacaggtataagccactgcacctggccaagaacttgattgttttaaaaagttaaattcttccccatgtttcatggtccttgacttttaagattgctgcgttctagtcctttacattcagttatcattttgcaaaaaattaatgtactcatcacaaattattctcatgaccattagaacacagttgaaaatgtataccatgtcttttgaaaaattgtagaaactgattatctgcctggtttaaaattttacgtggtaaatctccaaacaagtagttctgttttcaagaaaaatatggaattctgactggcatatgtctgttaatgttcttcagatcaatattgtccgtggtcactgttctatgtcctttatagatatcattgacatcttctgataagtatttctatgatgcatttaaagacaattttaaaattcagtctatattgagacattaatcattttatgtctgatatgaattacaacaccacagagattattgactacatgtcactgcttattcagatgaacaaaataaatgtgcgaagacattaaataagttattcaaagtaataaagctagcaatattagaatacttcccaaaaaatcaggatcctagccaggcacggtggctcacgcctgtaatcccagcactttgggaggccgaggctggcggataacctgaggtcaagagttcgagaccagcctggtgaaccatggtgaaaccctgtctccactaaaaatacaaaaattagctgggcgtggtaatgcatgtctgtagtcccagctactcggaaggttgaggcaggagaatcacttgattctgggaggcagaggttgcagtgagccaagatcatgccactgccctccagcctgggcaatggagtgagactccatctcaaacaaacaaaagaaagaaagaaagaaaagaaatcaggatcctatgtctagtgtaagaacatatttttggctactggactctcatatatgtgagtttcacttagcagaaccccaatatctaacattgataagttgaagactgactttatcttatgaaaccacaccaaatgcctcccctctttctcttagctccattagcaatagtcagtataattcagtggcaataattatgattatgtgctccacctactatttgccaagtgaccatgtaatttgatagatacacattatctaattttatcctcaaaataaccccaggagatctatgcagtcaattatcctggctttgatgaagaaaatgaggcctcagagagttaaataactttgacaaatgtagacagccaataggaggtgcagctaatatttgacccaggtttatttaacaacaaaatccaaaccctactcacagttaattttaacatccttaacttctatgctctcatttttacttcccattcgaactttctattaatcccctcaatgcctagcaccttaaatgagtaaattacctttgacttacagaaaggggcaatgatcagtaaaggtgatcatgtagaagactcttagacacacgtgctgaaatctaagactgcagtacacgatgggtccattcatcaggaaaacaaaacaaaaagccttctttccaggttccaaaaataaggaaataaattccccaggagtggcattgtcaatttcactaaaacaggaggatgtgggatatgacatgtcaatatcagctcagtctaacccagaatctgtaggtaacctgacagcttggccatggcaaggaaataacacctgacagataatccctccttaaaaaattagttccagaacaagttgaactataatgtacattttattttgcttgatttctcctggatattctacccaccaactttgctactctttttttcctctcttgcccacacatctacgctagatatgaatccaccattcttctgacaagggactcctgtctacattttgccaagtcaacacaccttcagaggcagccctctgtcattcttgtctgcatacccctgtggatatttctcccacctatcatcacctaccctcctgttgggtacaaaaaccatgaatgctacaaaatgtgggtttctgatgttccctttatctgctgttccggaatggaattatattcttctgcatttaagaacatactttccgtgttatttttaattaataaacatttgcttctagagcctggtgattttgtgaaatgtaatcgatttccatggatattgcataataaaatctaaacttaattagcattcttcagataaagaatactatttaacaagagtggtaaatttaaaagggcacattctaacaagcaaaatattaaaattctagggtaaattgaaagatgcttcttgcagcaatatctgaacaatataacaatctctccttatgtctctgtgttcagaaatcaggaaaatattcttgcatactccgaaaactacaacgtggttgctaaagacacataagcttgggtttggaaaagaccattcgcataccttattccaatcagctcctcttagaggtgagtgcatctaaacatggaaagtatgttttttccatgtttccaagtattttctttccatgcccttgattcaatacctattgaatatgtatctgaacatatgtcttgtacagtttaatcatattaatccttgttccatcttctcttccacaatgcaatatttgaagtgatagatcagctaattgacctgacttgatcatttcacaatgtgtacatagtgaagctgcaaattatacctcaaaaacatatacaattactatttgtcaatttaaaaattctgtaattgaaaaaataattctgcttttttttaaaaattacatcctcccaaatttttacttatttctcaactgctttgtggacctggaatattttcaaatataaggattctttacaactcactgaagcaaattatttttttctctctgcattgtctttctggagtaatcttgatccatttttccagccaggtggaaacttcagtcaaggaagacttcaactattctgaatatcttaccttgtacatttcacatataaagaaggcatccttttcattgactataggcaagttttggtgaaaaggaaatgattaatcagctcatcttctcaagagatgacatgacacagaagaacatgggatttgaattcacacatgagatttagctcacatttgtcctaagctttctgccatgactgtagaattaagtaaatcacataccctctccgtacttttgttaccctgtccctaaaatgaagataataaaacctactgtataggatgactatagagattaaaggtacccaacacataaccagtgctacaaaattgtcaactcatgtcactctgctggatatagtaaagttcgaccaaaatctactacagtagattttgcattaagaggctcaggaacatttcaatctgatgttggagatgatgtgtgacttttctagtatttcctgtgtacatctcagcacagttccatgtgcatgttgggatatctacatatgtgatgttaacgtcaatatccctgctataaagacagaaatatggcagactaacaacatctcgaacgctgatttcattccccacgttggttttggcacgtttttgaaaattttagctgcttaatgcatttctgccaatagacaaaagctcaactgatttcaaagcatttgcggataaagttgtgaccactgaagtgtcattgagaataaatctcttagacatgggtgtactaaagagcttgtcgaaaaaaatgacagtgtttatttaataagattgattttgttttcagatattgtatttaattattcattatgtaagtctcctttttatgtgggttcagctaacctagtattaacatatgattaagtaaagcttcaaagaatgaaacaagagtcaactccttaagtttactcatagtatgaagaaattctctgcaaataagctatcataatctaaaaacattccattaagaatatataaggcatagtatgcatgtattaagctgtcttactacttaccatgtaaattaacgtgaggctttatttttctgtataaacatgcatgtaaaatgctattttttagtaaccaccattactatatacctcatatgtcatttctgactctctctcactccacattaacaaagcagaaaaggaataatgtaagtgtgtctcaaatcaccaatcatactgaatagaaaaaggatctgaaagcacaaaattaccattttctgagtattcataggcagtgcaatatgcatgatactttatattttttggtgtttgatcatattattgattacctatgttttacaaaaggtaactgagattagttaagaatgtgcctacatttacacacgcagtaagcgttaaaactgagattcaagctctttcatctatgacataagaatatgtcctttaaaggaagttgtctattaaatgtctatggcatttaataaattatttaattttctactgtccaattacattaattctgctcaaaggtattgtattttaaaatattaacatatttttctgtaaccacttcagaaaaatttaatgtgtttctctacagtaaataattttgccacaacttgttcaaaaaagcacaactgcaatacatgtactttatataaatggagatgttaattcttgaataaacatcagtgtgtagaattgtttaaataaaagatgctctcataaacttgacatttgagacttaaagctaggaactcctaagttcctctctaaaaaagaatagagcccagatgagaaaactgttgtcccttgctgataagacaccctttccccctgcacttatataagcctcttttattcgtctaccatgaggcacagacatcattcttacagattggtcagtcgctaaaccatcagtgtatcataaaacacatcatgtgctccagaaaacaatcagataaataggcccaactcacatggcctttgcaccacaattgcaaacaaataatggtttgttttagctttccttttagaaattataggtaagagccagtattttaaatttctcattttccttagaatttaatgacgtcacgtagtcataggtgctcctaatgttcataacagtaaacaccatcctttaactaaacttatttgcatagaagatattaatgagcaacacattttattgctattagcagtggaaaaaacgatctccaacttactgaaagtctaacgttaaaatgttggtttatggccatagttatatattataaatgcctaatcttagagacaagcacatattactaacctggatatactatagtctaatgattcgatataaaaatgatgagtaaaaccaacactagttaatattcatttctttgatttctcagtctcttttgtctccattgctattatattaagtagaacagaaataaatagattttaacatgttcaaatgagtgtaatgataatttcaagatttctcctgtctgactgggacatggacaactaaatacttcttgaatttaagataaatttcttaaaatatgctcctctaaaaatctgaaggctgctgtacagtagctctcctatattcttttttttaatgagactttccaaaaaatgaagttttaccatacagtgatactcctcatgtcaaaaacctggatggaaaattaactttcatcgagtttatagtaaagattgggaaataaaatgcatataatcaagaactctagctccaagccattcacaaacttggtactttttacctgcttggccttcagcaagttacttaatctgtgtgtgccacagctcataatcctaaaactcatctcttaagtgtattttggggactgaggacatgaacagaatgtgcttacagctgcgtcatgtacacagtaagtactcaatacagcttagctactggtgtggatcatattgtttcaatatagctgtcaaaatagagtgatgtggtcttaactgatggatgaacttattgctcagttaatactgtgttcagagaagactaatgagaaagaacaatcaagtatgtaggcattttttcactaaatataggtcaaacatattgtgtgagataatacggttatcagatcatctaaattcaaagtctgtggcttaaccaaagtagtaaaaactgtttgaaacttttgatattaccttgtatgttatcagtcaacatattctttttgccaacttttcagttactgacaaagtgccttaaaaatggaaatttgtttcttagagaaaaattctggttgaatgttacagttcatagacaaaggtcatgacatccacaagaagcaaatttagtctgttacaattttcccatttactcacatactgatctgaaagttttaagacatgtagtaaaggtaaacaaaaaataccatgtattttggccaaaccatactgcttaatctttaaaattaacacttgaggtttgacttaaatcatcctgaatatggtttctgagcctaatacctatgcattttttccatatttcagcttcatgctgatatctggcaacacccctgggtgtggaagctcagagaatgctagagaacaaagagctctaagtcatgtccaatcaggctgcccatagggctgcacccaggagggaacaaatccaaaccaaaggtccctacttctagaaacgcaattcaaacacaagcatattcctaaaaggaagaaacctatgctctcatgttagtaattaagatgaagattaagagccagagaaactgattaatcaagacttccatctggaaggtctccagcaggtgggaagtaggaaggtaaagccaagcgttgataggaagcaaatagatggttaatgatgtgtgagtcgataaaacacctagtttgggactaatctcaccatctcttatcatttttgttttcatgccaaacaggtgtgtggaaatctcaagagtgaaaggttgcccagttaatctaagcggctagaaaattaaaattataatcttccaagggaaacgctaagcagccaaaatacaatctgtgcatctttctttattgagggtgacaagtgacctggatttttccttgaacaattgagactgattactttgattctacacattaattttatggcatctacttgactgacagttacatatttagaatgaaaatggagtaatctaattacctgtttttatattaaatgttttgctttattaccacagacatacttgaactggtagagtaatcttaaatagacttttctttatatttttttggccaggatagatggtagatggttatacactgtaaacaaacttttatttatttttcttttacagatgggccctcattatgttgcccaggctggcctgcaactctgggctcaagtggtcctcccaacttagcctcctgagtagctgagactaatagtgtgtgttaccacacctggctcaacaaacttttgactaagataattcaattaaaccaagacttttcttctgaaccttacaagaaaatgtgtatttttcactactttttacattcacttatatccttagaaatcctcatcattctggaagacttaatcattcaatgccatgtaagattttattctatatgcatgccttaggcttgagagatgccataaaattaatgtgcagaatcaaagtgtatgccaaaaaattagaatcaccaaagcaccgtgttaaaagtggaaattcaaattctatcacacatccttccacagatctgctggagatggaactaaaaaaatttccaatttaaataaggacctgatgtaatctttatacacacctttaaaatctgagacccattgttatagacattatagcaaaagttcaataagaggactcctaatttatttttaatatttatttatttagagacagggtctcactctgtcaaccaggctggagtgcagtgttgtgatcacggctcactgcaggttccacatcctgggctcaggtgatcctcccacctcagcctcgaaagtagctgggactacaagctcacaccattatgcctagttaattttttgtgtattttgtagagacggggtttcactgtgttgcccaggctggcctcgaaatcctgggctcaagcgatccacatgactcggcctcccaaagtcctggaattataggatgaggcaccgtgcctggccactctaattttaaagcactgttgtttatacacactacactaaaaacagctatataaaaaaacagcataatacggtcagtgaaaacgctggtcttacagtcatggaacataaatcatgtgagactcagtgactctataaccttagacatgtcttttaattctctaaccattagtttagctatctgcttcactgaagggttaagtcttgttttttctgaatcttaacatgccagaattctagaatcagtactacagtataatcaatccttagaactccataattaatatgggatacagaaaacttttatcttgatgtttaatagttacatataaatgtgtatttattactactgctattttaaaatgtttaatttgtatttatagtaatttggaagtgggaaaaattttaacaacagctagctagcctgagtattaaatcataaaagtgatgggagaaaatttctcatttacatattaaatgaatatccattgctttgtacaaggagaaagaaaataaattctttaaaatctgttttgtatattaacatctggatacttcagatgtaagagaaaacaactgtcaattttaaaatatccttggtgatcttcttaatatgacttttaaaattccatacttcaaaagaaccaagaaaatcatattttaaatatttcacaatcttattttaatatctctctattacacattgatcaaaccctgtaaaattcatcctgatggaaaataattgagatactcatcacatgcattgtctgggcttcttgagaatggaaaagctttcaactatttaaagcagacccacttaaaactatttgctaatactactaacaggaaaacagatgtgtaggcatccaaataactcttggatatgcaaaatgtcttttggaaattgtttgcagatcgctggcagccacatatgacaaatacacgcttttagtatcacactccctagggcgtcattagaacttttctgaaagtgtctagtccattatcatagaaacacaaagttggaccctggccctcctccttagtagtccatcagctgcagccataataaaaaaaatcaatgaaatcacttctctgtgacttgaaaaaggtaatactaggttttctctgacataggtgacatgataaagaacatttgtatagattttaagaagagttgcctctcactgaaagtcacaaatacacacacttgtaagcattagccacagtaccgacttctctgagtcatttgtacttctcatcaggaattgagctggttattctagctcaaaacagtactatcttgacactcaaatttaaacgtattcttctacattacgtccaccatgagagttgtgtatttcaccttcaatattcatatttttgtagtatacagtttgtagtgataattttgtagtataatcagcataacagttgcttagaaaagggtctcattgtttttatttttttcatttatattagcagaaataagatttattcaggaaaaacaaagtcatgtagtgtaaactgtggtatcgaattttcctattttgtatttggcttaaatggtaggcatacctcttcatcagggaatggtagaacatcaacagaacacgtttattgtacgtcaaagtaaaaaaattacacttcactgtattatattatcctcaaggttaattgatttatgacgatttgacgagttcagcacaatttaagttacaaaattgacacaagaagttccagcaacccacacaataatcggaccattaaacaatctacagatgctccatctttttatatatgagtgtccacttaataaaacagtatcatttattcacaaatcacattacagtagtttctacagccgggttcttctatgggtccttgggatatagcagtgtgtacaagaagcaagaaagacctcattctcatgaacaatacctgctagtgggggaaacaggagaaacattaaaaggaaccaaattaattgaatgatacatctaaatagacttccctgctgaaagaaaataagacagagggatggagagtgatacggcagttgttttatttatttatggttttttttaaatttttttttttgagacacggtctcactctgtcgcccaggatggcgtggagtggtgtgatcttggctcactgctaactctacctcccaggttcaagcaatcctcccacctcagcctcctgagtaactgagattacaggcgtgcaccaccatgcctagctaatttttgtatctttagtagagactgcatttcaccatgttggccaggctgatctcggactcctgacctcacgtgatccacctgccttggcctcccaaagtgctggagttacaggcatgagccactttgcccagcaacaggccagttgctttagattggatagtgtctgaggacacatatgagccgggaattcagtgacagaaaagagctattcatgtgatgagagcagaaagaatagcaaattctatagtactaaagtcctgagttaaagggagacaagggtatcccacacacagggagaaggaagtgtctctggagcccagtaagctaggatgctatgagaagagtgatatggttcagttctttgtccccaccttgaactgaaataatccccatgtgtcaagggaaggatcaggtgaagataattgaatcatgggggcagtttcccccatactgttctcttgatagtgagttgtctcaagttctgatggttttatgaggagctttccccttcgctctgacccattctctctcctgccaccctgtcaagaggtaccttctgtcatgtttgtatgtttcccaaaggctccccagccctgcagaactgtgaatcaatttaacctcttttctttataaattacccagtctcgggtatttgttcatagcaatgtgagaactgactagtacaaggagccacagtgttaccttcatttcacccaaaacgaatgcactctatattgtgaagtcaggaaaaattttaatgcttctatgttgactgtatttggagaaaacattttattttatcttatttttttgtgagatggagattcactcttgttgcccaggctggagtgcaatggcgtgatctcaactcactgcaacctccatctcccgggttcaagcgactctcctgcctcagcctcccaagtaactgggattacagtcatgtgccatcacccctagctaatttttgtatttttagtagagatggggtttcaccatgttacccaagctgatctcaaattcctgacctcaagtgatgcgcctgcctcggcctcccaaagtgctgggattacaggcgtgagccactgcgcccagccaagaaaacattttaactggataacatttcatctatgcatttcagatgcatagtttctttttgtttcttaataggttttcatttgtatcttttccttgtaatgatcaattattcaatcatttgaatgtatttgaattcgtagttttacttaaatgaaaataaaattaagattcctcacaaatatgagggtttcagatttttttttatggaaaagaaatataccctctgaacattcttgcaattgttttctgttacccaagcatcattcactcagccaaaagcccattgacctttacccccacacctgaagggaccaagcagtgtgctaaagtaacacagtcgtggctcatagtttcaaaactttacgattttcaatgaattgcagtcgaggagttgccaaatcaaacaaaatgcatctttattcctataaattcaacaagttatgttcccggtaaaactcagccaaaagttccactccttcctaaatcaggctgattttcaacaaggatcaagccttttcaagaagcagtttactttgtcacctaaatttcaaattgatgaacccagttcacgaaaatgagcagttctgtgttttgaacaacaaaaatgtccccaagatacgccatcaaactgtgccttatttaatccatacgagaagtagtttcttttttatttttacttatttatttattttttttgagatggagtcttgccctgtaccgcaggctggagtgcaatgatgcaatctcggctcactgcaatgtctacctccaggttcaagcaattctcctgcctcagcctcccaagaaactgagattacaggtgtgcacaaccacgcccagctaacttttggtaatttttttttttttcagtagagatggggtttcaccatattggccaggctggtcttgaactcctgacctcaagtgatccacctgcctccatctcccaaagtgctgagatgataggaatgatccactgctcctagccaagaaatagtttattgaaattcatgattgtctacgaaagcaggaataatataatttatctaccaaaggagacacttgtgagatgaaaaggaggctttatcgacaaatatggcaggactgtgggcataaacgtatcaaccatccctggcaaaccagaacatgtaatgcttccacctatgaagcacaggcctgagaagccttagaaaattatatcttatttcttcccagataaaaacgaatgaaatattttacaaattgtaaatatctttttaatttttattttatgttacctttttattttattttattttattttttgagacacagtctcgctctgtctccaggctggagtgcagtggtgcaatctcggctcactgtaacctccacctccagagttcaagggattcccctgcctcagcctctcgagtagctgggactacaggcacataccaccacacctggctaatttttttgtattttagtagagatggggtttcaccgtgttagccaggatagtcttgatcttctgacctcgtgatccacccacctcggcctcccaaagcagtgggattacaggtgtgagccaccgcacctagccttattttattttttgagatgggaggtctcactgtgttgcccaagcttgtctttaaccccaggcacaagtgctcctcctgcctcagcctcctgaataggtgtgactatagacatgcatcgctgggatccataaactgtaaacatctttcttgaagctacaaactgtttgggccactgttacgtaaagcccataagtcttgtaccctaccgacagtttcaccaacttcataacgtgtataaataattactctaatgcacatacttgtaatatttactctaatgtagaatgcctttataatcttatatatttactctaatgcaaaaagacttagagaatagaaccaaactctttacctgcagtagcttgagcataaaaacaaccttctaatggtaatataaaaggctgaggcaaccgcaactatagtcagtgcacctccacttaaaacatttattgctgagtgtgaaaaaaaaatcccattgctaggatgggcatggttgctcaagcctgttgtcctagcactttgggaggccaagatgggaggattagttgaatgccaggagtttgagacaagcttgcacaacaaagtgaaaccccatctctacaaaaataaaaattaaaaaaaatcagtcggggcaatgttgactgcctgtagtaccagctactgaggcgagagaatctcctgagcccaggagtttgattacaccaatacattactgtctacgcgacagagtgagagcttataaaaaaaaaaatatatatatatatacacgtatatatgtgtttatatatatatatacgtgtatatatatatacgtgtatatatatatatacgtgtgtgtatatatatatacgtgtgtgtatatatatatatacgtgtgtgtgtatatatatatatatacgtgtgtatatatatatatatatatatacgtgtgtatatatatatatatacatacatacaccattgctagaaaaacaggaactgggtattgctctagcaaaagtgacaggtaaaatcttctctccttacctggctaaccttgggaattaaactggtgttgtaagctttaactcacgacttggaaacctgtctatagccttgaatatgaagtactgattctttatgtagaagtaacagccccacattaaaaagcagagcaggaaaggaggtaagaaaacagatgttgtaaaaggaaattaaaggaaaaaggaggaagaaaagacagaaaggagtgaaaaagaaagaagaaaaaatgagaaaggaaaaaaggaaaactgaaacaagtttaaagctacaatgtgcatattcttccttacatttttattactctgttcacctctttggtaattatgttagatgcaattagaatcagaatcccacagaactaaaagaaaatcatacagatcttctgaaatatcccagacccaaacaaattttgacccgcctagtatcacacagctagaaaaggtggcaaagttagttacaaactcatgtctcctaactcttttgctccacaatttacagaagaatgcttcgtatttacaatatgctagtaagtatatcttataaaatgtcaaattggaggttttctgctaaattccagtttcacctttataaatgctttacttgttttgaggtttccaagagtacctatttctgaaatacctgttctgccttttttttctggcttttaagtttaataaatcttttctctctcctacagaaataatataaattgtggtactcaataaatacttgatcaaatacatgaatgaataaaaaagtagtgcctcagttcgggtgccatggctcacgcctgtaatcccagcactttgggaggccgatgagggcggatcacctgaggtcaggagttcaagaccagcccggccaacatggcgaaatcctgtctctacttaaatacaaaaattagccgggggtggtggtgggtgcctgtaatcccagctactccggaggctaaggcaggagaatcacttgaacctgggagacggaggttgtactgagccgagatcccaccactgtactccagcctgagtgacagagcgagactccgtctcaaaaaaacaaacaaacaacaaaaaacagtagtgcctctgcaggttttattaaaccatggtttttcaaattgttattgtgtagagaaaacacatctcagaaacaataggtaaagccaaataagagaggaattaatcgtgtagtctttgtgattggccttgtgtcttcaataataagacattgaacataaaaatagagcaaccaaatatatatgtaaaaaaatactaaaatggaaattacatcagaaataaacaaggggctgggccatcacaactgatcccccactgtgaccaattatatgcccataaactcgataatttagatgaaatggacaaattcttggaaaaaatactttaccaaaactcacacatggaggaatacatcctttgaataaagaactgaaatcaaataatagcttccccaaaatggaaagctcaagggccagtagtttcactggtgaaatctatgaaacatttgatgaagaaatgataccaattcactaccggctctgcaaaaaataattgaagaggaggaaacacttctcataactaagtcattctatgaggccagcattaccctaatactaaaacctggaaagactttacaaaaaagagaaaattacaccaatatctctctaaaaattctcagtaaaatattagcaaattgaatccaacaatgtataaaaatgttgtacaccacaaccaagtgaaatttatttcatatatgtaagactggttcaacattgaaaaataaattaatgtaatctatcacattaacaggctaaagaggaaaaattacatgatcatatcaataaatgcagaaaaagcatttgaaaaaaattcaacatactttcatgataaaaactctcagcaaaattaggaataaaagggaacttccctgacaaaaaaaaaagtctacaaaaatacctagagccaatatcctactttaatgttcaaaaaaagagataatttttcccaaaacagtaacaaaacaaagatgtcttttcttaccacttctagtcaacattgtaccaaaagtcatagctaatccaacaagacaggaaaaggaaattaaagatatacagacagaaaagaaagaaataagacccttgaattttcggatgacttgattgtctatgcagaaaattgcaaaacctgaaaacaaaatttcctggaactgttaagtaattatagcaaggttgcaggatacaaagttaatatataaaagtccatttattttttatatttcagcaccaaaaaaatgtaatttgaaattaaaaacataacactatttatattattacacacacatcaaagaaaatttagctataaatctaatgcaatatgtatgaaacagatatgaggaaaaccgcaaaatactgatgaaagaaatcaaagaatatctaaataaatagagagttaatccatgttcatgaataggaagactcaatattaagaagttagtttttcccaactttatctgtagattcaacacaatctccatgaaatcaccagtggattattttgtagacattaacaaattcaaatgtttatttgaaaaggtaaaagactcagaatagccaacacaatactgaaggaaaataaagttgaaggacagacactacttaacttcaagacttactgtaggccaaatgtggtggctcactactataatcctggcattttgggaggccaaacacggagaatcacttaaccccagaaattcaagtccggcctgggcaatgaagtgagaccctgtctctacaataattaaaaataaaaaaattagttgggcatggtggcgcacacctatggtcccaactacacaggaggattgcttgagcccaggagattgaggctgcagtgaaccatgactgcattactgcactgtagcccagctgacagagtgagaccatgtctcaaaaaaaaaaaaatactctttacccaacttgtttaccatttgtaataaaaaacaaatggtgatagaacaaaacatccacatgcaaaattgaatctagacatacgacttatacttttcatacatattaactcgaatcgtagacctaacgtaaaactcaagactatgagacatctaaaaaataatacaggaaaagctccaggtgaccttgagattggggataacttttgaacacaccaaatgtataatccatgaaatttaaaaaattgttgtaattaaaatttacaacttctgctttgtaatagacactggtaaaggaatgaaaagaaaagtcaaagactgggagaaaacattttaaaactcatgtctgataaaagacttcaatatatacaactcaattcaaaatattaaaagtaaacaacaagaaaacaaacaacctaactgagaaataggcaaaaaacatgaaaagatgttaccaaagaagacacagatggcaaataagcataggataaaatactccataacagatgtcactaggaaattgcaaattaaaacaacatgagatacctctattagaatggctataactgaaaatactgacaccatcaaatgctggtgaagtggaacaatagaaattctcattcactgctagagggaatgaaaattggtaaaaatcggccaggagcggtggctcacgcatgtaatcccagcactttgcgaggatgaggcaggcagatacttgaagtcaggcatttgagaccagcctggaaaacatggtggaatcccatctctactaaaaatataaaaattagctgggcatggtcgtgcacacctgcagtcccagctactcgctgaagcaggagaattgcttgaaccggggaggcggaggttgcagtgagccgagattgtgacactgcactccagcctgagcaacagagcgagactgtctaaaaagaaaaagaatattggtaaaattactttggaagagagtttggcagttttctacagagctaaacttaggcctaccatctgatccagcaatcacacctctagcctaccatctgatccagcaatcacactcctatatatatgccaaaattaaatgaaaatttatgtccacacaaaaacctgcacaacagtatttatagcagctttattcataattgccaaaacttacaaacaaccaaggtgtccttcagtaggtgcatacaaactgtggtatatccatacaattaaatatttttcagtaataacaaattagcttccaagccatggaaggtcatggaggaaccttcaatgcagatttgctaagtgtttccaactatatggcattctggaaaaggtaaaactatgtggagaataaaaaggtaagtgggttgctaggggttgaggggtggaaggagatataaatagatagaaaatatgagtttttagggcagtgaaactaacctgtatgatactgtaataatgaataaatgacattatgcatttgtcaaaacccattgaatgtagaacacaaaaaaggaactatagtgtaaactatagacttttgtttgtaatgatgtatccatattggtttatgaaatataacaagcataccacgctaatgcatgatattaatactaggagaaactgggaacatggagggacagcagggtataggagacctcactcaactactgcacactttttctataaatctaataatgttccaaaatattctattgtaaaaaaattataaaatgtttatattggtaaaaggcaccaatttgtgtatggagattattaaaactttcattaaagtgaacattatttatatagaatctctactttttctcaagtcttacatttctaatgaatcttatcatctaatttaaaccactgttaatagagcaacacttaccaggaactctttagtccaagactgtgagtagattctactaacacaaagcaatataaatcatattccttacactaaggaatttactatttttctgtgcatataggacataaatgtaattattacataacaatataatgtaatataaatagaacacatatattaagtaacaaaacaatgtcatgtatggtgagtttcataaggagagatcgaagagtccagaaataatagagaaatgacagtcacagctcagtgcagtggctcaaggctgtaatcccagcactttgggaggccaaggcagatgcatcagctgaggtcaggagtttgcaaccaacctggccaacacggtggaaccccatctctactaaaaatacaaaaattagcaaggcatgatggcgcatgcctgtatacccagctactggggaggctgaggcacgacaatcagttgaacctgggaggcagaggctgcagtgagcagagatggcgccactgcattccagcctaggcaaccaagtgagaccctgtctctaaataaataaataaataaataaataaataaaagtaaatgaagagccatagcaaaaccagttttatagaagtaaaatctcttgtaaaacaaatggaaataaaaagagagagttatcagggaccaaacagtgaaacactaataagtctggatgttaatttttaggtaataagattctaataaaggagtctaagccaagtcaaactagaggaagattcatctggtttgagtatgaagataaggacacaatcttcatactcaacagagttgaaattaaggaagaagaatcacaaacaggatcaaaggttaaaaggcatcaaatctgaagttaatattagagacaaactaaagaaagcttggtaccattaaacagtaaattcccagcataatgggagagaaagaaacatgaagaaaaggaaaacagtcccacactaagaaaatataaaatctaattgggcatgcaaagcatacaaatacgaagcaaatagaaaaagtgtcaaagtcacactaatgaagtgttgattagtggaaactctttatgatagagcaatccaggcaacagaaatccccttttaagtgaccgtacgctggataagggataacagacaatgacttggcattttcatgattctcccaaatctagacaaccatatttgatgcccaaacgaacctttctcacgtttctgtaaaacagactaagtgctccacttcttaattaggaaattctcagggatcaacactggatgtgcccccaacttatcaaatggttctggtttcaataactctgttttttgaggtcatcctcaaaacaatcccttgcacaggattcctaccctctccatctaagctacccagcagctaatcaactaatacagtctcttatacaggagacaattgagggtggaattttgtgcctaaagcaatggatgcaaagcattagataaaagctacaaggatttgtaaagtcatgcacacactggcacatcagacagagagaaaccacacaaggaaaaaacatttctttctatgcatgtgtatctaatatttttacactttaaaaaaactaaagtaatattataatccaggtatttccaaaagtttaaaaaataaaaagtaaaattctctttcttgccttgctggcacttccagtcatcagaaatagccacgcaaattttcctgtgtgtgttcttccaaaaatgtttatacacataaactattctgtaagtatgtatatatcaatatattaatttttaccacaactgtgtaaccacgtgtaaaacttgtttttttcagcatcttcctatttgagcacatatagcttcccaataacaacatatagaagtgtacccatgttccatagaatgactatggaacactccatattatggatgtatcataagctttttaactgttacccatttacatggtttcatttttgcttttacaaataatactgaagaaatagtcttgaattctgtatacatttgtcttaaaacttctgaatcacagggtatgaacaatttttgttgttgttgttgctgtttgtgctgagatagagccaaactgtcatcaaagggtttgtataactctttcctttatgcctcaacaatatgtaagtctatttcaccaaactacagttaaatgaatgttgtcattttaaaaaatgtttgctaacccaataaattggttaattactacctttgctatgaaattaagcatttttacagttactggacacttgtattacctttatccaaaagtctattcaagaccttacacatttgtctattaatcctatcttttatttgttgtaagtgttctttgcatattaatagatcaaatacgttgccagtttcacttctgtattttcgaccttgtccatgattattccccctacagatgtgtattagtctcacacacatccctcacactgctgtaaagaactacatgagactgggtaattcatgaagaaaagaggtttaattgactcaaagttccacaggctatacaagaagcatggctagggtgcctcaggaaacgtacaatcaaggcagaaggtgagggggaagtaagcacgtcttaccatggtggagcaggagagagagagagagagctaaggccgaagtgatacccacttttaaacacgcagatcttgtcagaagaccatcatgagaacaggaggtagaaagtctgccccatgattcaatcacatcccaacaggccgtccttcaacatgtgaggattaccattcatcatgagatctgggcagggacacagagccaaaccatatcaagatgtttctaataatggtcaaattcaccagtgtttaatcatcgtttgtaggattatgatgcatgggaaggcataagcactcatatatatagcaaatcttaccaaaattggtttctataattgagtgctgttatttttttcaaatccttttgaaagctccagtttagtttgcagtaggagacaagcatatagcaacaacagctttttgccaaaagagccaattcttcccctggcaattattgaatattccatcttttccccactaattaacctgtgaaatctgctatttatttgaactgatatctggactatcttgactagttctggttttacttctctgcttatacaaatcccaaattgattaaattatcatgacattacaatatgctgtaatatctagcattcctattccttttattacccttcttttaaaaatattctttggttaatttcatatgtttatttttccacatgaacattagtagcatcttttactactaattagtaaatgatgtgttgtacatagcattaataattactattagcaacttattagttgtcattttttacactaatacttgatattttcaaaagtgtcacatgcatttataagacaagttttgagaacatttacatattaacactattgacattatatacatattacatattaacactttatttctacatatgaacaaatgagccttttcattgattcaaatctcattcatatactttaattttaaatttttctcttataagctttcacatttatgtccagataggctaaacatttatgcctagacagtctaaatgtatttggtattgtaaatgaaacttttccatccattatactttacatccttttattacatacagacttctaatttttatgatttaccttttataacctgtcactttattgaaatgtcttactagtttcatttgtagatctatttcttggactttacatgtttagtggatcacatataaataatccaatagtttctattaattcttagtttgtaatacttattttttttcttatctgattatgaatttaaaaatacgtggcaattttaaatgtggtggtgatagtactcatcattcttgtttcccactttactgggaaatctgtttcacaactaatcatgactttgttttggagtctgtatcacaggaaggaaatgtttctcaacttctgttatagtcaccttttaaaaaattcaggatttggtgttgaatttttttattaattatacatatatttaaaaagtgtttttctccatttacatattaatatggtagactgtattgatggattactactgctgatctaaatctgcattccttacatgagcccctcttcattatataatcagggtatattatttgttaatgcaccattcttttctaattaatatttgtattactttatagggattcataattgagattagtttgtcattttatgtcaagttttaaaagttttgttatcatgctctgctgattttgtaacaatattttagaactcttttgttctcaaagtagcacgcagtttgaatagcattaaagttgtgctgtggtttagatatggtctgtattcaccaaaacttatgttgcaatataatccccaatgtgataatattgggaagtagggcctagtaggaactttttgggtcatgggaggagatccctcatgcatagattaataacctccttcagggtgagaggattcttccttcaatcatttacccatgaaagctgcctgttaaaaataacctggctctcttgcttcctctctgaccaaaaggtctccttgtctccgtacatacccagtccccttctactttttaccatgactagaatcagcatgaggccctcaccagaagccaagcaattgccagcaccatgtttcttgaacttcccagcctgcaggactgtgaactacataaaccttttttttgtttgtttatttttgttttaagttacccagcctcaggtattcagttacagcaacacaaaacggattaagacaagttctccatacctcaatgtttgtagagagttcacttctgaaatcattggcctagcactctttggagatttggtgtttgaaaatattacccatttcttccattgccatagatctcttctgagatcaattttggagatttgtattttcttagaagtcacccatttcgttcaggtttcatatttatttgaataggcttgaacaaatcattataagtttgtaagttctttaattcaccctacagttgtagttattctgctgatctcatttcgaatttatacagtcttattttccaatgggatttactaatagtttttgttttctccttacccctcccctcaaggaaataggtttggatttatttatgaattctactactttctgtttaataattcactattatttttatcttgattaatttattccttctgttttccatgcgttaattttgctgctcttttaataacttaatttaaaattttaatcaatttcattaaattctcttgaaattagtaatatgggttttaaacatatggttctcagttattttttttaggacagtacactcagaaagtgattaaatttttatcaaacgcagaggtaggtctgaggttgctcactaccctatgccctgcttctcgctgaatgtcctgagggctaaagggaataaatatctttacacacctgtaatccatttgttgcataggaattggaaagctctgttaatgaaatcaagtggattttgaatgctatgctgcatatatttatatattcagtaaacaaccattgaacaactgtgctaagagctcagaacacaaaatgggtaagaaagggttttcaatacatttgattcataaaataagagtttttagaaagtacataggattgatcaggaggtttaaattctagccccagagctacgcatatggtgtgtgtgacccatctctaaacctgattccacagtgttcactctatatcgaagatatttgaaaattaaaagaatgaatagaaatcattattaatatgtattgtaagaggctctgctactaacatgaatacgtctatgctgtgtggtgtgtgctcgctaaataaatacttaatggaatatatttattactttgctagaacaaaaaataggccaactggctgtattagttgttacgcagtgacagatacaggttatcctcagtttcagtgaaagaatcataaatgattacattgtgaaaacgactgcaaaaatagaatgaaattgggtttcaattttctccatttctacattttgaggtttgatggtcttacagtaatttttaacaagaacctggttaaaattattcataattggaaaggattcgaaaaacaaatatgcaaaaaataaaacacacacacacactcataatagagacctaaaacaaatatttggtaaaatcttgatttttcttgatgatgatggagatcattctgcagaaaccacagcaaagaagacaatgccttctcctttcccagcttacagatcccaggagcccaatgtttttagaatttctttttattttctgctaatgaatcatgacatataattcataagcaacttacaaatcaactaaaattcatgtttctagatgtcactcgagctgagttttaaaatttgagaaggaatgttggccaattgagtacttatttcaagtatagctgagcatacaggaaaaaatgtttatacgagaaatgatcacagaatcataagacacagaaaggatcacagaatgttgagagtatagttatttatttgcaatgagtcacagaagatttaattgcaaatttgaataacattacaggatgtctgtatcttaagcagttctactagataatcaaataagaaatactgaaagcaaatctaagttggttaaacttgattcaggaaaacagaaattatgggcaaactccaagcatttctcacccatcatatatttaaatactcacagagttctgggtagttaaatgagttaatatatgtgagacactaaggctacatagttttgtgaacatgttagccattattattattgttgctgttaaaattacaggtgacattgcagaaatagatatggttactctcataacagcattatcatttatatgctaaaaaagcaataaggcaatctctttatgggcaattttcttttataaaataataggaatatacatatatacaaatatacattaaacttttaatgttacagtcactaaatcaaataattttaaaaataaaggattgcatgtggcattctttcttctcttgaggccacagggacattttcattagttaattattcagagacattttatcatttttaaaaatctatcgtgagcttagaaatctagagtgaattcataaagccaatggcacgttagtgagaatattaaatggggttaaattatggctttgaattacaggaatggattcctgttatttctgtctttagggagggaggtaggaagcaggccagtcagatgatccttgagttacctcagaactccaccattgcatcaaaaagactcttacagtgtcagtattatctgaagatgattaaagagatacattcggctctagagactttaggagaaattgtaagctcataaaattatgttcacaatgatcatctggtcgttcctataagatccatggataggctgacccagctgaatgctgcatgagattcattacttaaattacatggtttctagcaagatagccagagagccttcagttacttttcatcacataattattgtcctccagcccacagggcaaagggattaagtttcaccaaagtgaaatcaaagcaaagcaggtgtgcatatcacaattcacatgatgctcaagtttgctgcctccttccttcctagggcagagtgggcagagcagtatggcactagccagcaccttcatacgaaagtttttaaagaggccaggcgtggtggctcactcctgtaatcccagcactttgggaagccaaggcgggcggatcacctgaggtcaggagttcgagaccagcctgaccaacatggagaaaccctgtctctactaaaaatacaaaattagctgggcatagtggcatgcacctgtaatcccagctacttaagaggctgaggcaggagaatcacttgaacctggaaggcacaggttgcagtgagctgaggtcgcgccattgcactccagtctgggcaaaaaaaagtgaaactccatctcaaaaagaaaaaagaaaaagttttgcaagaatttttaaaatagcataaccaacaatgagtcctgctgaggcaggagaatatggtctggaggcagagaacctaaggccaattcacgcttatttcataaagctggatcagaaggcaaacaccagggaagcgggggcagggaacccaaggggaattcacactattttcataaacatgactcaaaaggaaaacacctggttctggtggcaggtaacccaaggccaattcgcgctgatttcctagggctggctcaatagaaaaacccccatttccacggctgggtaacaaaggatcagaggcaactctccctacaaccctctcccgcttccactatatctcagatgaagagggaaagtgcctcggattggcgatgggccaagcgtggaccatcccttcatttgcatagggcacccatccactcaggcctctgattggccaaggaccaattcacttgagcctcaagccacgggccaaatccttcacacatttagggggtagccaataggaatctcaaaaggagtacttacacctcagaaaactttgtaaatgggaccttgagccactcactcagggccgctcccaccctgtggaatgtctcctcactgaaataaatccctacatttcggccgggtgtggtggttcacgcctgtaatcgcagcactttgggaggccgaggtgggcggatcacgaggtcaagagatggagaccatcctggccaacatggtgaaaccctgtctccactaaaaatacaaaaattagctgggtgtggtggcgcgtgtctgtaatcccagctacttgggaggctgaggcagaagaactgcttgaaccagggagtcagaggtagcagtgagccgagattacaccaccgcactccagcctggcaacagagcgagactccgtctcccaaaaaaaaaaaaaaatccctcctttcagtgtttcatttctttatttcattccttcgttacttggtgcgttttgttcaattctttgtaaaacacgccaagaacctggacataccacactcaaggcctgccttctggtaacactatgagcactatctcactgttgctctctttttctctcttttgtgagattaggtttgagcatttcagcctccaactaaaatgttcacatctattttgcaatattagttatataagaaggccttgactctttcaccgcgagaacatagttgaaacctaacataaatgagcaaattcctaagaagaaaataatataccaccagcactaccctgatatcttctcaactttaatttcccttcatgatttgttgctatttaaatttgttttatcttcaagtcattaatgtgcaaacaatagtattgagttttggaccttctgctagtagcttgctttattctttgagaggagttatccattctcctgcttcagatattgcttctagaacaataacctctgaagaatagctttgatcttatgctttagtttgcagtggtttaaaaacatctcttcctattgagacatagagacaacatctccttatgaatctgaactctaggaatgcttgacaaaaataagtggaaaagtaatgtgtccgtttctgggcccaggccttaatacataggcagtttcacttctcatcacttgtgatgcttgttattgaaacacagccaccatgccgtgaggaagtccaagtagctcactggagaagaaataaggttcccagcccacatcctcaagtgagctctcagctaaccgctagcaccaacttaccagccactggagagagtcaccttgatagtgaatcctccaagccagctatcccagttgatgctgtgtggagcaggaatgagctgtctctggcaagttctgtcctacttacagattcatgatcaaataaacaattgttgctgtttgaagtcatgcgttgtgtgggtagtttattaagtagtaaagaaaaatgaaaaaaagcagggcacagtacactttcagaagccaaggcaggtggatcgcttgggcccaggagtttgagaccagcctgggcaacatggtgaaaacctgtctccacaaaaaatacaaaaattagccagatgtggttgtgagcgcctgtagttccaactactcaggagactgaggtgggagcagcgcttgagtccaggaggtcgaggatgcagtgagccataatcacgccactgcactctagcctgggcaagagagcgagacctggctcaaaaaaaaaaaaaaacaaaaagaaaaccaagaatgctcaagagcaatatagttcataattctaaagataaattaaatgagttctatgtgaaagccctaattttacttcatctcaaaatccttattgaagttctctattcatctataaatcccattgcatcttctctcagacgaaccagattttctcttacaagtcctcaattcagctaacaattgatatcaactgctctgccttcacaatgggctctaaatgtcatttgttttctctttccctgcttcctctcaataactaactcatcagtaaccaaatgcaatactctccttttcaaaacatctgacttcggtgcctgccttcccattactcttaaaatcatccagagcatgtctcttcggcatgaactaccatcgtgaggtataaggggggcctcctatattcctgctttcagtcccccttcctcatacagtctgcctaaaagtcatcttccaaagtcattgcatgaaattatgcaaaggctcccaccagctcgttgattcatgtccaaacttgaccctctacaatcctcctacaatctttttgctgcagtctctcccagattttctcagtaaaagcaaagtctgtaatcacagatttgtgagccattccttcttccttataagttcccccataggccccatctttttgttccatcatagaaagcacactgctccatctgccaaatgggctttttccccacgcatttctctaggctgtgcctcctcagtcattttttgacagaaaacaagatgctcctcattttaaaggaggtatcttggtatctttccctccttttgtctcctgccagattagagaaacagatctcatgtttcctgataaatttgacatttaatttgcttaattctatttaatgtaaccctcatctaatctgtcattctaacttgcatccgaatatattatttctctctctaggtaatcaagtttctgatcaaaataaatatccctgcactaatcattttgtaggtaaaagtggagagaaccctgtcctggatgccttgtatatttgagttcctgtctttttttcttaccagctgcataacctcaaatcattttccttccacaatctctagtttgctgtgttgtaaagtaaaattgttgtattagatggtctcagctttgttttcccagcctgtgattagtaatatcagaattgaaattattactcaaattaaaatgtataaggcattctctctttacaaatgtattttgatttataaaatggttcaaaaagaaagtatgatagtaagccatctcaagccttgaatcactatttgattaacaaaaattgttttgtgatttttatttttattttgcagaaatctatctatagagagctgtgcttattgttagaagtacaaactaatcggaactggctcttgaaggcagaatagttactgaacccatacaaatattcagatctgagctaaaagtttatacacagggtagcgctcctgactctcaatcctggaatcgagatacaagcgttttctttttgtttttttttttttcagtttctcaactatctaaattctcctgtatgcaaatactaaacagagttgcccagacaaaaatgtcagagtgaactcgaacacttcagttctgattctaaatccagagagtgtcattctcaataaacctctgaaaagagaaaatttttcattcaaaatcattgttaaagacaagcatatgggcctaagtaaggatgtgcaagcaagcttacaaaataatagtacattagttatgataaaactggccatattgaaaaactaatacactctcaaatctaagagtgtggcaagcttagcaccttgaaacagaaaaaaataaaaatataagagtttatttctggcacacagaaagacatgtcagtagagtcttgactccatgcagtgattcagagacccaggcacccttcctctatcttgtggtgtgctgccttctttacacatgccttccgagctatcaaaggcagggcagttggaaacatagaagaggcacgtttgtttctaaatgtcttggcagcaagtgacacataaatgacttctggcacatgtaatttgctagaagtagtaatgaaaccccacctaactacaaaggaagtggaatcttcctatgaggacatgactgttggaaaactggatgtacataagcaatagtaatctctactggaaatggaaacacggtttgcctcctgagagtccagaaactcaagacaaacaaattgatttaggatatctttataaattgttaatatgttacagattacatattagctacaaataacttgaattgaaaacatatgtaaaggctttcctcaagacaaatatgggctgtatcatcggggttcttagagagatacatgcaacggttatcactaggtgacaaggaatgttagtatgcagagaaaataattcttaatatgttctggattcagatgttccattgtgcaaatgtctctttaggtcattgctattgaatacttttttggaagaaatgtaagctattttaaaacacatgtacaatgtgtaagaaggtttattcaacaataaacaactttttctgctgtaaagcagtcatattcccaaaggggaaaaatattgaaaataataaagtaataaaatgagtgcagaaaacagtaccagttaaactacaagctgaagcctctataatagttcagcaaactttaataggccacatagaaagtattttaggtttcacaagccatatggtctttattgcaactgctcaaacttagcccttatagattaaaaacagccataaacaatatataagcaaatgaatagcttcattccaatcaaaaacttattcacaaaaactggtgtggtcagatttggtctgcagccattagtttgcctatctctgctccacaatcctgaaatggtgctacatcccatacaactcttcatttttaaatgtaagctctgtatttaaaaaaaataggaatgtaaaacaatcagaaccagaatatatacattttttgtcttttagcagtatttggctatattaactctgacaattagttgacatcaaatgggttattatgaactttctgccttaaatcttacggtatgaaatagtccaatgaaacctacagataagataatactttactattctaaattcaaacatagatgtattccatactcaatatatcccaatgagaagtgagtgaaaagtttagcatatgggataaaaatgccttagatcaattttaaacgatagattttgtcaaaggtcttttagctgggtgacaagtcttactttattaaacctcatccaattattgcttctcagtgatactggcaggacagaaggctgacagaaagggcaaagggtatatccacaggaagtgaaatatgtataataaagcacataggaaaagtgaaagataatggaaaagtactaagctttacaccaaagacagtgaaaacaacttgcttactatgccacaaaatgtttttgcctggtactttatcatttctctctttcctaacatgtcagcaagtcattgtgtggtagtttcaaaactgcaagtaacttggtaatacacaagtgctgtcatgcagtaatgttccaactcggtgttctagaaatggttcaactacaatcacagatacgtattttagggatataaactgtataacttttattcaagattgatagttctaagatagacatttatgaatttttatgccatcaatctattctgaataataacagttacatctttgctaaagtgctgtttcttcatattataacactgtaacaatttatttcaattatttcacttataagtataaatgtactggcagggcgcagtggctcatgcctgtaatcccagcattttgggaggccaaggcaggcggataacgaggtcaggagatcgagaccacggtgaaaccccgtctctactaaaaatacaaaaaattagctgggcgcggtagcaggcgcctgtagtcccagctactcagggagctgaggcaggagaatggcgtgaacctgggagggggagctcgcggtgagccgagatcacaccactgcactccagcctgggcgacagagcgagactccatctcaaaaaaaaaaaaagtataaatgtattatttgctctaatgtgctgggcattgattacttcttaaagcaaatattatctccaacaaaatgctattaatttacaaatccattgtggcatgatggggaagttgagaatacagagggagaagagatttcaagccttatgtctgatccttattagctgtgtgatattgagcaggtcataacttctgagctcctattttacctgtaaaatataggaaagaatttgctctacctcctctcatggtggttgtgaggatcttggaagatatttgtaagcaacttatatgctaccaaatgctacacaaaatttaaattattattattttccatattcccctatggataaataaaagccatttactaagttgataatttaaccactcagaaaataaataactatttcatcacattcataattgttaacttgtaactggcaggctaagtagatctagggccaaaaatctccacgtattcaaacaaatgcaaaaactcaatatacatttacccacttatgccttaggtattaattgctgtcttaaacataccagacatgtactttctcctgagagaaacatctgtttacacctagtgtgcatatagctaaaacagaatgagtaaatctctgctgaattatcatgaaagataagaatgtccttgtgattgcagttcgtcttcttgcttcagtagattttcatgtagcactttgatatttagttgcggtaaaaaagaagtcctcaaatcttactacattgttaagttttataaatcacatatcaggctttatttacacaattcaacaactaaatcagaaaagcattttaagatttaatattcaataaaaatcattattctttcttggagatttcctatatttctgagcagggcaaagatttgaggaaatgtctttaagagaataattgtattttgaaaaatcctaaaaagtcttggaacttccagctagtccttggctaactggacggtctaagttctctgggtgtgactcccagacagtaaaagaagggggaggcttgaaaatgcagtggggacactaggatccccagaactgcctactaagcttctggttggaaggtctaaggttgatcactccaccttccagtcatttcttttctccatccttctaaggaatgggtttatgtaaacctgtctgtggatgtgtgcgtggaagaaaaacgtcaaatataagccatttgaatgggtagttcaaagggtctcttttcaataatgaagttaataggtcaatcaaaaataaggttgagaccctctgatcaggagtagcttagactataatgagaattaaatctccatcctgtccaatttgtggtatattaggaaaaaaaaatagaaaaggcaccctaggaacttaggctttcaaaattatgacaggttattttccccatttgatagccctgcagatcagctccatagttataaatatatgcctttaagtaatacgatacctgctgctatggtattggctttttaaaggagtatagacacgttccagatgaaatcatgcacattatagagacagaatctctcagatcttactctcgacataggttttctaaattacaaaatagacatttttctcccaattcactgctatttgagtagaaggcacgcttttgggaaattacactatgcaataaattacaatttgatacttttttcagaggtagattttctgatttatgctttacttcttatccttttaagggtgtaatgagccatttgttagactctaaagaaaatataacacaattgacagaaatagcaatgaacatcaaaaatatttttatgatatcaaacagcttaaaataccaaataaatcctctgaaaatcctcttagcggggtgcagtggctcactcctgtaatcccagcaccttgggaggccgaggtgggtggatcacttgagctcagcaatttgaggccatcctagacaatatggtgaaacctgtctctacagaaaatacaaaaattagctgagcatggtggtccaggcctgtggtcccagctactcaggaagctgaagtgggaggatcacttgagacccggaggcacacaagttgcaatgagccatggtcatgccactgcactcagcctaggcaacagagaaagaccctgtctcaaaaagaaaagaaaaaaaaaaaccctcctaattttctattataacatgtctatgaatcataaaatcgggtcagagtgttttaaagttagaggacagctcaattcccaccccaactagctctgtatttagtaatatgattccttttgtatttctgtcagataacttgctttctatcattatcattagcagaactttactgcttgttttaattccttcactctcccatcactaccacgctcttatattctctccatctggccctaacacttctcaattccacttttatatttttcttttttgagacagtctcgctctgttgaccaggctggagtgcagtagtgcgatcataacgcattgtggcctcgaactcctgagctcaagccatcctcttgcttcagcctcctgagtagctagaactataggtgcattccaccaagctcggttttttggtgttgcttttgttttttattgtttgtagagatagagtcttgctatgttttccaggagtcttgctatgttttccaggctagtctgaaactcctgtgcctcaagtgaccctcccacctcggccttccgaagtgttgggttacaggcatgagccactgcatcctgacccaatttttatatttttctaacaatgtttcactgatcctgccaatgaacgaatgataaataagattttgatttaaaaactcctacagttttgcttgggattgttatatttcaaaaagctatgtttaagcctatttaaaattgtaagaaaatttcatgtaatcataattgatctttatttcataaaactattcagacattttctatcaaaatcctatacaggtagtattttcccccaacacttagaaatatagctcagcttggggctacattttcgtcactatttcaactagatttattggttaatttaagtagtttaatacataccattatcaaagatgtttcttttaaagtggcattaactttcagactaaaaaaagaaaagcttatcttttattttcaatttaccagacgttacagtccctacagtgataatgttagcaatctggtattaaggtgtagaaattgtgttttgtgatgtaatagatatggacttttataaaggttccattatgccccctgagaaaatgaattgacatgctcagcccatcgcccctgcttttggtctacttcacaaagctattatctcttttatttctactagataatcacaaaattttcaaaggaccattttgttgattttcccaaatctctcaaacttttacaacattaaatcactgtcctatttgcatatgaataccttgtaacagtatttctttttaaaggtactgtggtggtagctatcagccccgggaattaatccaaaaacagcctctgaagatggccttctttggtatctaatcaaaagcatcaacgccatgacagcagccctgctgggaatcctgtcagatttcatttatctgaacacattggataagtgagccaacagataaatgctttgaaataaccacttcttcattttttctttgcgttgccacaatgattttgtaatgaaaatataaaccagttaattagtattcgcactcaatgtatgatgcaattccatcttacccttctttggttatggtgagccatcttttcaaaggctaatttgaagttatattttgtagttttaaaaaaccagcattgtccagaaaaattcaccctcatcacaattaccaatactatctgctattcctccaagctctttccaatttcttctaataagctacaacaaatgacatttcttttaggcccagctagtatattggttctaggtacacgattcttaaaatattctggaaagcttctcaatggaacatcaaaggctacaaaatgtgtcatatagcagatgaccttccaagtaccaagaagactcattgagcatccactgaacacacatgaggcaacagtgctaggcaaaaaacccacccataagatgcttacagtagtctagttgttgaagtaagacataagtgcatgaaagagctaatgaatgattctatgcatatataacaatatgggaatttaagaaacagaaaagaaatgcataaagagttagagaagatctcatgctggagtaatcaagaaatacttcactacagacactctcaagtgaggctttgggtcctgaaccacaggaggctggcaggacaaatgagtggaaattgtatcaaccaagaagacatcataaagttcaaaaagcatggttttgaaaacagtgccaatatgaaggcagaagacagcagtatgttctggaaaaatataaacaaaaacaaaactcatgaccaaacatgggctttcttttcggcagttaccaaaaaaaaaaaaaaaaatagatatgcagacattttggagagcctttcaaaccagatagtatggaagcgaaaggtatattgatgtgtagggatacaacataaatgtaatacaaaaatttcagaaattctatataaaaatagacaatgactaaattactaatttatttggcaccgtattctcatcttttaaatttggaggtttgataaaataattccagacacccccccacccctccaactctatcatatcatggacatactcaaccccaaaccctgcaatattcaaagataatctgcaatgggtatgaagaaaaaaatctatttttttccaagtagtgaagtcaagaaaggcttaatgggaattgtggtatgttgaacaggatcataaagcatgacaggaatttagccaagcaaaatgggaaacaagggtattcaagacttagaaacagtgcaattttgataagattgcttttcattttccctttattctagaaaattatcttctatcatacatagtagaaggtgaattcaaatatcttatttcctgtgagctgaaatgttttgctttttgtaggtcatctttccaggtacaaaaatttttacatgggaaaggataagcacaaatgattgacggttgaagatttatatattttaatagcccaatgtctagaccaagaagacagcgaataaaaagaatgggaaatcacgttaactgaatgcccagcatgagcccctctccatgttagatgccttattgatgttatctaatttaacaatgaaggccaactgtaaatgctttccaaattttcctgttgactttttatactactaaaaaaatcaaactctcataaataaacttagttatgaatatcagtaacagttcctgttggttcaatttcaccttttgacatatcatgagattcaggaggtctggaaaaactaagctttcagtccactgaaaaccaaaatgcacaaatgtgacatactgctcttaatgttacaccatagaaaagattcttcttattattatttggaaacactgagctttcaatgtgagtcatattaagtcaaggtctataggtatagtgtaagtaaactgacctaaaaatgttaccaacaaaacttacttgcagatatttgtcacccaatggcactctggtactgctctgtaactagaaaatcccattttgtgaagctttaatgctcttctgctgttataaagggctcaccgtcatgacactgatatcatttttcacactaccttctcattttaagatattttctagctttatgtagcatcctaagttttttccaggagcatgcttcaaaataaaacaaccagtgctaccattcttcagttctttttccttgataaatagaaaggctgatgtattttataaagatttatgccttttattttcgcttttcatattcaggccttctttccccaactatattatcaatttctttctttcatatctcttgcattgtatcttatatgcaacactttgttggaaaacacagtgctcagtaattttttggtttaatcatagactagaatcctagactattagaccagaggagatatagaatttacatagttcagacacattcattttacagttgaggaaatggagataggttcagggaagttattacgatttgatcaagccttttcagttagttgatagcaagaacctgggtgtcttaataatctcatgcttttcacattttttatcccatcaatttagtcaatatttactaagtaccttctaagtgataagtatgacaccaggacaaagggtgaacaaggcacctacccttatactttctccctaatgtgtggaaatcaggaataaataggaaacataatgcgataagcataacattaccgtaagtacactgaaacaacatcaatcgcagactgagggtcagacaaggctttccggaagaaaacgtatttcaggtaagaatggaagaaggaagcaatgttaacaaagtgaacgctggagtgctgaaggtagtctacaaaagagggaagggtgggttgggcaagaggaagaaagagggaacattggacaggtaggcggggcagattgcaaatggcctggcagccttgctagtaaaattacaatttatgcttggtaatccattatcagatttaagtatggaaaaatcttcattaaatttgtattttagaatgacaactccggctgtgatgtggcgaatgaatgaggtagagagggcttgtacctttaagagcagaagaccagttagaagactactgtagtcatccatgaagtggacagtgacagctttgatttcaatttgaaaagcagtgagcctgctccaatattttaaaagtaagtcttctttctatattacaaggatggagagaaaaaaagaatgtgtttatctttgaggagtaaattaaccttggcaaggaagaatttcatattgtgggaattgaggccacaagccttaattattaaaatggatcattgcaacctgatgatggggcaaaactctgttccaattctgaagaccagcagtcctaatcaagatagatcatgtttgcaaggccagggcagctattccagccatgaacagtcatggcttaattctaaatagaagaggattttaaaataagccttcttgatactcaaaatactggaatagtctatttatttgaagtttcctcttcaattgtaaaagcaattgccaaaatatcatccaagctcctgattctcctgccaattcttatgagttttatggttgtgcagttgttcccatgccaacctaattttttaaaattattatgaggtctaaatactggcaagaaatgccaaagggggaacataagatcaaacaacgtgattgcatttttgtgcaaattcatccaatacctaggcaaaataatacaattaagatctttaaaaaatcagggaggaaggatatgtatttacatgaaagatccaaaaatcttgcttctaaaagaaatctgtacaaaattttatttcatatgataatacattatggctatgaattatgaaaaaaaacaatatgggtataaaagtagaggaaatgcttaaaggttatatatagtaaccttttatgcacattatgaaaaataattacaatgctacactaagatgaagctgcacagatttatattcattttatggatactgacccttgttttaccatcttctttggcaagcactttttttgtaatcccctaattacttctttaaaaactcctatcagtaaaacaaaggagatgatcgaattacaaaataaaaataacattttactttagactgaacaaggaaaaactcaaaataattgctatattttttgttacaagattctcaaagcattgatttctctctgcctttctacactcatctacccttatgtatgtgggactatgtcctctctgacctggacgctgcagttccagacagatatagcaacttcaggccacttttctacaaaaagtggtgaattcctcctgggaaagtattaattaccatcaaaggcctaaattaaaaatacccttctttgtgcaaacttctctgatccttccaaagagaaatattctcttctttatgcttctaattatcttacttactaacttactagctttcgatttgcaggctcacatgtaaatgcaaaataccctattttaatttgctatattttttcatataccccaatatactctggaatatatctcaatgattagatagaatagttatgtaaaaataatactgatatatgtactttataaactcatgttttataataaatgactgttcattaccatgaagtactatgtctacagtatgtataccataatctgatacttaaaaagtatgcaatgattacctttaacttccataaacttttacaagtttgtttcatttgattaagcttcagcacatggtaaagaaaatttcagggtcgggtgcagtggctcacgcctgtaatcccagcagtttgggaagccaaggcaagtggatcacctgaggtcaggagtttgagaccagcctgaccaatatggtgaaaccccgtctccactaaaaatacaaaaattagccgggcgtgctagtgcgcacctgtactcccagctactcgggaggccaaggcaggaaaattgcttgaaccctggaggcggaggctgcagtgagccaagatcgtgtcatcgcattccagcctgggcaacagagggagacgccatctcaaaaaagcaaaacaaacaaacaaacaaaaaatgattgactgaagtagatgaattaaaatcatgctagtagtatcacaatgattaatgctgtattttttaaatttacatttttaataactacaagtagaaaatttatactatttatatctacagagatatgattatatttaggaatagtgtccaaatgcatggatttatactaaactctacccgttattccatagaaaaagattttttaaaataagcttcggattcattaattaatttagtgaccacacattgataatctatcagcagggcattgtgaaagcaaaaacacggggaatacaaactggaataagaatggatccctcccctcaaatagttcttgtgtgttggagtagacaggaacaggaacagataaattcatcatggaagaactgatgtgaaacggaggtaaatacaaggtctagcaaggttgcaatggtgacaatggccaactttacctgggaaagtcggagaaaatgcccagtgttgggtagaaattcaccaggacaatgagttgaggcacaacaggaagagtgaacagtgtgtacagaggcaccgagacttaaaaagtgtggctcatttgagcaactgcctgtggctaaggatgactgaagcattgggcacatgggggagaaaagtgggagataatagccaatttgacagaggtcagacctctactctagggaagctctttggactgcatcttgtgggaaggacatggagactgagaccagggggaagagaggccagagagtagactgtgctcatggtctaaagagacagcccttcattaagcatctctttgacgtccatgcacgtgtctagacacattctaagtattgcattctgtagttttagaaattggctggaatgcataaggatttaaaaggatgacacttcactttaagatttaggttttaaattgccaaatatatattgaatgctgatcatgtatgagacaccatttttaagaactatagggtagtcaaagaggtacaggctacaactattatcccctaagacatctaaccctgatgtaaaaagtagaaacatctataggcacacacacacacacacacacacaaacaaacacacacacacacacacacacacacatatacatacatggcataccaggataggcgttatactataattacaactaagtgatatgagacagcattcagcagagcaatcttgtgaaataccattccgtgtcctgtataaatatttcaaatttaaataacgtaactcaggacttactagaccagatatagagagcagttctggggtattgcaacatttaaattcatctttgggaactgttacaggaggttgggaaaataatatgttttcttcacacacataaaatttttacaaatattcttgtgaattaacaaaacaaaacaagatttttcttgttttgaaaaagaggacagcctttatatttatatattatcagcacttcttggatattttttcaattttaaagtaacttaaggaaagtaaatggtaaaccatctgcaattcatttataaaagtctccctcttgcatatagattatactccatatgtggaataaaaataattcaatattcaacattaatgttatcaacacaaaataaatagaaaagaaattccaaaggagagaaacctaaaagaacctaatttttacatttccagttttgacatgtaatttttcaagccttacaatcctttaatacagctatttatattctatttccttcctaaatttaactatgctttccccatatgagactcaggatgctgacctataaaacaaaaagaaattccaaagaatatagtacggaaataatagaggttcatgatgtactatgctattattcaggctgaaaataaattggttttctttaagaagagacccttttttaaagataccatgtgccaacatctgtcctcttttttttcacatcccctcattccacaagagctggaccacattggcgatccagagtctaggatcaatttcatccactggtgggaagaagagttattttcagtgctctcccacatatctccaatgtgttaattcagctcccggtgatgtcttggttactctaaatggaaatgctgggttcccaaaaccaagactcaccttataagctttgagatttggggcccatttattctcagcattttacctctgaggaatgaagtcttgtctctgaactccagcccatgcctcagctcccactgctggggataaatattccttatgcagacgttttgcaggcctgcctgcctggctgagctcagcacgccatctgttctgggactccccttcactaagctctgattgtccctccagactctccatttagtccttggtgctctgacaccaactgctattctgcactctctcactgctggtgacaaggttgaatctcagaagcgccctgtgatcctggaatacagtataagttaataaatcctcccatagtttgtgttctgtgaaatggcttactgcaaagaaacacatgtccccacaaaacttagataagaaacagatgcactcctttacctatgacaaggccacaacacagatccttcaaatttccattcttggcctcagaaatgacaaattgatcaatcagaacaaaatgcaaaattctctccttccccttagactgctgaactttacacacaacctctggagaataagctgatttcagaataaaacattctcttctctgctgtctgatcataccaccattcctcacccacctccccaaacttggtgaattccagccatgtttacctctccctgtaaaagaaaatctgtcttttgctcaacttttgagacctaccagatctcatagtggaagctatctccctattatcttcctccacctataatcatccctttcaccactcttgtaataatcctttcaaataaagtatcttcttctttcagtccaaatttcctttttatttgacactggtcagtgagctttctgtctgcataactgaagtggctgactttttcgtattgccgggagtagtttttgtctcgcactacccctaatcgcgtctattaatgtccacactttcttttgcaaccacacccagataccactccctacacccttccaatctttctttcaaagcttgccacagttaacacttagagtctatgcaccacaagttattattatattagccttcctatcctcaaactcattcaattcataacatttttagtcaaagatctagaaagtaacatccaaactgtttaactaaaattcttccaagatgcctccatcttattgccatcaaatgtcctctcatctcacacatccacaatggaaagcttttaagaaatttgtcagaaactcacaagcaaggaaagaaatagcactggaaaatgtttcttattacttgagaaaagtgcttgataaccagccatgcatgggaacagcatcattgaaatagaggcgtgtaagtgcactcaagccacaaggtcccgttcgggtaaagtcagagaagcatttgcaaaaaaaaaaaaaaaaaatcacagttcttccttcaatttcctggtaaaaacacacagattaaatggaactctctttgcaggaagttgccatgcttcaaatgacatagaaaattagctaggaagcagtgagcacccttctgctccacgtcctctgtgtcctcagacagtcaccaccaccgacagccttgttttatgaagtcggataaatatactcccacatatgcatatatacatatacatatgtatatatttagtaatctcagtattttaaaaatgacattggtgatgcatcctgtatgactaagtaggccaaaaaatatgagttgttcttttctctcttctaatcagaatgaggcatcctattttggtcgattttggtgttatctgtaatgatatttgaggcccttctctatcgggaggttttggcatttcttaaaggaatgtgttggctcactcactacactctgttcttgctgctcctaaaggctcctggcgagctgcaaaaactgagctgtgcagcaaggctgtggtgtgatggctaagtggccgtgcaatgtttcattaccataaggatgccaatatagggggaagccacttgacgggaagtaatctgcaggctcagcacttggtgcaatggcccacatatctacccagtgtgctgaaattccagcaagggaaatgaatgcactaaaaagaaatgcaaatgagaaaaattaataaacacacgattaccaaaagaattttgtagcaaatacatacaggaaatgttctatatccacagtaaataaatattacaggaagctaaactgcactaagctaaacagtttttagaaatgctcctcatcccagcaggctggcattccgtgtttaaaacggatgtgtcacttcagttaaattatcactcgtttatttacttcagtctctttcaatgtctgttactttaagaataaatgatataatgaggctgtgtcaattctgatgaaagtattttccaccatcatcaaatattgtaaataattgtaagcattacaagcagtgattccatgccaaaattatgcatactacctaagattatatgcctatgttttctgaatattcatcacctgggtatacagaagggatatgaatgacaaaatcactacaaaatctataaagttgaagataatgttttttcacaatattcttaacacatccccatccattttatattatttattgagcatttactatgtgttgaccattgtgctagatacggggcttacaaaaatgaatgaactcagcagcctgtagtttcaaatgaagttactaggatttttttcaaaatgctatctataagcaagctgaggaagcatcaagatttacttccaaatatttgaaaaatgattaccaagtagagtgacacattaagttattaactaatgacttaaataaggtgcttcagtgatatcgtttgtctgtgtccccacccaaatgtcatcttgaattgtagctgccaggattctcatgtgctgtgggaagggcccagtgggagataactgaaccatcaggatggtttctcccatactgttctcatggtagtaagtctcatgagatctgatggtcttataaggggtttcccctttcacttggctctcattctctcttgcctgccgccatgtgagacatgcctttcactttctacgatgattgtgaagccctgccagccacgtggaactgtgagtccattaaacctcttttcctttataaattacccagtcttggatatgtctttatcagcagtgtgaaaatggactaatacactaaggaagttccaaatatatcttatgcgtacaatcaaatgatattttatttttatgtccaaataaagtgaaatcataaatattctgggtcttttttatattttagccaaagacatcccgatttctgtgagtcagctaagtatgttagcgcggcatcttctcaaggaaaagttttttcctgcagaacagttattgagtcccctaatagcaaccagctctgttcatcatttatgccaccaaaggccaaactcctccttatcccatgaaaactagccatgaggctggcacagggaatggctaaaaaaacatcttgagaagaataaatatagttttggtggaggtgaaatgtgtttctcagcctgaaaggtctgcaagctcttcatctttcctatttcatgataagacatcaacaaatacccttttatgaaatgaatgtttgcatgataattactaagcaactcttatttgtaacagagctaagcaatttaacaccttccagccattttctagaacaaatgtataatcataattctttcaatgcattggtggaagtacataaaagcccctggaaattgttcattttgcttacttaaagccattagctcagttaattacaagtcattgtcttgctattatttttttcatacagtttctttccacattgccatttatttagcaagaaccacacacaatggagttaaagagatttaaaagtgattggaaaagagcacactagaagtcccacattcctcagacccgcagcatcataatcttttacttgcctgtagacactgtgtatgtaatgccggtttgcctgagtccactgtcttcacagcacaagaagatgtttatcatcagactatggagtctaacacctcaatctccccttataccaaattttcctgttcttacagccgccatcacatgcctcatggagatacaataggcaaggcatgaatgaatagatgcatgcatgaaaaccagtggaaggtttacatgagagggaagacatatgaaatcagatttttaaattatcattttaatccacttatgctaattttgggagtactgtgggtttcttgactaataatttaaccagaaagactttgtaacagtgactttctccatagactctaaaaaatttaacgagttgtgagagcaattggtaaatattgaggaattttgaaagccagttgctacatttttggtagcttgagattagtcattattggcatgtgtttacaccatggcagtcagcaaatgcttcctctctctctttctcatttgagagcctgttcaccaccataccattgctaagaccttcataaagttctagcaaaaataaaagaagtggccaggcacaggaacccatgcctgtaatctcaccactttggaaatccaaggtgggtggactgcatgagcccaagagttcaagatcagcctggcaacatgatgaaaccccatatctacaaagaacacaaataaaattagccaggcatggtggcgtgggcctgtagtcccagctacttgagaggctgaggtaggaggatggcttcagcccaagaggtggaggttgcagtgagtcaagatcataccactgcactccagcctcagagacagagtgataccctgtctcaaaatatataaataaataaataaataaataagacaagtattctcaatttacctaatttcccaagtaacaagatcatgatgtgccttttacattttctgtccatattcttttggtatgtgtttttgataaactcttcttcttagagttataaatgtaacacaagtattagccactttgtaagtcagtacttgttttcataagtccaaaaactgccctcaaacatcagtgaagctagcaagcaagcaatatcctccctatctctacaggtcatgatttcatagccctcagtgaaaatctttctcagcctacgtcttttctggctgaaaaagtcgattttagactctcgttatcttccctgctcttcctcacagttctttttactcactcttctctgggactctttcagtcagtcttttcttaaatactgtagtcagattcatttgcagtatctcacttgtaggagaaaacaaaatctgccacataaccacagtaaactgatgtcttttactctcttatgtttacttatgaataatgcccatgtaatttaacaaaaatgacaacagtaagacagaaccaaagtcttcacaacaaacgaagataataagagtagaccatatcagaagagattagtagttgaagtttatattagctctgagcagaaaatgagcctaatgagattcttaatttcagatttgtgaaaaaaacaagtgttaaaaccacttaacaatgatcctttgctaatttttgagggaagtctatttttcttagtaagcctggtattaggcatctatttcaatgttctgtttttaatattatcaatgaaagaaaaattattctgagaaattaatattaactctattaatattaacgatttatcagcttaagtatgtgctgattaagacacttaataaaatacttgattaaggcagatgactgaggccacttaattctgtattttgcctttataaggctatttaataaatatttaagcatcctttaaaaatcaagctttatctttacactacctttccctttacagtaaaaacaaacaaacaaaaatcattatcataccagctggaaaaggttaactttcataggtagtatcatctcataaacataactttggtatttaaatgtaaatatacaataggagcattaggtcttttttttttttgtttctttacttccaataatttgattttaaaccttaaagcctaaactaaattacatggtcaaaaaattaccagagaatctaatttaagctatatgcccaagggtacattcactgagcaattacaacctccaagcaaaaggtattccctaactgaacaatgagcggtatactcatattgaaaaatagcgcattttttttccttttatataataaaatcctttcaattttaggatatcactttaagcgcagaaataactgatcacaaactttgaagaactctcaatgtagcatgtactccttgcataattgtgcaagatttaagcatacacagctgattctatgcaagacgagtcaccaaaaagcccaattcagagtttctcaagttatttcctatgacacacttgtgtttgacaaaatactacagagaatattccagaaaggatgcagtaatgatcaaatgagtttggaaaactgtgtaacagaaagaaaaatatctcagaacttttaatatatgagtatgcttttttttgatcattacggaatcattatgcattacttctgaaacacgtttgaatgttaaacagtttgctttcaacatcttagtttttgaaagacaatagtttttcaagcaatgttgtttcaaaatgtggttactctaagcgttagctaccaatttgctagacttttgctcttcagttgctacatttgagtgatttgagttcatttaggcatcttcatatctgaaatgctgtcctaaatatggttccctacagctttcaggctgagaaaaattatatgcaactttatttcttgagttttgaccctttctaaattatagataaattatggttctgagcattcagttcaccatttatttttctgtgctattaagtagatcaatgtattcccctaaaggcaaatactctatttctaacaacactttctacctaaaatattgctgaaaacttttgggtaaatgaacgagtcagaaaaagcagagttgctgaaattggctcattttcactgattttgtattttaatctggcttttcatttgaaaagagagctacagaatgatgttaaatgaaaaatgacattccataattcttccattcacattttcctagcacatgaagaaaacaaagtcaccttgtcaaaaagactcggcatctcattaaaatgtgtagaaatctctacatgctgttttctacatatttaccaactctaatagatggagctgcattttgagcaagaacgtttttctgtctttacagagtaagcagtggacttctacaaattctggaggctcttagaaattgtggctctgtattttgattaaggtaagtaagcaagtcaaacagtgtttagactgtgtgtagtactgatgccgggcaggcaagccccagaactggggcttggcctgggatggttcttggcctatcccaggaaataattcgagggtgagctggtggggttagacagcaacttttattgaagtggtactgaccagcagcagcagagggattgctccttgaggagcagggctaccccatccataagcagtatgcccaaagtagcagctcaggggcagttgcacaggcatatttatacctacttttaattatatgcaaattaaggagattatgcagaactttcttttaaaaaacggtggtaactttcaggttatcgggtcattgccatggaaaggggcaacagcttctaggtgttgacagggcaatggtaaactgacataggacactggtgggcatggcttatggaaagctccttctgtcccatccctgttttagctggtcctcaatttggtccagggtccaagacccacctctggagtcaagccccacctcctgagtagagtcctgcctcctacctcagtaccctgctcaggatcattttgtatgcaccatgattatttaaactttctgtgcctcaactggccccttgtaacaggcaatgagtttattggatggttcatgctttaagccatgagatggcattctagtgataggagagcttcaggtgccctgatctgaatagcaggtgtcactccagcatacttgataagaggcatgagcttacagatgacttatttgagttgacgaagtaggagagactgtggggaggtgggtaattgtcagggaagggcattgatattgtttggctgagtccccacccaaatctcatctgaattgtagatcccataatcctcaggtgtcatgggaggaaccagctggaggtaactgaatcatgggggtggtttctcctatgctatttgccttataatgagagtctcataagatctgatgcttttattagtgtctggtattttccctgcttgctctcattctccattttgccaccctgtgaagaggtgcctttaaccatgattgtaagtttcctgaggcctccccagccaggcagaactgtgagtcaattacacctcttttctttataaattacccagtctcaggtattctttcagagcactgttagaacgcaataatccagtaaattggtactggtagagtgaggtgctcatataagggtactggaaaatgtgcaagcagctttggaactgggtactaaaggcagaggatggaacagtttggagggctcagaacaagacaggaaaatgtgggaaagtttggaacttcttagagacttgaagggcttagaagacaggaagatgtgggaaagtttgtaacttcctagagatttgttgaatggctttgaccaaaataccgataatgatatgtacaataaagtccaggctgagatggtcttagagggagataaggaacttgttaggaagtagagcaaaggtgactcttactatgttttagcaaagagactggtggcattatgcccctgccctagatatctataaactttgaacttgagagagatgatttagcgtatctggtggaagaaatttccaagtggaaaagatttaagaggaagcagagcataaacatttggaaaatttgcagcctgacaatgcaataaaaaagaaaaccccattttctggggagaaattcaagcctgctacagaaatttctataagtaacaaggagcagaatgttaagcaccaagacaatggagtaaatgtctccaaggcatgtcggggaccttcctggcagcccctcccatcacaggccctaaggttgaaaaggaaaaaatggtttcctgggctgggcccagggcctccctgctgtgtgcagcctagggacttcataccctgtgtcccagatgctccagacttggctaaaaggggacaaggtacagctcagtccatgacttcagagggtgcaatccccaagccttggcacctttcatgtggtgttgagcctgcagctacacagaagtcaagaagtgaggtttggaaacctctgcttagatttcagaggacatatagacatgtatgaatgtccaggcagaagtttgctgcagagatggatccctcatggagaacctctgctaggacagcatggaagggaaatgtggggttggagcccccacacagagtccccactggggcactgcctaatggagctgtgagaagagggccaccgtcctccagaccccagaatggtagatccactgacagcttgcactgtgtgcctggaaatgccacagacgctcaaagccagcccatgaaagcagtcccggagggggactgtaccctacaaagccacaggggcagagctacccaaggccatgggagttcacctcttgcatcagcatgacttggctgtgagacacggaatcaaaggagatcattttggaactttaaggtttaacgaatgccttactggattttggacttgcacgcagcctgtagccccttgttttggctaatttctaccatttggaacaggtgtgtttacccaatgcctgtacttccattgtatctaagaagtaactaacttgttttttattttacaggctcataagcaaaagggacttgtcttgtctcagataagactttggagttgggcttttgagttaatgcagggatgagttgagactttaggggactgttgggagggcatgattgtgatttgaattgtgacgacatgagattttaaaggggccaagggcagaataatatggttgggcggcacccccactcaaatctcatcttgaattgtagctcccataatccccacgggtcatgggagggaccagttggaagtaactgaagcatgagggtggtttcctccatgccgttctcatgataaagagtgtttcacaagatctggtggttttataagtgtctggcatttcccttgattgcactcattctctctcctgccaccctgtgaagaggtgcctgccaccatgattgtaagtttcctgaagccgcctcagccatgctgaactgtgagtcaattaaacctcttttctttataaattacccagtctcaggtatttcttcacagcagtgtgagaagatagtaatatagacagctaagataaaaatgtttaaaccatgtggctcaggacggagaaccaaaaggaagacttgctgaactggaaacataaaggatggagttcaaaagggaaaagcaaaatgtaaatcatatgataaagaaatgccaacgagaaaaatcaaataattttgtatcagctctacagatccatctatttttaaatagatggacacttaatgctggatttaagcatgccctaagttaagtactttggtctttatatacatttccctaaaattttattttcctccctgacaatggggcaaatgaatataaacaggccagaacatgaatgcctttgctgagggcttggctgttctccagttcctgctgctaaatattatcagagaataagcatcaaaaccaaatttccctaatacaattctttaaacatagttcatatcctcagtgcttccaaaattctctattctttagagcttcctttcttagagcttataaacaacatgtatcagtcatgggagaggacggggtatgtctaaagaactattttgaatctatgtttatacatcaagcacacttttttcctagactttaagttgggacttaataaacatagtaaagtgtcctaaagatgttactattcatacttttcagaaggtcaattacctatattaaaagtatcactattactgctattgcaattgcattttttggaaataaatattattgtgtatatttaaggtgacatggcactataagaaacctatagagagtaaaatggttaccacagtgaagcaaaatagcatatctaccatttcacacttctttttgtgtgacaaaaccagctaaagtctacttatttaaccaaaattccaaataccataaaatattttaactatagtcctcatgttgtacattagatctctagacctgtacatcctacatatctactacttcaggtcctcagacctacacctctccatttctcactctctcccctgcaattactgttttattgttatctatttttaattattagtgatagtctagaaataatgacacggtagtcactgaagttcccccatggcatgtgacatctaaacagccactgtcaaagtcactattactttatacctgattctatactagagtaccttatattacaaagaaactgtacctctcctctatgcattaaagttggtgggggttggggggacggacactggttataaagccttttttttttattttgagacagggtctcacactgttgcccaggctggagtgcactgatgcaatcttggctctctgcaaccatcactcccaggctcaagcaacattcctcctatcttagcctcctgagtagctgggtgcacacaggtgtgcaccaccatggttggctaattttttacttttttgtagacaaagggcctctctttattgcccaggccagtctcggactcctggcctcaagtgatcctcccacattggcctcccaaagtgctggaataacaggtatgagccaccgtgcccagtcattatagagcttatttagagctcataactaatataaatagtgtaatcacttagaaaccactcacccttcttgggcttgaattctatgctatctttggttaaatttcttttcagagagtcaatatcctcatttatagaaagatcacttatttttcaccctcttgaggatggagataatacagattaagtacttggcccatattggtaattcaacaaatatcagctgccaactaatagtaataataataataccaacaaaaaccaaaaatgacccatattatttacttttaatacctcctttttcttctacaataattttatatttacttttttgtgtaagtaatcacatactgtatttcccctgtctataatatttgtctctataggcgattcagagagctttctttttagttcagattatactttatctattatccatcaagacagctcagttatcctgctcattccatccttatttcaaaatccattcatttctatcttctcatgagaacctcagtagtattgaacactaagcataaaacagaaacaaatacatctctgcagtttttgcagtgacaagttgtgtatacttgcagtaatgatgaccaccgtacatttaatgaggaactattatatgtcaaggatttatagctttacttaagcaatgaggaaactatgatgacataaactttgtatattaaaataaactctggctacatcttacatttcttttcccatgttccttttgccctgacttcttatgtaattttcaccttgttgcatgatcttatgtctaaaatctttctcttatacacatttatgacaaatattgaggaattaattatcaattaaccaatttgaaattcaatgcagttgagtaacttgtctttcccacacaacccacataataccagggactggtggtaggggttgtggattcaaacccactgcagtctgatgatacaacttctttttcctggtaagatctgttgattccatgttgactttacacagtatttcaatgagtcatgttgatttaggtataaattcttagggcgtcagccatattacatgaatgtcctggagtttgggagcacagaatatctaatttatgttttaaaaagatgtccacatcagtggctaaaatttcctaaactcagaacagggacagattttaggaagtaattgtactctcaatgatgataaatgaaagtgtatgacttgggtccctagattctgtctggggatcttccttagaaggctctgcccaagaaggctttgactaaagtgagaacctcatccatgcacggtggctcacgcctgtaatcccagcactctgggaggccaaggcgggaggatcacgaggtcaggagatcaagagcatcctggctaacacggtgaaaccccgtctctaccaaaactacaaaaatcaactcggcgtggtggtgcgtgcctgtaatccaactactcaggaggctgaggcaggagaaccacttgaacccaggaagcggagattgcagtgagccaagatcacgccactgcactccagcatggcaacagtgtgagactctcaaaaaaaaaaaaaacaaaaaaaatgagaacctcagtgaaaagatctgtcaaatgcagaaaggaaggagcctgtagcagtggaagaccctgggacaggcaccggctgcatcaagaaagctcaattggaaagaccgagtaggaaaattctcaagagcttataaaggttcccaacagatggggaagagaggaccttgatgctgaagttggagttgagcatcccactgaaatggacatgtttattacaaacacgagatgattcttttcataaaatgactagaggacttttgattaagagggagcagatgggttttagggtctaagattttattgaggggtagggaaataaccctagagtatgtttaggcaggcactgagtaggagaaatgttgtttcttattgcactctgagaagttatgttgtttcaacataatgcttgagtaattaattatatattggttatatttaataccagatgtggatatactgtaatatatttgatgtattttgaggtggagcctctaaaattgggagtacctagagcctacagaatgtttctttcaagtcctttaaattcagaaagatgtgaagctaaagtagagactgggagtctagaaactggccctcagcctgcaagactcacagagcacactactaaccctgggcaagagacatcatgtaaatcaccccccaattaccatccagtcttattcaagtaacaatgatgacttcccatactacgaaatcaccaggaaaataaatgcttcccgcccccaccccccaatctcatctcactgtaacctccgcctcctgggctcaagtcatcctccaacctcagcctcccgagtagctgggcctacaggcacacatcaccgcacccagctactttttgtatttttgtagaggcagggttttgccatgttgcccaggctggtctcaaactcctggctcacccaatccacccaccttggcctcccaaagtgctggaattacaggcctgagccaccgtgcccagccaaaaatgctactttaaatgacgctttctatctgtaatatttttatggtacactgaaaaatattatgctaagggttaacctatagttttgagaaggacgtactgtcctagagtatttcatgacaatttcttttcctttccaaggtacatttgcagttgctaaggaaccaaatttcacagccatggctatctagcaataccatatgtggataatgtcagaataattttgtgatagctactgtgaagccaaaaatcatggacattagaaataagaaaaaatttcattagattgtctgctacaaacataataaaagtctagttctccagtagaatgagtgttccaccatgagaggaaccttatatatcggtttatcattctaccttttagcctagcataactctagcacgtagtaggcattgaaaaatatctattgaaagaataaagatgtttcttctcactagtactcaaaagcagaattatttctataaggctcaagcaaagtagctctcacaggaaaaaaaatgaaatgtatttaagagaatttcaaagaaacattttgcatttataatattctcatgctccagttttccaaagtgttttgaaaatagccagatcattggaaattagttaagtaccatttaggttttatttaagttacttctttctgaaaaccatggcttacaaaaacacatgggtttaacccatctattaacacatctcctagtctcactatgtctgacactaggagaattaacccatctccttggggctcagtttttgcatctctaaagtaaggtagtgtttccttataatttagttattgtaattgcttatttatctgtggtcaatctattattaccttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctattattaccttaacttagcaaaatatctgtttcatttctgctttctgggtgagaggaaacatcagtttctggcattttgaagttggtgtaataaaaggtgatacagaatcagaaaattgcattccacaaatgatatcacagttcttggcaaaggttcagacttaaaatatttcttatgcatttttaatgtacttgatcctatatatctttgttatatgctacacaatttcaacaaagctctacagcttctgtgttatttttgtacctcaggttgacctattattgttgcatatcctcaaatattaacgtttcctagtttaatgaaggcttttcatgcaacaggctcagaagtagttctatacagtttgttgtcttagcaggttgacattcactttttttttttttgactaagtctcgctcagtcacccaggcttcagtgcagtggagccaccttggctcactgcaaccacctcccgggttcaagcgattctcctgcctcagcctcctgagtagcttggaatacaggcacatgccgccacacccagccagtatttttagtagagacagggtttcactctgttggccatgctattctcgaactcccgacctcaggtggtctgcccatctttggcctcccaaagtgctggggttacaggcatgagcaacggcgcccagccaacattcaccttttaaaataaatatttaacttctgttagtttgcagggaaaagcagcagtgcttagggacacattaattttaattaattttttcctatcattttccggtgtaccgtaccacatattgtggtgctgtatgtaacctgatacattccatctgctgcttttattctcttcagtcactatgtgatttcacaaaacaagagaaaccaagtttgtctggcataataaactcctgtgattttagctgtttagccctgtagattgttctcctacgagtacttacagatttctttttacttcatctttaaatgattgcacagagtcacaagacatcctttgatcagagcaaattattccccaagccctgccgtatcgcctcagtccttctggcttctctgtgaaggttataactaattctttacgattctgaaattcagccatgttcattatacattctcttttgtacctatagctgatcaactgttaaattaggtgaaccagtaatgaaactaatctaaagcgtcaccaaaactaaaatattatttggtaataacttttcaaggagctcaagagttgtcaataccctcaaatgaaagagacattccattttggtagagtgaggaaggagtgggctttgtaagctactgactgctttgaaatcccagatccacatctactatgtgaattaagccacttagtatctcggaacttctgtcttctttttttacacagtttctcaccttgtcacctacgctgaagtgcagtggtgccatcatagctcactgcagcctggaactcctggatttgagtaatcctcctgcctcagcctcccaagtagcttggactacaggtacacaccatctgattttcttttcttcagagacaaggtcttactatgtttccgaggctggtctcaaactcctaggctcaagtaatcatccaacctcaggctcccaaagtgctgggactacaggtgtgagcaccatacgtggccctccatcttcctaaagaatggagatagtaacaccaactctttagactgatgtgaagactaggtaaaagactaaaagaaaatggcacagaaatttatgattatcaaggaggttaaacacatatatttatctcctctgcctccctagaacttgaataaaaatgagtcaagggaataaaactgtataaactccaaaaaggcaaagagaatgggtgagggggtaacagtagaggaacaaggggatgaatgctatctgctgtaagcatccctctctctgctctgttagtggccatgaataggagacgggaagaagtgagaggggctaaaaaagaagaaatgattcataaatctgagcaatttgaaataaatgaatgagaacttagaaaactaagaaaaaaattgaaataaatagtaactccaggaaaaagaaaaagtcatacaaaaaaaagaaatataagtgaagcacaaacatctaatcttattcaatgtttacaaaaatataatgatgtaaatgcctaccgttgattttcgtcggaaaggaatatataattatatataaatgttacgaatataagagagctaaattctaatcaattatttgaggaagccaatttttaaacatttatttattatgagaaatggagtctccatattgtccaagttggagtgcagtggctaacaggaatgatcatggcatactacagcctcaaagtccttgttctctagtgatcctcctgcctcagccccgtgagtagatgggactacaagaatgtaccactgtacctggcaggaggccaatttttaaaaatcaaaagaatagtttcagtagtgtattctgtttgtagctttagtgttataattttgttttctatatgaagataatactaaaagaaatctcacagttgaaagtaacctctgtgagcatggggaaggaatggtaacatcactcattttcattataatacctgtactatttttttaaattatgtattaattactttgacaaaaatatttttataaaagagactggcaaatgcatgatcttttctgaattattcttcaatatctttttattagcatcctaataaagatcagttgtttaggctatcattaggttaataaaattatgttaatactgtatagcaacttaaaagaaattcaattaatcatcccttaacacaagcctaacacagatgcccacaaaagtaaaatgccaagtatctttcaatgtttaatttactattgaagggctgaaaactggaaggcaattttcaataaacttggtctaggtcatcatgaaattacctttcaaaagttagatccaagataatatacatcattgaaaatattaatttattgttaattatccaagcagtatacctatgatattaatactgctggtagaacactggaaaacctgcatcatctaaagctcttgagaaccataatctactcccaacacattctatcatcctcactccccaacctaccccatccctcatgaagcagaaattaaaaggacatcgctgttttgttctgttttttgagacgggctttcactctttttgaccaggctggagtgcaatggcaccattttggctcaccacaacctccgcctcccgggttcaaacaattctcctgcctcagcctcccgagtaactgggattacaggcatgcaccaccatgcccggctaattttgtatttttagtggagacggggattctccatgttcgtcaggctggtctcgaactcctgacctcaggtgatccacctccctcggccccacaaagtgctgggatcacaggcgtgagctgccgtacccggctgacacttccgttttattgggttaatttagtgattttccgctgaaagttgggcaggacacgatcccttatgtagaatgcatgaggaaaaacttgcagtaggggctggctcacagccagataagactgagaggaggggagaaggcccaggtagaatccctgttgcagaaggggttctgagaaggacacagttcacactcttcgaagggcactttgttgtcagggggaagacatgctgaagaaggatgtctattaattttttccatgtaatatatactatgaattatatatgtctctgaatcctctggacaaaccatataaaaggtacatttttgcttaattcgtggtagaattgggcttgcttttctgagattatagtaaagttttgagtctagcctcctaagtaggtaaacctaaacttccattgtggtcctgtggtccaaatttacattttctctcttttcattctcagaagggctctcaaggaccaaccaagtctcctacaccaaaagcaagaagcagcgatgaggcagctagtaaaagaatatgtgataaaattagtttctacttagctaatttctttacaataaaaacatatctgacataaaatagacacattgatgcctttttaattaagtgaagaaaacaattcactctctcttggatgatgtgagtcaatattggggaaatagtagttgggataagctgaggatttgatggacattaagttgctatcggacatcaggttcaggagctcactgatggttaatgaacttcattctggaaaaagatgcctcgatgtcagtttgatttttgctcatttgctgccttgacataaaagtgagttaagtgtgcagctgtgtgacctcctgggtattatagcatgactacactactccatagttaattagcaaatcgaaggttgaagcagccttttccggagtcataggaattgcaaggccatttgctccccattgtcctaaatatcctctgtctagttaccatcaattatttttgcttgattaatacaacccctgaatttacgatattgttgagtctcacttatactacggctaataggtgtgaagacagaagatgcttcaccctttcaagtttctcaggtgacactgatacgagttctccaagcaagcctggatgcttgacttataactgaatttcagacacaagctgatacaaaaattggatgtgggttgccataacaaaattaaattccaacatattaactgccaggaaagaggagagtgaaagaatcatattaccacttgcccctcacactgtcatagtcgacaaaagactgactgaaaggccaaagaaaagcaagaacagggaataatactgcacgagcactgaaatcaggagtaaaagcaaacacgtatcacagatatactgctgtgtgagccaaagcaaagaaaatcacaggacactacacagaattgattttcctgctgcagaaagcaaaaggagggaattctgtaagtgtctgttaagtgtccctgttttgaagatgcaatcaccggtggtccttccccacagcaggtcagaggctctggaaaccaggctggaaaggagccattattcttatttttttttattattgactaaatgactatccttcaaacattatcccattaaatcctatatgggatgaggtctggaagggaaagggacagggctgaaatttgacaagtaactggtcaccaatttagtgcaaattcaagtatggaggattggtgtgcagaataaaaagctcacaggacagaaagtctaactggacttcttactgatgtccccaccagataggactatgaacttgattttgcaaacctagtaccagttcagcagtggcaagttacttgaattaaaatgcaccaaaaaatcttctgtagccctgctttttgcatttcctccagcctccaaggctctgacagacaacttgatatgctctagccaaccctcctgctttaaggatggaattttcaatgcaagttaaaacaacaatgaaatatcatttatcacttacatcattgctaagattgaaaatattgagaatagccagctttaatgaggtggaggaaaacagtcacctttaacgactgctggtataactataaactacaaaaaaaaaaaaaaaaaaaaagccttcctggagggtaatttgacaatctgtttaaaaatttcaaatgcatattcactgacccagcaattcttctaaaaatacacactaataaccacggaagtgtccaaagatacagtatgaggatattctgttgataatagagaataactagaaaacaaaaatgtgcatcaacagagacctggaggcatcatgggaaaccatgccaaggagtacagtgtagtcattacaaataattgtatttgtctatatttagttagatggaaaaaaatctgcagtgtgtctgcaaaggaaaaaagcaagctgtcaaacagccacctgtgcaaaatattcattatgaaaaagtctgaaaggctctacaatcaaaatgtggcttgtggatttttgagcgattttcatttccttctttacaaatttatctattgtctggatattttatgaggactgtgtattgctttatccattactttataaaacagtgcgaatcagaaataaacataccaatatgtttgataaaaatgaataatttttacaaagttattacaattgataaaaaattaaaactgtcagctattctgaatatataaaataaaaagtttcagttagaccctggttgaatttaagtcagtcggttatttaatgcattaattaattgacctcagtttctccattgaaaaggtttccttcgatgccctggggccatagaccctgctgagcataggtaaagccacgtgattcactcccatcctctggaaccctcccaaacctaattccccctccctactcacgcacagagttgactggaacaaggtttgattgtgttaatgagtatataaagcaattgaagtcggtccctgttgatacttgaactgaacaagtatgttgggattctggaggccctttttcacctggacaccaaacaagaggcagagatgagaaaaaattgtatcaagagaaacaaagaagctgactttttattttcctaaattctctcaccaggcataactatacttcctgcttggtttctggaagataacacgtatttgtttccataaattctcctttgatttaagctaaggctgtggtttttttgttttctgttttctttactatttgcagctgactaaagtctggtgggtagtctctaaaatggcctccagtgatttttgccctctcattttcacacccttgtgtaattcattctcctctagtgtggacttgacctactggcatgcttctaattaatagaacatggcagaaattatgggcactaagtggtggacctattggcttctatcttacgttctatctctttctctgatgtacatacacacagacacacatacacactcacgcacacacttcgctggagcggcctcggaggatggaggctgtctattcagaggactactgcggtacgccaaccaacaaccaacaccaactgccaatcccgtgaatgggcttcttgcacatagaccctcctattctaatcaaggcttcagatgaagctgccccagccaatagttttactccaagagagaccatgagccaaatctatccccactaagctacttctggaatctcacccaacataaactgaaaataagtatttgttgttcaagccattcaactctggagtcatttgatatgctacaatagattacaaatacataatcccttattgaaataatgatatgttcaactatgggagaaatgttcaaaaataatatcagtgaaaagttggaaaatataacattgaaaatgaatgaggttgaaaatgtgaaaggcctaaataggacttctttaatttttagtcctctctgaataaaatatctttatgatatagaaatctgaatacattttcacaaagaatgcattatttttaaagtagagaaatacttcaaactattttcacttggatgtacatgtatacacatacataaagagccaactatataatgacacagttaataatatttcagattaagaaaaaatactgatgcctcacagcagtatcaataagacttaagcactgaataaatatattgaattaagaagtcaatgaatgaattttccaacagtaaccctgtttttcaactctgtaatgatccatcaatatactggctttttcatcttcagagaactcttgattctaataaaagcatttgaagcggttaatccatgtgtaaaccacatacactaaggggaaaaaaagatttgaaaagccaacgacctgacgtgatattaagtgattcaacagcctttaaaactgtggttaagcaaaggtttgaagtaaaataagaaagtatcataaaataataaaaggggtgttttattattactttaatttccttttgaaagaatcacttttctggattttgtttgttaaaaactgagatgtcctgagatagcatgaaagtgacaggacttctaataataaagatgtcaagctgttagaaatgtacttcataattgctgaatcacaggaaacaggttcctttactaagactggaagaacaaagcaaggcaggaatagttaaaacatgatgaactaagggtcagaaaaaaatatgtaaaaacaaggataagtggaagtttcaagctgagaagaatcttaggcttagaaagaaggcagtggtacaggatgctcgagtacagtacgtggaagaaaattaacaggaaataaacacataacctggagaaacaaggtgttagaacagccaatgcttactggtaaaatatccatctactgagtaaaagcaggtccttgcaagctccaaactacagatgtcaaaacaggtggaggcaacttattgtgaaacacgacagaagagcaatgaaaagccattatcttttcagcaacttgagaaaatcagaaggcacggcgagtagaaaacagagagaatataaatcacactcctttgagatatctttgctttttaaaaaaacatggttaacttacctggtcgagaatttcattgaagttgctccagagtacgtatcttattcacaaagaagtcctttttgtttaatgtctctattaagaacactagtattgtctagagcaaaaatacctacaccctcctaagtacctatatcagataaactgactaataatctcctgactgctatagtgattcccagaccaagaaagttcatagcagatggtgtcaacaaccccactgctccagtctcctgggtagaggaaagggttttgcaaatttggtgacccgctttggactctccaagcctcaaagaaatcagaggttattatgaaactgtccaatggtacaaagattttgctcaatggccgtcaataacttaaccagagtttctcatctaaaccaaagaaaagagaaaatcatttgagagactacagtctcaatacttccaggaataatatataattagtacaattttagatgtacaggagataaatgaatccattacacataacgggtagctaaagccatcagggattaattctcttgtaaatccaggtgcatgggtggcatgaaaataaacaacataaaacttttgagctgctgcaactaaaacaaatgtctaatgcatgatatgcctaacatatatactgaagtccatgttgaagccaaagtggaatgtgcacctcatatttaaagccaggttattatacaactaactccgtcactttagtaacgtgagaatgccagacagcttgccagacagagagacacatcacagagtctgtattagtcagtgatatagtttgaacatatgtccccatccaaatctcatgttgaaatgtaacccccaatgatggaggtggggccgggtagaaggtattttgatcccgggggtagatccctcatgaaaggcttggactatctcctcggtggttaagtgagctctcgctctgagttctggccatttaaaaggctatggcactttccccccaccctctctctcttgtccctgctctcaccatgtgaagtgcctgcccctaccgtgccttccgcgaggaaaagtttctccaagcctcctcagaagcagaggctggcaccatgcttcctgtatagcctgcaggcccatgagtcaattaaacctgtgtttaattataaattaaatttataatcctttataaatcagcaatttccaacctttttggcaccagggaccagttttgtggaagacaagttttccagggatgtaggggtgggtgagaactactccacctcagatcttcaggcattagattctcataaggagaatgcaacctagatccctcacatgcacggttcacgatagagtttgtgcttctatgagaatctaaagatgcaactgatctgacaggagatgaagctcaggaggtcatattcactcaccacttaccccctgcatgtggcccggttcctaacaggccatgaactgggggttggggactcctgttataaattatccagtatctggtttttctttatagcaaggcaaagacaacctaacacagtcagctttcactagttttgctcctaaaaccaaagtgtcttaaaacaacaaggatatatttctcactcaaagtacctgtgggctgtgagtcacctaaagcagcagaccctacatgaaataagctgatctctggaaaggagcaaaaatgggaccacccagcttttgctcagcctggtcatgcctcccttccagtggccagagtgtcccacatccaagactcttatgaagggctggaaagtagacatctcccttagagagggtcaccagagaggggacacagagagatggaccccagtacagacagcagagcaaatatgttgagcaaataatagtctatcatggagtaaacagtacaatatatcatagaggcagaaacttcagaatgccaccatatgctctgagttgtaagtaacaggtgatcaatattttgtaaagaaaattaaaggaagcaaccatccttcagaaaccatttgaagagggctttgcatttaaagttgcacttcaagcaattataaacaaaaaatgggagtatttagtaattcgactgagacagtcagtcaagactctgatgcccattgtttatatcctgccagaatttgtataaaaagttatagtccttttgatgaacatgagaggttggttaacagatacaaaattacagctagataggaggaataagctctagtgttctacagcagtgtagggtaaaattaattaacaacaatatattgtataatttcaaatagtgagaagagccgattttgaatattcccaacaccaagaaatgataaatgcagccaagcatggtagctcacccctgagatcccagcactttgggaggccaaggaaagtggatagcttgagcccaggagttcgagaccagcctgggaaacatggtgaaacatgtatttctactaaaaatacagaaaaatcagctgagtgtggtggtgcacgcctatagtcccagctacttgggaggctgaggtggaacaatggcttgagcccgggaggcagaggttgcagtgagctgagatcacgccattgcactccagcctgggtgacagacccagaccctgtctcacaaaaaataaataaataagtgtttcaggtaattaatatgctatcataattatcctgatttgatcattatacattgtatgcatgtattgaaatatcatactgtaccccataaatatgtatgattatgtgccaactgaaataatgcaaaacaatactcctatcttgacctagcaacttcaatttttagtattctagaaaatattaaagtagcacaacagatgtattcacaagtaagttgagtagagcaatgtatacgaaaccagccaactggaaacgtcataactgagccacaagtttggtgtgcaaaattatgctgtattcatattaatataattctctgcagacataaaaatgacatgaagaacgcctattaaatatatttatgatacatgatataattgatcaccatgcaaaattgaatatacagtataaacctgatttgcagaaaaaatgtatatagctttaggcataaagaagagtgggctgagcgtggtgacttacacctgttatcctagcactttgggagtctgaggcaggtggactgcctgagctcaggagctcgagatcagcctggacaacatggcgaaactctgtctctactaaaatacaaaaaatcagtcaggtgtagtggcgcacacctgtagtccaagctactcgagaggccgaagcaggagaatcgcttgaacttgggaggcagaggttgcagtgagccaagatcgtgccattgcactccagcctgggtgacagagtgagattccctctcaaaaaaaaaaaaaaaaaatagaagagtgaagtgaaggtcaatgctgaaatatttaaagtgattatttctagatgccacatttataggtaactttcatttttttctgtatgtttcactccagttttcaaggagactcaattaattactttaaaatggctaatgtccaaaaacgcagactatgagtcctgaaagactgaggccttatttctgcataggggctttagattgtcactaggcaatctaaagttcctacgcagaaataagaaataaattgtcatttagggtagaaataattgccttaaaccttgagggatttaatggcttatcacctgtcctaagagaacttgccaatcgtgacaagaaagactcattttatcagcatggtgaaatcactcttggatagaatgtacttggaaagaacatacctgaaaagctgcagagttcttgactgtcatgatttgctgtttttcactaactttctttcaccttcccagcttgaaatgacaaaaccattcttctgaaaacgtccattatctcgttgaaagacatttcctcaaagctccttatctttgcaatacataccaatgtaaagaaagcacttctcggccaggcgcggtggctcatgcctgtaatcccagcattctgggagtccaaggcagacggatcacctgaggtcaggagttcaagaccagcctggccaacatggtgaaaccccgttgctattaaaatacaaaaaattagctgagtgtggtggtggatgccttgtaatcccagctactcaggaggctgaggcaggagattcgcttgaacccaggagacggaggtggcagtaagccgagcatgcagcatcgcactccgcctgggcaacaagagggaaactctgtctcaaaaaaaaaaaaaaagaaaagaaaaagaaagaaagagaaaagaaagcaagcacttctcaaatattctcaaatagtttcttttctctgggaatctttcatgaaaaaaacatgaacagtgaacctccaatttacatgagcatacatacctgtacccaaatgatgcctaaaatgatgcagaggcagaaaaatacttgaacagctctgctaaggcccaatattacatacatagatgatgacattttatacttacccataaatatttttccctactcacaatatgatatttttctcataaaagtagcgcatggctaggcagggtggctcatgcctgtgatcccagcactttgggagcctgaggcaggaggaacacttgaccccaggagcccaggagtgagctcacaccactgcacaccagccacactgcagattacgccactgtactctaggctgggtgacaaagcaagaccgtctcttaagggggaaaaaaaaaaagtagcccgtaatttttttcattttttacaaagaaaaaaataaaaagaacaacaacaatgacaacaagaaccatttggagttcatacaaattcacggattcaattcatgctttatgccttcatcacttgtaatactcaggaccaggaggctaccacaccagactaatgtcctggttctactaggcttacagctctggaacaagtgaacatgtcttgtctcttcctccaaaacaacacacttacactcatggacatgcagacacagacacactcttaggcaccctgaatgaaacctttacagtactagatcattgtggacctagcacttagcactactgtatacctccactagctgaactatgctagtggaatatggcattcaatctattcccctttctaaaaacaaatgtaaaaatggagcaaaatacccatttggcctacaaagaaacgtagagaccatctggccttgttgttcctccttctcaggccctcggccttccgcaggtccattccagggccgctcttgcccagtgactggcagaactgtcctcacttttgttttgctgttgctagatttccattctttgtccatgcacttgcctctcaccaccccctttcctttggcaaacacaaatggtatcatctccaatccttaccatttctccttttctctagatctctcttatttcttctctactccatctcttatcacaatttttctagtttgccacaaaaaaaaaaatggtgaaaagatatagtccccattcatcagggaatccctttcctcctccatatcaccccataccaggtttctctttctgtttatcctccgttatccatttttcccagttctaaaggccaaaacccctaccctaaatttttccttttttgctagctatttgtggaatctgaggtcctaagaaggctgttctccacatggctgatatttttgtgcattttttatgtgcatatagcaataaatataaatcatagctgtaacttttgatatatacttgggttaaaaagaattcttcaatatttaatctaaaaggtgcatagtgtgatttaatatttttcatgagtagtaagaagaaaaaatattactactttatgctaaaacctactgaagcatattcagaatactaaggaagagtcataattcttcttatttagaaattcatttggaacttataattcatttagaatgtataattcatgtggaaaatatctgggtaggttctttgaatataaatagtgaggcctctagggcatggtctacaaaataaaggtaaaggagtttaggatttccccaaagacaattttggagatggaagatgagggtcacagggatgaggagacccagagtgacaaagaaagatctagacagggagaaagatcctagaaatattatgtgaagtctaaactcaaggagggttataatcactctgtggtcaggtaatggcagtgcagtattgtcaaatatatatttggtcttcaacctgtttcctgatatacaactcctaaaatccttaaaatctccaaagtgatggtttttgtctgcaaatgatcaacagatggctgcaatccctacgtagcttcaggatgggagctggtcacctgaaagaccagaacatctgaaagaccagccttctgagaggggagggggcctaaggtcaagttgattatcaatggccaatgatttaatcagtcatgcctaggtaatgaggcctctataaaaatccaagagcaaagggtttagatagcttctagatagctgaacacatgtaggttcccgaagggtggtccacggagagcaggcatgggagctcaccaccacaattactgccttaggtgactcttcacatgtatcctttctagtatcctttataagaaactgaaaaaaacatggttccctgagttctgtgagtctctccagaaaattaattgaacccaaagagtgggtcatgggaactctgacttgaaaccagtcatcagaagttcctgaggcttgggcttgtgactggcatccaaagctggggagcagtcttggggactgagccctcaacctgtggcatctgaagctacttccaggtagatgctgccagagttgaattggaggatatgcagcttgtgtccactgcagaactgattgcttgcctggtgtgtgggcaacctctcccatatatttcatcatagaagtcttccctgttgactgtttttgtgagtggtgtgagaacagaggaaaaagagtttgaaggtttttttattttttttgttcccccctccctcgcccccgccccccccaccctcccccccacccccgccacacacacacagatggtgtctgaatcagcttaatggcagataattttctgggaccagtaatatgacactgaatttggggtaacccctctaattcctgcctttctctactcacaaattaagttgcaaatggtaagtgtgctacaactttgtgccaataggcacttagggggaaaaaggaagagaggtgttcattatagacgagtaggagacagaacagcagcatcaagacctgatttttttgttgtttttcacttttaattgtggtaaaattcatagaacataagctttaccatattggcccatttttaagtgtacagttcagtagtgttacattcacattgttgtataaccagtctccaaaacgattttcgtcttgtaaaactgaaactctgtatcttttaaactgtctctgtgaatctgactactctagacatctcagggaagtgcaataacacattatttgtctttttgtggcaggataatttcactcagaataatgtcctcaagattggtccatattgtagcaattcatccaattgaccatattgtgtcagaatcaccatcctttgtaaatttgaataatattccattttacatatctactccgctgtgtttatcgatttatcttttgatagactcttgggtgcttccacctttgggctactgtgaataacgctgctatgaacagacgtgtgagacgagaattttgaacaggagtcagtccactagtgtagatggacccagcaacacaaccctattccccaggagagtcaattttgaaagaaggaaaagtagccatgtgatttatatattcaacattttttttcggttacctatagccctctcccaatttttctaggctttgtagaaaacattttcacattaaaactatacattaaagcagacatctccacttaagtgttcagtaggcatatgagacttaacatgtctaaactaactttccgatcttccccatgaatctgacttcaattggtgctctgctcttgtcagttgagggccactgcatcctcccaggtgctcaggccaaaaggcacatgccaccgtctatgcctccattctgtctattctcaacatagcatgcagaggcatccttgagacagtcttgctttgtcacccagcctagagtacactggcgtaatctggtgtgcagccactacagtggctggtgtgcagtggtgtgagctcactcctgggctcctgggatcaagcattccttttcatcttaagtcaaatcatgatgctctcctgctcagtccttcaacggcctctttctctgcaagatctgaagatcttgcagtggcctctcaaatccttaggtgatctggttccctgctccctctctcacctcctaccattcttcaccctcctcctgtgggtccaaccccattgaactctcttctgtcccttgaatatacccacctactccaacattacatcatggactttaaacgctctccccctacatcatccatgactcccttgtttacctcccctactgtcgactctcctgtaaggtctttcccaggtaaccatatttaaaatttcagctttctcatttcctgaaatgctccttgtctgtcttctctgctttatttttctccacagcacttaccccactcattataccatatatactttatttatttgtcttagacatcctcaatttttcaccatcaggatgtctgcttcatgagggccagggctgtatgtgttttgcctacttctgtatcctcagcagtgggcagtgcctggtgtccagtaggtgcttaatgggtctctgtgaaatgaattaaatttgtatgaatgaatgaattaaagcaaaaagtcaagtttggggaaagaaaaaagttcagcaaacatgttgtaaaaagtagaaaccaaaaaatttcaactaaggtttttccatgttactcatttaacaaaatacaaataagtcacatcaaacagttggcaattaacaaattaaaaagaggctgggtgccgtggctcacatctataatcctagcactttggaaggccaagatatgtagatcacttgaggccaggagttcaagaccagcctgggcaacatgacgaaaccccatatctataaaaattacaaaaattagctgggcgtgggggtgcacacctgtagtcccagctacttggctgggacacgagaatcacttgagcccaggaagtggaggttgcagtgacccaagattgcaccacggcactccagcctgggtaacagcgtgaaaagaggcaaactgccttgactatatgcctatagagatttactgtaaacagaatcagtttcttaaagaattttaatcttacacttgaacaaagtttgtattggatgaagacatctatgatattttgtgtgcctcattttatcaattcacaagaggaaatgttttgttagacctgttaagaaagtggacaaataactcaagacatacccataccatagcttttgcattaatcaatagattaaagacacataaagaaataaataacgaggaatttttttaaaaaacggccaaaagttctgtggccagcacctgtcccacctctaacccaaaggaacattttatgtggagttattcaggagaatggcatttaaattttagacaactgatacttttctttcttacagctacttgtaaattactttcagaaagagccatatatcctttagctacaagtcacgtggatagatactccttcatgactcagttctgtttccaaagtgttttgatactcagataatgttaatgcaagaaaagaactgccccttctccagcttttcacttatcttatggcatcggcctttgaaataacaaattcagtctaaaactgtgtttcacttttcataagagttaggaaaattctggctctctcaagtggattatatccaggacaccttatcatcatcttctgaacctaccatgtctatgtttttctctcatgatctgtgtaaccatttagtaatttattagatttttatagcatcttacctctaaagagttctaatactttatagagagttcctaaaagtgaaagtttataaacatttcctaaacatttatcctacaatagcaaggaaatcatgaaactgcagaaacagtctaaataactgagatagggaaaatgaagatgaaagaggagaagtaaaagtggtcggagtaggcagcagtaaatttgcataaaatgtcttgtgtcttaaaaccttcaaaacattattttgaaatcatttcgtgctcagttgtatttctcaggtatgctatgactaggactgcagacagatcaccaaagaactggacgcctttgttatacacatgtgtttgcatgggattctgtacgtaacagttcttgcttggggtcatctttgcaaagtcatatccagccattctttgttactggcttatacttatataacatttatcatgtgtcggccaccgttttaaacactttacaagcattaccacattgaatccacacaacgtcttatgaggtagacacaaaaattagtctatcttcatttcagagctgaggaaactgaggcataactactaagtaggagatccaaggttcagccttcaggctgtcttgattagaagccatgctgtttaccattacgctaagttgcatttatatacactgaaaggccagaagatatgaatactggaaacgacttcactcatttcccttcactccctgttttgttttgttattgactgtgtggtttcttttttcttcttcatttaatcttgaagttctaataaaaatatatgattttacttatcctatttcttaaagaaaaagtctgatagctattgcttaactagagaccctaaagtaaattactgctaagtttaactaatgtcgacttatttggttacaattactttttactgcatacttttgtactattgatctggaggattcttataactcttaaatatttctttattatttacagcaatttgccctttaataagtaaaatatgacaagcaaaggtttagataaatagtatactaagtttcactgtccaaaagaaaaattcaactttacataccatggtgtcttttgggctgctattgagacagccaggtgggagggtgtcctcagagaaactccagccagcctgcccactgaggtggggcctcagaaagttcaggacgtttacaggggaaggaggctggcctctccgcttcctgcgtggaacctggcattccaatggccgccgggaagcgctctagcagggactctgacctagcgagggttcctgtttcccccttttctatcttttcacctaataaaaccctatctcactcaccattcaaattgtcagcaagcctgaattttcatggccatgggacaaagaaccgtgtcttcagctgaactaaggaaaagtcctgtaacatttttggtgcccaatgtgggggcttgagaagtggtgagtgaaatggggactcaaaacctctcactgttgcttctacgccttttcaacctcagaatcctgagggtgggggataccatgcctttttcttccttttacaggacccaccggtgagcagcagctcccagccgctccccactccatgacagaacagctcccagccactccgcactccatgacaggactgggacgcatggtccacgggtttgggagccactggcagtccccgccacgtgctgctgctggagccctccccagcccaggggttttactccctaggacagtaattgaattaatctccgtggtggaagaaccacttgcctaagaataagaggttcttccccaggcatttttaaactttttttttttttcctcttctccaccccatcagcagttaagttttaagcaagtttttttttttttttaagaagacattttactaggccaggctccccaactatcactgttgataatttctttaaagctttaattgtgaaaaagggtttgtgaggctagtcttgggctgtggccaatctggtgtgctttgcatgtctgtatggttagtgctgcaagcctccatcttgttttacatcttgcgggtatggctgtaaccccttggcaacgctttgcttagcagtcctgacttacggaataagcttctttctggtttgatacctgcatgttttcccagccctgtctcttaaagggccccacccagcaactgggttttcttctgcctgtgtgtgtactgtgtgatgtgtgtcaaaagagctctaattaggccaggcgcagtggctcatgcctgtaatcccagcactttgggaggcccaggtgggcagatcacgaggtcaggagttcaagaccagcctgaccaacatggtgaaaccctgtctctaataaaaatacaaaaattagccaggcgtggtggtacatgcctgtaatcccagctactcaggaggctgaggcagaaatgcatgaacccgggaggcagaggttgcagtgagccgagatcacgccactgctgcactccagcctgggacagagcgagactctgtcctccccgcccccaccaaaaaaaacctctaattaatttggcctgaagaaaaaagctgtggaacctttcagttcacgtgactttaaccttaataaataaaaacagccctaaagactattggtaacatgcaacatgcgggtcagaagcaaggtttgccaggtgttttgaggttacaaactgctttttgggttttgagaactatttgacatgctggctttagatttgatatggcctggggacatatggaactaactaccccgcaactaagaagccataccttggctgcagttagcacacaattaaagcaacttaccaagttttaccttgaagttcaaaattgctaggagttaattgaaactactagaaatatatttacacgcaaggtgtatgagaacagtaaaatgtgttttttaatcaaaggttataagaaggtatggaaatgtaaccttttgcttagggttaaagtattttgagttaggaaaaagctgaagttgcaaagaagtggtggaggaattgtggaaattaatcttgcagaagagcttctccgtgtgaacatatcgactatattcaaaaagggtgtcatatggtttttctgtaaattgagcactgaaataaaatcataacaaggttttcccaaggtgtgaatcttctttttggcaaaatttttaaagggttgtaaaaggattttgcttcttcaacatttctgagttatcattttggcaaaataaataatttatggaaatctggattctatttcataatatcgagtgttttaaacctcgaacatttaatagccttcccaaaatcaaactccagtttcaaaattgtcttccctggcacctggctttttgaattcttcaaagggcccgtggaatttccagaaaagaaaggtaaacaggattatttgacatgttcaggtacatgggattgccaaaatgatgctcaatccttttttttttcttttttttttttttctttttttgagacggagtctcgctctgtcgcccaggctggagtgcagtggcaagatctcagctcactgcaagctctgcctcccgggttcacaccattctcctgcctcagcctcctgggtagctgggactacaggcgcccaccaccatgcccagctagttttttctattttttagtagagatggggtttcaccgtgttagccaggatggtctccatctcctgacctcatgatccgcccgccttggcctcccaaagtgctgggattacaggtgtgagccaccacgcctggccgatgcacaaccttctttaggttttatcttggtgaataatgctaatatatattgcaaacttatatgggatttctaaaaattctaatgtctgagtatatgctatcaatcataattaaggtttatgttaagatattgtaaacaacagagataaccaaacttatttgtcaattgtgtttctaactgcaactaccctgcacattttgctattcacagacaattgttgtcttgttttaatcctcttcaagggtggtttataatgagttatagaacattaacaggtgctctcaaatacagccttctgataactttagagattgtaacattggaataaaggaaaatgtacaggattcacaaagagctgaaatgttcatgaatatcaagcaaaactcgagttaactaaatggactgaactcaggaagctgaagcgaatctttttgacttttgtttagaaaattgctgattcttgttttgtttttttttcagagtcaaggaaacttattttttaactatttatgacctttaataattgagtaaggtatacccccgtgatcaaaatttggagtatgtttgtttctctctgcctggttcctctaaaatttggaaactatctgtgagtatcctcgtggcaataaggctatttgcatcagtgcaataagaatccatttttcttttgcaacagaacacaattggagaaagtgattattttaccaaggctttgactggataggtatgcttccctttaaggtgtcaatctagacttgcagagccgagaaaagcctcatggaggaaactggcctcacgtcctcatctacgtagtccctgtacagggttcttgacctgtggtcagtaaagactgtcactttctaacaggtctaggagctccaagttcatcttgggacttaagaggagagaattacccaactcaggtgtttgaggatgcaaacccatggttgtgctcagctttaaaaggtcttagctgagattccttgtggaacagacttccatcaaagccaaaccaaaaggcctctgcagaaataattattctttctgcgctttatgcaaataaacagaccaagtgtaagactaaaggctattttgcaaaccactcagtcctttttataatttgggatgtttaaaaaaaaatacggtctagagagaggcaaattatatttcaaacttatatatttgtcattaaattctaaactcactagttgtcttaagtttttgcctatattttaggctaaccctgcttgttcctgtgaaccaaccagcaacctctggctgtagatcagaaagaacacgagggatgggtaatgtacaaatcctgatcaatattctagttctgaccaatgatcctgcaaatcctgccaggtcatgggaataaatagggtgcccatcacttggcggtttctttttgggaaagtaagaccaagggagctaaccaaagccaagcacaataacacccaaatctttgcagcataactatagccaccagctatctgggtatgtcacaagacatcctttcctctctcttgttggaggaggactcaatttcacaatttcaccttagcatttggcttatgttaaggaatccatgcgacacccccacctcccaagatacatttttgtccaagcctcaattccaagcttcaggtcagagccctaggaaggaaaactgggtctaagggattcagaggcagatgacaacagagcttaaaaggcacagcgcaggtgagcgtggctgattcctgacgattaagccaaccccaggcttcctgtttcatgggtaaagaccaaattactgtccatggcataaacgaggtctaggaacgcagaggctactgacggtaggaaagagatataggtgagagcagataattccctattcgagcagagaattccctattctctagctccccccacaacccaacccttgcttcatgggcgtgagctgctttggtactcatggcagtacctgccaaggtcgctggaactcggggatgcaaggatggaagacggagagaagacgctcttccctgtctccatcacttacccccggtatctgctaggaagagaagggaaccagggacacctgttcccctctttctagatgggtagccattcatcttcagtctgtacccatttcgaatgcatcctgaacccctgggactcctttgaaaagtgctttctttttcttttctcctcctctgtcctttcttcagttaggcaattgtgtctccatatgacgggaccctcccctcagatgcatcctccaaactgggaagagttaatttcccaaaccttaaactagttggtttaggattgggcttgggggaagggaacccagaagctcagcatgctggcaaaaggctgaagtttttttgtcattcaggcttttagcctcccactcctgtgtaaactggtaaaaggcctgggaatttatgagctgtctttaccccttgccttgttttgttttgatacatgttttctaataatctggtttgtctgtctttgccttcaggccatcaaactctagtcatgcaaccatagcctctaacaatggcccctgctgggaacccttaaataggcctctaaggaagctctgactgccgcttcccccaaaacagcgccccctgtcagcaagaagcagttaagattggtcttcgcccttatccctaatctaagggcagttagatgtacttctttaaagggggaaatgagacagccagggaggagggtgtcctcagagaaactccaacagcctgcccactgaggtggggacttggaaagttcaggacgtttgcagggggaggagcctgcctcttcctgtgtggaatcagggattccaatagcgggtaggaaactctctagcagggactccagtcaaacgagagtcactgttttccccttttcttccttttcacccaatagaacactgtctcactcacctttcaaattatctgtgagcctgaattttcatggggtggaacaaagaaccctgtctttagctgactaaggaaaagtcctgcaacactgtaacagagtaccctagactaggcggctaataaacaacaaccatttatttcttagaatcctggagacttgaagtctgggatcagcttttcttgagggctttctttccaggttgcacactgctcatttcctgtatcttcacatggtgaaaagatggcaaggaagctctccacaattccttttagaaaggtacaaatcccatccataagggctccatctcccaataccacaaactaggggcttctatttcaatgtttccattctggggggatgcaaactctcagtccactgcacatggtttaccatacctaggatttaagtatcttagttggcattaacctagaaaagagtgaactacgtaatttcatcatagatatttgtttccagtcgaaaatactgcagccaagtatttaaatctttgtggccaggaaaaaggacatctaaatgacacacttcagtttggataactgagtggtttatcattcaaagaacgttttaaatggcaattgaaaaactttctgtcaatatgatagatgatcagtaattaaatttttttccatgtgcagactgaagttattttgtcataaataatattatatacctgctctctgacacaccttgtctgtgcctgcctgagatctaaagtttcctggccaccttgactttcatacatgacttgtctcttcctgctcaaggacacatttgatctacagcttcaatttcatttattcagttggtcacttacacaacaaacctcactgagcacttcctcttccccaaagatataaaaaaaaaaggaaaaagcacaatttcccagccttgaataaatcacatctaatagaaaaatggataaatggacaactttccacccctgcttagagaccagctttccacctctcagagaccattctgtgaccataactaaaattctttctcagtgccccaactctaaagtgctttcttcttcaacagactggggaatttgaaaacccactttaaatgaaagagtccaccagatcatgtgtccctggaatccaggtgactgggttttgttttgtttttttaaactttctatgcacgctctttcaaaagcaaatagaaaagtgttttatgcagaatagtcgatgtatttgaactatgcagtgttttagtatctttgtatatagtcttacaagggatccatattacatttctgagctccctataggaataaaaaacatcaactagacttttgatatggactatataaaatgaatgaagaagtaagaaattgtgaaacatctatgattcgtttaatgcaacaaaagaggcacagttgtgtaatccagtgaaatgttttgaataaataaaaattacaaaatttagatgatttggtagctgtgtgtattctaacattctaagtattaaattgattattcagataatatttagactaacaaacaaattatgaggctatctgcaatataaataatgaagaacaataatttaaaacaacagaaacaattttacctagacaaaagataacaagaaagacttaaatgcttcctgttggagctgactttctagacatagatataatctgctacctactcttaattgaaaaaagataaagtagtctttgagttagttcattttcctgaattataatcatcatcgaagtatattttaaaagcttaaagttgaaagagattgtgcagggtaaaagaatccagtcccaattcccagcagagttactcaaccctagaaaaaagtgtctcatgcttgagtagctggaaacagatctagaaacataaatacccttttccatataaagtgttttattgcattttatttaattttatcaggcacaggaaataatatgttgctccctgtgcaatgatggaagcacccactgaaaggacaccagcccttcagagtccctgtgctctgaaaatcactcaaagtctaaaagctacttctctttttagctggagatccaactgggtattatgtagaaattcaattaagttcagatttctctgcagccataaagtttattcctatgaattagaagttcttctgatttcactttggataatttttgcctcttaatcttattagcatgtgagcccttgatcctcttcctttttgaataaagtggatatcaagcctgttgtagatgatttgcatgcaatctcagatgtggtatgtgtcgaatagtacatctcggtctcacctgtagggacacctagtaaaaccttctctcaattccatctaaaatcatgagcaactgcatattcattgccaaacgagctgtcttcacctaaatggcttgtaacctatattcagaggtcactgacagccaagtcaattgaacagagtgccttctcactccattgaaaggtaacaggagcccttgatcccttcaacattatttgtgccagcaaagagaactaataacttgaaaacagagatttctatgtgaaaaatgccaatttctacacaaaacaaataacaaaagcccgttaagcaaaatagaactattcaacattatattttacttagtttaaaggaaaaaaatgccttttatactctgtttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatctgcccgtctcggcctcccaaagtgctgggtctattttttataaaatagaaatcaaatgttttatgtaatgactagtgaaaaagaaaacacccactagagagtaggagtcaggaaactaagcaaaccatttaaccattctaagtctcagaatatttataaaaaattaaaatctaaagtttttccttcaatttacatggtcaacttcatttgtattaacgaaataccaaagaaactcttgtcaaatatcaaaaggagtgacttcctaaccaatacacttggtcttggagtctattaaaaaatcttcctgggatagaattttacctttatcaacatgcgtagaaacattttcataatgcgctttactgcttcagacatttggcaaaagtagatactttaaaaaattatgcaataccacaaacaagattttacctgaattcttcatagcaatatataaatgggttgttctattgatgtataaagatgtatatacaaagaggaaaataaaaacttaatatggaaaacgtattaatactagttaaatccaaagaagtcattacgagatttcattttaaattgactattctgaacttttttggataacaatgttgtgataattcactaattataacattcaaacatataagtcctcgacttttaaattctcactgtagtctaaggggttgtgtgcagacttaagaaaaaggcagtaaatccagtattgaaaagcccaggcttgccactgtaagcctgacttactatttgtgtgacctttagcaattttttaaaatgtattgtaataaaaaacatataacatggaatttaccatcttagccattttaaagtgtacagtagagtaattttaaaaatattcacattattgtgaaacagatctccaggaatttttcatcgtgcaattttgaaacactgtacccactggagcaacgtttaacttatttaagtctcagttttctcatctataaaaatggatgatgatagcaccatttatgactaaatgagacagtttctataaagcctataacataatacctggcacatatctagggctcactgaatgtagagaattattacatgagtgtctttaattgcatattaaatggaggagtgccttgtatattataatatgtagtatgatttcacaaaatatgtgtaaattaaagcttttaagatgcatttttaaaagctcattttatgtggtattcttgaagattcattttaaaatgattcttggtaagacacagaacattccctaatgtctatgtcttgtaaagttggaatggtcatcaggcagtttttaattggcattttctcagactcaagttcttcgttagcagattcattcatttatttagagacaccacccaggctgaaatgcagtggtgtgatcatggctcactgcagctttgacctctagggctcaagtgatcctcctgcctcagttgggagcataggcatgcaccaccacacctggctaatttttttatttttaatagaggcaaagtctcactacattactggtcgcaaactcctgggctcaagcaatccttccacttcagcctcccaacgtactgggattacaggtgtgagccactgcacccgttatactttatttaaacattctttttagtgtgcacttcagttaagggccgtcattgatcatgctgcatattataccaacagatctattttaatggatgttaatagttcaaaacatcatgggaatgccttcacagtcacaagtgagtaaaacattgtcctaatcctcaaggatttaaataggactagcgaaactcaccagcaactaaactgttacatcatgtagggtaggtgatgtaaaagatcaaatagttttttcattgtgtaaatatattacagcttatgtaccaattattctgtcaattgacttcagtgtttgggttgtttccatgtttttgctgttgcaaacagagctgctaaaaacattgtatataaccccagaggcaaaacaaagataaaacagaaccccagaacttgcttcattattgatcttttattgacagagagcaaaaaaactaagcagctgtggtaagcttgacgaaaatacaaaagtatactttatgtaatataaatatacctataaaaacaaagacacataagaatttctctcagaatttttgagttgaagtcaatgtttaactttacaagatggtatcaaattattttcccaagcgattgtaccattttacaacccttccctaacattaatagtgtataaacgatccaatttatccacatgccttccaacactcggttcagacagaattcttaattgttgccagtgtaatagtatggaactgtatctcatcacaatctccatgtgcatttccttgactagcgacttattacttttttaaacattaaaattattggctattactaaaaacataacacatgctggtaaggttgtggagtcaaagtaatgcttacacactgttgggaggagtgtaaattaattcaactgtcatggaaaacagtgtggcgattcctcaaatacctaaaatcagggaagggagagcattaggacaaacacctaatgcacgtggggcttaaaacctagatgacaacttgacaggtgcagcaaaccaccataccacatgtataccaatgtaacaaacctgcacattctgcacgtgtatcccagaacttaaagtaaactaaaaattaaaaataaatttaaaaaggaagaaagaaattccacttgaccgagcaatcctattactgggcataaacacaaaggaatgtaaatcattctattgtaaagacacatgcatgcttgtgttcactgcagcactattcacaatagcaaaaacatggaatcaacccaaaagcccatcaatgacagactggataaagaaaatgtgatacctgtacgccatagattactatgcagccataaaaaaaaaagaataagatcatgtcctttgcagggacatggatggagctggaggccattatccgtaccaagctaacacaggaatagaaaatcagatactggatgatctcacttataagtgggagctaaatgatgagaacacatagacacatagagtggagctacacacactggggcctgttggaggatggagggtaggaggaaggagagcatcaggaacagcaactaatgaatacaaggcttaatacctggatgttgaaataatctgtataacaaacccccgtgacacacatttactcatgtaacaaacctgcacatcctgcacatgtacccctaaacctaaacataaacataaaataaaaattgaaattctggaacttctaaaaaaaatttagatgcaacttcaagatatagatagtcaattaaataaaggttgaaacacaggcagaatttaggtaaatggggaaagaaaatgacttctaggagaggaagattgcaaaaccaaaggaaaagagttaacaaggagaagactcatgttaggaacagaaagcagtcaagattgctaggaagatgggctaaattcagggtaaaaatggaaacgttgtttgcagctttcagacagcattaaacaccaggatgaagagtttatacttactgtattatactacttatataaacctgaaagcaatttaagtgaaaaaatggaagaaattctcaaagtgttaagtttaacattttcaaaatacccacattataagtaatatttgcattatctaattaggtgacagttcttacacaccaaactcaaagctcagttaaataggtttggtcatttaaagctgagaggctttaatcttactcaccttctagtctgtaccatgaaagttactgtctagggaagtgttaacggaatcctcagtcatgggttatctgttcctttagccataggattttattatatttctttttttaatgaacatgttacatgttatgttttcaattttagaaacaatttctcattcaatagaagatagtgcatgtctataaatacttggcatttgacggcaaatagtctaattgaaaggttttaaagactttctatgtttagaaagcataatactgtatgtgaatataccaagcggttttccaaaaattaacttttaaacatatcagctttatgcttaaagagccatggaaatttgaaagtaatatttcatagaagaattattttatgatcaaactcaccttactgaacaatttaaatccaataattgaaaatatatacttagaaaaattaacaaatacagaacagttttctcctaataatttcctcagatagtcaaaccttatcaaaagaaactatatgttggccggacacagtggctcacgcctgtaatcccagcactttgggaggccgaggtgggcggatcacaaggtcaggagatcgagaccatcctggctaacagggtgaaaccccatctctactaaaaacacacaaaattagccaggcgtggtggcaggcgcctgtagtcccagctactcaggaggctgaggcaggacaatggcgtgaacccaggaggcagagcttgcagtgagtagagatcacgccactgcactccagcctgggcaacagagcgagactttgtttcaaaaaaaagaaaaagaaaaagaaagaaagacactatatgaaaactatatgttaacacttttttaatgtgtgagcattattctagggaagaaattgtagataatttattttcctttccagggagagcaaattcaaagttcttgaaaaacattaaataaaatatcagccatagttgaaatcaaatgaaaagacagaatagcgaacatgcctccagaatcaagagaacacaatatgacaaataaagggcatttagatgttcctcagatggtcgaaattatgccaagagacagtaggcagtggaacgtcccacctacagcagctgatggataacgaaagaggaaaccaggcagctggtgggctaaaatatgttgtaaaataaggagctgaggccttacctcaatggatatggcatggccaagtattcagcaattttccagaattagtgctattctatctgtaaatgttgacaacatcaactatttgattttaaagattatacatttaatcttacaatgggaggcattgtaaatgatcattttttaaaaagaaagaaaatagaagaaatttgcaaaatgttgataggcccatagactgattcattgataaaaaggaactgatggaacagtaaggtcaatattcaaagcaagataaagatctaaaatgtataatgggcaatctgtagtgatctaaatttaagttaaggtctaacagaatgtatcactttgttttatggcttaaaatgagatgaggcatcttcacttgtaagcaatcagcctgtcttggttattctctgagacaccctgaaccagtatacgtggacctttcatgggcgcctctgtccagcttccagtctagacacttggggaagctatgaactccctactccagcctaaagttcagcctcctgatatacccagaacagccattgccctgtaggcctcaccacttcctataaagagaatacaacagaataatttctatttaccactcaccacttcctatgacctctacctgtaagccccatgcttggggcctagccttgcaatttgctccatgtaaacattccactctgaattccctgccatttccccaggacactgcctcctgagcctggaggaatcactcttcctgccttggaatttctctaaagcactttccttctcaaccgcacccctacaacaccctccacaaccatttctttttttgtttttttctttgagaattttttttttactaatcaataaaatccctttgatgataatgcaagagcattacatttttctataaattttgttttaccaatcacctaaatattacagcattttacaatgtctaaaagacattgtagcgcagagatctgagttcaaaaccaaattctcccatttaatttctctaagcctcaattaccccatgtagcgaatgggactcatgtctatattaagaggacatattttcaaatacatagtaaaatgctcagagcatggtaataacacaataaattagataagctgactttctagaaactacctgtgccccttattctttgtttattgtataataatacattgttgctaactcagatgcaatgttatacagcaaacctcttgaacttattcatcttgctcagctggaacactgtacccattgattgccagttccccatcttccttttaacatattggagctataatcaaagacagaaaaggccatggacttcagacaacctctgcattctatataatagcccaaatcacacagggaataattacgaagactgagcaaagttacgaagtgcagggaaggaaaaaaactagacgaaggcaaacaagttctccacaaactgtattttaccctaggatataaagaaaactctatgtccaataaatgctacttattttcaatcaagagatagcatattggttctaaacatagtgaagtcaacttagaaaatatgataaacaattttagatattgtcttggcatttggacacattatgagactttcctcaagctgttactctcatgtagtagactaaaaaactacgtattatatccatggacataaaagtataaagagttgttttgctgggaacaaaccttcaggaaaaaagaaataagactaaaatagtaaattttaatagtctagagatatcaattaaataataattaacctgtttaagtaaagattcttattaattgatgaagatcaaataataaaataatgaaagttaatctcagtagatttttcttcagatagagggaatgaggatggtgtatatgaatagtgaattatctcttcattagacttcttttccttagcttgttctctttagctgaaaataacaaagttaaagaaaaaactgagaatacagattttgtattttctggaattatttcacagaactttacagttttgacataaaactacgtaagatgtatcatcaacaaccactgaaagtaggcattaaagggttttcatgatctcaagatgttctgataattacaaaccaggaaaccaaaaataacaagtaattttcgttgtttcagtaatgtgaatagtttacaattcatgctgggaaatgcattatttcacattataaatggcacaaagcatggtacacagtcatcagttttggaaataatttatgactgaaaaagaaaatgagtactgttttggtataaccctgcaacaacaacaacaaaaaaggacagcctcctcaaaaaagtaattctgccaatttaatcagaggagaattaacaagacattaggaaatagaggcaaaataaaaacgggtttggaaggcacgtaacctgatcattagcagaagtaaaggtacttttctcaaacagaataacaaagtaggaagaagatataagctaaactgtaccacacaacaacctgcaaggaactactttgtgtaggattatgccggccagtcatcaaatgtgccaactcccacctggcattgaaatttaggtcaaaatgtcctgtttagtaggctgactattatatgcacatttttactatgtgttataaaaaaaattaaaagtgattacagaaggttgcttttctagattcctcttatcgttcctacatccatgcaagtctttatagaaatcaaggaaaaccaccctagtcatgataacaaggaaaaactatcaccctctcatcccgcaaaactaatatcatgatgtcactacaaacagggaaataatccacacatgttctccccagtttatctgagtgcttcaaatgtgtagaaagttcttttctacatagacagatgaataaatactgtcttttccactggctatataaaagccattgtgtaaagctactgaagacactttaacatgttggtatattgatttgatagtccctttacaaaatattacttgccatattacatattttagggctcagtaacatgtcctaaaaggaagacttagtctggaaattattctacatctgctcttttattgctttgtttttttgtaaatgctctctttgatcaaaaacaatactcattctaatctacatatgaaggggtcacaaatttagcactgatacaaagaacaagttaaaaaaaaaaacagagggaaaggctgggcatggtgactcacgcctgtaatcccagcactttgggaggccaaggcaggcggatcatgaggtcaagagttcaagaccatcctggctaacatgttgaaattccatctctattaaaaatacaaacaaaattagccgggcatggtggtgggcgcctgtagccccagctactcaggaggctgaggcaggagaatggcatgaacccaggaggcagagtttgcagtgagccgagatcatgccactgcactccagcctgggcaacagagcgagactccatctcaaaaaaaaaaaagagagggaaaaagacaggataccagcacataaactgtatttcatggcaaactagaacaacaaaggataaaaaatagatatgcccaaatgaaggtaaatttacattcatacacatacaaactattgccatctttcaattagcaatgttaattgattcctgaaaatcttgccactcaataaaaagccattaaaagaaaaaagaaatccaagaacttttaatgagaaaaaattacactgtgttttatttcaatacaaaatgcccaaacaatttttacaggaaaaatgtttattaaataaagaaaacaagttatgtaagtgaaaatattaacttgaaaatagttttttatacaaattagaataaagatttattctttttactttctgcacctcgctcttcacctttttttctacttaagagtttataattatatttgaattatacttaagaataaagatataccacagaaaaaacacctaagggctaaagaccaaatatgacagagcctagatacccaaataaaatagcatgtgttcccatgaaattgagaagtcttttcaacgtttgcttggcaaactaaaatgtttcagctcatacaaacagtgtgagatacaaatttgttctgtgtgatgatattctcttactagaaactgtagtgtcaagcaaataagtgcttgtgtctttgcctcaaaccattatgttgaaatatcagttcttcagatatacttaatatatattgcagtgaacattttgatacgctaaaaaaaagtcacctaaaaagcagataacttttcgaaagtcgctagggcaagaggtcactaactgaacagttgttatgggaagtaagtacctacatacatttgtgtttctgtctgtataattcataactccattaggtgaataacagataaaaatttataaggtgaagtgttatatttagatttagaggaaaaaataacatgagattatttggggaggtgaacttttcctactcttctgataccttcttctaatgcttttaattttcaactttcaatttttgaacctgtgttacatcttatgcagtgagaaaaagtcctcaaacgatggtgggtaagccatagaatggtgcactcatcactgagtatccattcataggacaatccttgaaaaaatagaggaaaccattttattcattccgaaattcatggaagagtaaatatcttgaagtagactcctctatctagcaaaatacatttttcatcatcacataaaactaaatatgtgtacctgatatttcacaaatgtttttccagatgccaataatatccttaattcttaggttaactgaccaaaaaatacaacaaacctagattatcaaactataattcactaaaatatagattagcattatactaaatataatgcagtcatgtgccccttaacaatgggcatacgttcctgaaaaagcatcattaccgattttttcattgtgaaaacaacatagggtatacttaagcacacacctagataatagatcctactacataccaaagaataaatggtacagcctattactcctaggctacaaacatgtttagcatgttactacactgaataccagaggcaactttaactaaatggtaggtatttgtgtatctaaacataaaaaggtacagtaaaaatacagcataaaagatttttttaagtggcacacctgtataggacccttaccatgaatggagcttgcaagattagaagttgccctgggtgagtctcagtgagtggtgagtgaatgttgaatcctaggacattactatataccaccgtagactttataaactaactgtacacttaaagtacacaaaatttattttaaaaattgttttatcttcaaaataaatctcaggttactgaaacttttttactttatcaaggttataattttttaaacttttcggctgttgtaataacagcttaaaacacaaacacattgtacggctatacaaaaatattttctttctttatatctttaagcttttaaaattttcaatattaattttacctttttaaacttttttgtgaaaaacaaagacacacacacattggcttaggcctacacaggatcagggttatcaacatcactgtcattcatcccccgcatcttgtcccactggaaacccttcaggggcagtaacaggcatggagctgtcatctcctaggataacaatgccttcttctgaaatacctcctgaaggacctgccttaggctgttttacagttaactttttttataagtagaaagattacactctaaagtatgcatcaatagtatagtaaatacataaaccagtaacatagtcatttattatcaagtattatatactgtacataattttctatgctaggctgtcatacagctggcaacacagtagctttgtttacaccagcattactacaaacacatgagaaatgtattgtaatacttcattttgatggcaaggacatcaccagatattagaatttttcaggtccattataagtttatggtatcaccatggtatatgtggtccatcattaaccaaaacttcactctatggcacttgactgcataatacactgtacctttgataactcagagatgtcatgtgatcttatattgtctctgcatcattttgtgtgttactgattagagggctttaatttagatgtgaaagtttcaggggattgggttaaagccaaaatgatcctatgacatattctttatgttgccatttggggaagaaaaatcactaatatcttcttgtttacttgccatctatgttacttatgaaaatataccgggatagctttcccaactatttataattgctagagattttgattctaaataaaagatagctagcattactgggcattatggtaatgcttagttacaacttatgatctgttctcacaaaatctcacagttcacaaaaattaactttactagctagcatttattacttcaaaatattttaagggatcaagtgtaattactacatactgcacagagtaataaaggtctgtgtaaagcaaagagaaggaagaattattgtaagaaagaatgatgtacaaactacttagatactgaaaggtagagtggaaaagcagttaactacttttatagtgctgaaataatatattttttatttattttccgtttcaacagcacattccaattacacattttctgtaacttctgcaacaattatgtttaaaacatttaattctccttaatatgcttgctcataaaaatgaattgtaattataaattcttcatcatatatactgtcactagtagaacttctggtaggaaaccaaaatgtatttcataataattaccttatgcttttaaaattttcaattatatttaaaacaaacacggtgcatgttagttgtagttaggacacgaacatgcaagtatcatagaatcaaactcacaccgatttgaaaaactgaaacagctgcatctctatatccccaaaatagaaaaggctgcctaatttaaaaaatgcttccttctgtggcaaatctgagaagttgtatcgggcatgagtttccagttactcttcacctctcatgcattttctccttttttttttcttttgtcctacaccaggcctcgggagactggtcccgaaggatttcatcaccctagatctcttgcactctggcctcactaggttcaggcaacgggagtccccagcaggaaactgagaggtgagggaagagagagcaggcgatttcttcacacacacccttcctgctttggtgttccggaagcggaagccacgggtcgagtctaagattttaaatataacctataattattaaagtgtcaggctttggtaatatcgggtgatgttgattcttccttttacctgcagccttgtaatggcttccaactgttgctaatctctgtatgcctcaacaaacattcatcacgcgttccctttgtattcactttattaaattcccaccaaaattctagatacacatgctgtctgtctcctgactggcaaatggagactgtaactggggagtctctaggcaattagactgtaaatgccctattacctcaaggctctcttcatctcccaggttgctttttagctccagatgcaaatatcaccctgctacatacaaggtggaaaatggatctcaaaattttggagcagtatctgtataatcatcagggcaattttaattgggaactaggtaaacctcacacactctctgaagcaaagttaggcattaaaagatcaaagttaggaggaaaaaatagagggaaagccagggcttgaagtctgtcttctgcaggatactcctgaaaatttccactgaagaattaacaacagcagatttttactaaagagccaaagctctgaggtttcactagaaatgtatgagaattaaaaaatgtgttggtttttaacataattagttccaccaaaataattgtaaaagctgctgcatcagaaaaatataccgtgttcaccatgaagttttaagtactcactgagacactgcaagatatctagtttgacttacatgtatgttcctacttgtttactctttttctatatctactcacttgatatatgagaaatctatttattgcctcgatatctttatatctgtctagtcatgcatgacttcttcaagaagggcaaatgagaagaaaacagaagagaaacagggctaccatcttggacagcacagaatacatcctcttcgatcactgccccaagttctgttggaccacactgcttgagacatcctgaagactacatgaaggcataattacatactcagacagactacagagttatttatgataagatgaagtaatctaaagcctcaagatctgcaacttggttaatgatcatttctggctactataactttgtatgtaaaatgcatgacttatgaatattttaaacacactgtattttttagcttttctttatgttaaagcaaagtccaaaataatactatttaagcagcatacaagttaatttctctcggctgggcgcggtggctcacgtctgtaatcccagcactttgggaggccgaggtgggcagatcacgaggtcaggagatgagaccatcctggctaacacggtgaaaccccgtctttactaaaaataaaaaaaataaataaataaaaaataaataaaaaaataaaaaaaaaacttagccgggcatggcggagggcgcctgtagtcccagctactcgggaggctgagccaggagaatggcatgaacccgggaggcggagcttgcagtgagcagagatcgtgccactgcactccagcctgggcaacagagggaagattccgtaccaaaaaaaaaaaaaaaaaaaaaaaaaaaaaaaaaaaaaagttaatttctctcgcatgtagtagtccaaagagaaatagtctccaaatataacgctgatataaatactggctccagtcgggtattaagtacttttccttaaaccagacttccactcatgatctactcataaatgtaaaaactgtaatcagtattttgcttacccaaaatgaaaggaaggtagaatttttcaaagaatggtgaacacagtcctttctaaacaaagatcatcagcatatataaagcattacccttggagctttgaaataatatctatttgttgattcccatatcataatttatcttcaaaagatggcattaaaattgcactctaactatgaaacattctgtacttcacaaagttgcagaaggtgagcaatcaataagtatttattgagtgcatgaaggggtgttttacttaatttgaaaactagctgatttcaatcagaaataacaattatataagactttcgcctataattagtgagacaaagaagtctacaacattgattttgcccaaagtattaactgtgaacgcttgtttttcagctagtgggtttttaagcatttaagcagatcttattggctttattgactagtattcaacagcaatgcctctgaatgcgtttttatatgagataatcacttttttcatgatataatgtcagttgagaggagacctttctatttgttatagtagaaatcaccctaactcatataaagcattacgtccaatgatttccagaaagtcgcataaatcagccaacaagaagttttaaattaactttaaagaagaaggcaattttgtttatttagctctactagctgattcttgaattaagcccaagtattcttcattatttatttaagtaaataaagccacttatggtaattgtacaatatttcctttcagctctattctcccaacattatattccaaatcaactccatatttatatttaaggcaatgcttctaacacaaaatggttatataattcaaacgaagaaactcatgaatttgctttaagaattggtgcttttccatcttatttcccacaaattagaatacatgtgcatgtaatgtgcattttacaagaggagagacattttttagaacaggatagttttagaaaaggagaaaataatctccagacaaatggttataatacgaaattaaatttgatgtgattttaggatatctcatttttagtaaagtttatctcttttactgcatgagttaatttattgtaaatagtatttatgacagtgcttcatagtgaggaaatagactcaaaatcacataaagaactttttattataataataacttttaggcacatttctccttctcactagctttgtccccacaaaatcaaaacccataacttattaacttaaaaaattatttctatttctaaatatcaagataactatagccataaggttttttaaaaaataagctcttcgtgagtttgattatggactattataaaggattttttttccaattcaagtgctttctccaaatgtagcatttaaattccaagtaaactatgtgaatttattttataaaacaaaaataaactcaccaaatactatttatgaaaatgattaaggaataggagaaaacttatctgttgctgtgggtgagtaggggggtgtatgatatccgtatttgtgtatgatacaataattacattttattgaaacatatatgtaacaacttacacattattctttttatggacacatatattaatgtatgctcgtttaattttaaccatgtctacataataatctccattttgcaatggattcaaatactctttagataatctgactgcagcataccactccaaacatcatagttcattcattggagtattgtatcaagtgggatttctacaagtcaaataaaataaatgcaaagaatggacacaagaaaaattagtgtgatcagcagattacatatcctcttttgcaatcctatgagtttataaactgaattagctcctagaacatctgttacttgaggaattgtcctgtatagacatattgtcaactatattttaaagtatctctctgttaatctatagatctacattagctgaagatgcagatatagaataagcagatgctagtgtaagaaatcagtttcactggggacaatttttgtctttgtctttccagttggtagtcatgaaatgtgttgagattgtttcattttgttttcactcattgacatgattcatttaacatttcctacaaagaatctctctaaatactaaaaacatttaccaagtaaaattcctgttgtgcttgttttaaaaaacggataaggatcatttgtacttagcagaatttatttgcatagaaataattactgttttaaagtttttcaatctgccattttcacaggaaaaataataaatacacatgctgcaattatatttgcattattatttgcttcctttaagacatccattgtcatattgtatcaggagatgttgatttgagaataagaaagaaaggaagggaagaggaaggaaaggcagagaggaagggaatctggaaaagagtgtgggaggaaaaaaagaagaaagaagctacaaaataatatgataaaatctccccttttttgcaatagctccactttgacattcatcctccattcactcattcattaaatatcaaaaaaaatagatatgctcacagagatggaagaaaccataaaactattaaaagcttggtacacagtaggcaatccacaaatatttgtgttttttaagagattcaggaagatggccatactttcactataacggttttgctttgatatagatcaatctgcatttccttcagtttagcagtaataattttatatgatggatgttccaggtcacattttaagagtaaacaaatttggaaggtcaattttgtcagaaagtaaagagaactaagagcaaagagtttgaccaaggtctacacaatgacctgtatttatttattaggttaatatatgtttattgtacaaaagcaaacatacgttttctctagaggaatcatgacctcctgaaagaatttttttgaaacacctcctccaaatggtcattttcactttttgtaaagaaagctttccctccaaaagcttgcctggtacccaaatcaagagagccaaacaacagtcttaacatacatttctcatcacgctcaagggactctttgtgtacagttagcatttcaaaatacttcatgaggaccttgaagcatttttttttttgagatagagtcttgctctattgcccaggctagagcgcaatggcacaatctcagagcccagctcactggaacctctgcctcctacctgagcctcccaagtagctgggattacaggtgcgtgctagcatgcccagctaatttttttgtatttttagtagagaaggggttttaccatgttgcccaggctggtgttgaactcctgacctcaggcaatctgactgccttcgtttcccaaagttctgggattacaggcatgagccaccacgcccagcccttgaagcatttttccaagtaagacttcctgccatattcagaattttgtttatttcaatttcttcttgtcttgtcattgatttcctttgttccacagtctaaaagcctcaccttggtatttcagacccataataacctagcttcaacacattatctaccattctttcttgtcactctccaccaaacctcctgtgttatagcctacctgattttctcacccaattctgcatatgccaggcaccttcacaaacccatggtttgatgtctgctttacctgaaattctcctctgtacactcaaaccctactctcaccaccataacaccaacggcaaaatccttggctcatttaattttatatcccttatggtaaagcttgttatacctttaagtaaccctgatatcagagtgccatcatctgcgtagaacaacctatgtatattatttgtaaacaaatcaggaaagatgaaatgaaaggataattcatttcattcattcattcattcattcattcattcatctattatgtattttgcacctaccatgcaataggcttgacacggctcagaaaagacagtggttaagactcactctcagccctcaagtgacagtctagtcagagaaataggcaagtcaaagattagaaatcagacactgtggtgtacttacaataaagctttcttgaaagagtggcccagagacttgtttcacaagtcagagttctttcagcacgaaagaatggtgcaaatctacaggttgatatcattcagatgtttttcagatagtttcagagccttcaaagtttttacataaattcttatttaaaattgtgtggggggaggtgtgcgtgtgtcgtgggggatggggttaggtttgtcagcaatcaaaaacttgttttggagccaaaaactatcaacaaagatttgcaattttgtaaaaagtcttctttagtaactataacacgataaatagtgtttccaaaactggtttgtagcagctaaatgactactccttccctaattcaatcacaactggaaaaggtatacagttagttcttctgagttttaagtgacttagaaataattaatttcttttctcaagagtggactatctatggattcaggtgtccaatgacctaatgtgattccaatcattttactgttataaatcttctattataaaaatcaagaatacagtgtcaaaaaataaaaactccccaatatactttaatacaacaatagtaactctaatttagatcaattaaaaagcttaataattgtgcagtgcatataaaaaaatctaaaaggctttgtgtttatttgttctagattattactgccataattttcaactaataaatcactagggtctaaacttaattacatatattgttcaagactgaaaaattctaaattttcgcatgatctagtctgtattcaacgtatttattctcaaaaggaaaatttttttattcatttcgtattcacaagcatacctagaccaggcaggtaaacttgtaacaaatgatgtagaaaatatatttgaccaagttgaatgtcaccgcttaagggatttatactgaactataaacttaggaatgttaaatagtatttaaccctgaaaacaatttaagattttaaaggttttaaagaaaaccttattattttaaacccatcatgttagatctcaaattctccttaaataacatatctccactaattcatcattgtttttgaaaatatttcagtcatcattatatgaaagtatgtgatgagaaatacatagagaaaacagacaataaggaatataaaaataactaacatttaggaaattcctcatacgagcttcagctgtagagataaagcatgtacaaataatatgctaggaatagaagcagttgaaaaaatactgatatatttcagaaaagtgagtgaagtctttgtttaaacttcaactcagtcctacctatttaattatacaaaatgactctaaaatattaaaggtaaaacaacccagaagaaaaatattaaacttttatctacccacgcttaagggctcagattgctggatttgagatttagctctcattatacaaccctgggccaaactaaatctcagttttctcacctgtaaaaattgcataaaagtagtacctacatcaagggaatgtggtgaagattaaatgagttaatatttagcacttcataattagagctactattatattcccagtgtttttacttctgttatggtaacccctcccccagtaatgggaatattcttacaccaaaatactattggcttttgtgctatttctttattcatgtaaaattttgttcctgaatccccctccctgtgtagatagttgccctggtgacattcttttattcctttcaacagcccaaatccctgaagatgatgtaaacacagctttagctacttcggaacattgttttgatgagtaatgtgggaagaaattttaagtacgcatacaaatttttcttaaaatacacctgaattttaaaatcagcttccaaaatgctgaaatataacagtttgtttcgttttagtacatcaaagatgctacaaaaaatttttgaaaaaagaaacacatcaatccatttaaatattttctagtcattgtaactgagcatcagttgaaaatactcattctttatgctcttctacaactttgaaatttggatttccaattctttggtatttggagggacagccactaacgactaatccaaagtctctttctggtttactggcatcaatgccaaactcatcaacagatcccatatgccatgcataaaacaaaccaccttcacaaccatcaagttctatgataagttgtacaactcctaaaattaccatttccactgaagtcttctgccccattgccattaatctgagagagaattttgagctgctttgagaaaattctgttgagttgtgcattcttgtggtttctcactccaagaaaacaaaagcagcctaaccagttttgttttattttagatatacagagaaaaaaggaacatttaaaaaaatatattggactaaggattcccaaagacagagattcataccaaatatcattttaaagtgacatcacaaatgacacactttacccatttagtggagattatttaatgaccactactgaagttttaccacttataattggtgaatactggtagtggaggtggaaatgagggtatagttgtctggaatttaaatcacgtaggtaagcaccatagaaacacatgaccggaaaggctaacatcctttgagcaagtctcctgattctaatagtttaatgtattatttctcttaatttttcaatgtgacgatgataatagcattcaccaaagacatttggtagaagactataattatcaaaaatatggaaagttgcttgaatatatcactgaatataatcttaggctagccaagaattctaaagcatttaggtacaaaacattcatgaggacatcgttataactgtcacacgttgaattattgacaaatttggactatttattttaatatcctttgagtattttctatgtgttaatcactgttttaagcaattcatttaatccttgtaaaactctatacagtaggtactgtcaaatggtactttggagatgaaaaatattgaaaaccaccaccagcaacaaaacctgacacataaaggagtgaaataaatgaccaatgcccacaaccaagagatggtagaataaagaatttcaactcagttagtcatatttctggtgcccgtatttctaagcattgttctcttacaactgcaatttcttacaattctctgtaatcctatttctggctgaaatattagtagctactgttgagttgtaacaaatgtacagaatacttcaatatatgaaaatataatttttcatgggtggtaccattaggctttacgtaatcaataatttagccaaagcagagaatcacaaaccacgttctacttattttttacatttataaccagggacctcattttgaggcaaaatacgagcaattgccttcaaatcactacatctcaaacatgttcttatcttaatattctagcagctaaaagctgggcaaattctcagtggcattcttctactctataactagccagtgtaacttgttagagtatatgttttctgagttgacccttatggaaaaacattttttcttaatagagtttaagacaaaacatagagttatttatctttaaataaatatagtttacaagtagttttagtacttcttatccaatgggctactcacctgaaatagtcctcgtgtcccacctctaatcacacacacacacacacacacacacacacacacacacacacaccacaaccctccctttggtataactcatggagactgaagtcagccctaatagtaaaacattctgtaaaaggttgtgcctatgtaagtttattcatggtgggcaccaaaaccctatattaaaggtcaggtagatacaaacttcaaacaaacattgttctataacttgtgtggtaggtacaataatattcccccatacacacatgccatgatgcctatgtcttaatcccgaaaacgcatgaatatgtcaccttaccttgcaaaagggactttgcagatgtcattaaactaagggcactgaggtggggaaattatcgtggattacccaagtgggccaatggaatcacgagggttctaataaaggggatgcaagaaggtcagagtcagaaaaaggaaatgtaaggatggaagtagagataagagagagacagaaagggagagagatctgaaggttctacactgtggctttgaagatggaggaggaccataagccagggagccaaggccgcctttggaagttagaacaggtaaggaaacattctccattcgagatttcagaaagcagccctgctgaaaacccgattttagccaaatgaaactcattctggacttctgacctcccaacctataaggtaagtttgtgttgttttaagcagttaagtttgtgatagtttcctattgctgctgaaacaaaattaacacattgcgaaagtatctacaacttgcgacgtcgtttttaaaaaggaaatgttaaaaaatgactgatcatttattttagaataaaattcccatcttattatcttagcatctattgccatccaaaaaaataaactataaatactacacagtgaggttcttaaatcaagatttagttttttctgatgaaccaataagaacatttacattctgaaaactgtaatacagtctctaatctaagtcttatctagatcccacttcttgcagtgtcctacgaatcattttccgggtaccctgcagttttcttggcccagtgtagaaatcctttactgggagacgtgtgtcctcctgtcagcatcattaatctttgaggatggtgtgcaggacctgtgtacgggattactcatgtggaatgatggaatgttcggtaactgatttgtctgaacactctccttcccactgccaaatgcttgctgctggctctgttgatgcagggatggcttttgtctgtggtcttagtgctcggcaagctcattttcatgcccatctctcagctctctctaacctgagcatccttttgtctcctgcaagtttgtttcttgctgtcatcagcctcctctttcacaatgctaaaatgatgggttgtatttttaaccctttggtgacaagagtccgtgcctgattggagctcaaattccattagtgtgccaccccagtgaaatacttctataaggcaactaaacgtctctctgcaggattactctgaaatgttgccatttggtatgttcaagtataatactcggtcttacgacaaccgatttttcatctaaaaaaaacttacctcccacatttcagtgtgaatttataacaagtcatttaaactgtatgtttatagcaaatgagacttaacacaagctaatagctactctttataaatttataatgggttttatacatccttaggcttcgatttttttttttttttttttttttttgagacggagtctcgctctgtcgcccaggctggagtgcagtggcgcgatcttggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaggcttcgattttttaaaggcaggaactatcccaaatgccaccttataaatcagatgccactgttttaaatacaaagatgtagttcttttcttaatccaaaatttgttttgctcaaaactggatttgacaatctcctgttgtctccatttaactcaagaaaagctcccaaatgaaaacaccccagtgaaaaagtgcaggtatcaaaagtccagtaagcttaggaatcatgcatgaaagctagaatacatgaaatgttatcatcctgcaagtgaaaagaatatgataacatagcatcatttattatactccattaggttaaaactaagattgtattatattgtgggtgttaagacttgccaaagttttcatttgactacagaagaaaccacccctaaaatgtagtgactacaaacagtaaaatttcttttatttatttatttatttattattattatactttaagttttagggtacatgtacacaatgcgcaggttagttacatatgtatacgtgtgccatgctggtgcgctgcacccactaactcgttatctagcattaggtatatctaaaatttcttatttctcataattctatgggctgcagggtttcctcttctggtggtggctgggctcactcatgtagccgcattcagctgccaggtgagaggggctgggaggcccaggccccacggttgttgctggttggcagctggagcccgtatgtttttcttcatgtgacctctcattctctagcaggacagactgtattatttacatggtggtctcagagcaatagtcccagagtgcaaagaaagaagttgcaaggtctctttaagccaagactcagaaatgacactcattcttaccagaatctattagtcaaagacacaaacccagttcagattcaaggggtagggaaatggacttaacccctttgtgggaggagctacaaaatatcacagctacattgttcaatctgccacacacagtgtgcttcaaccctgtcaggtgtctttattttataacaatgcttttactgtctgagcacatagtgaaagataaacctcaaattagcatttaaattagtgtcgacattaacaatttcttttttctcttcttcagaatacatatgatggcctgttttgaagaaaaagagaaaggatataacatcttcacgaaaactaagtttcatttcagaatgtggcaggaaaaatatcaaagagtttacatttttgaaagcacaaattcaaagcataatatcatgaaaataagaaggtggtgtaggaagcactggtatcttcgcagatagaattctcagttgcaaataatagaaactgaagcagaaaggaatttattggaagaacattagctcacagaatcaatgaaaatgtgggtaaattcagcttgaaaatcagaatgaataaagaaatgataggtcaccaaaatcacaacagagctgtgacttaagacccagcggcgtccaaccccacaatgccagattctgagggccctgcctcaaaaacagggggaggcaaggtctaaaattaaccactgattattagaatttccttcaatataaatattatactgcagttacacttatttgccaattgttatttcaccttatcctttaggtagtaaattatacgcacacacataccaatatatttacattatatgtgtatatatacacacacacacacattcgtgtatatatatagatacacatacacccatataaacacataatacataccatatttacattatatatatattatgtacagatacatatatttacataattacatatgtaaatatatgtattatgttacattatatatttatattatatattacattatatatgtataatggcaatttgatatgtattatgatttataattaatgatataattatgtgtcaagaaagagaaacagagactatatatattaatctataaacattttaacattgttgagtaggctgattaaaaatgtaaagctaagcaagtgtagctaaaaatcttcacctatttgcatttttacgccaaaatatgatttcatgttcaagtatgaaagagggatcagttatgcattgtacattgaactcaaattttatatctcaacaagggaaaacatcaaattaaaagtttctcatgattcttttatataataaatatgcatattaaatttcacagggcctttagggtatctttattctagtctatcctatactactcattctaataagaagctattgaaaatttaggttaggaaatgaaagtttttaaaagtagcacatcaatctgggataattcatgtacaatcttgtgaaatggatttgctatactttagaataaaaaagaaattcaaattaacgcataatatcaagtagctacaactctaagatgttaactgtatgctctaaaactgttatcctaatacaacccttaataacaatagtaacaataacaacagctacattaatggctgttatttactgtgaggctacactgtgccagcctcttgctacttaggcatagctaaatacacaatattgagcatgggggaatcaactagctcaatgtcgcacagctaagttacagggcttcaagcctcatgtgactctatgacttattttttaccttcctgcgctttcttgttgaggaaatcaatctaaagtcagatttaggtatcaaggaaaagcataggtttgcaggctaatggaagagctccacaaagagcactttgattcaatgttgtttaattcttaacacatcaagtaactgaaattttatcttgtaaattctaccatatgagagtattaatacagtgattcgtttaaaacatatttcatgactttcctctgccaaaactaggtaccaaaacttcataaatttttaggaacatcaacttcggatagaaatgatacccgacattctaaaagtttgacagaacttggaatgacatttcattttcattcgttctttcattcctcatgtcttcattaacttaacaaacatttcttgaatgactgccatgtgtaactgcattgttaatcttttacaagatgtgtgtgatctcagtgatagcagaaagcagcaaaaatctgaagctcactttcagtctagaccatagaagcaattccctcaaccattaaagtaatttaatcccccattaaatacagaatttatttctaatgtttaattttttaatgttttaaatttgtgtaataaagttgagcgataccattacttatgagattcgaatgatccatgtgttctcaaaatcattgtcactctgtaatactctagagttataactaattacaatttttagccaggagggaaagcatgaaggaaattatggcgtccatttacggttagaaagtaaattaatagatcatctttataaataagaaataatccagctgatacccctctacagtcaggaacctataaattcaatttgctaacacctgtcaataatatcaaagtagaaattagtaattacaatataaactattggctagggaaacaaaggatatacttcattagtttcagaaaaataagcctcaattaaaaaataaattatggttatgaaacctatactgtattaaacctttgcggaaaaaaatttcttgttgaaatgggcagaataggacaagcatttcttaaatgcattacttcttctctaaccaaccactcacaacatcatgaaaatgtaagggccaattacaacaataaatagtaggattcatagggaagaatgatagcaccttcagattacatggcatatttgttgtggtctatactttcttgtttcttggttttaaaggaccaaagttaggtatacgaattttgtttaggaaaattctttaaccaaaagggccaacactgtagaaatttgtatctcttcatccaaagtaaaccatctgggtatgtgttcagcgagtttcctcaagttcttgtatcagatcttcaaaagtcaatatagcataaatactgatttacatctgtagctttggactcattaaagctccagaatttaaatatttcagagctaaataaattggctcttgatacttggatctaaacatttgaagaattcagtaacaacctcattagaattctaccaggacttcctcagccctggggttttccatcatgttccaggccatcactggtacctcctgtaaggtatcagaagatggcctagctgtcccactgtgaagataaaagtagacgtggctgagctccatgaatactgacaggagatatctggagctcccttacctaaaggagggtagggggtaccatggatagcctaatggtatgatatgacattcatgagaagtaactacgaataactataaaactagactttcctgttgtttcttccatcttatgactgttacatggagtcatatcaccttagatcctttctataacattagtgagagccagcctgggtggtcaagatcaaaacatagtagatcagaaatgcaagttctcttgataatattcctgaattgtaggaactatcaatatcatttagagatgaggaaaattaacaagctaggccaagacacaaacccacgtctgcctgacccaaagtccttaacctgtcacactctgcctgagttctaatccattcccagaaataacacttgcatatcataggaattctaatcaaaactcaaattgaaatgtacattctgttggtctctaaatattcttttccctttgaatctctattttcagtaaaaataacaaactctctcccttcccccactaccaaagcgtccccaatcagatctactttatctatttatttagacaaagtctcactctgtcacccaggctggagtgcagtggcaccatcttggttcactgcaacctccgcctcccaggttcaggcgattctcccacatcagcctgcagagcagctgggactacaggcctgtgccatcaagtctggctaatttttgtatttttattagagagggagtttcaccatgttggccgggctggtctcgaactcctgacctcaagtcatctgcccacctcagcctcccaaagtgttgggattacaggcgtgagcccccgtgccaggcctagatccatttcaaagagacaagaagagaagatacaccaggtacctgccgatgactcatagtttgcttcctatttagtcatctgtaattatacataatacttgcaacaatccagcaaggtagagcaagtgtttatgtcctttcacttcacaggtaaagagctactcttggagaaatttaagtcatcagaggacacaagattaataaatgtcagttcaagaccatgtctttactgctgtcactgttggaaccatacaaatcacccaagttcatgcattgagtctgcatctaggctttctaacaggtaccattcaatggcttgtgaaactgctcctctgcttccctcaactcacagggaaaatcatgctcaaccactgcaattacacaactggaaagaagcacacattgcaatgcatagaaactgaacctacccccaccttctggctttttggtaacatacttgaaaagcaggatacagatatgtggagcatttttttcacagcacagtcatttatctaccctgacatctctattttttcagtaagaaagagtgactatctatataaaaaatatcaagccaattcagtcaacagtatttttaaatgttttcattttcacttactgtgtttctaaagggtttacccattaatgtagtttgatttttttcattctgatttaaaagaattagggatgctttttcatcttattttagaaactcaaccactcctgattctattgttgtccacatcaagatcagaaaaacagtattccaatattaaaatgtgatgaaagcaactgaataacaatttcacaaccaagatccttggtcaaaatatcaaagcaaaggaggaatctaaatgtgatcttttgtcattgctaaccattgcctaagtaatagcaactctgatagaaatctttctgtagaggccaaatgctcatgaatcaatgagtgaataaagaaaatgtggtagaataaagaaatgtgacagaatactagtcagccgtaagaaggaacaaaataatggcattttcagcaatctggacaaattgagagaccattattttaaataaggtaactcaggaatggaaagccaaacattgtgtcttctcacacataagtgagagctaagctatgaggacacaaaggcataagaacagtacaacggactttgaggtcttagggaaaaggttgggaggtgggtgagggataaaagactacacattgggtacaatgtacacttcttggatgagaggtgcaccaaaatctcagaaatcaccaccaaagaatttattcatgtaaccaaacacaacctgttccccaaaaacctattaaaataaaataataataatttaacaagaaaataaattttctgaagtagcttctaagtcagacattttacatatatttctgaattgatagtaggaactatcaataccttttagaaatgagagaaattaacaagaacttaggcaggctcacagagtaaataaaaagctaggttaagacaaacctggccgggcctggtggctcacacctataatcccagaacgtcgggaatccaaggaaggcagatcacctgaggtcgggagttcaagaccagcctggccaacatggtgaaaccctgtctctacaaaaatccaaaaattttcctggcattatggtgggtgcttgtaattccagctacttgggaggctgtggtgggagaatcactagaacctgggaggtggaagttgaagtgagttgagaccatgtcatggcactcaaccctgggtgacagaacaagactcagtctcaaaaaacaaacaaacaaaaaaaaacaccaatatgtgccttaccccaagaccctctatcctattatattctgcctcggtatcttttctggaagtttgtattctttccaaatctcagaagtcatatttgcttattgtaagtaaatttaaatgtaaatctatattctaaaagtttctaaacggtcttttgccttttatctctatttctcctgggataacaaaatcgacagtagtgggatttttatttggcttctcaattataccaatgtcaggcattgagtgtacaaaccccgtgaggccactgcagtttcattatgcacatctttatcaggttcagctcaaatagaatacaccggattgagggcaaacaagatcttgatcttgtaaatttcactatatggcaagtagcacattgattcttcatgcaaatagcacaggctacttaaaacctaaatcggtttgatttagaagactaaaatgatacttttaaacagacaaatgtggcattcatatatatcacatggttattatagcaagtgataaaaaattgagtgcaaatagaaaggaaaataaatgaatggccaagacctcttacagcctgccgttcggaaagtcattttcaaaaatgcatatgatttagcagtgcttcaagatcaataacctccttgtccatcaaaggaaatatccaagaaataacactaaaatgatgtaaaaataaatgaaataactataattttgcagtttaattacacaatttacaaacaattcaaatggattcatttattctactttatgtgttatatagcttttgcctcaaaactagtttttcttttttaataaactccttatgggactacgtttatgtaagaaacaataaaacatttctcatattattgctttatctttagacttatcacatatgaaataagaaaaattttgtggccataattaacttttgaaattatgaccaattatagtagctatctactcctagcattaaacagcacttctgttacacatcttacatctcttgaaaattgctggagagaactctgtatatccaatggtaataaagaggcagttgatcaccttaagattgtttcataataattatatagagttggagccaccaagtacagtacacaatcaatacattcaaaaagccaaagtcaaataacattttctccaacttaaaattcaaaaagtatgcagaagggttttattttgacaaccgtgtgtagaaggaaagacatgaattaaaggtactttagataggaataggaaaatagcatgaattaaatccacattatctgtaattgcattatttttatcacccacccaccaataaaacacctatacttcagtcaaattgggcagcttactttcttcctaaaaatgactcaaaattttgggcattctgcttcactggaaattgtgggtatcagaggctagctttcttgtgaagtctttcgtcacccaactagggtcttcccttcctttgcgactctcatagcacttcacaagaatgaaacaccatacgatagaaagactcatctcaagtcctgccctctgtataaagcccttccagacttatctttgcgacctttcataaacaccccacataatattaatcatctctactttttatgttaactatagcccacataacatctactataatatttttaaaacctccagcatttaattgtttaactaccactctgtcccaagagaggggaactatctgtagacaggattatatacgattcagtgccaaatccctaaaaatttcacagacattaaaaaaccagttagtgaaacctgaatgaatgaacttggccctgtctttaaaatcttttattctaattaggtgatgagaaataagcacatctacagtaaagtttaaaatagaattttttcatgaaaattcaattctaaaaaaagttcaagttaacagtgaaacaggttgtcatgccagttcatgactccctgtaaaatcaatttttggattaaagacttaaatgtaaaacccaaaactataaaagccctggaaaacaacgaaggcaataccaccccgaacataggaaggggcaaagatttcattacaaagacacaaaaagcaatcacaacagaaaccaaattgacaagtgggatgtaattaagtttaaaagattttgcacagaaaaaggaactatcaacagagtaaacagacaacctacagaatgggagaaaatatttgcaaactatgcatctgacaaaggtctaatatccagcatctataaggaacttaaatttataaaagaagaacaaacaaccctattaaaaagtgggcaaaggacatgaacagacacctaccaaaggaaaacatacatgtggccaacaatcacatcaaagaaaagctcattattactgagaattagagaaatgcaaataaaaaccacagagagataccatctcataccagtcacaatggctattaataaaaagtcaaaaaataacagatgctggtgaggctgtggagaaaagggaacgcgtatacactgatacactgttggtgggaatgtaaattagttcaaccattgagaaaagcagtatggcaattactcaaagagctaaaagcagaactaccattcgcctcagcaatcccattactgggtatatacccagaggaatgtacatcattttaccataaagacacatgcacacaaatgttcatttcagcattattcacaatagcaaacacatggaatcaacctaaatgcccataaatgacagatgagatggaatactatgcagtcataaaaaagaatgaaattgtgtcttttgtgggaacatgggtgaagctggaggctactatcctcagcaaactaatacatgaatggaaaaccaaatattgcatgttcttactggggtctacttgaggatggagggtgggaggagggagaggagcagaaacaaaataactattggatactgggctggatacctgggtgctgaaataatctgtagaataaaccaccatgacatgagtttacctatgcaacaaaccttcatatgtatgccggaacctaaaataaaagtttaaaacataccatcctagtttatggaaacaaaaactacttagggccacggtagtcagggaaggctttgcagaagatgtgagaatgagatccatattacaggctgagttggttgtgagcagtacaaaggggtttctaggaagggcaccatcaagaacttcagcatttcttgagagtagtgacttacccaattaggctgcagcagagggtcattttaagaagaaaaataaagataggaaggtaggctgcttttactctggggagtctttttttttttttcttgagatggagtctcactcttcgacccaggctgcagtacatggcaccatcttggctcactgcaacctctgcctcctgggttcaagcaattctctgcctcagcctccggagtagctgggattacaggtgcccgccaccacacttggctaatttttctcttttcagtagagacggtgtttcaccatctttgccaggctggtctcgaactcctgacattgtgatccaccctcctcggcctcccaaagtgctgagattacaggcgtgagccactgcacccagccgggcagagtctttaatgagcaactaaagagattttttttttctattgtaggagtcatctaagatttcgttcataatggcataattcgaggggtactttagaaaggtgaatttgaccttagtatgcaaaaggggtcagaattggaatgaaaggtaggatggaggatatgaattaaaaatttgctgtaacaagacaaatataatctaataaggatttagtaaaatagcttgcagaaaaaaggaaagagtaaatgcaagagatattgtcaagaaataactatcagcaactacaagacgaagggatgtggggcttgaaaaggcagacactgaaaaggcagttgctaggttcaagcctttgcaaagtgagagttctggaatcactgaaatatacagggacgttaacagagtaagcgagatttaagagcagaaaaagctgtttttttccagacacaccaagtttgggttgacagcaggctaatcaggcagcaatgctaggcaagcaattagaaaactggacctttgaaagaaggctaggctagatatttagcgggaattattttctgggatgaaggctgaagacctgtgaatagatgatgtgtgccaaaaaacatgaaaaattagaaggctagactggaaactaatgaagtatccatgtttaagggacaggaggacagaaaggatctggtgaaagagacaaaagaataatcaaagaaacagcagaaggatgaaaagagtgggatcatagaaatcaggaaataaaagagtcggcagagaagtggagcagactgctcggtggtgcccacaggacaaggagatttggcacaatgatcatttttgcagttaaagctgtgaggtcaggaatcctagagaaggcaggtgacagcagcaatcacaaggaatatggaaaaaaagggttgttgaaaaagtagaagcagatgctttccccattactcaaatagaaaatttggaagtgaaaagaagtagccagaaagaacagtaagatttaaatgagcttaagaaaccagagcttttttatataaggagggaaagaaggaaatgaaggacattctgaaataatctgaataagctcaaaaggaagtttgacatagaaaatatacctgttataacagaaaatgtatgttgggtagtttctcaattttaatacaagtttttcaaaactctataactcttaaggaatatggactggtgaatgtctgtcatttcctttgtttgcttagcctgctttcagatttctccaaaatcttagaaacactgaatgtaaatttcctactctctgatagttttatgtgtctactaaatattattttcctctgttaagaaagagtaataaaacagcaaataaaacacattggaaaacagatacagtgagaaataatgcctttcaaggccaaaataagttccctgaagaatgtgtaaagagatcaaagacagtaatcctcagggtttgctggaaaacgatgatgaaagcattcatcagaaccaggctagtgatgccattgattattcccaatataggtatggcatattatagcaaaaaaaaattatcatcaatgacgggtatgatttaagacataacatctgactaacgcatccaaataatatgctggtaatctgttctaatgactcttttatatttaattattagcagttcccacctcatagagtgttttccagaaatgagtttataagtcagttgtcagaaactcaaaatgtatttttctttttttccccaaacacagtattacaaaaatagtgattctcttcccaaagtaacttacaaaagccaatttatcagaaacaagatgcactgtgaatgataattatctcactgaaagttctagaaaagtctgtaaggtaggaattattagtatcttatattagcaatgtgtcagttgaggcattagagatcaagtgacttgctcaaggtctcacatagctatgacagtatttgctattacatgaaaccttgagcaagttacttgacttctaatgcctcagttggctcacaaactgcaagatgctaataatccatatatatacagggatacatatatatccacatatatatggagtagtatcttatataattcctatatatcctaaatatatatatacacatatccctatacatatatatagagagagagagagagagagaattgttcctaatactatctaaaaggatttaacattttttcataaattactgcatttgttatgaaaaaactgagttcttcagagtggtgtggtagaggtcaaaggaatcctagacttggagttctaagaaactacttcaagttctcaccttcacagtcactcataactttgcatcacaaatatcttagtttttccatctgaaaatggatgatttagattaaatgacttctaaagcaccttttagagcaataattaaatgattatagtatgaatttgtgttgcattgtcttatgtacttagctagacttgcaggaaatataaaatccttgtttgtaaaactttgaacgttctttcactttcataatgaatgtcgttagaagagaattctcttgtaagagacttctgagactatttgaagggagtactaaaaattaaggcttccggaatcaaaaagacccatgctcaattttcacattttattcccatatctcttctttcatttatttttatggccaagcacaggaacagcgaagttacgtgtcagcataatagtaaaaaaaaaaaaaaaaaaaaaaaaaaaagtggctttcagcttgtgttaaatacctaagtataaaaagaatgaaagagaaaagaagccagtatttagttctttttgtgggatagacattttgcttaagttaaatcacaattctgtaagtgagaagattgaagtttaaaagatctaattaaattgctcaacaccacatagatatcaacagacaaaacataaggcaaactcacatatttcaagtttgtcttatcgttgaccaccagaaatgacagataccagtagttgccttaaaaaaattaattaattaaaaaaactttttttatactctagcgtaggctgtacttctcccagcccccggaagtaaatatacattgttcttagctaatcatgggggcttctccaactttgccaagtcataggtttagttatgagcataggatgtaattttgaccaattatattttaggagatggcagttatggagtttctgggagggatttactcacactatttaaaaaatcatttctcttctttcccatcaggtaatgtgtttcgaaaacacaatacttcttactcattaccaaaacataatgcttcttacccattattttatgattctaagaggacaagtctttggaatcacaaaacaaaaggacaataaggaaaggatttcttttcagaaaggtagaaagaattagaatcctaccatcatcgagctgcagaattaactgtggaactgaacaaactctgggtgtttatgtggggtgatacgcatttgctatagccacttttagatggatttactgttattttcagccaaaaacactgtagctgatactgtctttatgatatgaagtcattcatggctctctctcctcccaatacattatcccataagcactctctgtgattcctcttcttcagtttccgtaatactgttccttctccaatttcccactgtgtcctttataaccctactccataacaacttccttaaagtcacagtctgttgctctgactttaccctttgcctctgtgccttacttgcaacctggctcttggctgtcttcagatcaattacctcccaacagctgactttgtaaccactcactttcactccctgtcctctagaccccaagtctttccatcttcctgaatgacttaaatacctatgcaaagtatgagcaatccaatactccctcatgatcttgtattgctcatctctagtgtactttatcacccgtcccttgcagacgtccacaccagcgcccatgcttagctgcacctcctctagctcttaaaatctaaacttaagccacctactctctgaaagcaatctcctattggccgtttcttactcagtcactcccattaaaccttttcttattttattttcatccagtttagaaccccacatccagcatttcaatatctttgcctcctttattccctcagtcttctattgcctttgcctagaaatcttggatcaatccaactgtccaaattttcccctgcaacacccaggcttctctctctctatatatagatatatacatatatagatatagatatagatagatatagatatacatagatatatagatagatatagatatagatatatatagctatatctagatattgatgtatctatacctacacagatattctatatgttgatatctaggggttaataaaaagaattccagaacctacagatatcaacagacagaatataatacatactcacatacttcaagtttgtcttatccttggccaccacaagtaacagacactactggttgcctaaaaaaaaaaagtcctttacttttctcactctagggtaggcttcaattcacaattaaatcagactcctttacctttcccaatgtgctttctgtgtttttgaagtctattctttttctcattgtccatacaactatttcacattatctgccacctcccatgaacctcctactatccttcattatctacccaaccaaccatcccttcattctgtgctaaagacctgcctccaatgcaacagtcaaaagagaaggtctcagataggaaccccttctgtgtcttgccacaccgactacatattaacctgcacctccactcttcctttcttccttttcactggaaaacaatatcataccttcttctatgtgatcatctctaaactagttctctagatcctattatcgcccgcctatgaatgggactggttctagtaattatttcccaatattcttatatcttcaacctctccccttctaataactactgttcatcagcttgaccaaattatcataaaacagactgattttttagtaggatgaattatataggcatccaaattccattttgtaaataactggaaactcatctttttctggaaatgtctttgattagggttcacttttggaataaggtttctagttacatgagaattcaaagtttaacttgaatactgaacaaaagtcagactgattaagaaagggaacaaatgaaatgttatcagataaggttttgagtgtctacattagtcaagttgctcacaatactcagacgttcgtgaatagaaaagatgcaaaaatctttaaagtttctcctacactgactatgggatctcaagaaacgactgcatggatgcctaaataacaatatgttcaaaattagttctaggtttcctgttctcaaggagctccttaaatctcttaaggctcattgttcttaatttgagttgttcttataatgatttagctactcaatcctacaccaacactggccaattcatttcaagaagagactgttttgcacagaaatatacatgaggaaaatccttttgaagccacacactggtggattcactctgcttgatcattttaattttgtgatcagcccaacattttttaaaaaatcctaggagtttagattcttatgttattcgtttcaaggcgtcttgcagagtggtttaggattgtttggcttctccttttaaaataacttggggaattatttccttgatagtatcttttgaatttaatttgccactttctaaccatttcagtatatattctgtagactgagagccttggctacagctggaataatatgttatctgtcaatgattttgaatatagaggcttcattaggaagacctgatgaacttagagataaaagaacaaaactgttttggcatcttagttaataggcttgtgaagtccttagaggtaaagcagaattttgactggtaaatctacacagccgataaacatgattattttagacatattttctcaaagtactaaagaaccacccacagctggaaatgggaatatattaaaacatactaaaaagacttcaacatcattactttaaaaaggagacagtattaaccttctatctttggggtaatgaatataactgatcacagatctgctgaaatgaaaagcatgacaactcactgtagacatttacctcttaatgtttctgcttaacatcataaaacaaaattctaatgaatgaaaagtgataaaattaacaatttaactaaatgcacaaaagcatttaataccatattttcactcttgaggggcgacataaaggggaaggttggaaaacagattctgtcagacaagcataattgtatactaaatgcatttttcaataattgtcttttaatcaaagataaattcacataaagttgaaggaaaattaaagtctagtagttcttaaggtttaaactttataattgcaacaagagtaatcctacccctcaaattatttgttaagtatcttctagaggttttgatttttataaaaagtaacaactaacagaagtaaaatatacacaaaaaatttttttccctttgggtaattatatagaaaaatattacctaaacttactgcagaaaaaattcaatgtttctatatgtgaaacattaaaaagccaaataaaaaagatgtatatttgagaaaaaaatgatttttctagtataggctttttagtatcaataattatattaaatattaaaaacctgtctagtatctttctatttgctatgcattatcagtctacaaaaacaaaagaaacaaatcctaattgcttttataagatatctaaagtgccacattcctacatagatttataaatttaatgaaatatagaaatctctctacatttgaaaataaataattttcacagacttaaggtagcaaaaaagtgaaaagatatttaacataaaccccattaacttatccttctactagatataatactgttttatgtcttgagaagatggtaaacttgtaatttataattactagaatactccttaataaaaggaggagaatatgttctaattttcccataggaccatatttctctttttaaaaaaccacaattctaagctttgcagctatgaatagttattaacaacatcaaattatacttattttggggttcagctgtactctttgaccttgcagaatacaaataattttaaacttgcctaagttattattttattttaaaatgcattcctatttcattaacttatagaagcttttgtatattcactttagcctttcataatttttattctagtataatgaaatgttctctgatgatcagccatgtgaaaaaaaacatcaatttttatataataataagttaggcaccaaaagtggcattgaaatatttattctaatagaatgatccataatataaaattattttctttttttaaacaattacaaaatactgtcacgataactaagcagaaagtttgatttttggtttgttttaaaggaacatgcaaaacagcctgaaaagcatacaaatatatgtattatttaaatcactttaaacagtgtttcactttataggagtttctaaaatcccaacactgctgcttttatttaatgtcctaaaaattcacattcactgaggtttatttgactgttttaattttaactcatccaactttaatgtgtctatgcatataaatcacttatataatatctagtatactagctaatcaaagttagagttgaaatctgaaacctctgcactgtttctaattgcttcttaggttttgtcagaatattttgtcatgctagacatgcacatcttcctgtgcaatctcaggcagttccctgaatcgtggggagctcacgttacaatttatcttcctaagggaggcatattcctcacagaggtcatatttaagaaacctcagactcaaattctgaacactttgacttaccttcttctttcaaaaataattgcctatctaggccgctgatggtgcaattttaaggatataatttggcaactggtcattagagatgttaccagagcaaatgaaaaccgcaaactcagtaagaaatgaagagcaggtgttctttcacttagacagaaaagcgaagttgcagataatgagactgtgatgaaaactagtggaggatactatgtataacacacaatgttaaggttgatattcttcccacacactcatctgcatgcttctttaattaaatgagcaggatagtttgcatcttttaacatttaatcttgaaacaactccctcttttcaactttaagtaatgatcatgtagattactgaatatgtaaaacagtacaagaaattagtttatatgcctcttagttaactgaagtaaactgtggcatcctgtggcattaaactagatatatcacagttacaaagataattattgctcttcaagatattaatatgaatatttcactttatgaatatttcactttattaaagtagttctagtagggtgcctctaaaacgtttttcctaaaatgcactgcatttggtatacgcaagaagaaaaaacctttcagaaaaattccattatctgaatataacataaacaatcaaaatcttgctgaacttcatatttttacaggcactgttttacttccttcggggaagtctcaattttagatttctgtctggaacatacacacacctacatctgtctatctagcaatgcctataggtgtttatagttgcatttgccacttaaagattagctcaggatgatcagggccagctggaggtaagacattttttaggttgctgtgggctatttttagcacaaggggagaagtaaatacaatctttcctagtccaaattacaaaacttcattgccaagacaagctgaactgaaacttttgctaaggcagtctgaccctgccaaactgatcagttgttaaagagctctggaatagtaataaacctctaagagttacaattaaagtcctatatgttctttcattgataatagactgacaaaacatatttttaaagtaaaattctttggcagcctgtatgcaaacaaagatataatgtgatgagacagtacaaactttaatccgaagacagaaacatcaacttctggaatgcatttttcctgcattctgtttgaatattggaagtacatccttgttggttgcctgacactttcctcatcaacagtgtatctttaatatttctttgtcatttaggagaaaattgagctaattcagaagagcagcatccagaacatctcaagtgtggccccatctactctgatacccattactattaacatctgccagagccactaattgcattctctggggatatggttgaaagcaaaggcacttctcatttcaagaaaaaaggatgttttaagtatcattttagcttattctttttttttcttttttttttttttttgagacggtgttgctctgtcatccaggctggagtgcagcggcacgatctcggctcaaggcaagctccgcctcctgggttcacgccattcttctgcctcagcctcccgagtagctgggactacaggcacgcaccaccacgcctggctaacttttttatatttttagtagagacggagtttcaccgtgttcgccaggatggtctcgatctcctgacctcatgatctgcccacctggggctcccaaagtgctgggattacaggcatgagccaccgcacctggccagcttattctttctaaaggatgttggacgtaacaaagaccctgtacaagttgtgtataaatatacagaattcccaggaaactgtcaagagaactatatagatatccttattgctatgaactcactattaaagaaaatatggaaagcatcttgttactttatattcctggaatggaatcttctaaagggcaagtattttaaagaaatacaagcattaaatttggtcatagtagctgcagctgcagcagtgatggagttacaaacagaagactagaattaggagagaataaaacagactagaattaggagagaataaaactcttcacttcttgagctatttccttttatcccaggccacaaaagagttatagagagatttttgggtatcgttgcttctgcacatgggattagggtagaagagaagattaaagggtaaagaatcttaccatcatattgaagacaatctttcaggggaatggatagatgctcttgacttttcaggtatcatgtcctgcttatgcgcttatattcttaaaaaaaaaaaaattgttaggatcaaaaagtaagcattccgacagctaatattaaccccacagagtagagttaagaattgaactggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccgggaggcggagcttgcagtgagtcgagattgcgccaccgcactccaacctgggagacacagcgagactccgtctcaaaaaaaaaaaaaaagaattgaactaacaaaaatacctcttttttttttttttcctgaaatttcagtgatcgttttggtttgagttctataaccagaaagctggacctttgaaaggatgaattataccaatctaggagggttataaccaagattcttgcccccccttgtcccaatttgcatacttaaaaacgtggaagggacgagactggcgtgccttttctttgttttcctgacttgcatgcactgagttttctacttagcattttgaaatattagcataggcaaatgaactagcctatctacttatacaaattagaaaatgaaattctcctgtatagtcttcaagcaaagcaatgtgatagcaataagacttaagaaactagggctctggctgtgcgtggcattcatgcctataatcccagcactttgggaggctgagttggacggatcacttgaggtgaggagttagagaccaggctggccaaatggtgaaaccccatctctactaaaatacaaaaatttgccaaacggggtggcgtgtgcttgtaatcccagctgctggggaggccgaggtaggagaattacttcaccctgggaggcggagattccttcggtaaacatacatgcaataaattctatgtaaaatatagcccatttacataaaatacatgtattttaataaaattgtgattttctattctattaaatttttctttctttgtgggttgagaggaaacttatttttagtgggtaacttttttaagtttctcatgaaagactttgtatttttaaatatctcaaagaatcaacatttctgaaagcatatatacaaagagatggaagagttatttaaaagaatcctatataaaagagcctattgccctattataaatcaaatacccagaacctgagactagtttagcaaaaaagtagttaaacttggtgagatgtgaaattaggttttaatgcatgcagaacacatcccaatgcatatttttaggtgtaggctgattgacttttctcagtgtttataattaaaagctgcctttaggcagttaagaacctttggagagcttttgatattattaaactcaagcacttacatttagttctaacatacatccatgcaaagaccaacactctagtctcatcccaggacagattttaacatggccacctaccaatactgtttcttgcagccagtttatcagcttttcttcctagtgtacccacatgagtacactcgtttttttacagcccaatcatgtttcactcatttcaccagccctcatgaacatattaacaataactgagtaataattgacgcatggatggatagttctgtgtgaaacattgatgactgtacccacataactatcctattacagtctcacaatctatatgcagtaggtacaattattaatctcattttaccatttgagggaatcgacatttagtaaagttaaatcacttgcccaaggtcacacagcccacaagtggcgctgaaaatgaatccttgtctatgtggtgccaaagctgaacaaagagaatgagcgatcactgggttctcaaagatcgttagattacattcgttttctcctccaacaaacacgctgtaaatcgttttaccctgcactctccacgattaggaagataaagagcttttctactcaaatcaaattatattcaataactacatattgagtacttttttacaagatacttggcatatcatgtttatttattaatcatgatttaaattcatttcttttcagagtttaacattccttgaattcaagtctctcagggatcatacatgtggattactctcatgatactatactttcctttctcttgtgtttgttcacatatatacatataagtatgtgatttgtataaaatgtaaacacaatcttgactgtgctcagttaaaatacattgctgagtcaatataatccatacatgttgatgtataagatatatcaactgcatcttctgctttcataaactatcagttatttcctattattcgttggtcaaaaatcagaaatgcccaactcaatagaatggtcatctgagaaaggtgtgttttttcttttatgtctatgatgggaatttcatcccagactatgatgggaactttatctcaggatgcagtacactgttcgtatcccattaattttattattcaatagcagaagtggtctttggatactgagtagctgagatatttaccggaatgctactattcacctcatctaagtgaatacagaaggaaacaggaggtttaactgaggagagattttgtgccaggcatacagatcattcccaatcacctactcacttatgtctcattatgaatttgaaggcgaaatagcagtgagaccagttttccaaagcaactttcattcaaaggtgaattagttcaacaaatattcctgaagtgcctatagtgtgtaaagcactgtttttagctgcttgagataaaataaacaaaaaagtgtaaaaatactttgatggtagttgtaaaaagaatagagaaaagcagatactcatttgttaaacataattcttaaaaatggtacacaaattgttctaacaatgcctttgaaatgcttggatctataatatacatataactaacagatatggatcttaaaataatttcaagaacaaattaaaaataccactgcctacaagcacacttaacaaatgaaataatagaaaaaaagcactttcctcaacatagtctaaacaatatactaaaaccaaaagtttttgaggtcattaatagatgtggaagtagtacttcaaaagtcagttttgtagctctctttggacaaactgacgtttatatacatcagttccttactccaaacttcctgctatctagtcttattccattaagtgtaagaatcagagacataatagtaagcatgttttcttgatattggttacccacaacaatggctcactggaatgaaaaagaaagtggagacacaaagctccaggcccttgcaaatgacaccctgccttgccccatttctaactgcttgggcaattctgattaaaatcagagataagaggatcctgaagcatccagtttcaggacgatttagactcaactagagtaggaactcttagaaaattacataaactagttcaaccattgtggaagacagtgtgtcgattcctcaaggatctagaactggaaataccatttgaccccatgatgccattactggatatatacccaaaggattataaatcattctactataaagacacatgcatacgtacgtttattgcagcactatttacaatagcaaagatttggaaccaacccaaatgtccatcagtgataaactggattaagaaaatgtggcacatatacaccacggaatactatgcagccataaaaaaggatgagttcatgtcctctgcagggacatggatgaagcaggaaaccatcattctgagcaaactatcacaagtacagaaaaccaaacaccacacgttctcactcatgggtgggaattgaacaatgagaatacttggacacaggatggggaacatcacacacaggggccggtcgtcgggtagggtatagggggagggatagcattagaagaaatacctaatgtaaaggacaagttaatgggttcagcaaaccaacatggcacatgtatacctatgtaacaaaactgcatgttgttcacttgtaccctagaacttaaaaaagaaaagaaaattacataagcaaataattacatttactctaagaagtcaaaatcaacatgaaaagcccaaagttcccctggatttgcgaagaagggtgtattaaaatacacttaactgcaaatgaaataaatcaaactaaactaacatgggagtgggggagtgggaggttgaagagggctaatgagtaagatttattttcaggtgaatagcacgggatcctagaaagaacagaactctttctctcatctctgatctgcctcattcttcttcagcagcaggtggccacagctgtgtaccgcacttggtgaactaaaagattagtttccaaattttcactgaaaattctagcaacactataaaccaggtctatcctatcataggctagttcaaaaattccagcaggggtgacactgccttcctaggatgaatatttgaaatctgtgaagacacttttggtgtcatggtgacttgaaggattcctactgttatgcagtaggaagaatcccgagatgctgaaaacccatcaatgtgtggaatagttgtcgacgactctgcccgaaacctaagtccattttacacttttttttaaacaaaatttaactcatctttgcacaagtaactgattgtccaggaatacaacctttgtgtaaaaggagagaaacactgcatttcgttttgttcagaagttaccaggagttgctcagtacttcaaaaaataccatgtcaccatgtggaacactctgcaggaatctgaatggcccacacaacgttatctctgtctgagtcttcaattgtagcttttgcattccctgtgtcctagcacttacatttcaaaatgcatagaattacatcataaaattatttcctcttattcacttttacttctccttcgtaattacgtaacattttcaaaattatatgtaagttggttagactatgaaagcatttaaaagagaatccaaaagagggctttgtaaaaattatgtgcaagttatattatcaaagcattttatattctaaagggggctaaataaaaagtatttgccttaaaatataggatattggatccaataaggttaaaattagattatgtcatccatattccagggagagagaatctcactagtccaacttgggtcaggcatttcaccatcccccaagcagttatggctaagtagcccaactcaagaagttaaaacatagttttcaagagtccagcattaatgacaaggcttaactgggaggcacttccagtttttctgtcatggaaaatattcctgcctatgaaaaaaaaacacccctggaaggacctgcttggctagcaaatctgataaatcaattagtgcttacatattaatgcttacaaatgatttaatgtattagcttttaccagtagttgtctatcagagaattagaaggaatttttcacaatcatttattttagcaccttcattttgcatttgtggtaaataattatatttatgagagtttttgtttttgtttttatacatcccaaactgcttggctggtcaaggtcttagaagtcatgatgctctttatggcttccaaaactttcatttatcaagcttaaacacagagtgtgtgtgtgtgtctgtgtgtgtgtgtatgcgtgcatgtgtgggtgtgtgtgtgtgtgactaaataagaaagaaaccttattttgcacagagaagcaatagtactcactaacaattaaagacaacaaatggaaagtaaatgtaaaactgataattgccaacattcaattttagttacaaattgcatgagtttcatgaaagcatagtttgagaaccactgttttaattcaaaaactgattgaaataatggaagtttcagacaatttgggaaatatttttccagatggtaaggagatgagagaatcttaaatcatattaaatgggctgctttctattttaccaacccttaaagcataccttatgatgcctaagaaccgaatagtctctggataatctgaaattgaaataaacttggtttactgtcatccgtttctgaaacccaacaccaaagatacggaaaataaaaagaaatttctccctaagctaagcactatctaaaatggaagactcagaatcaactacatgatagaaagtttgcagtaagaactcagctacaaaaacatagcttccccaatattttggtatatatcacttcaaaagttggcttcagaaatccaaaaggaacattctcccacctcacacaaagacgactccttgtgtgactaccacatggtaataaccttataaaaaagcctagaaatatgtagtaaatcactagtcccagtaacttgttaccatttacttcattatttaacgtgtgttttaattctgtatttgatccagtaaccaaaacagaagactaaaagagatggtgctatttccaccaatttaaaattctggtcagacaccaaatattgccaaatatatattaacaaggatgtaataaatatctaacctggatccatgatttggtagagaacattagtagatatataaaacatagacaatccataatcctcattgtttttactaattatattttgcacatttcagatagtatggagtcattacagaatatgtatttaaaaaacgagaactagaaaaagtatagcaaaatcattatgggttgcagttgccagcgaaaagctcctttttaaatttttatttatttatttatttatttattgagacagagtctcactcggcagagtgcaacggtgcaatctcagctcactgtaacctccacctcctgggtccaagtgattctcctgcctcagccttcccagtagctgggattacaggcatgggcaaccacacccagctaattttttgtatttttagtagaaacggggcttcactgtgctggccaggctggtctcaaactcccgacctcaagtgatctgcctgccttcgcctcccaaagtgctgggataacaggcgtgagccaccatgcccagccaaaaagcttctttaaaaagacagtatggtagttcttacataaactctatttataacagagtatatttttcttctttcataaagattcaggaaagtcataaaataccaacctggataatttttttaaagacacattataataaaattgaagaacattaaaaactaaaagaagggattaacatctggtttctcatttgcaacatgagaatcaagacagtgtaatacttttaatatcctaagagaaaatacctgttcatctaaaattgtatacccagaaaaaaattctgaaaagctagagaaagaaaacgactttatcagactatcaagaaaactgagtttgctactaccatacgtacctcaaataaaagggaagtaatttctgggattaaacataactcatgaactaaaatgccagaaataaaacccaatatattagatattacaataaacgtaaataagctaaatgcagtaaataggcaaagcattatccaaacggatttctaaaatctaactatatgctgctttccagatgtatctaaaatctgaatatacaaaaaggttcaaaataaaagaatgaaaagaatacttatgagaaaaactagccaaaataaagctggataatgctatagtgatattcgtaaaagctgatatagctatattaaaatcagacaaaataaactttatggcagacatcattagcagggatgaagaaagtcatcacctataagttttaattcaccaggaaaatataattttaaacttatatgtatcttataacatagtctcaaatatataaggcaaacattgagaaagctacaaaaagaaataaatgcagtatctaaacaaaattttaacatatctctaatttgtagtttaaacaaacaaaatagaaagattatgaacaattaaaacagcataaataataaacttaatctaatggacatatataggaattaatccccaacaagtgaaaacatacacactcttttcaaggaaactcagaatatgtacaaatatttactttatactggccccttagcaattttcaacaaacttcaaatgattggtattatgcaggccatttttttcctaccacaatgcaatttagttaaaagcgtacaatgcagctaaatatccaaagtgtataggaacacaaaaaaaaagatatatctatctcttcctaggactagtttactggtcaataagtaggaaatatataagaaaagaagatgtatttcagacaagtacttatgcaatattacaacagagggagaggaactggcatgactaagtagaacttagtcgttcattgaagttatggtaccgtgtttgagtgtgtgtatctgtatgtgcacgcacatgcacgtgttcacataatgaaaagtacaaaagagggtactcttttccagagagcctggaaattagcaagctctgtatcatggtatattgtgttgcggagtgtggattataacgtaagcaatgggaaatgacaatgaatttcaaacaagtgaaggacacattattttattcataaagggaaatctgaaagtatgggatgtgacttgcttggagactggctggacagagggaaagtagatgaaaagtgtcaggaaaccaggtggttccttaataaagaagaatgtgtctctggagaatcatgaacaggtcttgcctcctagaatctgccactttgcaaattacattttcttacgaaatacctcactacctattgctatcaccaggcatctttagttagattttgcaatcccatgcctgctttgatctatgcacatctacattgccttactcttactagtccacattgtaacccccatagaacagctaaacgcagctatgatgactaagtaacttctactgaaagactaagataacaaggataaaataattacaaagacgtctaagcaacatatttacaggtaactaacaaactgagtacattgagtactaatatgcagctcagaaattcaaatatcttggcctgtcttccttgaaatccttcggacctacctacctacctccctacttacttagctggctcactgtgtaagcatactgtctttgggccacctcacagggacagagctgtcaaattcccagaggcagataatatttttgactataagaaatctgaccaaactgtcaaaaatacagaaaatcagctaaggagattgttaagcataactcatggctccgcaagagtgtaactcaaagatttcatcaagatagaaaatcaaaattgatcattattatctccaaataatctgtggttcttttttcaccaaactgaacattttagtcatcatcagcagcagctactatgaagtttaacttccaggagccatctttttctcatttttgagggtgcccttaggcatttttagagacctctaaatccctctgcatccagcatcaggcccacccttggtgtcccagtttccactctttcccaacttattctaaaatgacttgtgaaactttaagagagaatacataaatcccttcacgttaattccaaacccaccctgaacactagagctacataacagtagaattcactataatatggccagcctcactgcaagaaatacatacatatgtcttaggataaaacagattagaaaaggtgaggacttggtctagggttctaacagaaggaaaaaagcagactatacagtgtgatggtcttaatgaccagttggatgtacggaatgatgacaagggataagtagagaacgatcttctgagctccagcttggatgacaaaatgaatggtgaaatactaaacaagacgaagaacatacgacaggaggggcacacttgacagagaatgaaaggtgtgctccattttgttagatcagggtgactgcaaagcatccaggtaaagatttctagcagattgctggaaataggagaggtgtgcatgtagcccaagagaaaggtgggaggtgcccatacataaccgggcatcatcaccctgcaagtgaaagtagaaaccacatgagtagataaaaatgtctatggagtatatgtaaagagggaatagaaaaataccatagacaaaatcccatacaaattttatgtataaacagaatttgtgtttttctcgtggcatacacaaacgagctattaaatgattctgagagtggaagatcaaataggtaaatattcatataatgcatatacatagaaaatattttgaaagttaaattcttgctaataattcaatcatgcacataccagagagttctaagcattacaccaactaataccacaatgaatcacacgtcttataatgtaaactttagacattagattacttaaagaggaaacaacatcagttaagtcaaatgttcttttggggtagaaacataatgtttattctgtttatttttgatttatttggagtcattctttctctttcaagctataaactgctgttaacattctcaaattgtagttgatgtgttttcttattatttttattcattcgtactgtgacactgttcgtcaataagacaacgggaaaaaatgagatttcaattgtttggattttgatggcattgcacatgttgcaaaacactgaagtacaactccacaactctgaataggcacagagtttacaaataagatggatggtgcatctcactaaacatcagaaagctgagactgagaagacaaaaaattacactctgagcatgttcacagataattttcacaattatagaagtctatgaatgtcaaaccaatatacagcactatttaattgtttgagacagcatgttatcataaaatgctgaaactttactatggcttaaatcgtatctttccagaagtttctgaaattcactttgagtcgaaatatggaacagatgtttgaaaaaaaagtcgatacttgcagatgttaaacattttaaagtcagttgtgtttttatttgttatacattaagagctattaatgttttaggaaataaatgaaacaaatacgtatgtaatatattcatctttataaaatgaaagcaggtttgtattgtaattggactcagaagctcttaaaagatcttcagttgtccttgccacaagccaaaaatatgtttagcttaatccacctgtgtatttcacacactgtaattactaaatgttcataatttctcccagggatgatttaataatgaggagctttatcattaagacacgacactgtgcacagacctgattattcatggaactatgactgaggcatcgactttaagaaacttgatgagatgaaatacaatatataaaagtaactgtctctgctgcctagaacaagcacctgatgaaaacattgatttttataaaatagatttgaaaactttaaacacaatgttgattaaaatagctcatttatttttaactttttctaaaataatgtctctgccctagaccaaagtaacagacaacagaaatacagagatttagaaatacaggtgatgattcactacaaaggccaaatttgagagcaataacaaaataatcatttaagacagaatgccttagaacaggtagaggtgttaacctaagtattaaatatcagtcttttactttaggtatatagtgggtttcattttgtggcacacgagttcaccaattacacaactatcgtagacaaatgaagtcatgcaaacaaaaactggatactcacagcacagttaagctttataatcttcgtagctcttgataaatttttgaaaaatgcaggctgggcatggtggctcacacctgtaatcccagcactttgggaggccaaggcgggtggatcacctgaggtcaggagttcaagaccagcctggccaacatggtgaaacccgtatctacaaaaatacaaaaatcagccaggcgtgatggcgggtgcctgtaatcccagctattcaggaggctgaggtgggagaatcgcttgaacccaggaggcagaggttgtagtgaaccgagatcgtgccactatactccagcctggacaacagagcaagactccgtctcaaaaaataaaaaaaaatgcatagttataagttgttcagaagagatgtgaaatactgaggcacatctactgaaacatgaaaataattaagagtatctaaaaaggattttaataattttaactgtataaacatttattaccactaattctttatgaaagcataataataatttcaaaagtcaaaaatattatgaggctaggaattaaagatacaggtatttgttggagatggaccacaaatctgttcctaaggtaaaggggaactaatttaaagtagaaaaacactattgattttatggtggaaaagatttataaaattaaatgtaaatcagttgcttaggagtacaactaattctagtagtaagaagagatagaatttctctctcatgcatcccatgttgggggagagtttgaaggctagaacatgattcaagaaatcttgaggtaagcgatttatttccttgaattagtttctccttctgttttggattttaaaagccctcaaatactctgagtaaacacagactttggaatcacaatgataacagcgttttcccattcatgacattgatttattgtatcatgtttcacaaaaatgttctcactcatggcagctgaattggttgcttctacccaagaatggaaagaatcaaagggtcttttatcttaggtagataacatgtatttttctagccattctaaagaaagatgtgagtttaaaaacatgtgtggaaataagttagataatgataatgtgtgagttagtaattaaagcattgcatgcctccagcaaagacaaatatttagtaggctcttagctcttatagatttaaagtttgcatttttaactattttgaagtaaaccggaatgtgcatgaagagatgtgaagtgttgaggcatgtccactgaaacattatgcaaataaccaacaaatatcaaccaacggtaatttgacccaaaactaaaataagtcactatgaataaggatactagttaaaaaaaaaaaaaaaaactgtaatgtgaaccactactttgcaacaagattaaatactatgatggtagctcaaatactgtcactcttcttggaaattagagtattagagaaactcagtgaaaaatctctaccatcagacgttctttaagatttccctggaattttggcctatgtataatagcacaggatttggaaatagaggacatgaatttaagttcttattctactatctgttaaccttgtgatcctaggcatttcacttgatttttctgagtctccattttggtacccataaaatgagaagataatattcagcagaaaatcttgttttgatgttcaaatgaagaattatttgcagaatgaaaggaactatataaactatatcaatgtgaaaataatttcctttgaagaagatacaaaaacgtcatttttgagccatagactctgagccctggaagacaattcgagatcaactggttgtgaggtttttaccttccattcttcagtctacagttcttgccatggtcccagagtcaactgcagaggccaaaggcaagtatggagagattcctcagactgtcttgaaccaaacttccctttcactgcagttaaatgttaggttgtttcgaagacattggacaaattcttcaactgtggctaaaaaatgattatgacaaaaccctttcaaaaaatctaatccccaccgtgcaatgcttgagaatcccttggccaagaaggtttgagggacatccccaaggtgccactactggtagacggcagagccagggtttgaacaatgtctcccaagtactactctaaccagatcagcaccttttccactgcacaaatgaatttcctcaaacactacaatctgttagatttacagtgtgagctttagtactttgcatgcttctgaattctaactgcttctgagctccattttagcgtggggtgactgttggaattaacttctaaggctgaagctttagcccctgtttccctgatggacattgccatgataattaaagcttttctggctggatgctaaaatcctctatttttaaaggtttcatatgtcaacttggcatagaacactctagataacctatttaataccagcaaagtggtataaagttttctaaaatctaattgtggcttatcatatttttcagtcaacgtacaaacatgttgtttaggagcctcaagaaaactctcaaggcaatttggaacaatttttaatttttagaatgtgaggctacataatgctcttggaggggtggtaaccttaaatttgctcattctgtggttagcatagaagtctctcatcagtttcactgagaatatagataaacccatgtttctagacatttgccaagaaaaagaagagactttgagtaaaataaaaactttggatgttaatatattcttttttttttttttttttttttttttttggagacaggttctcactctgtcacccaggctggagtccagtggcaagatgtcagctcactgcaacctccgcctcccaccttcaagcaattctctcgcctcaacctcccgagtagctgggagtacagaagcacaccaccacattctgctaatttttgtatttttagtagaaacagggtttcaccgtgttggccaggctggtcttgaactcctggcctcaagtgatccacctgccttggccttccaaagtgttgggattacaggcgtgagccaccatgcccggcctaaaatgacgtttatagaaaatgtggtagcttacttctagtcacagagagttttagaagctaagaattttatcacaaaccaagcacaattctcaacaaataaatgcacaaatctttaccttgacatgtaagcatttactcatttaaacagttaccaatttaaatgcatattctcaaaaattcatagagaatttgaacaaaagtaaacggtcattttccttagtaacttaaagttgtaagctctgccaaattgtattttagctgaaattctgagacagcataagaaacagcgcactaaatattacataaatgtcccaaaaacagatgtggatttattatcttatagcagtaagccatctcgtgtagctatgattttgagttcataaatcttaaaatattcttttttactgggccttcaacatttgatgtattttcaattggtaaactctggagatcagcaaaactgtaatagccagtatgtaggctggaacatatgctaagtaatgacagtagaccactgaagagttctaaaatagtcatttgtccaacttcccacaaatgtatttttcttaattctttttccactcatatcaagtatgttccctcatccctcttaatggcataagtgatgtttccctactgtaacttgaatttcaacttcaattaaacaactttatttccaaatattaaaaattcaagattatatatatatgggtatatatgtgtgtgtatatatatacatatatatgtgtgtgtatatatatatatatgtgtgtatatatatacatatatatgtgtgtatatatatacatatatatgtgtgtatatatatacatatatatgtgtgtatatatatacatatatatgtgtgtatacatatatacacacatatatatatttcaaaatagctaatagggtacatttcaaatgtctcagcacaaaaaatgagtgatgtgattaatatagtaattagcttcctttaattttttccacattatagatgtatagtaacatcacagtataacccataaatgtatacagttgtagtttatcaatgtcaaatgatattaatttttcaaattaaggttacctgtttctaagtctttgtgactagttgctattttgtaaagtgaattggaactagacctagagggaaagaagttatgattcctttagatgtgaaacaagtcaaataattcagtattcacaaatatgtttcatctttctcagccaagaaatgaatatataaggcaggctgctaaaaatatgccatttgttagagagtactatttttcactatagaatgactaacataacaaaataccacctacttagattcatcagaaagcttcctacactgcagcaagcttgactctcctgggctgagtgtcttattgattaaacaaaccaaaaaaaaaaaaaaaagaaagaaagaaaaaaatagaattcttttaagtgccaactctcttatttgatttaaattgtagatgaatgtactatgacattgctttaagacctcagcattttttaatcaatctcttgtttaaatacctatgtattttttgctgtattatcatttctcacccatataatacttttttaatgacctcattatattatttagggaaggtttttcctcacctatctagggcaagattcaagttcttggtagatgaaatgttgattcaattaagcagagaaaaatgaagcaacagtgactggactacatttaataaactcaaataagtaagattatccttattgaaaagttgttttatgtgtctcaagattaactatgtagtttgtaatttttgtaacgtgcaaaataattaagaaaatattccagaagcataccgttcatgttctgcaattagcagaaaaaaactaatttaacttccagccagtcatcccactaacagaacaatcctgacagataaataaataaaatctaggatctaacttgactgaaaaaaattatattatactcatgatgtattttatatttttgatctcaaagcaaataacaattatccacaaataaattcttagcatctgaaagcatgacttaattgccaaattaatacaggtgaattagtacccatattttaaaagatgagtaaaagaatcaacaaagtcatagactttattataactgtttattcagcctcaatgtctcctatgagtaaatcttacaaaaagcaaaatttaaagtgtcagctctaaaacttagtcatctcatttccagtgcataagatcagttgtttaaaagagagcaacgatggagctaaaataaaggctaaagctagcagttaaatctcgactgctaaaaggcacccagtactctataactcagagatactccaggatggagggggctttttctaatatcaatattcattaacacccacatttccaaagcagcaacccatattttggattttttgatgtttcttctttaaagtaaacaccagggcaaaatccagagtaaagtttatacattcattggagagagaaacagagatcaaagggaaaagaacacacacattctttggatgagaactctctcccttttcaacactgatgtgtttcatcaggagtttgtgggcagaatagaagatgaaacatacttaccttcattagcaagttttacacacataactgtatttcagttttccatcaaataaatcctttaacatgcatattgtttagttttaatgataatggcagcaatagcttaacaattagagcttatctttagtttaaaagcttgcaaaagaaaacactattgacactgcacagcacattttaaaaaaccaatgtttgcacacccagcacagcaaaaaataaaaaaattgttgttaaaatctcaaagagaaaatagtttatcccaaataaagataaattatcagaatctttctttcttaaaacctgaggtaagcagcttcacctaacaatgacactgatcatctaaaactaagctaaactatatttttatacttttatgcacatttatttatgtatcaaaccccagtaaacattttttgtatatttaaagcatcataaaaaccaaagttctgtgtggatgtgttttaatgtaagcattattagatgataagaaaagtcaaaacatgcaaataatgccaaaaacaagtatcctagcttttttcttccctctctccactgatcacaccgggaggctcttcagcaagaagccaccagagactaacttgaactggaatgtctaggaaaccaagccaaccaactccgctaaaaacaagaaatctagacaagttattccacgcgcactgcatccatctctacaaactgtatatatttcagaaggattccacagccttcgtattccacaagtgtagtcaaaactgccaacataaatttattcccaaaactggaggatctcaaacattttctaataaggcttgactacatctcctcacttgccagttttgaccctcaaaagtagcttgtccttgacataatttctcaacaacctcaatagatccttgtatctaacatgccttcatttcttcccagtcagtcattgccaatataccccctcatgcccaaacctttccagttccctaccctctgctgccagagcactaagtccagtacactctggctatgaggatctctggattatctgtgcaggagtagtgacattaagctgagatcttctactaattctagacataagtttccccagtgggtttgctcttttgctgatttaaacaacaatgtattggcactggggttcagagtgggataagctaggaaactaaagggatttcaggggaaagaatcaccccaaatcatttctcccttccatttctcttaacagaacgctctcttctgtgtcataccctaaagttaaccaaaaaataatctggatactccacctctgcataaaacacagatcacaatcattatcatacattcttcttcgcatctcagataaaacctaccccttctcccaagagactgggatgcttgggaaagagaagtagggaatctttgcaaacataaaggcaatgtgtcctatcggagtagagcagagagataagaggaaacttctagcccaggccaaggtctactgactatgatcttggcaaaaacacagaaacttgttggccaactttaaacgaagcatcaaatctgcctcctccctacttccctttgcccagggaactcagtcttcggtggaagtggtgttctaggtcttctcactgtcctccctccgtcctggactgcatctacagtcagtggcagggcgattctggcaggcgccactgttctctgtccctccttccttccccgtctatgcaatctggggcgcctggagaactgggctcctgcgtgccccctggccagggcacaggacaggctgcagacagaggctttggagctctgcaggggattttgcagcctgcctagcttgtcggataaacccatttccttgacatttcagggcaaacctctattcgtcgtttctccagcgggtgggggggtgcctaaacattctcactgatcaaagaagccagaatccatctgaacctctgaaatagtagaacgtaccaaatgcctaggggtaaagaagggtggaggatttcaataaaagaggtgcttccagtgtcgccccctttcccgctttttcgtttacggtgagcgggacatttaaagtattttgtggtttgttggttttttaaagtttttatttattgtgtgtatataaatatatatatttttttttcttgaagggaagcaggcagaggtgcccataggcagaggggcgcgttgtcaccccggatgctccctccgggcaggccctcacggccaagcaggggaccccagagggagagggcgcggcgcggggaacccgcggagcggcggggggctccaggctggtgggagaccgtgtgcggccggagcctccgcagatgccgcccctaccagcccggctcccgcctccccgccccctgcccgagtccccggacctgctcccgcgcctggggctagggcaggctagccgtccccggcagcgggggtacctctccagcccctgcactgcaactgcgggaggaaacactgcccgcgggcggtgggagggaaaaggggtctcacgaagttctgggataaaaacgggctgtcgttgcagatgcctctgtcacgcgaatctccgagcggaaatgcactgtccccgtgccgggctggggcacaggcgggatcggagccgggaagaggaggcaaagtggcggcgcagctcggacaactttgctgggaaagcaggcgacagcgggcagagctggtgccgctgccccccccggggagacgagccggcaagaggcgcagggtctgcaccccaaatgctgccgtcacggaccaggaggaggacggggtggccgctggcgggaggagcaggcggggagggcgcccagcccgggagtgcagcctggctcgggagaaccaccctccgtgtcctcggccccagcaggggcgcctgcgcccgggtgcgcgtccccccaacgccccctcgtcgtcccgcgggaccaccaactactccgcgccgctggaggagccgcgggaaggagaggggagagcagggagcgccgagaagcggccgcgaagcccgcccggacccgcacgtaccttgagctcctcaatgtccaggttcgttgatctgtccatggagcgcaactaaacgaagtggagaggaaccgggcgagtggcacccaaaaacaatctagtcttttagtttccagcttaaactcagctttatcctcctccaagccccggcagctcctctcagtctcattctccgtggtcacgccgcctccaccgggttaaaaataaggaaaataaataaataataatgataattcactttattttacttcctcaaagatttagtgacaggtgatctctaccgcggtgcaacacagctgagtcgattgaaacaggggccaaaagaaaaaaggaaaaaaaaatccactctatttaagattatttcttcttctgcaataagcttagaacccagcgaattgctgcatcccgagaaaaaaagctgcttccctggtcagcatcatgcggcaaatttcaagcaaatgtgttcaaactgaagagaagagtgtatgataaaaggcttcctccgtcaggcttactctggtaggtaatttagctccagtcccaggcattagcaatgatcagtttccccggcaagataacagaatccccgaagtcctgcatagacttaaaaaatgtcttgtagctgagaggtattttctcagtggggaaaagaagataatcaagtcagaagggaacgttctcctttgaaggttatgctaaaag

SEQ ID NO: 228 - DNA, 222941 bp, Homo sapiens
caaagagcattttaattaatttatttatttctttacacataactgaaagtgatgttacagtacataagttatttacaactgtgcagtaatgtgttgcaaaataaattatctagaaggcagcaaaagtacattgtgaaggtatataaaactgtacagcgtttacggatacactttttatatgattattggctctgtagtgtttcaagttacgttctcagaaagagaaacaaaatgcccaagattaaaggaaagaagatacaaaccacgcggatttgactccatttcaatacggctgggagtcctggctctgtgtccctccgcctggctccgcaccaggtctgaagcccagtctgaggccgtcgcagctcggcggcaacagaaccacggctgggatggggctcctgcccctccgacctgcaggtcactgtttgtgagaggtggacaccttaattttctttagttgatcagaatggaacaaaaaattttaaaaatgtactccgttctccaactcctgaaatgcctctgcagttgctggagaaaagggcccgaaggtcgccgttttcaaacagaagctgccgtgtgtgcgcgcccggcatggtctcctcatcccgccggggccagtgaggctctgggggctttgcccccgccgcggcagctggtagagaagagacgtgtttcacctccccgacgtctggaccagtctggaagggatggaggcgctgtggccaagtgcagtctctctcggggtctctccccgcccgggtggacagggcgctccctcctccgcccctggggctcagcagcagtcctgggcagccgtgcggccctcgcctgcgtcctgcggccgtcccgcggtgtcatgccggcaacaatacaaagtcgtcgttgacgtcgaccatgggcacgtagaaggagggcacctcgttcacgcacagggacttgtgcccggcggggtccagttcctgcaccttcagctgccactccatcctctgcacggcgttcagggccgcggcctcgtgctgctgccgcatgaggaggcaagtctgcgggacacacagcggggagaggagggaggaggagtgaagggagagccccagactctgccgacctcagctgccagcagggccaagggcgtgatacggccgtgaacctaccctggtatgggccaggcccagctgtacccgctcctggcatctagttactacacgtggcggtagcgccagctgtgctacatgtctgtccccataaccgctgtctatgccacctctaccctggcctggggctcaccctggcccgggggccctgccctgctctgggtgggcctgggactcacctccagcagccactgcagcttattagaatcgaacagctttgcttttgtcattttacaattacttacggccagtgatagtttcacttgtatttctagtagaaactatgccatttaaaagtgcacataaggggactggactggggtagcacatattttggaaactaatggagaaatggaagcgtggccagggagtactggtatgtcacaagcaaccgtgtagagaatcttttttagataccgtctcaaggctggagtgcagtggtgcaatcatgactcactgcagccttgacctctggggctcaagggatcctccctcctcaacctcccgagtagctgggactacaagtgctaccacgcctagctgatttttgtagagatggggttttgcgatgttggcgagctgcagtgtgatcatgtctgtctctaaatttttctcaacatatatatatgtatgaaatcgttttcgaagctcaggatggattcacaatcctcctcaatgggcctcatagcttttactcggcagctcagacatcaccagtgtaaattgttacatggaatcatataataccctttggatgttccaaactccggtgagtcactgaattactgatgggcctctgagtgagtttccagttttgttccagtgaatatttttatacatatccctaaggtttttttttaaattttgtccccaggctggagtgcagtggtgcaatcttggcttactgcaacctctgtctcccgggttcaaatgattctcatgcctcagtctcccggaattacaggcacgcaccaccatgcccagctaatttttgtatttttactagagacgaggtttcaccatgttggccaggctggtctcgaactcctgacctcaggtgaaccacccacctcagcctcccgaagtgctgggattacaggtgtgagcaaccgcaccccgcccaaagtcccattttaatgtagtcaaacatttatcttcttacaggaaagtcttccatgtgtctttatgaagctttcagttttttctcacggctctggttaggaagggcctagtggcctggggagggtgtggtgtgagtgacttcctgcaccatcatcttagggctggccagaaatgcacactcagctacgcctcagacctgagttcctcagcacaagcccccaggggccacgctccccaaatacccacagctcccaccgggtagggctggtggttctcatctgtgcccacatcagcacctttctgagagctgcagtatgacacacgggtgcttggttcagggacctgggtggtgctgagcctgatactgcaggtagccggggccgcctgctcccaggcctggctggtgactgtacagggtgacgctgactgtaaagttctgtaacttttggcaagtttccgccttccgttgcctcctggtggatcctccagggtgtcccggtgagcagccctcgcgaccgggataagggtgtgctgcccttcccggcacctcccccgcccctgcccaccgccctggccagcacttccagagcagtggagggtgaatgctgggaccttagagggggctcacagggcagtcccaggagttctgaccatcaagcctagggtcctgttgagctggcgacaggagccgctccctgcacaccgggacagaagggaagactgaggaggccacacgcagggacaggacctcacctccccgaaagcatcggccagattaagagaatctgaaattgtcaccgcccatcacagaactgggcagcggcctccccccaggcagcgcaaagggggttgtcaccacccatcacagaactgggcagcagcctcccccaggcagaactgaggggacgcgcaacaccgaccttcatgcggtcatacttgtcatccacgtcctggagccaggagatgaactggcgggcgttgaaacggtcgcgcactgacttgttctcgtcaccctgtggaaaccaaacacgggagtttcatcaggagccccagagaccgctacgggaaggcatgccagcctgggcgatgctgcagtgaccgttctcaagggacaaccacagggggagcctcattccaccgcgcacacactgaatcatgttcaaggcatggcaggcgcaccctgcccatctccctaaacagcctccctaaaatgcgcgtggaggcagctgggcctttgtctcctgggcaccgggtgcccgcaggccccacctgtgagccggtccccagccctgcccccaggggacagtcagagctcagcccactgccaactcctgggagagacttttttttttttttttaagagacagagtttcgcttgttgcccaggctggagtgcaatggcgcgatcctggctcaccgcagcctccacctccagggttcaagcgattctcctgcttcagccttcctgagtagctgggattacaggcagccaccacgcccagctaattttgtatttttagtagagacggggtttctcctgggcgagactttctagatatgtcaccgtcctgtgtcctgaagggtggacacggataagatgtccaggctcctcccctttttcacgggttcatggtgaagctgacaatgccgtctgtttctcagaacatgtggagcaccgacagaaacccacacacctgcagggaactcactttccacaaaggtgccaagaacagaataacgatcacagggaaaggacagtctcttccgtaaacggtgctgggaaaactggctacgcatcgcagaagagtgaaacgagaccctagctctcgccacatacaaacatcaaaccaaaatggatcaaagtctggaatccaagaccttaaacgatgaaaccactacaagaaaacactggggaaaatctccaggacattggcctgggcaaacatttctcaagcaataccccgaagcacaggcaaccaaagcaaaaatggacaaatgggatcacatcaagttcaaaagcttctgtccagcaaaggacacagtcaacagggtgaaaagacacgcacagaatgggaggaaacgcctgcaaaccgctcctgtcacacagattctcaagcagaacatagaaggcatgcaattaactcgatatgaaaaaatctaataatcccatcaaaaaaacgggcaaaagatctgaatagacgtttctcaaaggagacacacaaatggccaacaggcatctgaagaggagctcaacatcattgatcgtcagagaaatgcaattcaaaactaccgtgagacatcacttcaccccggttaaaatagcctttatccaaaagacagacaatcacaattgctcgcgaggatgtggggaaaagggaaccctcgtaccccgttggtgggaatgtaaattaaaacagccgccgtggagaacagtttggcgtttcctcaaaaaactaaaaattgagctaccataggatccagcaatcccactgccgggtatagacccaaaagaaagaaactgggggccaggcacggtggctcacgcctgtaatcccagcactttgggaggctgaggcgggcagatcacctgaggtcaagagtttcagactagccttgccaacatggtgaaaccccatctctactaaaaatacaaaaattagccaggtgtggtggtgcgcgcctgtgatcccagctacccgggaggcagtggctgcagtgagctgagatcgtgccactgctctccagcctgggtgacagaggaagactcagaatcacaaaaaggaaaaggaatcagtatattgaaacggtgtccacactcccatatttaacgcaaccccatttactatagctaaggcttgtgtccatcaacagatgaatggataaagaatatgtgctacatacacaacggagtactattcagccacaaaaaagaatgagatcctgtcatttgcaaacacgtggatggaactggggtcatgatgttaagtgaaataagcatacaaagacaaacatcacatgttctctctcacttgtgggatctaaaaatcagaacaattgagctcatggacacagagtagaacgacggttaccagaggctgggaagggttgtggggggctggcagggaggtagaagtggttaatgggtaccaaaaaaaaaaaaaaaaaaaagaatggataagacctactatctatctgacagcacaatagggtaactgtagtcaatagtaactgcattgtgtattttaaaataacatataagagcgttaactggattgtttgtaactcaagggctaaatgcttgaggggatggacacccattggagaaataaagagggaagtaatgcttccttggaaggtgttagaggcacgagctggtcctcctcatttttgctctgtacagagctgtcctgactgcctgtccatcacagcctctcacctgcggtacaagaatgcaaacttatcagcatccagcccccaaagcaccatttggtccaactcatgttttctttaaagaaaatctgtcggctgggtgcggtggctcacgcctgtaactcccgcactttgggaggctgaggcgggtggatcataaggtcaagagatcgagaccatcctggacatggtgacaccccgtctccactaaaaatacaaaaatcagccgggcatggtagcgcatgcctgtgatcccagctactcgggaggctgaggcaggagaatcgcttgaacccggaagccagaggttgcagtgagccaagatcacaccaccacactccagcctggcaacagagcgagactccgtcacaaaaaaaaaaaggaaaataaaatttgtcattgtgtatatgagagacattgataaaatacatccccaaagaaaggaagatctttaatgcacaaagagatgttttcaactaaacatctgggagcccctggctgtcaccacacagcaaagcctagtgcactgctcagagtgcccagggctggggtggcgtcaaggggggcacatattacgagggctctcggtgcgagatctggacaccaaggcaggaatgtgttccaggcacgtcccactgcacaggatgtggggcctggggtccagggagcccacaacctgagcgcagtgggctccgaggaggagggaggggctgatgcaggcgaggcaacgggagagccaggggtcccacatggacaggtcagtggtggctggaggatgatttctgaggcaggagtccctggcacatgggctgcttgaaggcagacaggaagagctgccccagggagagccacggggccctggccgcccacatcctatgtcccagtggacagagcaggtcaaaggcacgggagctgcaggggtgggcgggagccccacagcagatgggcaggacagtgactgtagttctggaaccctgagtccggcccgccctggcccagatgagcggcacacctgggtgcccgtgttcccttagccacccagtgtccctgctgtccccgtatgacagcccctggggcctgtgctgtgaaagccctcgatgtggcagccctggggtgcctgagagcagcaggtggagcccagcagtttaaacagaaaataatgccagcgctgacacccgtgagaggtaggtaggggcaggtgctccaactgcatggacaagtgttacggagggactgagctgctgaggcccagcccagtggcctgagggccttgcccgtgcggggagctgtctgctgtctgctgcagccttcttggctcctttctgaggctcgcccaaggctagaggcatgcaaaggactctgtagcccctgcaaggtgctgagcacccgggaagctcctggtcaaagtgcagaatctatcaaggggaggggaggcgggcagggtgcaggcacttggactcatgggcctggcatgcagacgggccctacctggctctccaggggcatgttgtagacctcggagtccagcagcatcgtgcaggcgctgaatggcactgcctggttggcgatggtcctggccgcccggcagtgaacccgcagaatctcctgctcacaggatacgatcagcttctcctgaaggaggagaggagtagagtgagctgggacacagccacgctccaggccccactgtcaacacgacagcccctggggcctgcgccgtgaaaagccctggccgtggcgcccccctgcctgtgccagcccacttacccgctcgatgctgtgctgtagacgcagctttccccggacggcctcctgctgcctgaacagctccttcaggggctccgccagggagggagggggtgcgatctacaggcaaaaggtgagtgtggggggtcagctggggctgtggaactgcacgaaggatatagtctggagttcacgggggtcccgactcagcctccccactcctaggagcctgccctggaggcctcctccagtcccagcaacagacacaccaggaagcttctagaaaccactatgtgctggacgcgggagagcggacacctccacggtgccccgtacagcaccacgcagtgaggagatagtgcagggagaggcgcgggacagtatctgtgggccatcgtgtgccaaggagggcctgaaacaccggcatgagcacccaactgtgcagaggagatacagcgagacagcaggagggggctgggggtaggctgagcttcctgtgttcacagggagggcccatgcaccccaaatcagcctttcaaccaggctgtaacgtgcacagtggaatatgaaagctgacaaccgagccggtggtcttgcagtggctcgggggagggaagcacgcactggcccaggtccccgtgggggctgggggactgtgggccggaagcgcaggcactgcactcccaccagcagaagggttctcacagaggtgggtcggccattctgaaactacatgcatgctggaagtgaatgaggaagtaaagacagccgagaccatcaggatgaggcctcacactcttggagaaacaaggcccacacaggagcggggagccaggctgagccccgcagtgcagcagagacctcaggcccacagggagtcaggtttccaaagcagacccagaaagcatggccgtgtgctcggggccacagcagtcgtaccagggccaccactccccacaggtggacccacacggtaatggcaaggcggagccgggtggccaagaccagctggaacatcgaggggccagtcagcaacaggagcgcacggggcagatgggcaggtggacgcacaagagggagaccaggaagagctcctgacagccaaggctggggcgactcatggcatgagaccaacgctggcgatgccgggcacctgcaggcggaaggggtggctcctgacagcacagctccagttagcggacacaggagagggagacaggcccagcgcacaggagtgactgctgcagacgagagccgtggacagcgatgcgcatggacaatgggctgagagaaacagcctcacgcagtctccacgtctcttccaagacacacacacacaccacagagggagagacttcaactcatggtggacgggcctgaccaggcctccaggtcacgtcacctatgacaccaggagcagaaggccccgcctcacgcctataggctcctgcctaagaagcatcatcgcaggccaggcctggggcctctgaccacactgctgaccgacactgcccagaagctcccagccaggagacagggcacgggagggcctgccacagcgtggacgcacggcagggtctcgtcacctccacggctcctaaggcacattcaggggaggctgggcgtgcagcaggtgcataaacctatctctgctgtttctgaacttttctgcccatctaaaatcagttcaaaattaatgatttaggccgagcgcagtggctcacacctgtaatcccagcactttgggaggctgaggcaggcggatcacaaggtcaggagtttgagaccagcctgaccaacatggtgaaaccctgtctctacagaaaatgcaaaaattagccggacgtggtggtgggcgcctgtaatcccagctactcaggaggctgaggcaggagaattgcttgaaccggggaggtggagcttgcagtgagccgacatcacgccactgcactccagcctgggtgacagagtgagactctgtcttaaaaaaaaaaaaaaatggattaaaaaatgtagcaaagtccctctagtccacagacctcactctgttcagcaccacatccaccctgcctcgacgagcccagccccccagtgagggttctgctgagatggggcccgtcggtggcagggattctgtgggccacctccaaggtgggactgatgcgagctcaagcgaatgcacagcccaggacccggcaccaccccttcctctggctcagccccagggccggcagctacagcaggagctgtgccttgggcctcaggcagcacctggcacctgggcctgcctgggtctaggtctggggggtactcaaaagaccaggcgggaggtgcacagaacattcccaggactactcagattggcaggattctagtgacttttttcccctgtattttccaaattttctacagcagtcagactagtgttatgatccattaaacgagaaaacaaaacaacaaaaagcacagaaggtcagaagatcagaaggtcttactgaggagagatcctggggcaggtttttctgaatgtcatgacccaactgccgtctctgtcttctgtggatgagcctccccggggacggctggggtcaggctcgcggggaagggaaagaccgcagaggtcaccgtgggtgcagtgcccctcgtgctccctgggagcagagctcagagcttggcagggtggggcccgagggcgcccgctcctggatcctgcacaacgtccctgacatgtcggccagcagcacagacccagcctcaccctcagggcaagctcagcagaccccgtcatcctcaccaggggggtgctgggtagctgagccaggtcagggccagcacggcgaggggcctcaggcggcctgggcccacagagccaacgcgtgtggagggcccctggctgtacctcacgccacctgcgagtttcagtgcccaggaatccccagaaggaaatggccattggtgacggcaagcctgttctgggcataacacaacacactcaagcgagacggctgcatcaaccacacagtccgctaggcacagtgtgagtggagtcgcgtggtctgggaggagactccagggaagagccagaacgccacacgctggggctggatggaccctggggggcctgagaacaggagggcaggggaggccgtgcacagctcaggccgtcaccgaggacagacgggtgggctctgcctcccccatgaggaatccctgtgcctgctgggaaagaccccagtgggtaggaggaggtgggaacccagtcaggccccgcggcccagggcagagagtgcacagggcaggcagccctcatgggaatgtgctcagagcagggccccatttggagggatctattttgggcccagacgtagcgcaaggagctgggggagtgggggtgattccgagatgtttcacctgagcctgcagaggtagggatgatgcctggggaactgggctgacagggtcaggtggaacaaggtgaggctgggggccgaggaccaagctgccccaagggagctgcagctctgctgtcccagaagcccaagggaggaggtgggggaagggactcatcgtgcaggtatggaggctcagggaacccacgcgggtccaagggagaagggggcggggcaggggcaggagacacagggggtggctctcgtgaggccgtcctggtggacggggagtggagaggggagagtgagcggcgtgaagggggagccccacacgagtgggaccggggtgcacccagggtgagggggaggtcaggagaccgaggcctggcacggaccagctggaggaaggacctcgggtctgcagaacagctgggcagcttccggcttttgcctccacagcagaagtggggctgtgtctcctcaggtggcagaaggtcgagagaggtcaagggccatgagtgggacaagacgggctggaggaagccgtgactaggggccccagacgcatcccagagagagaaggcagtggctctcccgggccccgcactcaccacggggatgtggagcttgctgagcggcttgccgtccaggaggtaggagcccgtgtaggtgacgtactcggcgtagcactggggcgcctgcggcgtgatacagcacaggatcttgcgcttctcctcgatcttcttcctgatctgcaggtattcgaagtaggggttggccctgtcgctgtggtagggctcgatggcatccagcttgatggcgtccacgatggcggccagcgtctgctggatcacctcccgcgtctgctgcgtggacgtgttcagctgctgctgcagctgctgggtggagcgctgaaagcggcgtttgcgcggatgctgggcctgggcgtcgtcgtcctcggagccgcgggccttggccctggtgaccggggcaggggtgggggcgcactccttctcggaggggggcgggccctgcttgctctggttcgcgagcatctgcgcccggttcctggtcatgcgctgagggatctcctccactcggggggccttcggggcttcggccgtgggttttggttctgcggcttccggctggatgccgccaggagggccttcggctggggcggcggcacgggaggcctcagtgtcgtcctcggggccggcaccgtctgcggcctgagcttgtgccacagtgttcggggcggggccgtcaggggcacagagggacgcggcgggggggccttcagcctcagccccctggtctccgctccccagtgggcgctgttctgggggaacgggcgcgggctccacgctggagtccggatccccacgggccctctcttccggcaccgtctccgcctccaccgcagcttctagagccacgtccagctttggctcccctgagggctcaggctcgagctctgcagggagccgggtggaggcctggtcaggaggcagtgccggcggctcctcagccactacggtggaaacatccccaccgtttatgaccccgggggcccctggaggcatctcttctggaggagcaagactttcttccacgggttccgcttcaccatctgcggcatctttagtctgcaggggaagctccggcagggagaagggccccaggtccaggtcgtcctcggggccggcgaaggcgtccgcccagggcaccggctccacctggccgaggtgagacaggccgcggctgccgtccaggaagctattttccaggggccccagagcctccacctgagccacagcggctacacaggcgggctcgggggccacgtccagcggggcttccggaagtgacttgcagttgctgaagaaggactccagcccggagggaggggcgtagggagccgcctctgaggtggagatggcggcggggacggcgtccactccgtccttgacgtcctccagccccggctcagcgacgggcagagcgtacggggcaggagaggcgggaggggcggggtacggcgcctccgaggcgctgaagggccctggggcggcagagtggagggggtccgcggggcagaaacgctttggggactcggggaatctctgtggagacttcagcaggaggtccgagcccacaggccagctcacagggttttcagaggtgcccccgatcaggctagaggcaagcgcctgctcggaggggtgggcccactcaacgggctcctcggtgatgacggcgctgaagggaccctcgtccagcggctccaggtagctgggctccggggggatgatggcggccgtcgcctgctggtcctcggaggtgtccaggtccgggggaagggccccttcgagggaaggaaccagcagctcggctctgggggaaggggaaggttttgcttgtaaacttgagaagacgccctctggagacggggtgacagtgacaacggcagccggtgggcagtgcaaagcgtcgactttgggcgacgggaggccatagtctggggagtagtaccctggcgacaagcaggcaaacttctccgcgggaaccgggggcaggggcgccctgtcttccatcgagggtggcatgggagagtcgtagctggaggcagcaggaacgctctgctgcctgaagagcttgtctccgacgctgaattcttcctcgggggtcctcctaatgtcgacagagaccgagcggtaaaggtttgtggagagaggcctggcaggagcctggctggcgttttccgaaagcccacttgaagccacggagaacctgtcgaaaaaggagggggagcaggcgctggtgggagcggtgggcacgggcgtggagtgctgcgagtcggcgcagtcgaacacgaggtccgcgtagtcatcggcgctgcaggacggggtcctgggcgtgtgcatcacctcctcgtagctggggcaggatagcaccgacgtaggggtgggcacgccagtgggccggctctggtcaggcctgggggacgcaggcaggacctctttcatgtgagggcctgccagccagtctttggagtctgcacctgatgctgggtgtagcttattttccgcggcaggtggaataggagtcgactctttgagctttttgtctttaaatggagggtccagccccggcggtttcttagcaggaatgtccagacccttcttccgcccgtcgtctgccggcttcgccttctccttgagcttggggtctccggaccggtgcctcagcttctccatttgcttcatcctctccttgtgccgcttgtggcgctcctcgatctccaggtccttctgggacagcatcctctcgaagctggtcatcatcaggtcgccgtcccccaggagcttctccctgggcctggcgtctttcttgcctgggtctttggatggcgctaccttatcattcccgttgctcatcttcactgggtcgcccttttctttctctgcaccgtccttgaatttctccttcagtttggcatcgccgagcctcgggccctcgtccctggacttgtctttgagcacgcggggcgggctgtccttgtccctggtggcgggcttctgctcgtccctgtgatgccgcaggagctcgtccctgtgatgccgcagcagcccatccgcatgcctgtcccggtgcctctccttctcgtctctccatttctccctgtgtttctctctcttcttcttctcttttaggatgttgatggcactagatccataaggctttagttccttttctattttcttggaaggttctctctcggaatcatttttatctttcttttcggtagaaaacaattcaatggttttatctagctcatcttctatgtcagctttcatgttgtaagaaactccgtaagcatccgcctccaggaagtccttttcgtactggccggagtccttcctgctaccgccctccttgtaatcttcgcccttctctttcttctcggccttctctttcttggctcgctctcggtcgtggctcttcttggatgaagatgaggagtgtctgtgcctctccttctctttcagcttctcagggaggcaggcgctctccctcggcttgtcgtctccaggtggctccgtgaaagagacctccaggaaggcagtcagccccggctcctgccctcggtccgtgaagctgtcagaggagacctcgctgattttatcgttggagtcttctctgtactcatggagagcctcttcttccaacttttcaagcaggcttttttccgcgtcggcacttctcgaggacttcctctccttggaatgttctttgtccgacttctctttgtgtttgcttttagccttgtcttcggcagcgtgcttcttttcagccttctcggggagcttctgtttatttttcttatcttgcgtggagtccactgaggctctgtccttcctgtccttgtacttttctgtggactctttatccttcttctccttgtgcttttcaaagactttctcttttttgtctctccccgcgtcggcagcccctcggtcctttctcctgtctctgggctccttgtccttctgcctctcagggtgctgcttgtcagaagacttcctgtgtctgtcggaggcataggcctcccgtccttcctccttctcctggaggccgtccgtcctcggcaagtcgctggcctctcccatcttgaacccgctccccatgcagctgtctctgtcgtcctcactctcatctgtgaagatgtctgcgatgtaccagcttttctctttgcctttcttgtcatcttttttttcagagaagtcttctgagatgatcccagggaaagccttctccttcttctctttcccttggtcgagagacgctttcctttctttgtctttgccatgtgtgtctttatgtttttccttggtatcttttttctctttaaaacatttatcaaattctttgtccttctgacatttttccaggattgatttctcacttttgtccttgtcactggatttctctttgtatctttctggttttgtcttctccttcctttccttatcggggccatccttcttctccttctctcgtgctgggtggtgccgttcccacggctccaggcccttcccaaagtcgccgtcggacttgtccttgaagccactctcgcagccacactccttcagctcctcccggtgcgcctcctcgggcttggccctgccgtccctgcgctccttgcagctctccagggcgtcctttctgtcccgcccggcctctgcggactctctcctcttcttgtccttttccgaaaggtagccagggacacttttatgcttttcggtctgctctttcctcttctcagagtttttatccaaatagtccctgtccttctttcggaagaagggctctctgtagtctcgcttctcccgggcccggctgtcccgcctcctctccttgctgtcctccttcaccgtctccaagatgagcttggccacagagtcgctcttcatgtccctgtagtctgtcactggcgagtcccagctgtcctcccctttgaaatcaaaggatgaatcggacaagtcagaaaaccaccgatctcgctgatcgtcagaaaggctaaatttggtgtcttcattctccagaaactgatttttgttacaatattcgtcaaaagcagaatcttccctataaaccttttcttttttgagtttttctttatcttctttaaaaatcttctccttctcttttgaaattttgtcctcttttaaatcattcttcttctctaattttgagggccggtcttttgatttcttctttctctcctctttgtacagtctcagtttttcttctttcggagacttttccttcagcgatctctccttttctgctttattcgaacggtctttctcttctcggaaagacctgctgatgtctttgtttgtgtctttgattctcttcagtgatttttcatctttaaagagccattctttttcttctaatttcattttgctaagtttctcttcttttttaaagtggtcgcgatcgtgctttaacacttttagcttgttttcagtggaaagatcattctctaacagtatagccttatctgacttctgcttggagtcctcatattcgtaagtaaaacttttcaacttcagctcttggctgatggaacactgtcccttctccttgtttttgtgtttgtgttttgttttatgttttttgacaactttcccctccttgtccagtttggggacagcgccctccgcgctggacaggaaggggctcttcttctccgacagggaggctcgcttcctgtgctcctgcctcttcctcactggcttcagcgattccacactggagccctcagaggagtagtcagactcgcttgtcagtctcgtccttgtggagtctgataaagaactgacctctgaccaagccggggaagaaatggttttccaattgtctgtccgccagtgcttggtgtgctggtctgtgtggctggggttctgcttctgggcggcagagctcccgtgagacgaggtggaggaggcagagagggagctgaacagggaggggtccttcagcaccagcggggaccccttgaggcagccagagctccccagagagtccctgtcatcctccccactctctgaggactcgctctccgactccgaggagcagaacttgtcgctccgctttccgaagcgaacctctctgccttttgtttctttctttcgcttctttttcactttatttttttccttctgctgcttggcattagaaggctctcgtgtcttactaccaggcaatatcgtatgtgccgagagtctcagcttctctcctgtccccacggtgacactcgcgtcctcctcgtccgacgtgtctgacaggatacgatgggacgctttctttggtgcaatcgtgttatttttagtgtaacttttaacctccattttgggtatagagataaaactattggatttcgtttcttttctgtagtcctttttcaataggtgcttgtcgtccaccggaggaaccctgtcctgctcgtcgtcctcatcaaactcatactcgtccttgacgggggccgtggccttctgtggctctgggttcttggccttgtgcttgaggcctttttcgaactcggagtccgtgttgttgccgtcgactgaactggaaggtgcgaaggatggtgcgtcttcctcttctgagctctctgttggaggtaggaagcgagaggtcacaggcaggctcaaaacagctctccccagaatggcagaggagggaggctctgcagatgtgtctgcgggaaggttcccaccctgcctctgcagagacactttgctcgactcatggaaaccagccacaggcaggaggaaaccagacagagctcagctgacagacagggctggcatcttagaatgaagactgcaggcttctcggcagtgacacacctgggcggggtctcccgcagtccagaagctcctgtaagcccccagcatccgaggaggagctgatcagaggggcaacactgtgcaaacaccacagggcagctcctaccatccctgcataaaagaacaggcagctcaggtggccgtgacttacccgtcgagctctcctcgctggaagtgtaagtgcctttgcctaacaggaggttcaccatcgtgggggagttggccactttcagcggcgtctcgcctttcctgttgctctgctgcgggttccctccgtaccgcagcagcagcttcaccacctacaagacagtaacacccgcgtcagggactgctggagaagcacaactcctctaccgttccgcataacacggcagccccttccgagaaccctggggttcgacccgagagcagcccctcacggtctgagggtgtgggagccgagcgcccagggactgcctggcgaggctctgggtgtggtgggcgaggctgtggctcctctgtgggaagggctgcagccgcgggggctcccgcacccctcctgtgctctccttcagaagggctctgcctcctttggatttttttccaccatttctccgttgccgcaagtagacgacttcccaggaatcttctcacgaaggctctcccctcccgccaacagtgagctcctcagcagagtggtgccggagtggtcgtggagggctcaggcaagaggttagggagaagagtgttatggaaagggttggggggacagaatagaggaaacaaagaccaagtttctgcaagctgctttattttttattttcatttacattagaaaataatctctcccttgcttgattttacaagggtaagggtggtcacatgactgacagagacaaccatggtgacacagctcttttcagctgttcatcaccagcaacctggatttcctatgcccagaacagcaatgcactgaactcaagtacaaattaaatttaatcccaactttagtccagtctgagattagcgcattcaaagaatctgtcataacgtttactatagactcttgtcgcccacagaatcagtttccagttcgtgtgtgacatgttctattgttgaatcagtacagagttcttatgtgtgtgagttttctatggtgactacacaaaacctcaggcttacaattgtggaggtcagaggtcaaggtgctggcagggcaggatccttcctttcctccatcatgggggctgctggcagaattcagtttcttgcagggctgggacggaggtccccagtcccagctgcttaggggccaccacactcctcggccctcctctaaggccagcagcgcaggtgcggccctcctcgggttctaacctctcctgcttctggcatctctcagactcagcaggaaaggctctcaagctttaagggcccatggggctgccctgggcctgcaagatgacctaggacaatctccccatgtgaggcactcacaaggtctgggggtcacaacacgggcatcttgggggccattatcctgcctacctcaccgtaattccagggtccttgacatttttcgtaataaaaagtttaaaagtggtaattacagaactataaagctgcatcggatgccccagccccatcaccctccagggccattcccctcacacctgccctcccctgcagcactgagcgaatcccagacactgcagagccttttccagttcacgtctctggaagagcccataaaacagaaacagtataaaccatagtgccattcattatcttacccagaagtttaacggtcatattttaacatcaaatagggactcagtgttctgagttccctgctcgtctcagagtcttcaatccaccccccaccccaccggaacaagccgtttctcaagtgagctctttaaggccaaggcactgtgggctccaggacctccagcaatggccaggctgggcttgctgcagaggagcacgacgggcaccagcagatgtggccccgtgtgacccctcagccttgctgtcctgcctgcaaccaggggctctccacggagctctgatgaagacatcagtgagacccgccgcatctccaggcagcacccctgctttccggcaggacggggctgtcaggcacaccacgacctctctcgacccccacagaggctgagacctctcagtgcccactgctcctgggccggccacaatggccactttctaaagcttgagtctatggttctgtgcactggccacacctcttggtgttacctcattccagacgagggtgggtctgccttgcaggtctaacagtcccacagtggtgacggggaccggcagcaactcctgcaggcctccttccacttggtgtaatccttcacctgctcaaatccaaccagacctacacggctagcggatacgagcctttcatagatggcacttgctgggaaacctgtgagaggccgtccaggctgacccagaaggggaaagctgggggcagacagagggcacagctcggccttgagggtgggcaaggcgaaaactcgctttcctgtgccccacatcatggaaccggctagctacggggaaacaaagctacagaaccacccagatgccaggacaggccggatgtgtgaagaacggggggatgccaaccttgtagtgcccgttgttggcagcgtcgtgcaaaggcgtgtcgtcatctaggcccttggtgttcacctccgcacctgcagccagcagctgcttcgcgacgtcgtagtagccccggttacaggcctcgtgcagcgccgtccagcctggaaacagacactcaggacgtacgttatttaatcctcagaacttccctcctgtctctggaggcagcgccctgaggatgtgctacagtgcggggacaagccaggtggggagctgccctgtagtgagggctgcagtttagggaagcaggtgctggcccagagaacccctaaattctctttactgtggcacctcgttagcacgatccatatctagcttattaaccctacggactgacaacctgcagggctaatctgcggcaatcaccctaaaagggtaggaaatcagtgaacacacagtgtagtaaacagcagcctcatcctcaccgatctggaggcgtatgtgcctttgcaaaacacggaggggaaacctcccgtgtcggaaacggaaaccaaggctgagagcctcctgaaggctgaagagctgctacagcaggagctccaggggcgcccaggctcgggctgcacgacgaaggccaccccgggcaggcagctcctggctggggagcttggagtccaccatcggacggtgtggccgcacgcatccgtggaaacagagctcggccccacggaagcacacggcactgctctagagaagtttcttttagaaaaatgctttaaaaaaaaaaggtgctaaattaggtttgggtcagacagctataaaccagggcagttggagaaatctagaaggattctacacacacgattttgctcatctgttccccttacactgtggacagacagtcctgggatatgtggaccactcatggtttgatgggggtattttatgtaaagaaagggaatattaaactctaatcatggagctcttaagcccctgggccgtatcaggtctggggaggctcgctcagttctctccgggtcccaggcaagccccaggacccagccctgtgaagtgagggagtccagtccagggtgtcgacccagccggcctcccggctcagaggtgccctctgctggagaatgcagccatgtgctagacacaccagggacaggtccctccaggggcctggagtgaggtttatggaacacagcagagtaaaatttaaaattcctcagttctcttacagataggccaggcatgggggctcacagctataatcccagcactttgggaagccaaggcgtgaggactgcttgaggccatgagttcaaaccagcctgggcaacttagtaagaccccgtctctacaaaaaataaaaaaattagccaggcatggtggcgtgcgcctgcacccggaaggctgagttgggaacatcgcttgagcccaggagttcaaagcttcagtgagtcgtgatcacgccactgcactccagcctgagcaacagagcgagaccctatctaaaaataaaaataacaataaaacccagcaaacaagtttactttgaaatactttccaagaaacactgatttcttctcagcaacagggaaccccactggagtgagtgtggctgtgaacaccccgagccctgcagagcagacgcgcaccccacgaggccacagcccatccaacccgatgggaggctcacggctccaatgggggaggctcagggctccagcggggggtaggctcagggctccaatgggggtaggctcagggctccagccgggggaggctcagggctccaatggggggaggctcagggctccagcgggggaggctcagggctccaatggggggaggctcagggctccagcgggggaggctcagggctccaattgggggaggctcagggctccaatggggggaggctcagggctccaatggggtgaggctcagggctccagcgggggaggctcagggctccaatggggggaggctcagggctccaatggggggaggctcagggctccaatggggggaggctcaggactccactgggggaggctcagggctccagtggggctctctggcccttgccaggcacagggtgcccacctgcgaagtccttgacgttgacgtctgccccctcgctgatgagctctttgatgcgccgggcgtccccgcggatggcggctcggtgcaggcgggtctctccacgctcgtttctcttgttcactttatctttggtttttgaggcagagttgggcgttcccttctgacacactgtagactgggaggggtgctttggtgttgtgtccactgcaggccaaggaggggacagatgggcattactgtggggtggtcctgctttgtccaatcttcaagagcccaggccaccatcacgaggtccctttgcacagggcttgtcctcagcacagccatgaggctgcgaccaggcagagccccttccctgcgccagggaccacccacaggccgggctcacctgggctgttggcagactcctcggccgtcatctgcatgagaagggccacctgctggcgctcggagagggggtagccggctcggattccagacagccccatgccaaacagcagcccggccttccgggtgacaggctccttcttaatcctcttccgctcagggccctgcttctctgtgaggcgggcgagggagagagggaggagagatttcatgccatggtgtcctccaaagctaggtccttacctaatgttacggagccccctgcgtccacctgacagctgacagagcagaaaggaaggtctgtgtatggggaaagcacagcggtgctgggagcattggtgccgcccacctcacctctcagcagtgactgtgagaccatttaaacacctcgttaccagcccctcaagtctgctaagcctgggcctccaccgagcatccactcactccaggcacctctcctgggcctccccagacctcgtaccacacatgaatgcggtgggacagcttagcaccggtgacctggctcacacaggacaggtctctgttcaatacacgtgtctgtaattcaattccaccttccccgtccctcctccaaacagtgcagatataaaatggcagacacagtttaaaacacatcagtaaatcaaggccaactggtcagtactgtacctttcttcttgcttctaggaacctccatctcatgccatggtgcttcgaggagcgtaccagccttgcagcaccacaacagggactgggctggaggcatctgaaggcatcaacacagagcactaacaagacacggtgtgagagctcggctgtttccacctcagcctcctcgtaacaagcacaccctgcactcatctgacccgttacagaacactcggctggcgtctaacgcaactcacgtgctgtgtcttttaaaagaggcaggaggcaggggcggggaagagaagaccccaagcaccaagagtcgggggcacagaagatgcctcctcctctgcctgaccagtgccctcctgtggatggaaatcaggggccagacacctctgaatcctcctccagctgccctgcgggttctggggttttctaggtcatggggtgaaactgcagaggtgcagcgcagaggcaaggctctgccaaggcctgactcggggaagaagggccaccaggaagacgtgggcctctgaagctctcctctgaggcacctcccttcccttccattcagcactcccaagaagcctctcttcaggacttctccctcggctggtgtttgatcctacagaggtgggagacatctctaacaacggactaactggatcccacacctgcccggtcactggaacacagaacggtcttaactagtctctcagctcagctcccagggcccgactctcttgctgttcaccaccatggtccccgtgaatgtgcccgtcgatttcctaagaggacgctgcccacccactctagttctttccaaggtatctgaggctgatttcttaggaattcggtctggggcatgctgagaatgtggattcgtatgtcctatgggacaagcctgcaggaaggcacacacctggccacatcgacctgcgtcacactcatgggcaaaaccccaagtactgcaggctgccatcgccaccaccagctagtctgtaaacagtcctcaacgcacagatctgagaaagcacttgagctttggccccagcccctcatagaacctggcaaacacggtggttggggaggcagcctcgccaccggccaatgagccccagcctacagccatcattggcgtagccacaccttagcagtgagcttgggtcacaggcgcttggctgtgggtctctgcgtgcgccccatgctttccctgcaccctccatgctgcccgggggccggccctccccaggcttgcttctcatagccacctctaaacaacagaagcaggcctgcggctgcctccctctaggaaagaggcgacgaagctgctggagaaaccccagctcccccaccgatagccctcaagtcctcctctctccaggaggggcccacactcaccgagcagctggtctgcccacagtcgcctggagaagcagctgagaacctctgcagggccctgatccccaagacctagccacgcacattcagaggcctgctccctccgtcacccagagcaggggggttaatgttttggagacacgaagccccctgagaacacgaggaaagcagaatccccgagatacacagactttgcaaagctgcacacagcacaggagactcctgggagcagacggcatctccttattccattgaccatcagaagtgaaaagcgagtgggccccacttctgtgctgcatgtggccactaggggtggacacagggaggagctggggcagagttggggttgcggagggaggagctggggcagagttggggttgcggagggaggagctggggcagagttgtggctgcggagggaggagctggggcagagttggggctgcagagcgaggaggcggggtggtgttggggctgcggagggaggagctggggcggtattggggctgcggagggaggagctggggcagagttggggctgcggagggaggagctggggcggtgttggggctgcggaggggaggaggcggggtggtattggggctgcagagggaggagctggggcagagttggggctgcggagggaggagctggggcagaggtggggctgcggagggaggagctggggcggtgttgggaggagctggggcggtgttggggctgcagtatgtttacatcccgaagtgcaggcgttgccatgctcttaagttatcaaaggaccctaggaggcgtgtgtcagaggaacaggcagaggcaaaggcgttccttagaagtcagtctttaggctggcaggccaggagcccacgctgcgtccccgctctgaggggcagcaaagagctgctttgtggcaaacagaacatgtcccactcctgcagggcggccatctcaggtgcagctcacacccaacatgtgcagaatgggcaggactcggtgcccccagagacttcctgggtgggctccagggcctgagcctcagggtcagggccacatccctcccgctccccaccaggccctccctctgcttctgctctgagctttggtgaagaaagcctgagttggcttcccttacgcggccaggacagctttacagggctggctcccagcaattcgcatggaaggtgctgccaacctcctggtgaattctggtgcctggagccaccacagggaccttgctctgccccacactcaggaaaagcttgctcccaggaagcagcaacttttcacccagctctccctgtcctgaaacaggactttttacttgtcctgacaccaaaaaagtccaatatgaaaccagatctcccaggatgccaatctctccactgtgaaacaagcacctgcagctacgagcatctacaacgcccacaacacgcgccagacaccacccaagctccggagcccagcaaacttgcacgtctgtcagctctgagacactggccactccagtggcttctggggtagagggaaagccccacccacggagcgagacccccatgtgccacagcccatggctcaacaatgcctgctctccattccaacccagcgacaccatggtctgagagcagctgagcgggtccttgacgtgcacacacacagcccgtacctgtacctgcactgtcaggcaccacacaagtgggtcccgcactgcctgcctgcctgcccctcctaccccaggcctgggatgacctggagccgtgtgcccctgagaaacgctcctctgagaggagaggctgcaaaacctgctccctgccctccacacagtgcagagcgcaggaggcgcggggtgttgtctgcaggtaagaaaagggtgagagcatctggagctacccctaggacagccagcaagttcctgtagcattctgcaaatttcctgtttctaccgtccaaatggaagccaaatacaatttctatgaattccaaatggtattcaccaagttgcaaagtggaaaactggcaagtctagggactaagtgcggctacagcaccacagacagatgtggccctgggtgcctctgaccccggggtgggggtgggagccactccacagcactcagaagcccccttccacccctgccctgcagtcggaacacggcctgcaggctctgagggctttgtgggctcaggcagcctggggctgagggcagaggtccagggagagcggtggagggtgccaggagaggctgtgtcttcccaagtcaagcatgttggcggtggcacctgtgtccgctgacctgagcctgggcggccacccacctcatctttaagaaacaaggcccgtagggcctttcttcaaaccacatccacctcgccagccctctgaggctggcagcacacctcactacccagctggccagtggaagattccacggaaccctctcctcctcagcacagagctgagacccctccatgagccccatgccccttcctggtgctggtgctgctggagcacggccttggcctggggcagcaggggccacagtggacaatgcttttgggagctggagcccacttcctgcccctgcatccagccatggcctttctgaggcagcagagactggaggcgagcgtcccgaggcaaacggcggtggcacctggctctgtgcaggtgggatgggggggatgtgacgcgcctgggggtgccctgtgctggtgggatcggagcgggggctgtgaccttcccgaggggtgctctgtgcaggtgggatcggaggggggatgcgaccttccttggggtgctctgtgcaggtgggatgtgatgtggggggcctgcaaccttcctgggggtgctctgtgcaggtgggattggggggggctgtgaaccgcctgggggtgctctgcagggagtgtcttctctatctggctgcctttttttttttttttttttttgagacaaggtcttgctctgtagccaaggatggagcacagtggcgcaatctcagctcaccgcagcctccacctcccaggctcaagcgaccctcccacttcagcctcaggagtagctgggaccacaggtgggtgtgcctctggctgcttttaacatcctccctttgctgttctgaaaacttcacgtcagagtcatatttaaatgtgtaattactgctctttctcctgcttataattcattatactttttgaatttgaggcttgtgtttttatgaaccttgaaaagccctctgctgccggcctctggagccaccgtctccctgccctgctctctcctctgccgaggtgcctgttaagctgcattctctcctccacagctccccgcttcctgcaggcttcctgtctcactttctttctgtgctccagagtctaggcaatctcttttgttagaacttccaattcaccaatactttcttatgttgtgtctaataagctacatcatctgctcactgggttttttatttcagtgattatagttttcatttccagatattccatatgccttaaaaacatctgcatgatactccatggttttaactcccctgatgaatactgtgcatttaaccatcccagcacgtgaggtccctggggctgacccctgctgaccctctcagaacagctttcttcctcaacgtcttgtaattccaaccaggctcttcgtctgtctacactctgggagccggaaggccgggatgaggaaggtgtgtctctccagggagggtttgcttttgctgtggtgggggccccagggagtgtggggcacttccagcagcataaaacagcacaaatccaaatgccagccccaccagagggcaggaatgggtcagaagtctcattggtgacctctcaaagcccctcatccctcctcagcacctgtccctcttagctggggggacagtgtctaccctgatagcccagtgtccaggaagtgtggccctctcgaggggacaagctttccgtggggtctgggcccaaagccccttcctctacctccctgggaggtctgaagctgggctccaaggcagagaccctgaggttgggccccagggacgtggaggtgtgtggcctcagctgctcatctgaacaaatgccttttgtatcaatcatttagcacctctaatttctaggcttttctagcaagagtcttttaggagacacaggccacgatactgtcaacataggaaaatgtgcaactcctgcgtcccaccgtaaaactcgaagacgtcaaaatacattcttgattctgctccacaaagggatgtttccatggcgatattttcaaacaacagaaagttcacggccgatggcggttacagctcatggaactgatgggcagggccgggtgcagctttgtagcacggctgctgctcacagattctcttccatttgactaaaaaccatgctgtccacaccaaacatctggcctcatccggatgttcaaagccatgaaatacagcacttctggccaagaagtctaaatcacagccgatctacacgaggcggatggtccacaacgccaagttcctacccgggcactgagctcaacgctcgcacaactccaaacgagggcgcaaccatattcccactgacatcctccttggggcagcaagacaagctccgaacagcctgtcctgggccaacaagagaagctggcgggcgcccgctgagcactgtgagccatcttgtggtgagactggcttctccttccaatctccaggtttctctctctttctgccttctttctgtcagttaccgtcattgatcacttaaagaaagacagggcctacccctgtctgctgcgtgacctcagccctcccgcctgccgatgggagctgggtcatctcttacgcctttcagctttggcttcttccgcagtgtatgtgaaggggtcacacagaggtaaggctgtgcgtccagcccttgcctgcacaacctccatgccttccccatctccaggccggggtggggtaggggtagggtggggtggggcggaaggaccagttccacaggaagcctgtggaggcaaacagggttatgtggcaagggtgggaaggagcagggcctgagccccatggtggtttcaccagcatccagcggtcaccatggtgaacaagaagccaggaaggaaggaagcaatgtcggcaaaagggctcagatgacaaccaaacagaacggtttcccaccctgggcctcctttccacacacacagcatcgtgggtattttaaaataaacaagatcaacgtccaaacctgcgctgaggcctgagctgtgtccgtcactcctgcagggcacaggcctgcctggccgaatgcatgggcggtgagagcacagggctggggggacccctctgtcgaggggccacagctcctcacacagcagagctttatggatgaaagggctgagaggcacagacaggctgagaaatgggcccaaagtcccacagcatggagccaggaggtagcagacggcccctgcccgcccccctcacttggctgactgctcccacggcagccaccacctttatcctgagtcccggggtcctccatcaaatcgctgagcctcgggtggtcttgtggaccccagcttgtctgtgttgtgttgacaacatgggcctggctaccggcctaagtgcacttctgaggggtgtcagggaagcctttgctgcggcttggggattacagaattttaaacagcaagaaccttccctttgctagtccaagcttccctttgtatgagaaactgcttacgtctagagaggaaaaatggttgagaaataggaggaccagagaccaatcacgcggagttcttaatcatgtgaaaatattttattttgacgtgctttttcttgagtgcctgaatgtggtggctcttagggtaaccccagaatcctcactgcggcaacaagacctggccaccaccctcacctcgaccaccacggccttcgctgcagccccactctgactccccgggggctgctcacgtgccagcacccactggccaagcatcctccggcaggacccaagtcctctgtattcagaggccgaccctgctttccagagactcacgaggtggcagagagtcaggctgtggcaggggcccctgtgtatcgaggagaggaggaagagtctgcagaggtttctagggaaggagatagtgtggaagtgactgtggctctggtcctgcctgggaggagatctacaggggaggggcctggccttgggctggccctgccctgcgtgggatctgtgccctgcgtgggatccctgccctgtgtggggtgcgtggggtctgtgccctgtgtggggtgcctgccctgtgtggggtgtgtggggtctgtgccctgtgtggggtgcctgccctgtgtgggatgcatggggtctgtgccctgtgtgaggtgcctgccctgtgtggggtgtgtggggtctgtgccctgtgtggggtgcgtggggtctgtgccctgtgtggggtgcttggggtctgtgccctgtgtgagctgcctgccccgtgtggggtgcgtggggtctgtgccctgtgtggggtgcctgccctgtgtgggatgcatggggtctgtgccctgtgtgaggtgcctgccctgtgtggggtgcgtggggtctgtgccctgtgtgggatgcctgccctgtgtggggtgcctgccctgtgtgggatgcgtggggtctgtgccttgtgtggggtgcctgccctgtgtggggtgcgtggggtctgtgccctgtgtggggtacctgccctgtgtgggctgcgtggggtctgtgccctgtgtggggtgcctgccctgtgtggggtgtgtggggtctgtaccctgtgtggggtgcgtggggtctgtgccctgtgtggggtgcctgccctgtgtgtggtgcatggggtctgtgccctgtgtgaggtgcctgccctgtgtggggtgtgtggggtctgtgccctgtgtggggtgcctgccctgtgtgggatgcgtggggtctgtgccctgtgtgaggtgcctgccctgtgtggggtgcgtggggtctgtgccctgtgtggggtgcctgccctgtgtggggtgcgtgcggtctgtgccctgtgtggggtgcctgccctgtgtggggtgcgtggggtctgtgccctgtgtggggtgcctgccctgtgtggggtgtgtggggtctgtgccctgtgtggggtgcctgacctgtgtggggtgcgtggggtctgctacacgcttggtgagaaactgcatcagggcttcccgccgtgtgttgctaacatccccacacacgtgagtgccttgggaccctcgtcaacacactgagctgaggccactggtccacggcacactgcagtgcacatgcccttcctggccagaggctcccaggggcgccatgctctccaggcacctgccccgcctgcgagcacagcctggcccctgctgcactctgctctctctgcccgctcgggtccactgcagctgagcgggtgggagaagcctcttcaacttcacacacttgtcgcctctagcactgggcaaggtctggcattcagagttccaagaagtcccacagataccagtggctaagtctgtcttccctccaggaatggggaagcaggagccgtcagaacagccgtctcctatctgaggcaccaggaacaaacatgacgtcaggaaaagactgaaggtgccaagcacctaacgctgaaggaaccagcatgtgcctggcagcactgcagagagcacaccccaggcaccagagaccagggtgtcattcacaggtcaaagcaaaataagaaaatcataatttttccccttgttccaaagaaacatccacgtgcagagggcaggcagcttcggcccatggcgctcctgacgagggctccctcgtggctgccccaggacaagcaggaccccggcggtcctaggcagggagaagcgagactcagggtcacagacgaaggcgcaggagaaacagcggggcaggaggctccccagaaccccagggaggccaggcaatgatgcacagcaacctcaaaaacattcgctggttgactgattatttatttatctattttattttttatggacagggtctcactctgtcgcccaggctggagggcagtggcgcaatcacggctcactgcagccttgacctcctagcctcaagggatcctcccgccaaagtgctggaagggtgaagggtgtgagccactgtgcctggctacttttagattttttaagttttgggaaaccttacacatataaaaaagtagacaaagtagtatcatttgaagcaaatcccagatatcatataatttaatatgaatgctttcagtgataaggctttttaaactgagaccacccttgaggtggtagaggacagacttcaaaagcagatacaagaggccccgggcagacagggcaggcagagcagggcaggcaagatgggctagaagtcccagggcaagctggtctgagagggctcggtgggcagagctgtcttggggccgggacatggcaggtgccttcccactccttgctgcacccacagcccttacagaggcctggtcctaggacgggctcttgcccagcgctctggaagacacagaggtgatgctgtcacatgctcacgtctgcctggacagcctccaggctgctgtgcagggaccacgcggatgcacagcctcggggactgctttaaactgggctgattcacaacagacagaatcacattgttcttggcaggcggcccccagccctgactaagcaccgcagaggccacatctccatggcactggaccgcgggcagggccgactcaaccctgcatctgggaggcgggaagccatccccacagcaacatggaggtctctgagggagacgtgccagcctctgccacttggacacagccaaggcatccggcacggtggtgaccctgcatccctcccaccatagcaaggggcacccacacccctccagagaggcctgactgctggggaccagagaagagtctcttgtctgtcacgtgtcagttaaccctgcaccaatgtttctcttctcatccctgctggtgtgcgcctctccctccaccccactcatttctgagcaagaacggctcctctgggggaaggaggggacgcggcgtgtgtgagagccacagcgcccagcagcctcccggcccagggtggggctgaacgcactggagttggactcgctactatttatttatttagagacggagtcttgctctgttgccaggctggagtgcaatggcgcaatcttggctcactgcaacctccacctattgggttcacgcaattctcctgcctcagcctcccgagtagctgggattacaggcacccgccgccacacctggctaatttttgtatttttagtagcgacagggtttcttcatgttggtcaggctggtctcgaactcctgaccttgtgatctgcccgcctcggcctcccaaagtactgggattacagccgtgagccaccgcgcctggctgtggacttgctactttaagagggtcctggttaaaatgcaagcttctaggataagcaacgctccacactcatacatcagaacaatcttcctaggaaatctagttttgcaacattaaacaagaagttattaaaattggccccgaaagggtgataaacacaggaggacaaatactacgtttcttaggtctttttgttacaatccttgcctggaaaattctattttcaaaatgttctttactgttttcccacctcacagggattctcacctaccctgtcctcacctaggcctgcccctcacagagtaaggacatggtgttcaacacgcagttccaggagcacccagggctgtggcagaaaatatcccagagacccacagagagcgagaatggcctcagtgggccagcacggctggcaccacgcaggcgctaaccatcaacagacagaccccggaagcttctgacaacacaacagggccctgggtgagagcttctctgcaccatgatgaaacggccaccacaaagagacctgagcagccagatggggtgggcaccaggtagccctgggaacgccaccttaccaagtgggatcattctcccaggaagcagaagcagatgcttgtctcattaaccctttcagcaacacctccagagacatcacagaaacacctcaaaggtctgaggccaactcccgcatggccactgtgcaaagagctaacagctacgtatcaacatgacggccttctacaaccaaaaccagcatggggaccaaagacggcaaacacagggtttcaggcctggactgactttctctaggcctaaagcccgagagtacacagcaccgctgggagctccagggagtcacccaggccctcccttctgggggctgaggtcccttacacaacccatccacacattctgtccactcacttccccgtgtctcccagtgttcttcctcggagctgtccgctgctgggaagaggagtcctcctgggcctgtgctggtgtccctgcagccttcctgtccccagatgtgctggcccagagacaggagccatgtgcctggcactgcacctgcccctcacttcccatctgggaaaaccagccctctctgctggcctttcactcagcagagtctccacctggctactgtgagcacatccctggagcaccccacataggacaggaggggccacaggcctgcggcagccacacaatcataaaggctgaagcttgctgagctgtgctgacaaaagctggggtgtggatcctctttactggctgtgcctgctgccgttcctcttcaacaatctccttcgtatcacgagctcttctcacctggaccacttcccccatctgctctcaagcccgcatcctggcacagcctctacgccttgtgctatggctgcattcaagaagtctcaggaagccagggacagagccgagggcctgactcagcactctcccggttcactccaggctttgtggccagcttagtgctctactgcctccaaccttccccagcagggctgtagagaagctggatgaccaggaggacaaggaggcctctggacacaagaatcaccaaagagcaagcacggccagcgcagaggcctctgggctccctgcaagcagctcaagacagaatccactgggaaggtgtcactgcagaaggcgctgaccccaccaggagcgtgtgcacatgaacacacatgggcttgcacacgggcacacaggcatgcacacatgggcacacaggcacacacgtacacatgggcacacacaggcatgcacacacacacgggcgcatacacaggcatgcacatgcacacacatgcaaacgcacacatgggcatacacacatgagcgcacatatatacaggcacacacaggcacacaaaagcatacacatactcaggcacacatgggcacacatacacgggcatagacgggcacgcatacacaggcacacatacaggcacacacatgggtacacacaagcacatacacgggcacacacatacatgggtacatacaagtacatacacacacgggcacacacacgggcatacatacaggcacacacatgagggcatgcacacagatacacgggcatgtgcacatgggcacacatacacacaggcatacacacttgggcacacactctggcacaggcacacagcacacacattcctgctctgcagcctcagaccccgcctgtgcttgggaagacctccctgcctcctgctcacttttagggctccctttggtttttactacaagcaatggagtttcttcctgtgcctttgtggccctgaggggaaccactgtctccctcccgtgtccagctgtcagaagacccacaggtgagcagccccatacctcgcccagggctggacatgcaccgggtgcatctccacgtgtgtgggacccaagagtgaagctctccaatcggccccatgggcctgagcctcgggtgcaaaggaggtggcatgtgggggcctgtgctccgcccctgctgcctcttgcctggacggcgtgcagggtgctagagtgcgtcccagtgcaaagccggaggtgcgggggccagggacgccctgcctgggctgctccgggctgcctgtggagggctgactgcaggaggggccgcgggctggtacctgtgtccgagtccttctgctccccattggcgcccgcggtgaagggcagcttccgcttgctggctcgctccctcacctccttcccgccatcgccacgctccagttttggggtcttggttagagaaactttatctttatcctagaaaagaaagggatgctttcagtcgtgatgtccaaattacattctcaagctctcaagattttgtttcatatgccaggagaagcgcatctcttatttgggcaatgaacaccctccctgcaccccagggcgtggctgtgtgaggctggtcaccgaccgcagaaccttcacccagaagcccggggtcgggctgtggctcagccctgactctggcccatttctcatcctgcgcaccggagggacgctcaggaaatcgctggtgtgtgtggagaaagcagaggagacacacacgcgctacctctcactccgcagacacgcgctacctcccactccgcagacacgcgccacctcccactccgcagacacgcgccacctcccactccgcagacacgcgccacctacctcccactccgcagacacgcgccacctcccactccgcagacacgcgccacctcccactccgcagacatgcgccacttacctcccactccgcagacacgcaccacctcccactccgcagacacgcaccacccacctcccactccgcagacacgtgccacccacctcccactccgcagacacgcgccacccacctcccactccgcagacacgcgccacccacctcccactccgcagacacgcgccacccacctcccactccgcagacacgcgccacccacctcccactccgcagacacgcgccacccacctcccactccgcagacacgcgccatctacctcccactccgcagacacgcgccacctcccactccgcagacacgccacttacctcccactccgcagacacgcaccacctcccactccgcagacacgcgccacctacctcccactccgcagacacgcgccacctacctcccactccgcagacacgcgccacctcccactccgcagacacgcgccacttacctccccctccgcagacacacgccacctacctccccctccgcagacacgtgccacctcccactccgcagacacgcgccacctacctcccactccgcagacacgcgccacttacctcccactccgcagacacgcgccacctacctcccactctgcagacacgcgccacctcccactccgcagacacgcgccacccacctcccactccgcagacacgcgccacctcccactccgcagacacgcgccacccacctcccactccgcagacacgcgccacttacctcccactccgcagacacgcgccacctcccactccgcagacacgcgccacctcccactccgcagacacgcgccacctacctcccactccgcagacacgcaccacctcccactgtgcagacacgtgccacctcccactccgcagacacgtgccacctcccactccgcagacacgcgccacccacctcccactccgcagacacgcgccacttacctcccactccgcagacacgcgccacctacctcccactccgcagacacgcgccacctcccattccacagacacgcgccacttacctcccactccgcagacacgcgccacctcccactccacagacacgcgccacctacctcccactccgcagacacgtgcgctacctcccaggagggagacggtgcgacacacacagcgcttgggacgtggggagggggacggtgcgacacacacagcgctcgggacgtggggagggggcagtgtgacacacacagcgctcgggacgtggggagggggacagtgcgacacacacagcactcgggacgtggggagggggacggtgcgacacacacactgcctttccccatcagtaagccttctttctgtaactttccctaggtaagctgccggcaaataccgtgcagtggtcagcgaagccttcagagcaccggaggcctcagctgctccagggctgagatgcccaactgttcctgggagaagcccaagcatccccagccacggtcctgcctcctgggaccctgatacatcttccagctcagtcactctgcatccaccaaacgtgcatccacccaacctgcatccaccaaacctgacagttaatctgagacatccctgagtgaccatgaaagagctttccagaacatgctgcaagctcagagtgcaactggagtcaaagagaagctgccaagcagaccggagcccacctctccagtgagacacggggacaggaggagggtgccagacgggtctctggggagacggggcctcaggaacgtaacacccaccccagcagtgcaggtccctcccgggcctccggagggttaacacccaccccagcagtgcaggtcctcccggccctcggcctgggtgcccagatgcagctcccccgccgcctggctgcagctccactgagcttttctatggccccctcggagtgcagtccccacctggaatgagataggcatcttccttggggtcggggaacgccaggaaagaatggcacacaccagcaagaagctccaatcttaaactccttcctccaagaacactcctggcccagggggtgggttccaccagacatctgaagagaggccaccatcaccctaatctcagaacctgatgagggaaagtttctaccaaacatgtgaaggttctaccaaacatgtgaagaggccaccatcaccttcatctcagaacctgatgaggggaaggttctaccaaacatgtgaaggttctacccaacatgtgaagaggccaccatcaccttcatctcagaacctgatgaggggaaggttctaccaaacatgtgaagaggccaccatcaccctcatctcagaacctgatgagggcattctatgaaaagaaaatgataaaccaacataccttatgaacatagacaggatatataaaaaaagacaacacaaatgataggaataagaatagattcgagaatgcaagacatttaaaaagcaatgtaattcaccacattaagaaaataaagaaaagaaaaccacgtgctcatgtcaacagctacagaaaaggcctgggataaaattccacactgtttgtgatgtgggaggaaagccccacactgatcaaggcctccagggagcctggacagaaggaacactgtccccaggtccacggtcaaggcaagactgcctacaggcaccacccaacaggcacttcacaaaagaaaatatccaaataagacaacgaacacctgaaaaggtgattctcatcaggaaaatgcaaatgacagccacgaggagatgcacaccagcacccccaccaggacagttgggagaagacaggccctgcagaccccagcaaacgcccgggaggctttgagggagagctgcaggtgcgtttcccatgacgtgttcacaaacaagcacaaggatgttcaaggcagttttgttcgtaatacaaaaaaaatgacacaactaaactgcccgtccaaaggcaaatgaacaattctagaatacaaatggaataccgcagggggtgcgcgccgtgagaaacgggtgcacaccatgagaacggggacgtgcagcatcaacactgagggtgagcgccatgaaaatggggtgcgcgcagtaaacacaggaggtgcgcgcagcctcgtggaggagccccgtgcatgcagtggcagatgcagcgggcaaccaaggtgggaacatctgtaccccaaagatcagccctcctctggaataagactgggctcaatccctttcttcacacatggaagcttctagaagacagcacaggaggacatgttcaccaccagaagacaagagaacacacaccacaccaccatgtgacgccaccacacgcccaaccacacagacgtcaggcccacacactgagccctggcagggatgtggattccctggtggttcttggggcacactggctcatcgacagaagagcccacaaatgctgggcatggccacagccacgaagggagagaatgccaacaggagcaaaatcctgcaagtcagacactgtggagcaactgatgtctcccacggaaatctcaacagccaaaacctaccagtggagacagaagtcagggcagaggtgacttttcgaatggggaacattactgaaggcccctagcactccggaatgttgtgtattctcatctgggtggtgattatccctggttttacagatgaaatgccagctataatgtctatctatagttcactttaaaagttcacaaatttctttttcgcttcccagctccttacacctcaacgagctgcgcaaggaaaagcacacatgggcaaggcgcctgtgtgacacgaggcttgccccgagctgcctacaacagggagcgtggcacagccaccaggaaggcggctcccatccacctgggctcagagcctgctgggcagctggggtgggacaggccctgtttcggcccctctaacctttcctcaccagcacaagaggactgtcagcaggaaccacgtgcacatgctacagaatgttctcatttcctaaatgcaaatatctccaacattaaatccaatccttaccaggcacctcctgtaaggccccactatgccccaaggaccaccagatagtgacagccatggcacaatgaccctgccgggccccaccagcctgccggccacctggcttctcctccttatgacacgaggtaggctctgcacatgtcatatgcagattccctatcacatcacgacttccactcatgggaagcacacacagaggaaagagaaagttgtagtaactgaaaaatggccacgtccagttgacaccctccccctggagctcaatctttctggtaagaatgagagtcgtgttgtccactgactgcagcacagaggtgccatccggtccttccagttccatcaccagctcagctgccttggtatccaaactgtctatgtgcggggtccgcctgtgtgtggggtgcggggtccgcctgtatgtggcatgcagggtctgcctgtgagctctcttctgttccactcacccatgggtctgtcctgctaccaagaggaagcacactacctcatgcctgtagctttagaggaagcaatgaaactacactgtctgcatcctccaattctgttctttctcaaggtggctttggttattctaggtcttttcaatttccctattaactttggaatcgtcttatgaatttctacccaaaaaagcccacagggattttggctggcattacactgaatctgtacatcaatgtggagagagatggcatccagttttgagggtttcctgatctatgaatattgtataactctgcatttaggtgtttctgaatttctctcagttctcaggaatattttgcagctttcagggtacaggttttgcagcacatcttcggtcaaatttaccccaaaataatccgtattttttatactactgcaaacatttttacaatttcagccctctattatttacgagtatttagaaatacacttctgcataatgggtttgcactggaacaccatgctacgctcactgattcttgtagcttttgtgcagatgtcttgggctttcctccatcaatgtctgtgaataaagacagtgttcctctttcctcttcagtctgactttcgtgctgcctggagtctgcaggacgatgctgactgcagtggagatggccagtgtttctttgtctgttctcaattttaggtggaaagaattcagtctttgacattaaatatgatgtcagttgcaggttttcacagatgctctctgtcaggttgaggaaattcctctctattcctagtttgcagaattttttttaaaataatgaatgtgtgttaacttttgtcaaatgtttttgctgcattagttggtatgatcacatggtgttttcagtcttataacaacttgaactgattgatattggaggttcaaccttgaattcttggaatcaaccctacttggttggtcatggtacattattcattttattttataagctgatgaattcaatttgctaaaattctttttaaaatttgtatgtttgtgttcatgagggccattggtctgtagttttcttatcctgtagtacctttgtctggctttggtatcagtatagtactaacacaacaactgtctatctagatagaaaacaagaacctctatgtttacctcacaccacatacaaaacatgaacctctacgcttacctcacaccatatacaaaacatgaacctctatgcttacctcacaccacatacaaaacatgaaaatctatgcttacctcacaccacatacaaaaattaactagaaatggatcatagacctacatctaagaactaaaactatcaaacttacagaacacaggaaaaacttctgtgaccttcgtttgccaaagataggattttaaaagagagcacgagttctagaagaaaatattaaatagaatggacctctatcttgggagttgggcaagagtgaagacatggaggctgctcagagcaccctatacaacactgtctaaggacccagagccaaggggattttcttggctttttctttcttaaagtgggaagtttttgctttattctaataatgaaaatcaggaacacagggaaggacttccacttcttttttcttccccgacacagattctcactctgtcacccaggctggagtgcggtgatgcgatctcagctcactgcagcccatgcctcccgggttcaagcaattctcctgcctcagactcctgagtagctgggattacaggcatgcaacaccatgcccagataatttttgtatttttagtagagatggggttttgccatgttggccaggctggtctcgaactcccgacctcgggtgatcctcatgcctcggcctcccaaagtgctgggatgacaggtgtgagccaccgcacctggccaggaacttccacttcttaaacgtgatgtgagaacctgaggagctcggcgttcacagcatcaggtaagcctcagtgcagacggcatgtggcagagctgagaatgcacagaatgcaaattcgctgcttcagagctaaacctccagtgggaggagatgaggacagtgtgttctacagagaggaatcacgcaggggaggggcggggcagggcggaggcagcatgcaggcatgtgaactgggtggtgggggaagcccaactgtcaggtaagcagaaatggtaggagctggcgggccacaggccgtgtgctctgagccctaagactgggaagagaagcggatccaagtccagcaagcccagcaagtctggcttcctctgtgatgctgctctatgtccttttctgccttagtgaaaagatggacagaaatcaccctctccacgagcccatgtgggcccacagcggtctcaggggtgtgtgagcccagcttcgccctcctgtgctctcgccatcagacacggcctcctgctcctcccgaagcatgcgggggagttctgggctctgttctgagtacagaccccatgccagactggctcgtgaaaccacagcctgaggtgggacacgccgaggcccagccatgcgcctcccagcttctcagctaaggtcactctggaatacttatcttgagggacgtagctcccagctccccacctgcagcactgacaaagctatcttcggggaggggcctcagaccagatgtgagtctgtaactggcacagactgggggggtttctgctgagactcgctggagggctcacatgctcagttctcaactgcagcctccatgcccatggacgccatctccagcctctcggcctccacacagctcgccaggtctcagtggggctgtgaatgtgggttcctaacaagctccagcagctcaggtgactgctcgtcggaggacacactttgagaaccaccaagtgaagctcagggggctgtgaggctgcctgtgctctgagtggcgtgcatggagcacaatgagacagggtgactgtgccatggggtggggacgacaggggacccatggggtggggacgacactgttctctgtagccctgcacacctttggatcagaacacactcaacgatgcagacacctgctggttcttcccgaggcagctcagcggttctgggattccgtggtcggcaatggtgagagaccgtctgcagaaggggccctttctctgacacgcctgccactgtgctcactggtgcagccaaagggacacgcacaagccgtcaggtcagcgcggcatcaggatgcactgcagagttgtgggctccatttccatcttccacgtatatgtcactgagatcacgattcttttggaaaaatctaaaaatatattgtttttgataacataaagctatatctggagaaaagggagtttatggtagaagactgagcagaaaccatttcagcctgtaccaggagaaggcaggtcagatgtgtgcacctgagttctggcacttggggctcacttcctccctaaggaatacagcctcttctaacagcagctgcaaccaggagtgcgtcttcccaggcattctatttcaagctactgttcaagctaagaaagctccaccaggcctgagagctccctactccctgtaatgcgtttaaaatttgtctgcctccatgaggaaaatgcctggctttactgtgagtagttggaaaaacaaacaaacaaacaaaacaggacaggctgggtgtggtagttcacgcctgtgatgcggaagctgaaggatcacttgagctcagaagcttgagaccagccttggcaacatggtaagatctcgtctctacaaaagatacaaaaatgagccgggtgtagcggtctgctcctgtggtcccagctgcaagggaggctgaagtaggaggactgcttgagcctggggcagtggggcagggtggggggttatggagggtgcagaagttgcagtgagctgagactctaccactgcactccaccctgggtgacagagtcagaccctgtctcaaaacaaacaaacaaacaacaacaacaaaaaaccacacatacaactgaacccataacacagctaccttactggaaaagcccagagtgaaatccacacatccctcacagcacacgtgtgaacagagctcgcatcgacattatcaggccagttcatcaagtctctcttctccttaaacaagagaacaactcaaagcagctgagcgcacacatcagcgctggggctgccggcaaatcaggacaccctgcctcctgcgccaacacgacctgctctctgtggctcttccggcctttctcgtctcgtgctaccctgccgagactgccttccctgcaagtccactgacacagggctccaccacgcccagcctgctggtgtgtcaagcggctcagagaaccacctcctcaataagcatatctgagacctgagccaggagagctccctctttcctccactgcttactgatcttcatcagaccaggcacagagaacaggagtgacaggtgccacctcgccatcaatgccagggccaggatctcctttccccacattccttctgcatcctacccaggccaccactaccacccttaccctaaaacctgcgggcacagaggctgggatcctctgtgaagcgcaggccaggttcactcagcagtctgttcacacagctgctccagaactccagcatcagaccctcaagggcacaacccaaatctctttgttcctagagcacaccccaggtgcagaagccaagcagccctttcacagacgttctgaggtcctgggacccccacccacatcacccgtgtgaacatgacaggtttttgatccaaacacacagctcacgcctccacactctcggggtgaaaccacaccatacacgacctctttgggagccaatgctcagtggaggcatggagcatgctgaagccgaagcttggtggcagtggcaggagctcaagaggatgggggcgaggcctgagctgtatgcaaagtattctgcacccttgcagagctggctgctccccgtgaatgctgagtcccaggacccaaccccacgagatgaggaagatgaggccagggcggcgacgtgaagctatcccaacactctgactgcttagccacagaagagcagggaccaccgggaagcgtgacctgcccttgcgcctttctgcctcactgctgaaggccgcacatcagcaccctgaccacccacctcctcaggagctcagcaggacacgcccatcacgaccaccaaaccctgactctccgtaggcttcacacacacgtgtgtccccgcctgtgagctcggcggtgtggtgctgaccaagcactggcttcagctcatccttcgctggtggctgcaagccatggaacccacccagccctgcacacggcacgaggagcttgggacagagcaagtgggagcagacacttggatgctgcccagacatcaagggtctcagagctgctgtcgtttagcacctgcacgtgtccgtattcacaaaatgcttcacgattcaccaaaaagaagtggactgagtcgccatcatgttgctgctgaggggaaggccgtcttgctggttatgttcgcgtgtggaacccctgctgagctcacaccacaccaaacccacaacatgagcagagaggctgcagcacagcagcacaggaagcagcaagaggcctcacaggtagtgacctggggaccagaaggcggcccagagcaaccggcaaccaggaacacactgaggggaccctgcccaccagggaccaccgagggtcagacaggtcacagatgaacggcctgccacactggccaagaagttaggaggagcaaggaggcacgaggatcaaaggacgacagcgacaggatggcaggagctgacacacatcctgcacagcaaggccctgcctcaccattcactccaccagacacgatactgtgcctgctgcagagacaggaagctgactcaggagacacctgacttgttgacggtcacaaagataacacatggcaaagcctgaacttgaacctggatctgtccaagttcacattcgctgggcacaccccagaactcggcgtctcccctcacagtgcaggacaggaagtctgtacttcctaacaccccagaacccagcagcacccgccaatactgcaggacaggaagtctgcaccccaggaaactgcatcaccccccacactgcaaggcaggaagtctgcacaccaggaatcagcgttaaccgcacattaataaaatgcagtggttttgattggcatcccattttcctattcacatttagaataaaccacagttggaagtaacgtggcccagcattgcttgcagtcaggatatctgaatgcctgacaggcctaacaggagccaggacagaaatcctggacttctgggggtagaaacgtgcagccacattgaggctcaggccaacttctgtacataaagctattatttaacgcttgacttcggtccccaaataacaaatacaaaaaaagcaaggccactttgggaaagatcactcctcaccaccctctccactcctggctgcagacagaggcacgaggaaagggccggagggcggagaacaggccacaggcgggcagcaccccattcccacctcatccccatctgggtgcggtgagcatgcagggctgggagggggcagcattacctttttcccagtctgcttctccaccatgtcgctgctgaggggaagctcttcctgctgtggtgctttagggcacccacccttgggcatcgtcctgctcctcacccgatcttcatttacacggccggcgcttcatcatcaaccgtctgcttcaaaagagaagacacacaattcactgaattcagaggcagctcaaaactcatccactctcacaccgcactcaacagactcagtaactagtcaaggcaggcagctgctctgatcagggctggggcccgggccaggcccaggaagggacttctcaggatacgcctcccataaaggggtcaccagcaacaggaatggcagctttgagcaggaaggagaacagagaagggtcaagcactttgtagtggcagaaagggacgcatggcctagggtgtggctgtgttctgggtggcagtcagcagcacctggatcctgggtcccacctggtacaggctacacccaaaacggtcaggcaccacaaggcagtcccttccccgcattacaggcaaggtcacaacacgcagcgcagtaccccagccctcaggtctggcaggtcatgtccacagccccagcctcacgccccactcaccacctgggaaggagctcctgtccccaccaggcctgtgctttttgcacacccagttccctaacttggtaggcaaggggtgtctctgagcgagtcccagcagctccgaggtcccaactccacgcccatggaagcagacgccccctcgggcctcaggctccagctcctgggtttcccaggaaatccgaggacacatactgtattaattgtatattatttttatttattaatcatgttttattttaggaaattttgccatcttaacaagtttctggccagggagagactgcccctctctcagggctggcaaattcctagatagccaagggctcccatgcaacccaatcaccttcttacccaagttcacgcccaggccaagccctgcctgaaaccagcgcagagccaggtaaaggaaactagaaagtgtccctacagcacaaagcctgcaagaactttccgaagcagccactcccgaactatttgctctgccccgtccctctctttctgcaggaaacccaacaggcagttgggggaggccttccccgagcccctgcttccgactcccacccccgtggtgtgaggctgcccctctgcgacacacggtgcgagcgcacttcttccttcccagcctcgtcctggtctcttctgtggcgatgccaacttccccacgccacgcctggcatggacactctcggagcatgggcctcctccctgcctgtgggccttctaggtttgttcaccatcacagccaggcctcccgggtgcactcacgagaggaatgggggacacacctacacacccacacccaaagccactgtccccccatcatgtcctcgccgcaccgtcagttagaaaacatttcatacaaatggaactgtgtgcacgtctctgccctttccgccacagcagcacctctgtgcgcgaccatgccgggagaagcagcttctgcaactcgctcccctgcatttacccatctcgctcatgcacgaagtatggcttttgaaacacgatgtgcagacccatctgtgagtggcagctccactgtgagcctctcccacctccaccccgtcagctaaaggatacgttgcatgccacctgcccctggacgcaggcttggctgagaccacaagatgcttctcctccaacaccatctcatgacctgctttgtctttctaaaataaatgataaaatcccaccaactgctgtcttggtatttaactggtacaagaacacaggtgaagttattctggagagagggacaggtcgggtcaacgtattcactgcctgacacctccacccgcggtgcaggtgagcaggtgtttccatccaccatccctgatgcctgaggccagacatattttctctctctacctgaaccaatgaattttacattctcttccaattttccaccacaaaaccggaatgtctcagcctggagaaagggcatctcagcacctgactcggaaggctgttcaagctcatggctgtctagaaactcagtggtaatgtttacaagtttaaggattatctggaattaacattttaaaaaatccagactgtctgctctcaggacggaaaaacggggccttcaccatgtagagtccaccgtcctgatcccagatgtgagtctgtggcccacggacacactcaacagctctggcgtggtcagggcgcagaccccacggcctccggacggtgtctgggccccgacagtgcggggcttatcacttcactcctgagacacctgattctcttcatgtccctagcttggtgctttgcccaggcaccttccccaatggaccagggatctgggagtccactcaggaggtggaggaagtgggtcgcacccaccaggcaaaatacttttcacggcctgcatcacagcgaacactccggggactcgggagtgttgtcccaggtgtacgctgtgttttctggagacgtttctccagccacctgcacgatgacagctaagaccatccaggccgtggcccttccaggaccctcgtgtccgcctggccttggctacaacatgttaccgatggcagcgatgtgctcgaggccctgcaaccccagcccccgcctctccatgaaccaccaccctcatcacagtcatggagatggtgacagctgagatgtcctgctgaagcatctgctggatgtggatgaagctggtttggatgtagctgccatctagcccaggctacacctcccaggacccgcctgcaggcaccaggcgtgcagcacgcggcccactctagagtctttttcaatgagagaccagatgaggacagaggctccagttgcttttgttctgttccaagacttgccatcccagtcctcccagaagctgccctggtgatgcctctggcacctttggcccccacactgccctgtgttccctccaccaggctcagggctggtcagcctcaccccttgccgtgaaatggcagagccagccgagggccgaggaaccgttactcagccgtgtcagtgacttctaccaggggctgcacggcactcaggagtcaggccaacaggctctgctgactcatgggtgttgtctgagggtgggggctgtgatgatgtccccaggcctccctggcagggctgtcacataaaacagtccttgaagctgggagtcccctctttagacagttccgcagcccctgtgccttctcatcacgatgctgcacagccgaccacacaacagaaggcaccgggtctcactcccgggggagactcttccctggaaggtgacttggctgtccctgcctagactcattttaagtgcagcctaaatctccctcatttccaagttatcaggcaaagtctattttaaactcacgacccttgaatcagcaggaaactgaaacacgcctcaggccactggggctgactcacgccctgtgctgagcggcaaggcacagccgcgggaaggtaaacgcagagccgaggggccggccagcacctggccctgaccgcccccaggccacgcattccttgttacttcacctcctggcggatggcaaccgtcccagcttcgtggactgtcagggtcaccgagagtccagggtggtgggagtcccccacacgagccactggcacactccctgaagcagaagccacggcgccaaagctgtgggctcagggaacttgcccattacctggcagccccgcatctgtgccaaaataagacacaactcagcccagcggagtggacagtgtctgcggccagctctgggatccagggccagctgatgctgggaacagccgtccttgccctgtgcctctccacactgcgagagcccctgcagcccagaggggctccacctcccctgcaatggggctcaaaagacaatccttctacggggctggcaggacagacgtgacaggaacaacgatggcctgctcctcccggaaggtggcttcaagagcactcaggaggtgacagatgctgtcaagaccggcccagggaaggcacagggcaggtttcccagcacccaccacgcgccagcgagcacagagccttcgcctgaaccatccaggcaccgcgccctccccctccgcacacacaggagcccagctgcgattccctctgctccacaggagatgcagcgagcaccaaagagccttcctccaggattaagcctgatgcagaagtggttacactgactacggcaaggtcagtttggcaaaacccccaggaatttcagcctatctggtctcttcagctgacaagagcaggcactggtggggaatccggcgctgcctctccccggcttctaggatctgagctgggccaggacaaccctgagacacctgtcgggcggggcaggactggggctgcagggcgggactgtggggaggggactgtggggcggggcctgcagggcagggtgtggggcgggagctgcggggcggggactgtggggccgggtggggagccgcagctgcggggcaggggctgcccaggagcactccttgccagaggccttggcatcaccagggagtccgtggaccatggagactcacgggtcccctcgggccttctgaacccaaacctgcattttaagcatgttctgttctgcacactaacacctgagaaggaccgtataagaaaaaacttgtaatgacacaactaatcttaaaactcacagaaaaaaaaaaagacttctttggggttgaaattcaccttcaataaagggatggaatgtaagcagagctgaccatgaacaacctgggtctgggtttgcactgcgtgggttcacttacacgcagattttcttccacctctgcctctcctgagacagcaagacccatctctcctcttcctcttcagcctcctcaacgtgaaaacccggaggacgaaagccattcgtggagacccgctgctgctgcgcgaggcttaagtctattttctcctcatgatctcagtattttcacgtctctagtttgctctaccctaacagtaagagcagaacacacataacatacaaaatgtgtgtgactggctttatgtggtcaggaaggctctggtcaacagaaggctgttagttaagtttggggaaagttaaaagttctacacaaattttcaactgcacaggaggctggcgcccccaacccctgtattgttcaagggtttgctgtaatttgtattaaaacaccaagcccccttacacctgggtgagtctctctccctgaacagatgtgacaacattaccctccgaagactcccagagagaaagagaacacttcaaattcagatttgtcttccacagtatgttgatagaacaggcctttacgtacgtcctgggcaaatgctcctctccttatgtaagttaataactccaccaaccactagtttgtgtaatgaccatttaaatatcgaatggtgcccaaggcccctgagaagggatgtgattcagcccctcccctcacgcaggcacgtggcctcagaggcccaggaggaggaagacaggaagtcagcagcagggtggaaaaggggagggaagcccttcaagggaagctctcccagaaccttcaatcccagctccaattccaaagacaggaacacactcatgactgacaggatcaaacaccaaaggcctgtttgccttgagggggacactggggagggtggggaagggggagtgaggaggagctggaagcagcagtcctgtgtggcaccaggggcttgctcccacgtcggccctgggcacagccccgcatggtgatgaggtgtggcctgcctgcagcacacggccatgctccagataccttagctttatctgaagagttcttttgtttgtttgtttgtttgtttgagacagctgtgttgcccaggctggagtgcagcggtgtgatcacagctcactgtagcctccgcctcctgggctcaagctatccgctcacttgagcctcccaagtagctgggagtacaggcccgtggcaccatgcccggctaatttctgtactttctgtggagtcgggtttcgccatgcttccgaggctggtgtctgaaggatgctttacggcaacccctgccttttccagctgagccctgccggctgttgtgcgctccgtggaaagggagaagcacggtctccagcggctgcgtcaggagtggtgccttgtgcacacctcacagggagagaagtctccaacggactgagcggaggaaaaaagaaaaaaggagaaaaggaaaaagagctgcatacctggcaggcctactgtgtgcaaagcccttgagtgacacaccctatgacccacagcactgtggcaatcccaggtatggaagagaagcaccactggcctctcacctctcaccatctcagtgggcaaggggagagcaagcagcccagggcaggggggctgagccgagggcaggggggctgagccgagggcaggggggcagagccgagggcaggggggcagagcccagggcaggggggcagagcccagggcaggggggctgagccgagggcaggggggctgagccgagggcagggggtctgagctaagggcacgggggctaagcccagggcaggggggctgagcccggggcaggggaagagccgagggacagaggccctcacaggaaccaggccctcccgcacaccgcctgacagtccacgtcagcgtctctgtccagcctccacacacccctgcacgttctgaagagccctccccaagagtccaactctctctccttcctcctcagggccgcaccagctctctctccttcccctcctcagggccacaccaactgtggggttccagctatcactctgtgcaaaggactcctaacatgggtgtcctccgtctcaccccataagccacactggccaaggccaggcaggcaccacacatcgcgaggtagaatctctttgctacggtttgaatgtttgtgtcggcccctcccctgcaccccaaaattcacaggttcaaaccaaacccccagtgtgcccagctactttttgtatttttggtagagacagggtttcaccatgttggccagggtggtctccatctcttgacctcatgatctgccggcctcggcctcccaaagtgccccacggcacaacgctctctactgcagccctgtttccactcacattttctgttatcacggcggggggtggcagcaccgagagcgcgttcagcattactggcctctgctttgcccctcagacacatgcttggtcactgggctgtggaacatacaggagccccgtgctccggaacacggaccacccgacaggagcacggacacagcagtcggggcgacgtgggtgcctcacagaagagggaaaaagccaggagggcggcacgtgggcgcaaagttctcagcttcgttagtcatcaagaaaatgcaaactaaaaccaaggtaagtgtgagggttactactgagtttcaacttgactggactaaaggatgtgtaactgttcctgggagcatcttgaggaagctgccaaaggagattcacattgagtcagtggacggggagaggccgacgaaccctccatctgggggggcatgatctcatcagctgccagcacggcagatctgcggaagcactggactggctgagtcttccagcctccatctttcttccatgctggatacttcctgccctcgaacatcagactccaagtgcttcagcttttgggttcttggacctacaccagtggtttgccaggggttcttgggccttcggccacagactgaaagctgcgctgttggcttcccgacttttgaggtttggggactcggactggcttcctggctcctcagcttgccaacagcctattgtgggacttcacctcatgactgtgtgagtcaatactcccaataaactcccctccatatatacatttatcctattagtgctgtccctctagagaaccctgactcgtacacacaagtactggtgaaggggtggagcaaaggaaactagtccactctcatcagggccaactcacgcacctggcaatctctactcatactgaacacaagtatgccctatagcccagcaatgccattctggacatacacgtccaaaagaaaagcaggtgcacagacacaagagacacgcgtgaagtgcttcatagcagtggggtttgcggcgtgccactaggatgtgagggtggaacactacacagcagaggaggcaaacacatcacaacgtaagtcaatctcacaaataatgttgaggaaccctgtctctacgaaaagtttaaaaattagccgggcactgtggtgcatgctggcggtctcagctaccagggaggctaaggcaggaggatcacttgagcccaggaggtcgaggctgcggtaagccaagatcatgccactgtactccagcccgggcgtcagagccagaccctctcccctctcccctctcctctctctctctctctctctcacacacacacacacacacacacacagagtaataatgttggggacaaaatacatgatacatttacataaatttctgaaaatagcaactacagtacttagggatgcatacttagttgacaagacatccgcgaagcgtggaaaatggctgcctggcggatggaattggaagggacggtgaaacgggttctaagtgaaggctgcggaggcgtttgctttgtggtctgctaagttgtacatttttactgggtggacgtttgggttctcagctgaagcagtctttcagaaggtgacagagataaaggccacactatgtccttgcaaggcctcagaggtgtcactgaccttttgctgcaggacctgttcttctcaggggtcttggcctcctagaggaaggagggccccatcgccctgctaggccctactgggaccctcaagggcatgagcatgacgacggagcagcttcaggcttcccagcatgtcgggcaggcctagccatgcccaatacacactgcagggcacccactgcagagtgcaacagggagcttggagcctgacaaggagacacacagctctgtgaagacgaaggggaggaggagcaaggaaaatgcttcttttacacagaaggcgccaagatacaaactaaatgtgatgaagacaaagaaaagcaggcgtgtgtgttaaaggtacaattgcacagctaaaaataatcatggccgtaaggcagggacggcagatggagggtgactcagcagatttcctccaaggcttgcgagggtggaaataaacacacggaagtgaccagcagagagaaacacgcagggaagaggaaggttagaaaggtctggggtgtcacgcaccgttgctgggaatgcagaggaggacggtctgcagaaggggacgcagccaccgccccccccaccccgctgcagaaggtgcacaccactcagcaaccacccacccactgctcaatctacccccaaattacacaaatagggccaggcacggtggctcacccctgtggtcccagctactcaggaggccaaggcaggggggtcatttgggcccaagagtttgagacccgggcaatgtagggaaacctcatctttacaaaaatatcaaaaaattaatcagtcgaggtggcacgcacctgtaatcccagctccttgggagcctgaggcaggaagaccccttgggcccaggaggtcgaggctgcagtgagctaagattgcaccactgcactccaaccttggtgacagagcaagaccctgtgtgaaaaaaacccaaaccccaaaccaaaaaaacacaaccggggcatgaaaaagtgcttggcccagagcagtgccccaaagcatctcctaagaaaggggcttaacacaaagcctgcccgccaggggctgctggtggcatccgggcacatctgcacgtggggctgacaggactaaggaggttccacagacacacgaccaggcggagacgcagagaaaagcaggtacagcaagaagtccactgggcaatgcagaggtggggaatgcagagggggaatgcagaggtggggaatgcagaggtggggaatgcagaggtgggaaatgcagaggtggggaatgcagaggttggaaatgcagaggtggggaatgcagaggttggaaatgcagagggcacctacacttctgatgacagcgaaatatgtaaggctggctcaaccatcaatcagtcaacgtcacccagcatgccaacaagctaaagaagaaacaccacataatcacaactggtacagaaaatcatttgataaaattcaaaactcacgataaaaattcctaggaaaacaggagtgtggagaaacatcctcaacacgataaaggccaactaccaagaactcaaggctgacatgatcaagagtgacgtgctgagggctgcagatggaatggcatacagggcagaaaggaagaaatggaataaaactgtctctctctgaagatggtgtaagtgtccatgtcgaaaatcacaaggaatctatcaaaaattccaagaaactttatttaatagagttcagcaaggacacagaatccaagatcaacacacaaacacctatcctatttctgcaataatcctatgaaaacaagaaataaagacagtaccatcctatttctgcatgctaccaataatcctatgaaaacaagaaatacacagtaccattctatttctacatgctagcaataatcaaataaaaacatgaaataaagacagtaccatttataggtgctccaaataaaaataaatgcttaggttcatatggaacaaaactagaaaaacctatacacattttaggaaaaaacaggagaaaatctttaggacctagggccaagagttgtcagacatggcaacaaaagcacaatccataaaagaaaaaactgataaacgacctcgacaaaattaaaaacttttgctctttgaaagacctagtttaaagagtgaaaagacaaactgcagacagggaaaaatatctgcaaatcacaagtcagatagcaggcttgtatgtagaagaaagaagtatcaaacaacaaacattaattagaaaataagagaaaacacacagacattcagaagaggtgcacgtggtgaacaagccatgaaggcactcgacatcctaagccgttagggaaacacaacttaaagccgcaatgagatattactgcacaccaatcggaacagctaaaatacaaaatactcaaggatgctggagaggatgtagaaaagctggaactctctcgcttgctgtgggaacgcaaagtggtgttgctgctctggagaacagcaaggcagccttacgaacctaagtgtgcgcttgctgccccactcaacaactgcaccccaggacatttatctgagaaaatggaacctcatgtgaacacaaagacctgtttgcgaatgttcacagaactttcactgataatagacaatggggaaaacccttcaacaggtgtcccagcggtgtcctcgaaactgggtttcattcacatcacggcatcccctcagcagtaaaagggatggctatggatacacccaagcgtatgggtgaatctgcagaggcccctgctgagtgagtggacacacccaggcgtacgggtgaatctgcagaggcccctgctgagtgagtggacacacccaggagcacgggcgaaatcagcggaggcccctgctgagtgagtggacacacccaggagcacgggcgaaatcagtggaggcccctgctgagtgagtggacatacccaggagcacgggcgaaatcagcggaggcccctgctgagtgagtggacacacccaggcgcacgggcgaatcagcggaggcccctgctgagtgagtggacatacccaggagcacgggcgaaatcagtggaggcccctgctgagtgagtggacatacccaggagcacgggcgaaatcagtggaggcccctgctgagtgagtggacatacccaggagcacgggcgaaatcagtggaggcccctgctgagtgagtggacatacccaggcgcacgggcgaatctgcagaggcccctggtgagtgagtggacgcacccaggagcacgggcgaatcagcggaggcccctgctgagtgagtgcacaaagcccacctcttaggtcactccctgtggactctactcccacggcttcctccaggacaaaaccaccaacctcggggaaacaggcggggactccgtgaggagggctcatgtctgtcggtggctgtcgaggaggctctaggaccaggtatccaggataagacgggggatctgaatcaagtctgcagggcggtcaccctgtcttccaatgtcatgttcccggccactgggcgaaggtggggaagggcacaagggatgctgctatttttgcaacttcctgtgagtctataatgatttcacagaaaaaaggaaaaaaaagggagaaaaaacacaaggggtgtaaggagactcccatgggtgatgaatagtctatacttttaggtgatggtgtttccccaacggtatacgtttcccaaaacccactgagctgtaaatttaaaatgagtgaattttatgtcaattgtaattcaataaagctgttaaaaaattaactagaaacagaaaaaaattttaattcccatagaaagaaggaataaagtaaaaaaacagtatgaggtaggaggtaagcttcctttcataaaccttgttttgtgtatttggctttggaatcatgcattttacatcatttaaaacattaaatataaaatgagactgggtgcagtgaatcccagcagtctgggaggcccaggcaggcagatcacttgaggtcaggagttcgaaaccagcctggccaacatggtgaaactctctactgaaaatacaaaaaattagccgggcatggtggtgcgtgcctgtaatcccagctacttgggaggctgaggcactgggaggcagaggctgccgtgagcagagatcacaccactgcactccagcctgggcgacagacaagagtgagaccttgtctcaaaaataaaataaaataaaataaaataaaataaaatgtaaaaacataaaattttgtttatgtattcacattaaatataaacattttaataatgtttaaaatgatttaaatatacttgaatgacattaaacatttaaaggatttaaagcattcaatataaaaatacaaaaagcaatctctacaacttcaaaaaggaagaggaagcaatacacttagctgtgtgtccggtcaggggcaggacacaaagcatttgtcaacaatgaccatgcagccaccaccacaccaggagcattcctgacagcacgcagcttctgggtgggtgggaaggctcgggagacctggctcaggatgtgagtcaggtgctaggggagccagtggagagggaggggctgcttcccaggtggccgctcgcacaccgggagggctgctgctggctctggcagaaggcccaaattccttggtgcacagacacggctgcggatgtgtggacatgtccgtggggctacgtgagggtccccgtgacgtggcagcgggtttccacagtgcagtcattgatggggtggtgtgggggggagccacggcacctctgtgacctagtatcggaagcaaggggctgcgtgagggtcctcgtgacacggcagtaggtttccccagtacagtgactggggggggggggggggggcgggggcggaggaagctgcagcatctcttgtatcggaagtcccacggcttcacttccacctcatcctgttcctcctcggcgagttccaacctctagcccacactctgcagagaacggtgctccacttctgaagggaggcagatcaaagattctgtggacactctttaaacttcccccagtggcttttgattaaaacctggtaatttgactgtacagttctagttagtgccatatgccctgaggacaaaaattaaaattttgaaaaatattataagcaaaacaccttcctttttcttgagacggagtctcactttgtcgcccaggctggagtgcaatggtgccatctcggctcactgcaacctctgcctcccaggttcaagcaattctcctgcctcagcctcctgagtagctgggactacaggtgcctgccaccatgcccggctaatttttctattttgaggagagatggggtttcgccatgttggccaggctggtctcgaactcctgacctcaggtgatctgcctgctttggattcccaaagtgctaggattacaggcatgagccactgcgcccggcctgatgaaatacattcttaatattaacttcatgtgtttctttttactctataatgaggctaatagaaaatttaaaattagatgcacagttcacatcatatatctcatggacagaacaactctatgggacagaagaccccgatctctgacaaacaggcaaaaatcccagagaaaagaacaaagggagaatttacagattaaagacttaaaagacatcaaagaatcttagtgtgtagaccctgtttggaaaccagttcaaacaaagaactgctgaagaaaatggcacatttaggaaagagccttttgataccgctgggtgtgtggtgacactgagaaagttcaaggcacccagcgattcaggagatagagatttatagatatgtatttaggtacagggtctcctctgtcgcccaggctgcagtgtaattaaataatcacagctccctacagcctcgaactcctgggttcaagggatcctcctgcctcagcctcccaaaatattggggctacaggcatgaaccaccacacctagcctgtgtgctatttttattttcatttagtctaagatacggtgatggttttgaatgttttcggcggatgcaatggtgtggactcgggtttggttccgggttaacgggctggggtggctcctgcacgtgggccccacatgctgggaaccgtcatcaccactgtgttcaccacactctctcttaagaagggcacacaaaacattcaaaaaaaatttaaaaactcagtagcatgcagtggctgatgcctctaatcccagaactttgggaggctgaggtggaagggatcattcgatcccaggagtttgagaccagactgggcaacatggcaagattccatctccatattaaaaaaaaaagataataatcttaaaagacacaattccagaagctgcagaatgtgtcacagaaatgacttccttacgtattaaagaatcctcacaataaaggatcattttacaagcagactataaacactgaaacagacaaaaaactaaaaacccaactcatgagaaacacctggtgaacgctcttcagctccgtgaagtcctgggatggcccaagcacctctggtgggctgtaccttttcagaaagaaacactgagccccccaagtccccgaggacagagatgccttacagctccacacgtccctccacaacggcagcacctgtacccgcagctctggggagaaatgacacctgcaggccaagacaaatgcaagaaaacagcctcgtctgctcactgattctcaccaacttcctctataaaatgaggacaagaacccattctcctaaaggattttgtggggattaaatgaaaaagcactatctaaatccaagttatcatcactgtaatggctttagaaaaaagcaaacgacaaacacaacgagagaggcgctgagaccaggcagggctctcctccggcagggcctggtctgcactgccctctctgaggaaagtgccccgctgccctgacctccctagtttcacacctccacacctccaaggaggttatcctggtacaactgagaaagcaagcaattcccttagaaacgtccatttctttcctttatgctcaaatgttttattactccttagggctgctttgttttttaacgcaagggtccacagttgagaacgtagttacaaactcaagaaacgagctgcaacagaacagcggggctgctccacgcttctcagccattttcccatcctgtgcacccggggaatttcacacgtggtcccccagagtgacagggaacccccagggaagaagggcccctgtggggcatgcagaaaaacgcctgccccctggtgtgaggtcacagactcagtggccaagctcaacaatgctctgggaactccagtcaaagatgcatcacaacttttgggtcatgcctaaggtcaattccagaatcattttagcatgttaaacagacactgaaaataaaacatattttattttttaaagcagctttaggttcacagcaaaattgagcatgaagtacagagggttcccctgcacccccgggctcagcatccccacgagagtggccgtttgttacagctgagacccccctggacacagcatcatcacccacaggccgcacgacctcagggtccaccgggtgctgtgcagtctatggttggacgaacgtatcctgatgtggacccaccgttgtggtatcatacagagtagtttcactgccccaggtcccccgtgttcctgctgcacaaccctccgtccctccctctccccagcccctggcgtcactgatctttgtgctgtctgcacagttttgccctttcctggatgtcagagtcggaaccctacagtgtgtagtccttggagacgggctgctttcactcaggcctggcagctcgtctgtttttagggccttgtaatagtctgtcgtctggatggaccttggttgactgatccattcaccctctgcaggacatcttggctgcttccaagttttggcaattatgaataaagccattttgtgaaagtgaaataatacagaacaggaaacattagggggcactgcacaccatcacagaaagggacggtattattctgtgagtatgttcccagtatgtgggcgtgtgttgtgaacagagagataaactactttctcaccactggaagcagtcaggacaattcaaatgctggcctaactggttaagagccctcaatctgtggtcagatatatctaagtttctcaatctataaaatacagaaataaggccaggtgcagtggctcaagcctgtaaaacaagcactttggaaggctgaggtgggtggatcacttaagcccagttcaagaccagcctgggtaacatgatgaaaccctgtgttttaaaaaaaaaaaaaaaaaaaaaaaaaaaaacagagagagagagaaagaaagaaaaaacactgttcccaagctgcgggctcaggacaatgtctgatgcctggcctagccctcatcaatggccttcacaatccctgctgactgggagtcaacccccagtgagtgtactgccaatacggccaagtttctgaagttggtgacatgtgagggtaccccaagactgaacagaaacaacctcctctcaggttctgagtgggtccagctcttcttacccctccaagcctgccattctctgaggagtcctctcttcctccactgctctgcttcctctcacaaagggggagtgtcccaccacgtccaactccaggctggcaaagtgacgagaaaacaccccacccatgtgggcagtgggcatgcggcatgctatggggccatgagaagcagccaggtgggtaggccagaccctgacccagagcaagcagagcccagcgcagtctcagccacgctccatgaggggccacatccacgagggcccaggagcaacatcccaggcacaccccagggatgagcagcacaggccgccaaccacgtcataccacactcacttgtgcaaaacaccctcaaactgcaaaaagcccacccacgtgtccaccagcagaagagcaaatgagtccaggtggcccacaacacacggggcgcacgtgtccatagacagcacactggattcgaagagccagacacgagtgtgtctgctgtggccttctgcatgcatgagggccccatggtgctgggggccaggcagacagtcaagcagcagagtggaggggaggtccaggaggagatcccacaggtacatgtgacatgagctctatcgtatgtgcacctaagatgtgtgccatttcctccacggatgttataccgcaaagaacaataaaaaacgactaacactgattgctgaccacctccccaaataactaatcaggacacaccctgatgccccatgtccggcctgtgggggcactgtggaaagcacaggaagtgagctcagtgcgtgccttccccattgtcctggcgttccatgcaggctgggagacgcgggtgacagcctcacaccacccctgttcccagaagaggccagtgcacccccaagcaggggctgcaacagggctgcacagagggctccagttccttccagcacaggaacaaatccacaccgaggcatccgtgagtcccacaggtcccagaagcatgggagcagcttgaggcctctgcattcaggggtctctgccgtcctgagcttcaggatgagtgggttcccacctagcacgcagtacgcagtgggttagggcaggtgctctccctcctctccctatgaacgctataccactcccatgaaagcctgtgcgtgctgcctcaggaccctgtagcagaacagcgagtgacgtcgctttggcagggaacctttggtttgcaaagccccgtcacacacacaagctgaggtaagatgacaagtctgtgtctctgcacctcagctgagccctcaggacacagcacatgagcgcccaggggcctgcaaacagcaaggaccaaggcatcactgaccgtgacaggccccagtgtgtgacagtgagaggccccagtgtgggttctcacaagcttgttttacggtttgacccagagagtacctgtgagtttcccctacagctggtgcttctaaagggctaggagaaacgcagggcaggatccccacacgccagcagctgactggccagacccctgcctgtgctgaggcatccgccgcaaacatgaccgtgcaacatgcttcaagatgccctgtgactctctcagatgggtcttttattagagtttctaaataaagaagtgatggccaacatcacaggaaaccttagatactattcctgccagttggtttgaaaaagctttaactgttaatttgctgatcgttttcagccacacggttttctgccatgtaatccacagaacccaggcctctggccacttgtccaggatacctctggagctcagagccactgtccttgtgggctactcaagacttgaggggttcaggcaagagccacatcaacagagctggacctggtgcctggctgggagcaggtgccggggagcagccaccaaatgcacacacgccagggcacgcaactgcccgcacctccaagattgtcgtcagacctagaggcgggtgtgcgtccacagacagcacactggattcaaagacccaggaaggaaggagtctgtttgctgtgggcttctgtggtgctagggaccaggtgaacactgaaggaggggccagacggagtccaggaggactcctgtagcaggacattgcccagatttctcacaatgtcctctacaattaagagcacaaccactgttccttctgcactggtgggaacccagcacttcaatgagacacaaggttaaagtgacgctttgtaaggacggaaagccacctgtgggcaccacaccccccgggtgggccacgacagggagcacaggcactaggagacccggcctgtcctaaaagcacgccctacaaggagtccccactctctacctatctgcttctaatgttctgactacatgagagatgataaaagggtttcaatacaagtgtaacattttaaatataaaggaatgtctttccattagaaaacaactgcaggccgggcgcggtggctcacgcctgtaatcccagcactctgggaggctgggtgcggtggctcatgcctgtaatcctagcactttaggaggccgagacaggtggattgcttgagctcaggaggtggagactagcctgggcaacatggtgaaaccctggctctaccaaaaaaaaaaaaaaaaaaaaaaaaaaaaattagccaggtgtggtggtgcacacctgcagtcccagctatttgggaggctgagatgggaggattgcttgaacctggcaggcacaggctgcagtgagttgagatcacaccactctactccaccctgggcaacagagtgagaccctgtctcaaaaaacaaaaaacaaaaaactgcaaattaaaacgccaaacgcacagattaatggaggaagccccatgcccaaatgctcccaaggaaacgtcagaaaggagaggacttcaggtggctcggaatcctccgccacgtgaccaagcccagctgagcactgggtctcattggatttgccatcagacactcacagtttttgtcactgttaaccctactgcacaatacatgaacatggtctaagcaattctttttttttttttttttttttttttttgagacagtctccctctgtcgcccaggctggagtgcagtggtgcgatctcagctcactacaagctccgcctcccgggttcacgccattctcctgcctcaacctcccgagtagctgggactacaggcgcctgccaccatgcccagataatttttttgtattttttatagtagagatggggtttcaccgtgttagccaggatggtctcaatctcctgacctcgggatccacccgcctcggcctcccaaagtgctgggattacaggcgtaagccactgtgcccggcctggtctaagcaattctaaccatgcagacaatgtgcaggtctttcctaggtggaaagcaagtttgcccaagtcgcacgagcaaggctggagtcagcaatgcctgttcctctccctctgttctctaatggtgtggtcttcagtctactgtgtgtggaatccccctctattgggaccacagctcctgggctgcaagcacctgctgagcatgagggtccagcttccaagctcactgtcccacgggtgacaagcaacacagtgacctgcctcccacatcagctggtgccagtatcatggtgactccctacacaccaggaccactgtgtcgcgctctgccactcaggagccccaggggcccccactatggccatcccaggacgccgcccgtcaggctcccaggacactgccccaagcacccagcttcagtgggtgtgctgccccgagacgcactctcactgtgccggggggtgggacctctgcagcccagcacgtccactcagtgtccatgtgctgccatgagcgccacactgtgtcctccaggatgtgggtctctgttagtccctcccctaccaagccaggacagccacctgcttacaggggtgctgacaaatactgactacctgcaaaattgaaacatgggtttgaaaagggcctgagtggaaatcctgtacttaacatacactctgttaaaaaaaaaaaaaaaaaaaaggaccaggcgctgtggctcacacctgtgtaatcccagcactttgggaggccgaggcgggcaatcacctgaggtcaggagttcaagaccagcctggccaacatgatgactgtctctactaaaaatacaaaaattagctgggcgtggtggcatgcaactgtaatcccagctacttgggaggctgagacaggagaattgcttgaacctgggaagctgaggttgcagtgagccaagatcacgccactgccctccagcctgggcagcaaagagcaacactcagtctcaaaaaaaaaaaaaaaaaaaaaaaagagcgagcttttgtagaaacaggtttaaaagaaaaaataatctctgctcttttcagcatttagaaaatcagccaggcaaaacaatcatttccctttcttagctaaaaggtttgccaaatgaatacttggagcaaaataagcctaattagtaacaaaaaaatcacccagatataaatgcgtaatttaaacccataatgaaagcacatgaggaactcctttccctcaaagtcaccaccgagggcctcactggacttaggacccaggaaggaatgatgagtccatctgctcgtgacctgagtctctaaaccaggaggacagacgtcctgggtaaccgctgatgggtgagcgttgcacccccaggatccctgtaattataggttctcaaggacaccaacaccagaatccatatcccatctagaaacttcttcctgtgatgcctgccaaaaggtccatttttcagtccattatcacaatgaaggtgaagttttgctgtttaggtcaaaatcatgcattaggcaatagaacgacctagagatgtctgaattccccctcagtacaaccaaaggagtaagagaggcccaggtttgcttgaaggcttacactagcaaacaaacaaacaaacaaacaaacaaagagaaaccaagaactgggaaagctggtcggtagcatcacacaggtcagatctgaaagccccatggtccgaggagcccatcctgccctgagtgcacgcagcgcatgtgaagagtcagatataaaggtggctctttcacaaaccatttcggaaatttagacgaaccctcaatttatttagaatgggttattatattttataatttctacacagaaaatattttctaaccatatcattttataacaaattagcaatagctaatgtttcctttaaaatttttcaagcacacagaaaaggatgaaggagaatacaaacacacatccaccatctgttcattttgccatatttgctttagaattctaacatttaaaaattacaaattacataatggttgaagccccttatataagccccaccctgctgtggctgctcctcagcgtcgatctgattttggggctaagcattcctctcggcgctttgatactcacgctacacacaagcctacaccaaagccggccgctgtctttgcaggtaacgcattggacggttcctgccgtaccttttcccttcaagttgtgctctggggtctatctgtgtggatacaggcagttctactattcttatgacaactgcagtgtgcgctcctcgttgtctgaaaaatccattctcctgttgactaacatttgttttttccaactttttgcgaatacaaacaacactaaaatgagtatttgtctgtttctttacatatctaaagtttataactagaaatggaatttctagcaagaaactgtaaaatgctttgtaaaatatctgatgaaatgtcacactgtatagtcattcacaaacatgtcatctttcacttttgattagggcagatgtcttctgttgtaatttttgttgttgttgtttttgagacggagtctcgctctgtcgcccaggctgaagtgcagtggcaccatctcggctcactgcaacctccacctcccgggttcaagcggttctcctgcagccccctgagtagctgagattacaggcatgcgccaccatgcctggctagtttttgtatttttagtagagatggggtttcacaatgttgtccaggctgatcttgaactcctgacttcaggcgatccacctgcctcggcctcccaaagtgctgggattacaggcatgagccacagcgcccagtcctgttgtaaatcttttatcaagagatcttggttagacaaggggaaacagtactttgcacatcatctttttttctaacatgattacattctacaaaaagagacaatataattaacaaatttcatttaaataaaaactataaactcaagtgctaacaggaggctgttcattggcaaaacaaaatcttggaagaggcacaagggcccagagagctctgaaaccccagaaatcacacagaaaatgtacaggtatgtggacagtcctggggagaggatgcacagcttttgcccaattctcagagagtccagacctgaaaaacgtttaggaaggcaccttttcaatgtccaaatgtgggcagtgatgtgggagtgaacatcagccaatagagtcctggacggacattctaccttccaaagcagaccagactcaccaacacacccagaaagaacatttttaaaatataaatggcttcagaatcctttaacatatgcccaggaaaaaattaataagtcataacccaagtcatgtggactgtttatatgcaatattagaaaagaaatcaaggtttccactgcgaaaagcctgaaacccacagctctgtttctaaggtgaatgagatgggtgagatccgcggagaagactggacttctgctgccatcatggcaagcagacccggtttggaaacaatgctgtgggtccatttctctctgcattaaatacaccacaggatttttcgttttaaattattaatcaggcaatcaaaccaaaaggaagcagacaatttaagttgtaacagggcaatctgcagattctcacaggttggagggataaggccccaacgtgaacagaccccaccaagcagcttcccagccttccagaaggttccagaaggcctgtgtgggctgctgggctcgtcaccttagcaacggctctaaacatatgtgcagtgacaccagctgatttctgaaagctgtaaatagaggataatggcataaaaaaaattccagattaaaggaccacccactgcctcctctcccaccccatccagcccataaatcccaccgttaacactgggagcaatgccacgtatgcaaacgtggctttaatcccctcacacacctattcatctgcataatgatatacctacaaaagcaaaataaggtccttgggttaactctctctgcacaaacgtgcacaaacaaaaagtggccaagagatggcagagtctggcacggatggaccagcccacagcagccacggcccacggcgggagtgctgcacctccacccacagcggccacggcccacggcaggagtgctgcacctccacccacagcggccacggcccacggcgggagtgctgcacctcctccacgaacagcagccacggcccatggcaggagtgctgcacctccacccacagcggccacagcccacggcgggagtgctgcacctccactgcccacagcggccacggcccacggcgggagtgctgcacctccaccgcccacagctctgcttcccaccctccacctcacaccaccatgggcacttggtcccttctctcagggcccttctagatcttggcgtctgggcctcaaagcacaacacaggtactgacaggtaggtctccaccatgagagagaaaaagatgaggtcaactgcctgggcaaaggttccaggtggaacatcaagagctgctggtgaatgagagcggcagcccaggctcagacctcagaaccagcttctatctttgaaggatgcagcccatttcacctgagagtcggaaaacgttgaactccccagagatgttgaggccttgggaagacagcattcggtccaggataaaccagcaatactctggaccaggtttgcaaagaactcgcccaacaggaacaaggcaaagcgtgaggaggaacgggcagggagaggccagcgtgaactcgctgcggcctgcgtggctctctcctagcacaccacgtgcctgagcaggatatgccttttccttatttcccctctatcatctttctgaggcattatatggaaaactgggtgaataaatccccaagtatgagctgacattcttaagagaaaaaacaaacttgatacttcatggtgtaaaaatctatttatgggccctacagaattacttctcactatagtcctcattaaaattaaatactaaatactctaaggaaacacacaattgcatgttaaaacatgaaaaacattattacagaataaccaaacttttgttccctcagagtgcctttctgtgatcgtttatgcccaactggcaaaggagtgggaaagggacggaggtgaatgaaaagaaggctcatatcccagagcccaaaacaggcatcatttacatgcttcataattccgaatttgggatgcacaaaccaataaagactatgtactcatgtctgtttgcaaatataagcgctttttaaatttttatttgagacgcagtcttgctgttgtcacccaggctggagtgcagtggtgcgatctcggctcactgcagcctcagcctcccgagtagctgggattacaggtgtgtgccaccacgcctggctcatgtttttgtatttttagtggagacggggtttcaccatgttggccaggctggtctcgaactcctgacctcaagagtgatccacccagctcggcctcccgaagtgctgggattacaggtgtgagccaccgcactgggcctgagcgcattttttaaaaagcaatacctgtgttcccaaaaacagaaaaattgacatttagttataagctccaacactttaattgcttaaactgaatttgtggcaaattatttcaaagtaaaaatcagctcagatttgtgtttttatgtgtaatctcttaaaagccagggtacacaggtattcctaacacataatgtatgtgtgagtgagtgagcgagcaaatgagacagagctcgaggtgggctggaggcatgtgagggtgcacgcgaaacacagtgcctcctcttggagttgccagaattcacctcgttcagaacctcaccccagtcagaaaacacaaggcagcaactggccggaacttggtcagtcacatccataaaccaccaattaccttcacagaccacgactaacaggtttattacagatgagtcacagctcatgttttcaaggaagggtctccaactgagcagtcaccagtgcagcctgcgtcagggcgcgcctccctccagcggtccccgcgtcgcccatgtctgacacagtttatgcttcgcaggcggtaaggctccgctcctcactcccatggaccaacagagtagggaaaacgaaggcacgttggaaactacggatcacgggctgttttgggtgtgggaaatccacccacccacactcacggccagctctgaccgactgaacccaggggcacatcacagacataaatatcggtgcaggcggccagccactcctcaagcccggccccgcccctcctgctcccagcggaagcttttggtgcaggacttcccgggcctcaatctcctcatctataggctgggaacaaaccctggagtctgtgctctgggaggagcacacacgggcaaccctggctcaggacagattcccagcccctaagtcatcactagggcttaacgatccatttcaaattacatctgcacggtgctttactttcatacgttattttatttggagcctctaacgagcctcagctaacagatggtattatttccacatggcaaacaaagagacaggagctgcaaccatccaaagacacctccttgctatgaatgcctggccaggcctccaggcaggaccagcaactccagaccccgtcagggccaacacgggccactgctgtccacacactcctagaaaatatccatctgtctgaagcgagtgacacagattttaccctcttgaggataaaataatcccatctgccaaaatgacccacaaataaaggctcctccttgtctgaacgctgcctcagcgtctgagggataagcccacaatgcaagcgtccgggaggacactccaggctgaggggcccaggaagaaagagggccagaaatgagggcaccctcatgcatgctgggagctgccgacaccttcagactgggaagaacaaagagctcccaagcacgagggcacgggagcacagcggagggcacgggagcacagcggagggccagacgtgaggccagaggcggctggagcagcagctcccacccaatagcagacgaggcgtgagactctcaaccaccttccaagttttctcttcatcttcaagagaacctcaaactgtattttccttagtttcattaccaggctccttgtagaaaataccagtgaaaaagaatggttggcagaactgaaaatctcaggaaaaagcacaaacacagcacacagcagaagcaggcgcagatgaggcaggaggaacggcaaggccaagcggtgctccagggaagcccagctcggatggtttctcaaccactccctgcttaaaaactgcttcacggcctgaaagggcactaaaatctgggagcatccaccaggaaatggaaaaggcaaactcccaacataaccacaaaaagacactgtacaatctccaaactgtaaagatggaaaaaaaaaatggagcggcaaaaaaacatattacaagccccccctccccaccccccggcaaaaggagagagagaagacccatcacgacaaacggatggaaagcactcgaccccacagagctcagtgccgacaccccccggcacctggtgccccatctggggaggctctgccctcgtgggtggacgaacgctggctgctattaagggctagcactgggaggcagtcccgtccattcctctgtccctgcagccacggaaggacgaagccccaagcacggaggcagagaccaggccctccagtggccccaggctctccaacttccagcttccagaactgtgagaaataaatttctgttctttataaatgaaccagtctcaggcattttgttacagcggcataaacaggctaagggaaaaaagtaaatggactaagaaatacaagaccaagtttgtcagattggaatggaaaaagtaatccagctggctcagcacgagctgagtgatgtttaatccatgaacaaacatttcagaaaatacacaccaggtgcatgctgtgcacaccaggtacatgctgtgcacaccaggctgggcttcctctatcaatgctaggtacagacttgaggccagaatgcattccaggaggtaaggtgagccactataatatggcaaaaagttcctttcacaagagagctaagacggtccgacatttatgcaaataaaagcctctgagtaaagaacaagaatcaacagaacaggccagacacaggctcatgcctgtaatcccagcactttgggaggccaaagcaggcggatcacttgaggtcaagagtttgagaccaggctggccaacatggaatgaccctgtctccactaacaacacaaaaaaaaaaaattagccgggcgtggtgccgggcgcttgtaatcccagctactcgggaggctgaggcaggagaatcccttgaacccaggaggtgaggttgtaatgagccaagatcacgccacggcactccagcctgggcgacagagggagaccccgtctcaggaaaaaaaaaaaaaaaaaaaagaatcaacacaacagagaaaatgcgcctcagccacggagcagatattaaagtgcctttcagtaaagaacagacaaggagacaaccctaacccagactacaagacagaagatctgaaagcaagaccaagctggagctaaacatataaaatcatccaataatcacatagaaaataacacaataatcacgcaatccatttttcaagctcccagggaacaacagtcatccaaacttgatcacacagacaactacaccacacgcctaaaaactgtgagagtcaccttctgaagtgacagtgcagttcagatgggaggatggtgaccagaaaacacagccttcaatctgggaattaagaaatgcatttctaaggatgagggaggagggaaaccagagtaggaatttcgaatattcaaaattggaaatgacagagatgctatacagcaaggtgggagatccaggtaaagtggttgttagagggaaatgtatttatatttatcgctagaagacatcccaataaagagactctaaaagttagaatacaaccaaaagaatagaagaaaaacatgagaaatgtacaaacataaacgaaacaaaaagcaaacatgtaacagagactaaacaaagtcaaaggtgagttttattttaaatgacctataaaatagagaacaagctacacgacacaataggaaagcaactagacaaaataggaaggcgcgaactgtctgcgaagcaaatggcccaatccccaaggttggtcagtagcaggaagagaaggctctgctgggcgaaaggccagctaaagggggtgactgagcacatgggctgggctcctaggcccgtggaggtgtctctcgttggtccgggcatcagaggaagcagcaagcagcttgctgaaatggaaatgtgaatgaaaacactgccacagcagcacctgggtgagggcttctttcaatctctggcagtgtagccttgacaagctgacacataagcctgactgtcgcacatgtgtgtacctgtatgtgtgtacgtgaacatgtacacataaaaagagttccgttcggccgggcacactggctcatgcctgtaatcccagcactttgagaggccaagataggcggatcacgaggtcaggagatcaagaccatcctggctagcacggtgaaaccccgtctctactaaaaaatacaaaaaaattagccgggcgtggtggcaggcgccggtagtcccagctactagggaggctgaggcaggagaatggcgtgaacctgggagatggaggttgcagcgagccaagatcacgccactgcattccagcctgggcgacagagcgagactccgtaaaaaaaaaaaaaaaaaggttctgttctccaggttgtgaaaatgtgactattttacattctatttctccttatcggtttttcctaattttctaaaatgttgagtattgcttcagtaataaaggttactttttaaaaaagaatacaaagagatgaccacaaacatctccaacattaggcatctccaacattaggaaaaacatattcagtttttcaccagtaagaatggtgtcagtcagtgggtgtttctcagaacgtcctccatcagactgaggaaactcccttctgttcttactttgcagagcactttcctcatgaataggtatgggattttgtctttttttttttgacagcatctcattccatcacccaggctggagtgaaatggcatgatctcggctcactgcagcctctacctcctgggctcaatggatcttcccacctcagcctccagggtaactgggactacaggcgcgccaccctgcccagctcatttttgtattttttgtacagatagggtttcaccatgttgcccaagctgctctgcaactcctggactcaaacagtcctcccatctcagcctcccaaaatgttgggattacaggcatgagccaccatatctggcctcaaataccattttttaaaaaaatcttcttagatgatcttacggcatttcattttccttatgtcaatatggtacactacattgatttttaaatgctaaaccaaatttgaacttctgagataaaccccgcttgctcatgaggtatcgctatcctttctatctcctataacttaaatttacatcagtattaatgtgggtgtttctctaattttggtatcaaggtgtccctgactcatagaaagactggatgtgtaccctcctctgttgtggaagggcttctatataactgactttccttattctttaaatgtatagtacaaatgaccaagtcagtcatccgggactgaaggtttctttgtgggaagggtgttaactaaaatttcaatttctttaatagatacaggactatttaagctatctatttcttcttcagtaagctgaactagtttaagtcttttgaagaatttgtctatttcatctcagctgtctaatttattggcataaagttaacaaattcccttattgtactttgaatggctataagatcacagcaatgtcccttttctcatgtccatactaaaaatttgttgcttctttttctcctgatccatttggctaaggggctaccagttttattgtctttaaaaaaaaaaaaaaaacacccagccgggcatatcacctgaaatcacgagttcaagaccagcctcgtcaacatggtgaagcctcatttctactaaaaatacaaaaactagccaggagtagtagagcgcacttgtaatcccagctactcaggaggctgaggcaggataatcgcttgaacctgggaggcggaggttacagtgagtctagatggcaccactgcactctagcctgggggacagagtaaaacactgtctcaaaaagtaaaaaaaaaaaaaaaaaaaaaaaaaaagaataataattatagtaatcaagacagtgtggtgttagcaaaagaatcgataaatagaatgatggaacagaaaagaccaaaaacaggccaggcgcagtggctcacgcctgtaatcccagcactttgggagaacacggtgaaaccccatctctactcaaaataccaaaaattagccgggcgtggtggcgggcgcctgtagtcccagctacttggaaggctgaggcaggagaatggcgtgaacccgggaggcggagcttacagtgagctgagatcgcgccactgcactccagcctgggcgacagagcgagactcatctcaaaaaagaccaaaaatagacccacataaatatatagtcaactaatttcttaacaaatgtaaagaaattgaatggcaaaataatcttttccacaaatgatgctggaaataattgaatatcctcatgcaaaaaacaaaaacctctaaccttaccttatgccatacacaaaaattatttcataattgaagtaaatatgactgaaaactatgtatcttgtagaagaaaacttgctctacgatgctggcttagagagatttcttaaagacacaaaaagcacaaagtacccaagacaaaactatgaagttggacttcatcaaactaaaaactttagctgctctaaagacactattaagaaataaaaatacaggccaaatacttgttaaaacacacacacacacacacacacacacacacacacacacacacacacacacatattcaaacaacaaatagctggtaaaggacctgtgtctagaatccataaagaactctcaaaaatcagcagacaacccgatttttagaaatgagcaaatggcagatatgaaagtgaagacacatgcttcaccaaagcaaatacatggatagtcccttccccccaccaaaaaagccacatgaaaagacaagcaacatcatttgtcactagggcactggaaattaaaaccgcaattcactagaatggctaaaatggaaaagatggactacaccatgtaacggcaaggacagagcagatggaattcccattcaacgctggtgggaacacaaaactgagtggtcactttggaaaagagtctggcaggttcttaacaagttaaacattcatgtaacatgtgaccgagaaacccagacccagaaaaggtaccacatccagccatctgatgctttgcatgcaactactcatatcagcttgactcccaacagctaaaactaggaaacaacggacatgtctataactgcttattggatgaacatgcgacatatctaccccctaaaaagctactcagtaaactactgacatacaccacagaacccagatcaatctcaaaaggaagatgaaacacaccagacacaagagtccacactcaatgattccattcatattaaattctagtaaagcaaaagctacagtgaccgaaagcacatcagcatcctgggtccaggaaataggatgacatgctgctgcaaagaggaaagggggaactttcttggggtgatggaaatactactctgtatcatgactgtgatggtgggaacaagacagttccaactgattccttaaaactctcacatctgtagtcatgagcaacatgatgctcatgttgagtgtggtcaacaggccacattcatgatggtggtatgtgctaccataagatgctaatggagtggaacgggtcccatggcataaacacctaccactgtgttacgatttctttccacgattcagcagggtgactcagcaacaggctctaccatgtagcttaggtgtgtgggaggctctgccttctggatctgggtacgcacactctgtgatgctcagaggacaagatcacctaacaacgcatttctcaggatgcatcccccgaccgctattaaaattgatgcattccaaagtatttaaactgtacctcaaagaagctctcagagagaatgcacgggagtggacgatggcgggcacaagagctcgtcaagagcactgttgtgaagaaaagcagagaggcggcggcggcagctggtggtgggcatgggcgaggggttccacggcaaagaatgaaattgaatgcccatcaccccacgcccacaggccgccaaacacatctggaaaagcagaatacattcctgaaggggatggcatccatggccctagggaaggaagaccagatcccaacaggagcaggatgaggctgtccttgatactgagcaggtggctgacttcaccacacaccctccactacctccgcaaatcactccaggcattcattacccactacaccaaataactgattctcatttcataaatatacgtattcaaagaggatcctagcgaactttttcaagaaaacactggatacagactctcgggcaggtctgtaagttaaggcatggagacgaagcttctctctgtgtttggcattgaggcaatgctgctgtgggcactgcagacataggccctgtgacctgggcgcaggttcgtgtcatgccacacagcatgcaattccatggacacaaaatgaccagaacagcagactcagagaggacgcagaggctgcagggggaacaaggagtgacgattaaaggtccaagtttctttctgaggtgacagcaatgttctagaactgacagtcctggtggttgaacagacccgtgaatacactaacaacctttgaactgtgcgctttatctgggtaagcctacggtctgtcaatcctctcaatcaagctggtattatctcttttttggagacagtctcactctgtcgcccaggatggagtgcagtggtgcgatcgtggctcactgcaatctctgcctcccaggttcaagcaattctcacgcctccgctgaaatgacaggcacaagccaccaggcccaggtaatttgtgtagaggcgggggtttcaacatgttggtcagattggtctcaaactcctgacctcaagtgatccgcctgcctcagcctcccaaatgctgggatcacaggcgtgagccattgcacctggccgattatcttctttgaaaagcatgagacacgtttccctagggatggaatgctggacacgagacaagacttgtcctaaggactggatctcacagtggccaggtatgcatcacgccacgcggtgcagagccctgggggaaggcaagtcaagaagccaggggtctaggcaccgcaatgtctcaaggcagccccccaagaaaaccaagcagaaggccacagtgacgccctcctgctctcaggtcagtggcaggagggcacttgctgatgctgggcacagaggaatgtcagggcagatcttcaaggctcacacccttcagagcttctggcaagctcaacacagtgagcgagccctgcccccaagagtgaggcccctgtcagggccacttcctctcgccctggcccatccagatctcacacacactgtggtagatctttgaagggtaaaagctctgtccgctccactcatcagcaccaaagtgttctgtgcctggcccttctccacccaattcaccagtttattgaagcctcagctgggtgagtcccgcttgcctctgaaaatgtgtgtgctcagccaggcagattcttgagtgcgtttcctatgtgctgctgccctccttcaagatgaccacatgggcccccaagcagggcccctacctgctttgtcagcatcttgtcctttccctcttttctctcacggcttgttctacttcacggcatgtttaagcaaagggggtcactacaacaaaattattttaaaacaaacatacttcagaaaagtttatggaaaacattaaaccttgaatatattaactttacaggatccatttacttcaccctaacactgagttaaaattataacaagagaaagtagggctgggcgcggtggctcacgcctgtaattaatcccagcactttgggaggccaaggcaggtggatcatgaggtcaggagttcaagaccagcctggccaatatggtgaaaccccgtctctactaaaaatacaaaaattagccgtgcatggtggcagacgcctataatcccagctactcaggaggctgaggcaggagaattgcttcaactcaggaggcggaggttgcagtgagccaagatggcgccactgcactccagcctgggtgacagagtgagactccaactccaaaaaaaaagagagagagagagagagagagaaagtaaacaaagtttctatttatttctccagaggatctcaaaagtagagctggaaataccagcagtaagaggaacaccagtccaaggcaactacaaggaactggtcactttttcatttttttgagacagagtcttactgtgtcacccaggctggagtacagtggtgcaatctcggctcactgcaacctccgccttccgggttcaagcaattctcctgcctcagcctccctagtagctgggattacaggcatgcacaaccacgcttgcctaatttctttgtatttttagtagagacagggtttcatcatgttggccaggctggtttcgaactcctgacctcagctgatccgcctgcctgggcctcccaaagtgctgggattacaggcgtgagccactacgcccgaactggtcacatatcttatggaacataatgtttttcatgatcaacagccactatgggaacacaacacacatcagccctgagacacccgaaacaagacagagcagcctctgcagcctctcatgcagggagcgtggggcatgtctgccacagggtgaggggcggcgggcagagatggagacataaaggcggagctggcttccagccttgtgaaccagcccagctgaatgccccaagtctgtaaataattgatgggagccagagcacccagccctgcagggctctcgggagctgcccgcccaacagtcccatgcctggcactccctcaggtgccgcctgcaaggtcactccactgcttctaaataatgcactgcacagatggaggaaagtatacctttacccattcaaatcttccaaggcacgcattttcacaaattttacatatatataactaaattttgcattcagccaaaaaaaaaaaaaaaaagaaaacttcatgttgaaacactgtatctcaccctagaatttgaaaagcctccttttccttctcactgtcaatcttttttgaagtctcaaaaatgattttactaacattagacaaatacccaaatataaaaagtgcttgacacagtcaacactgcagcagtgaggtccactatgccagcgcagtgcagagccagcccacctccctgcaccagtggaaatgtcacagagggcagagggcagcgtgcccagcacctgctcttgatagggagggcacttctaggctggaatactcaagagatttgattgtgtgtcatcaaagcatgctttaaatacaaaagctggcagggcacggtggctcactcttgtaatcccagcactttgggaggccgaggcaggtgaatcacctgaagtcaggagttcaagaccagcctggctaacacggtgaaaccacgtctctactaaaaatacagaaattagccgggcatggtggcgagcacctgtaatcccagctactcataagggaggctgaggcaggagaaatcgcttgaacccaggaggcggaggttgcagtgagccgagatcacacctctgcactccagcctgggagacagagtgagacactctcaaacaaacaaaggctgtgagtggcctggaagctcgttcttctagctcctttggcaaagaaaatgcccccaaaggagtgagggcaacagactttccaagtcccaggaaatgcacagattcacatgctgaagacccaccagatgcaggaaggaaacgccagaacaacatgtttgctttcatctaaaaacatcagaaaaagtctaaatgttgctgacatttcctgggcagctgccctgtggtctcccgtctggccaaggagcctcaacccagttgctcccaacatactcccatcccaggcgaacctatgctggtgatgctcgggaggcgggcagagggctcacggagggagggcggagggctcacaccctgaggctcggaaggcgggcagagggctcacaccctgaggctcggaaggcgggcggacggctcacacagacccacaaggaccaaagaggaacgtgcaggactccaacacaaacggaggacgatggcagaacagaagagctgattaagtttctgctgcttgtaccataaacttttcatcagccagactgtttgcctgaaagacctaatcaaggctgacaagaattcaaagccatttcaaagtgctcctcaggggtgaacgtggccccatgtccggcacatgctctgctctgaacgctctctcttccagcagggacggccccagacatcgagtatcacaaccaactcaaaaatagactgaaatgtcacagtatcgccaggatcaaaagaaggtctcttaaaaataaagggtttcttccattaataagtaaaacaagaaaaaacccaaagatgctcacttgaacttcatcttgttatgagcatccacccgtcgagggcaggtcttgtgttactgagcgcagcctgacaatcgcatctgcaccgaggccctgccacggcggttcacggcaagggtctgtggctctcctgtgcgcagcccaatggaaaggcagagtgaccgatgagataaacaccacaggaacagggtgctccccccagcacagctcgggagaccagggctcaggaacgctaagtgactcgcccaagaccaccagaaatgagttgggaggctgaggtgggaggatcacatgagccccgccctgggggctgaggcgacagtgagcccagatagcgcccctgcactccagcctgggcactggagtgagacttgtctcaaaacaaatacaagaaagaatctggaaaaccttagttactatgaactagtgcttttcactaacaaaacacaagtattttttaattctcacgtttctgatcatctttgtttataacatttataggttacaaacaatgaactattgtgggtttttaaaaactgattacagactttcaggacgtccaaaggagacatctttgtcaagggagtaaagtggagaattccagagacacgcacagttctcggtggcaagccatccgctgaggtgagaaggatgtgatccatcagccaaccctgcctagatgatgacaccagctccggaagccagatggagcagctggacacattcagaacagtgctttcaagcagacactgcttgttccaatgtcagctctataaagaatgtaacagggccaggcgcggtggctcacgcctataatcccagctctttgggaggccgaggcgggcggatcacgaggtcaggagatcgagaccatcctggctaacacagtaaaaccccatctctactaaaaatacaaaaaaaaaaaaaaaattagccaggcgtggtggtgggtgcctgtagtcccagctacttgggaggctgaggcaggagaatggtatgaacccgggaggccgagcttgcagtgagccaagatcgcaccactgcactctagcctgggcgacacagcaagactccgtctcaaaaaaaaaaaaaaagaaaaaagaaaaaaaaagaacgtaatggtacaattttggggaccccaaaaggataatgcacataataaacaacaaaagcctgaggcttctcccaggccctgtggctgtaatctcccggagtcccaggcatcctgctgctgggaagggccagctcccaagtgacctgtgaccatcttggaggggttggtggctgccttgtcagcagggcatgtcccaatgctaatggttcaacagccaggcttgacatcttttattctaaaaatctaccacagaatagccaaagggcagtggtggggatgaggatgagtctgtaggagggacagtgtaaggaaggtggagccatctaggggcactgctcagaggtaggctcggccagagctacaacacaccttcgaagatgagtggggttgggggcggggtgagtcagcttcaacacacccaggattcacctctcatctgtcaaatctgctgataaaagtcacaccatgaaggaagggcagtcagggactgtgctcaccacgtgtcccggggacaggacacttgctgccagtctccagcacctcacagggaaccagggggcaggtgagcttgtggagaaacaggaatcctcgtgcattgctggtgggaacatataatggtgcaactgccaaaaaaaaacagtgtgacgattcctcaacaaattacaaaaggactaagcatatgatccagcagttccccttctgggtagatatacaaaagaactgaaagcagggcccccaaaagacagttgtacttcgacgttcacagttcacacagcatggttcccaacagcaaacccgagtgtcccctggcggatgacagagaagcagaatgcgtctgcacacagcataacgcgactcagccctaacgaggaatgcctgtcacagccaatgctgcggactccactcacagggtccagggacaaacagcagctgcacaagaggaagggccctgagggaggagtctgggaggaaccactgctcatcggcaagccaatccatggccacaggacaacgctgctgaaggtactggaagccagggtgctggctgcccctttctggggacacctttcctttcttttcctatttttattgaacactgggatgaaagtaatgaaaagtagtaaatcctttcaaaacaatcagatttagttatgatgctcaatttctgaaatcaatctcttcaaatagccagtaaatgcttcctttccaaagactgaaccctcttactgctttgaacaatggaggaagtgagtgaggcaccagatgcaacttttgacccaaggacacaggtcaagctgtgacagttaacaaccagggtggctggagatgctgcacccacccacgtggctttgctagaatgccaccacgtgcgggcagacacaggccacagcccccacacctcactctggcatcagcactggtcccgcatggagctgtgccggcttgcagaagacgtagagcacacaggcgtgttccttcccttctgttggccacatcacagctgcatattcacgggagtgaacatcatctacacaacagcttccacgtttgcaaacatgcacagcttagcgaccacgtttcaaagagccacgtggataactgcctatattactggtactcaatttccaggttgggttggtaactggattgtttacaacacaaaggataactagttgagaagatggataccccgttttccatgatatcatcactacgcattgcatgcctatatcaaaacatctcatggaccccataaatacattcatctatgtactcacaaaaactttaaaaataataattaataaataaacagaatgactaagatttcaactgtttacccaggatgctgcctgcagctcatttcagtgacaacccacaagctgccctcgctggccctgtgtgctgaggacgggacatctgcacccagccctagataaccccacgtgcaaaccacttcccctgtgccgctaaaacccacatctcacatttcagttatagtttgttttttgcctgtaggttttttttttgagaatagggtctccctctgctgcccaggctggagcgcagtggtgcgatcatggctcaccacagcctcgacctcctgggctcaagtgatcctcccacttcagcctccagagcagctgggaccacaggcatgcaccaccacacctggctaattttctattttttgtaaagacaaggctatacatttcttatatatgtctaaatcgtcagtattaaacactgacagagcaaagcctttctctgcttcaaattttaatattccaaaatatataaaacatcattgtcactgtcctcatctaaaagactgattctggaagaaaaaaaaaatcaatctgaaacaagatcacggaaatgcgatctgtcccacacacaccatctttaacatgaatggtgcctccaaagaacaaatgctagatgcaaactgcttgagtatgcttctttatttttagtaaagactccagaaaatcccagagcagccatttcccatacaactcaatcgcacgtacagccctttaaaaagcagactcccagggaactgcagccagctcctggagccagccccagcagaggagcaggaagaccttccagcctgcgccaaggagcagcgcacacgtctgctgcagcccctcggcccccactgcttcgggatgcagatggcagcactgtgacctcactgtgcctacctccttgttccggccctgcagtcttgattcttcaggctaatcccacactctgagccttggctgctggccgaaactgttattaatggcacagagctgctcatttcagcttcttttaccacgaaggtagccggctgttcacctctctgcctctccacactgaagcaggaactgggtaactgtacaagaggcattttcaacggtcttcatatctgagtctcaacagccagcagaagatgtttgcattttagtctacactacattctatgtgatgcagaaagataagatagtttttattcaattcttgtgtaaaagctacaaaaccctaagaacagagagtgccatggatgccaaaatcagcatcacatagtttatatgttttttaacttttaggttcgggggcacatgtgagggtgtactacataagtaaacacatgtcggcagtgggcggggggggaggttgtacgtgttattctatcacccagtactaagcccagtacccaacagttatcttttctgctcctctccctcctcccgccctctcccctcaagtagacccccgtgtctggtgtttccttccctgtgtttttaagttcttatcatttagatcccacttgtaaagtcagaacatgtagtatttggttttctgttcctgagttagtttgctgaggctaatagcctccagctccatccatgttcccataaaagacatgatctcgttcatttttatggctatgttatcttatcttattttgtattagggatggggcttcactatgttgcccaagctggcctgaaactcctgggttcaggcaatcctctcgaattggtctcccaagtagctgggactacaggtgaacatcaccatgcccacttttccatcttcatcacttgataaacatttataatgaatgacattaaattacacatagcaaaattctgagaaactatataccacaaatcctacaaaatttaaaagattaaaaaaccatggattattgttatgtgcattagccaatgtcagtggttccaatatttactttcaccactaaaatggcacgaaagcatgaagtcgggaatgacagcattctagaagccagtgcacctgagatgaaattcatggtatgttcggaacctagaacgtcgatggtcaacactaggcagcttcatctgtcatacgtggactccctttcaaaactccaggtgtgtgtgtctgtcatgtggctatggagaggaagaggagaagaaaagatttcgattcactaaaaactcctgttaagcctccaagaaagatccaagtaatcagatacctggtcagtcacagcctctctgcatgaagcctctctgcatgtggttaagacctgcaaacctcaacagaatccacggtctcttgcccctgcactgagcctgtgtcgggacttggccactgctctgcatcaggtgagaggctccttgtctctcacatccagatggatccgatccaactcacacagtgaacgactccaaacctgggcagccctgggctccaggatcagcccaccccagcccctgctgcaatggcacctcctactctcattgtggaaacctgtcaacccaattacagacaccctggctaggcccgtacttcttcctgtaagcctgaaaccctgctcagctaccctaaaccaccacctctgcgcaccccttaggaaaccccagcagcacatcccccttcttcctcccgcagagggcctgccccaagcagcaggaaacggggtgacacaggccttccttggcctcagcacacacagaaccatcacagcgccgggggcggggggtgctgcagggacacattccagctgtgcacttctctgggggccagcacagaccactgagcatgagctgcctcattcaggccaggtgactgtcttcatcatcattcaactttgaaacttagggtttgtgccagtccacctgtttatgttccatacttacatatcccaagccattaacaagtgttttcttctttggttatgatgctacagaatcagcagaggaacatccgcatcaccagaaggctctgcaggcagcactgaggcccatcctgctgggagaatgccgctctgagggcagtgggactgccagcaaaggacacaggctcagggagaccttccactcctgctgaaacaccaatcagtagaagatcaccacccagaaatatcactttcaagcttaaggatcacaagttacaaagataaatgtctctaaggactaagggagaagtacaaagtaaaaagatttaagcttgggaaaattaaccctaaacatttaaaaacaaaacaaacaaaaaaaatccgcactctagataagaccttcaaaacagcatgcctgtcagagggacagtaaaggtcagacggggcagcaatggggtatgagctggcacagccttgcaacaccctggatgggcggccaggggcttgtgagagtggctccaggcaggaggaccctgaatttatgggagggggcaagactaaccctcaagtgctcctcagatacgtttcattaaatgcactgaaagttttgtaaaagatgcaagtttcaacatgagatacaattatttacccaatctgacatgtggcttaacaaatgtgagtggattaggggatttttgttttattcttctgaaataccaactgccttcttcttccccttctgaaacaaccactggacaaactgaacggcacatatgcttttcgggatctcagcgtaagcagctcccactgctagggatgaagagtgctcctctgtctgcctgagtgaaacctcacgacaccttgcacagcccgcagtccttgctgactggaagcagaaccaaaacctgagctggagagagtgcacgaaagttccatctagacccaaacctaaattgcacagctacagaatgaagtgaacagcactgaagccggaagggacaagactcaatcccacgtgactgaacccatgtgtccagcaccagagatactgggcggagcacacatctcagctgtgtaaaaagtagaagttcctcttcaaagactttcctccccatctaattaaaaataaatagtaacttctcttaaaagcaacatttattcaaagacctgtgctgacattcctaaatatctgctagccttaataaagaaatcaatgtactttatgttcttagctcccacaatttagcctaagtatctgccctggcatgcttatactggtcgaagcaagcattaggtcacggcctgttcctcttccttagttgaaggtgtttttacctttctcagcattccacaaattacttcctccttcctttgttctcctctgcctttgcctcttttaaaaagttctaagttgctagccaatcgggacaaatacagaatgtgaggtcccgttccagccaatggaaaccggacacagcagttggtataaaaaaaccggacacagcgtcaggttataaatgaccctggtctcctttatccggtgtactctcgtggcaaaactgctggcgagtgtaccctttctgcagaaggtataaaaaatggccttgctgaggaaattaaatttacgttcaagtgctatttctttacggcaccagggcacaagcatttcaaacagctgggaacacgcctatccctgttaaaaaaaatatacgatgtttccagataaaagaattctgatcagaaataggtaagttttcatttaaaattttttcctatactctgccttctgaagcagtctctaaattcaccctgtatttgacggtgcatgcgaatttgttatttatgcttaaatgccagccaaggagtaagattcagtctgcattaggagatatacctaatgctaaatgacgagttaatgggtgcagcacaccaacatggcacatgtatacatatgtaacaaacctgcacgttgtgcacatgtaccctaaaagtataataataataaaattaaaaaaaaaaaagattcagtcttgcaaagttttgaaatctctcaagggggaaaaaaaaccttacatagttcacaattctgagtccagaatctaggagaaaccaccaaaactttctttgcattctgtcaaattcaaacgcactctgtgtgccaagcctcactcactttatgtccaccaagcaccacacgctgcttcccgtgtatgtggcccaggcccctgtgaaacaaacacactctctgtggtagactggaagaacacgggcctgcaggttccagtcaggaagtggagtgctagccctatgcggtgactcatgcctggagcacagcacttcaggaggctgcggcaaggaggactgactgaggcaaaaagttcgagaccagcctggccatcgtggcaaaaccctgtctctacaaaaaagaaaaaaaaaattacccaggtatgatggcatacatgcctgcagtcccagcaactcaggagcctgagcaggaggacagcttgagcccgggagttggagggtgtggtgagctatcattgtgccatgccactgcattcctgcccagccgaccaagtgacacgctgatttaaaacacacacacacacacactcaatggaaggcaaaagaaaaggaagaaaaaaaagacatggagcctttctttccagccctggagcctgggtgtaccccagacttgctgggcccacgaggaccctgccacttccacctgtgccctcaggcaacatgtgggggcccacacagactgaagtatgaaatggattcagcccccatcagcctaatgcagcttcatgagtgatcccaggtatgaccagcagaaaaccaccaggcaacacaagaattaagagaactcataaatcattattttcttaagacaccatgtattgtcttacaccgcaataggtaactgaaacacatcctactcacggtaagaacaagctgaaatatggaaagttgtttgagatgctacttaaacacagatttaactccagagcagagcctttccatgtatttttcttaacctattcgccctcaaaacagcgctgagcacagcagtcagaccctaaagcagaggtgtccaatcttttgacctccctgggccacactggaagaagaactggcttgggccacacataaaatacaccaatgctaacaacagctgataagcttagaaaaaaatctcataacgtttacaaatttgtgttgggccacattcaaagctgccatgggccgcgggctggacaagcttgccctatctcacactgttccctgtcagactgtaaacactactcagaatcacacaatctcatctcggctccaagtggaagcttgctcagcaccacggccaacctgatcccactgcagatgttccaacagcctggcacgcagatggcccagggaaaagcctcatcgaatgctgaatacctgtgagatcatttcttacaaagccaaatgaacaacactatgttaattttcaaattttggcatggaaatcacattctaagacgcttcccaagctttctggaggatgctatgaattctgttttataggtaacaagtctggaagccaaaataatcaagatttaataaaatggcctcaaaagtgacaagactctccttcccttatgacagaccatgtttgctttcctttttactagatgattaactcaattctttcaacaatcctgtccagtgatgactatcttgttggctggtcagaaggggaagttccagagctggtttttgtagaaaacctcagattctttcaatcccaggccatcttatcacgtagtctaaacccttgtgtcatcacctcctgacgtttccatcagcagaggcagagctctcaccttaaagagcatgaggccaaatcactggctgcaaagcacagaacacagacatccttggccacacaagagtgagagccactgagcccaaccagggtgcaggggagcctcccagatgagaggcctgtgcttggtcccacagggtgcagccttaccgtgctgctgagacactctgcccaagaaatggctccaggattttctgaaactcgctttcaaaatatttccaagctcttatgtcttgtgtatgccttaataattgaaaaagaggtatgttcactcaagaaagggaagagcagtaagccaagtagggggccttttaccgcaattcttcctgggcagtgtctgtggaaggtggtctctccgcagaaacccaacgttttttttaactttgttttaggttcgggttgcaggtttgttacgtaggtaaacttgtgtcatcagggtttgttgaacagactatttcatcacccaggtgttaagcccagtacccaacagttattttttctgttcctctccctcctccacccccaaccctcaagcagaccccagtgtctgctggtccctctctgtgtccacgtgttctcatcatttcgttcccattcataagtgacaacacgcagtatttggttttctgtccctgcattggtttgttaaggataagggcctccaggctctatccatgttccacaaaagacatgatctgatcacttgaacctggaaggtggaggttgcagtgagctaaaatggcgccactgcactctagcctgggtgacaaagtgagactccatctcaaaaaaaaaaaaaaaaaaaaaagacatgatctcattctttttcatggctgcacagtattccacggtgtatatgcaccacattttctttatccaatccgtcactgatagatgctcatgtggattccatgtcttcttctgtgaatggtgctgcaatggacattcgcccgcatgtgtctttatggtagaatggtttctattcctctgggtatatacccagtaatgagactgctgggtcaaatggtagttctggttttagctcttagaggaatcgccatactgctttccacagggttgaactaatttacactcctgccaacagtgtataagtgctccctttaatccacagactcgccagcatctgttattttttaaccttttcgtaacagccatgctgactggtgtgagatggtgtctcgctgtgagaaacccagttttcacgatcagctggtttccactcgctgaaatcagcagactcttgttgaaaaggctgccatcttgccttggctaacccgagctgtttcctgtatctgtcatgagggtgctgagacatgtctagacagaggtgcggcacagtcaactggacaccatccatgacttggccctaacaaagcagctctcttgaatgtgtgctatgggtacaccaagtcccacttccgggggcacccagggcaggggtcagcaaaggctttctggaagggtccagatgacacacactttgggctttgcaagccactcacggcctctgtcacatcatcctgttgctgctgtgaacgaccctttaagaatgtgaagaccatccttcgcaatctggttgtacaaagacagacccacaggctggattaggtccgctgattgtggtttgccagcccctggcctggagctttgccagtgtgcaggctggatgcccagccacggctccttctgctaggacgacctctcctctatgacagactccaagatgccaccccgagactcaccggatactcactacctcaactctccaccccgcacccatcggtgaggaagagcaggcacctcagggggacagtccatacatcccccttcgtgtttcccatcgaaacacaacagtccactccacgtgggagttcagcgttctctcaggggtgggtagagcgccgctccagactcctgccgcaggggccagtgctggcccagcagtaccgggagcccctcctcctgagcacagtggcggcgcccagagcggcagacctcccaccactgcttccactggggaaaggccggggatgctcaacgcaaccttagccggcaactcaggggagagacgctctcaaacgaccgggagtctcaggggagcgacgctctcaaacaacccggagtgtacagctgccatggtcacccacgctccctcttaggccacggcacacaccagtccctgccgcctgctcccctctaccctgttcctgacccgtccctcctcagcctgacaagtccacattgcttgggggcctctataaatcctccatggcacaaaacctcccttgaccaggaaagctcccaaaggctccaagcagcaacagctgcaggttttttgcagattggtgagtacagctccacgcatcccatcctgactacccccagcggctgcatgtccacctgctgctgcctcttgcaaactatgacttgttcaaaagcaggtggggagcctgggcaacatggcgaaaccctgtctctacaaaaaacaaaaatcagtcaggcacggtggtgtgcttgtggtaccggctactccagaggctgaggtgggaggatcacttgagcccaggaggtcaagtctgcagtgagccatgactgcaccactgcactccagtgtgggtgacagaacaagactcactctctcaaaacaaaaaacaaaaaaagaaattgtccttgcaaccaactgctgtgctccgtttatctgaaaaccctgtttatctgatttctagtcctgttcacagtgctcactacgctactcattggtttaaaaaataagtcctacatcaaaccagattccaacaattccaacatactctgtccactcttaacatgttttcgagctttttttttttgatacagattcttgctctgttgcccaggccagactgcagtggcacaatctcggctcactgcaacctccgcctcccaggttacaagcgattctcctgccatagcctcctgaatagctgggattacaggtgcctgctgccgtgcctggctaatttttgtgtttttttttttttttttttttttttttttttagtagagatggggtttcaccatcttggccaggctggtctcgaactcctgacctcgtgatccacctgcctcggcctccgaagtgctgggattacaggcatgagccaccgcgcccagcccagagcttcttttgtgcagcattttctcttgctctcaatttaatttcttgctctaagggaaaagacagcaataaaaacacgcagctcttaaaaaaaaaaaaaaaagggctgggtgccatggctcacatctgtaatcccaacattttgggaggctgaagtgctataattgcttcagcccaggagctcaagaccagcctaggcaacacagtgagaccagtttctaaaaaaatacaaaaattagtcaggtgtggtggtgcacgcctgtggtttcagctactccagaggcaggcgggatcgcttgagccaggaggttgacgccacagtgagtcctgaccaagccactgcactcaaatctaggggaggagaaagactctgtttccaaaaatttaaaaaatgggcacacagaacaaagaggcagtgggactctaagagaaggtcttcgtgctcgcctggagggaacaagggttgcatagagacttgggagtcaaccaagatgtaagcagcagactgagagaccccccactggcacccattcctccacagcaagcccacagctgccctacaatgatcacatcactaccaagctctggcctgacaatctaccctagaaaggaccaaccacaccagatcacagcataagcaccccaaacccaagaagttttcccaagagagaatatgaaacaataatcttcaaagggctggtctccaaacaaaaggcagtgcagcgacctacacctaggtacgcccgagaaatgcccacacgtctccacgacactcgcaggtctgtgttcacagcagcgctgcaaagggccaaacagagaccattcaggtgtccatcagctgatgggtgcatgacccgcatgaccctgccacagggagggctgtgctctgatgcctgctgcagcaagggtgcgcctccacggcaccaagctctgccgcagcatgggtgcgccgcaacagcacaaagctctgccgtatcagacacaaaggcccacagattgtccttcacatgaacgtctggaataggcagataaatccacagacagaaaacaagactagtggttgccagggtggaaagaggatcctggaaagggagggggtgcggtcacagaaggacaaccaggggggtccttgtggtgacgcaagggttttaaggtcccgactgtgggacacaggcatctgcatctgtgatcaactgtacagaactcaataccctttccaagtaagggtgaaacagctgtctaagaccagagggtttcatcaatgccgatatacaccctaggggtgatactgttcagtgtgcaaaatgccaccactggggaagcttggcaatgtgtacaagggactgctccctgttctttcttacatctcatgtcatctatggttatctcagaagaaaacaaacaaaaaccaaacacggggggcccagcccacctcaaaccccagctgcaggatggaagctcagagaggctgggggcctggccccttcaggaagagccaggccaagaccatccagtaacgagaacgcaaaccttctggcttcagagctctcactgaggaagaatctcaggcatggcaggaagaagacacactgctgttcaactggaaaaggatcagactcagtaaaatgctctttgcattcttccccacgcccctccctgccctggagctggggtggagctgcttcttctcaggactcaggcgaggggagcccatgtccaggggtggccagcctgcactttagtgtgggcctgtgcccaactatgtggcagctctgaggatgagaagatgtttctggaaggagctgtgagccacagtgcagtccagaaggggagacaggcgtgcccggtacctgccccagccacaccctgggcccagttaggatcctacaggatcctgagccctcctgccgttatccagggcaaagatggcaaatggctcctgcaagatgacacccagggccttgaggcaaattcccccaaccaagcaaagagaagaccagaggctggagcacacctcctgctgatggaaacagcccagcagcgaccacagggccttccaggcagctcagcgtcaccgcacacatttgacaaatgaccgactgaagcctaggacgcccaggtgagctcagcatcctcccctgacctgcacccacctggccttgttcctccacggcaggacccgagagcagaagggagctttcatcacggtgactgctgtgctgggaaaggtttccatgatgctggtcagaggcagccgaagatggcagcaacctccctgctgatgtcagccccagacgacccccaggccggctcctgagtgctcagtacagcagcctctcaaaaggccaagcctccattcaccccacggcactcaacacacccaagaacagaaccctgcaggcgccacgagacgcccaagaaccaagccctgcggacaccacgagacaaccctagggctccgtcccttgcttgagctctcctagttgagaaaaatgtgtttggcaatgttatagctgccccgtctcatgacgaaggggacttgttcaggtgagaaacgttcaactgcgcgctcgcttactgaaaaccgccgagggggaagacgggacgagcgtcttgactttcagggtgcacgtaagtggctggtcccaccaaggaagtgccagaaaaagatgcaacgactctcactacctcccaacactttcgcaaatactcactgaagaaaggccacctacacagagaggcaggttcagcatgacaccactaggcaattctcacagaacagaaacaaataaagaataagaaagagatgacagacaagcaccgccagtgtccattctaccatttggtgtcgttttatgtcatttaaatcaagtcattccctgcacagacaggtgtccagctgctcggtgcatggaggccagagccacagaaggggccgctgacgccagcagcttctctctggtgcccaggctatgtggtctgtagtctgtgcaccacccacagatgagttctctcaaggaccagctcagattccgccatgctgcaggaaggtccaggcaggcgccgctccccacattcaagggtgctgtgcactccctgcccacatgacgacacccaaggaggggtgtggagggcgatgcagactcccccctgcaccccctcaggatgactagatggatatgagaggtggtctcgggtgtggagggcgatgcggactccctcctgcaccccctcaggatgacggagaggagaggtggtctccatcaaggccacgccctctgcccaggccagcaatgtccatcatgttcctgagcaaaccgagctcttccacaggaggaaagggaggtagacctggtgaccgtgtgactccactggcatcaagaggaactctactgactggcctgttacagaacaggaggctgctccatagaaatcagctggaagaaagaacccacagaggctctaaagatgggaccggtttgtcacgggccaagaacatggtgaagccaggactgagcactcacactgaaaccagtgggtccccaggtggactgaggaaccacaaggaccaccacggcgggcacccggccctcgcatgcacacacgggcaactttacaacctggcctgggaagaaggaccggcgcccactcccaggaggaaaagcagcggcagcgcacggcaagatggatcctgacactcagagctggggaaagagccacacgtcctcctgcagcccgagcctctcactgagattaagaggggctctggggcaggcggaggcggcggcagcgcccagcgacggatgcggccaccactgcagggcctgccgccggtgtggagagcccgagtcacggagccccatgctgcccctcacagcacggacggggtcgacaaggcagtggcaggcggagtgagaggcggctcagggcaccagctgcccactgagtcactgtgagaagagcgaaggccaaggcttgggaaggtttccagctgacagagacgccactgaaacatgagctgataaaacaagatgatgttggagatttactaaaatactaacattaagatattaatactaaaaattaaaatactgaaattaaaaaatgtttaaagaaagaaaaaaatttttttgaaaacatgaacaagtgcaaggaggagatggatcaacccgagctggtcaaatgctagtaaacgctgagcccggggacccaggacactgttctctcagattttgtgactgaagatattccccacgcaaagttaaacaaatgttgagagtcagaaagccaccctgtggcagggactcactgaaagttacttcctacagctcctgcaccacccgttcatcagtggtccccgtttacggaccccggaagctcccgggtgacccagtccacctcagagagtatcacccacagaatgcaagctgactggtgtgtgcctgcctacctacatacaccccgaggaaggcacagcacccacagtacgtgcgttcactgcaaggaaagaatcttccagtcaccgttcctctgtccccattgtcgctgtcataaagaactcttctcccgctgcatatcaccggggttcaaataaagcccttctgagggatgccctgtgggaatgacagaagcaatggaaaaggccttcacagatcatccaatgcaactggaaaactaagacgtttacccaagattgtgaagcaatttaatagctgaacttgaacaaaaacacctatttccaaaattatccccagataagtggtaaggctgtggtaagcggcagcatccaacacagcaacaccggacccctggctagaataacccacacagtgatacagatgcgcaggaagctcaattccaaaacacacgccttccaccgggggcaaccccaacagggagccaggccaccctctccagccacgccagcaccgccgtccacccagctgctccttcgagccgtgcacggcctgagtcacaggaaaagcccagttctgctgagtggacggctgcaaggggaggctaaatatggctcatagcagtaccagacaccagcgattcgagagaaaacatcggcatgtgactgaggctgacgtcggaagttcacattcccacgagctgctttacttcacgaaatgaaaacatcatgtaactctcgctgatgcataaggaagacctgcagaaacgctgcagacacaaccccacgcgggaggcatgcacacgacacccctcccacacctacctgggatcccccaagaacccagcacccagggacacctgacagacgcctgtgtagggttacaagattggtagaaccttattcttacttttagttagagctgctattaattgcacttgacacagaggtggggcctgagtcttggcaggcggtccacacgggacagggtcatcaggagtgaccaccaagcgggctggggccctggcccactcgacatctccagaagggtctgacgaccacaatacctgcaggacaggagctccgcacttctgcaaagccagagtggagacaacacgcaagtgtgaggcccgcagagaggggtgttaacccgagacaaaaatgatcaatagttttactggtgattttcttcaccctcccctctccccatgacatcccttaaagagatcctttattcacggcaattctttttaaaaacattaatatcagacttcaaagatttacagtattttcatagaaatcaatgagattttatgcttattgaacctagtaattctcttcacttaaaaaatattactagagagccgaggtcagcgagttatggctcaccatgtgtttttgtaaaaaaaataataataataataatcacactcacctgtttacataaaatctatgactacttctgttctacatgggcagagctgaacgatacaacaggaactgtacatccagaaaagcctaaaataccactaatcggcccagtacagaaaaagcctgtcaagccctgctctgtgagagaattcagagccgatggcctctgccggccgctgtgtgtgtgagctacactctgtcctatgcttccaggatgcgccatctacagagcaacctcaggagagctgtgggaacagctgctcgggccatctcccgcgtgctacgatcagaggagaaaagctcctccagagagcatcgggaaaagcacttcaactctgctcaggtaaggaccagaaaaaaacaggaactaaaacatgccagctgaagaactccatgatgaacgtggacacacacgtgtgcacagagctgaccccgaacaccacggcttggctgcacacggcaagtcacccatcgatttgttttcaacaaatacactgaaaaacttattagagatttgtgaccatttggaaagaattacaaaccatacagcccaggaataccgaaaaaagtcagaaaaagtatgtcatgaatgtacaaaatatatgtagatattagtctatcatttcctaccataaactatacacagattataaaaaattaaacgcttataaatacttacagactgtacatggcatcgttcagcagagggaaacgtaaacaaacgtaacgtcgcaggctcaagcagaagtgtatacaactcagtgcgggacataccacactgcacgctgtaatgatctcacagccacagcctgtgctaccgcggtgagctcaagtgtgtcggtatccgcttaaaacaccgtgtgacactaatcgtctccgcgtgagcagctggtctctccagaaattgtgtatcacagtaaacaaattatctcaagccttaagctagttgcggtagcatgggcctggagtcccagctactcagaaggctgagataaatggatcgtttgagcccgggagtccaagactgcagggcactatggtcatgcctgtgacaagccgctgcgctcccgcccaggcaacacagcaagactctatctctttttttttttggagatggagtttcactcttgtcgcccgggctggagtgcagtggcacgatcttggctcgctgcaacctctgcctcccaggcccaagcgattctcctgtctcagcctcccgagtgattacaggcgcccgccaccacgcccagttaatttttaaatttttagtagagacaggggtttcaccatgttggccaggctggtctcaagctcctgacctcaagtgatccgcccagcctcagcctcccaaagtgctgagattacaagcatgagccactgcacccagccgactccgtctcttaaaaaaaaaaaaaaaaaaaaagcctcttgcagttctcaagtctttttcattgtgtttactcaataccataaaccctaaatgacaccacagacccacacaaagtgccactagcgatgctggcagtgctcccaagaagcagagctcccaggagttgtgactttaggaaaagctaaacttgcgtgacacgccgcagcctgtgctctgctgtggatgcttttcaaaatcgataaatccagcagaagggccatcacaaaaaaagaacaggacatccgtgaagccatcaccgcagctacagcaacaggcttgaaaatttttttgtgaaatacctttttatctcactgaaaacgcagctttaaaattaattcccaaacagcacggatatatgaaaatgtgtgggtgcaggattgctataagaaaggcaaataccaatagactctagtctgattccagaaaagtgaagccattatacaacaactgaaagtaaaaggaaggggaagcagctggagaagtggatgccagcaaaggatggtttgacagttttagaacgtttggctttaacaatgtcaagataacaggagaagcagcttctgccaaccaagaggtagcagatgaggtcccagacaccatgaggaatatcatcgaggaaaaaggacatgtgcctgaacagggttttgtttttgtttttttgagtcagactcttgttccgtcacccaggctggagtgcagtggcatgatctcagctcactgcaacttccacctgctgggttcaagctattctcctgcctcagcctcccaagtagctgggaccacaggcgcccaccaccatgcccggctaatttttgtatttttagcagagacgagggtttcaccatgttggccaggctggtctcaaacttctgacctcaagcgatccacccaccttggcctccctaagtgctgggattacaggcgtgcgccaccacgcctggccctgcctgaacaggttttgaatgcaggtgaaactcccctattctggcgaaaaaaatcctgtaagaacatttgttagtaagaaagagaagcgagcactgggatagaaggcaagaagggataagctaatgctactgttttgtgcaaatgcagtagggtttatgataaggactgcctttatctataaagctgcctacctcagaaccttgaagggaaaagataaacaccagctgccaggtatttggttttgcaacaaggctggaaagaacccctttttccggactgcttccattgatgctttgtccgtgaagtcaggaagtaccttgccttgccagtaaggaactgccttaaatgttcttttgacaatgaacaatgcccttggtcccccagaaccccgtgagttcaacagcagaggcgtcaacgtggtcttcctgtccccaaacacagcgtatctaattcagcctctagatcggggtcataggacctgtaaggctcattacacacagcatgctatggaaaggactgtcaacatgggagagagagagagagagcatcatgagtgtctggaagatgacaccatgaaagatgccatcattgttatagagaaagccatgaaagctgtcaaacccaaaacaatgaactcctgctggagaaaactatgtctggaggttgtgtgtgattccacagggtttacaacagccaatcaaggagatcatgaagagactgcggacatgtgggccggggcaggagggctggggggcggggagggatgaagggtttcatttcaaaactcaagagctaagagataccacaccagagaaattagaagacaacctggtggtgatgagtgcttctgacccacaccaggtgacgaggaggaggtagcagcagtgacagaaaacaaagtgacatcagacactcctgcagaggggaggggttcccacgactcccacccgcttttaacttcttgtacaacacacacctgtctgtgacatgggcactgaaactaaagccaacagtgagggaggactgtgaccatacaggaacatttctagagaaatgacaaagcacttcgtaagttacaccaaatgcgcctgcctctcctgcctccccttctacctcttccacccccgccccatgagaacagcatgaccacccctcctccttctactcaatgaaatgatgaggatgaagaccttcatgatgacccacttccacttaatgagaagtaaacatattttctcttccttatgattttcttaacaacaccttcttttctctagcttactttactgtaagaatacagtatacaatacatacgacatataaaatatgaggggcatggtggctcacacttataatcccagtgcactgggaggccgaggcggaaggatcacttgagcccagcagtttgagaccagcctgggcaacatggcaagcgagactctgtctctttaagaagcgggaaaaaaagtgctttgtatatgtcagtgttggattaaaatgtgttgactgtttatgtgatcaggaaggcactggtcaacaaaattaaatactcggggtataaaaggttatatgtggacttgactgtaccaggggtcagtgccactaatccccaagttgttcaaggaccaaacatatataatgatttcatcaacgtgtatgtcaaccatattgattaggtcaatattgatttgtaattcttgataataatttcaaatcatggcattgaagcctaaccacaaaaacctcctcagaaaatagcaaaaacgtagagctttaaagatattaagctaaatgtacgtgctataaggctacagatacagcaggctggaaatagtctggctgagaacacacaactggccagcatgactagcaagtgctcaagtagcttctcttgtttgaagacactggtgtacacaaagatttctgcctcctgggttcaagcaattctcctgtctcagcctcccgagtagctgggattacaggtgtgtgccaccatgcctggctaattttttgtctgtgtattttagtagagacggggtttcatcatgttggccaggctggtctcaaacttcaggcgctgtggtttaaaactcttttatccatgttttaaggggttgatgggtggggcgaggtggggaagggctttccaaggctgaaaacctcttcaggggttggtgggtggggcgaggtgggaagggctttccaaggctgaagacctttttgggtcaaggttctgacggcacactggggagcgtcaagacgcctcctgcagtcgtagacaagccgggctgaggcattcactgtcgcttagaactgaaaacttagggtcgtccatgcccagaacgtcggcagtgcggaccagccccaggaaggcctttctcactggcttctagaaggtggggccggcccccatgcctgccccggcacacggccattctgggagctgctggcagccggcgggctagaaggggtgcacaccgtctgtatgtgcgtcacaggctcatgcttttttaatcctatcttgaaaacttagggctttctcacaaagaccttgtgccagttcctaagtggaacaacaattttataaaataattttaaatggctcaaatcaagtgttaccagtgaacggggctttcattatatgtcgaaagctgaccatggggaacaggcccacaggggcctcctgctccacaccctgtcagggcatccaaaaccagctcatgtaactctgctttccaggagtccaacttgaacatttttttaaagagacaaagtcttgctctgtcgcccagacagagctcagtcacggctcactgcagcctcaacctcctgggctcaagtgacacttctgcctcagcctcctggctccaacttgagcttacagttttctgctccaccactgctctctgcctcccacctccaggtgactgggacgcgagcgccccaagcagcacggaagagctccgtgcagtgcacggatttgcgaagaacgtgttggttcttgtgattcacaaagaacttggactgagtacaacgggcaaagaagatgtcagctgtatttttaacattctgttcagcaagaagagtatacataataatttcccaaaaaatataatttttgaaaatgcagaaaaataaaaaatttagaaagaaatacatggctgcagacactgaccttttcagttttccaatcatcatttctcaaaacacacactttcatctctatttaccaaacactattttctgcatctccaaacccctcaagcttcagtccaggtccaagtatcaatgggtatatatgaagctcctctgccaccagaaattcactatggaaagatgttatttctggtaccccagttgcaaaacaatgatgcctgtttttttctttttgagacagagtctcattctgtcacccaggctggagagcgatggcgtgatctcggctcacttcaacacccacttcacaggttcaagcaattctcctgtctctgccccccgagtagttggtattacaggcatgtgccacgacgcctggctaattctgtatttttagtagagatggggtttctccatgttggccaagctggtctcaaactcctgacctcaggtgatccacccacctcggcctcccaaagtgctgggattacaggtgtgagccactgtgcccagcccaatgatgccattttaactccttttctcctaagtggattagagctccctgagccttcagatagcttccttggggctactccagagaacgaccagcagtctccacctgcataagaaacgggacacagggcacgaagagcagccccaggacctgcccgctgccttgggacttgtgaaagcattttttgtgtaatgccaaacaggtctttgttaaaagacaataaccaataggagacaggcttctagatctgcagaaactctagaaataaatgaaggaaagcctgacgagtacctgcctgctttccagggaagagaagtgagcaaaggcagagaagaagctggaggcctcgtggggcatctcctgcacgggcagcagggctgcgtaaccaccacgagcactggggcttatgggaggaaggagtgtgtgcagttccggccccaaaggtgaccaggcctacacggggcaatgcagctcagaggtcgtgggcagaggacagctgaggcaggcagacggagcacgcatccctgcttcccagtgtgggcccactctgctgggcaaggttctaaggggctccgagtgaagcccctgagcacacggtaaacaatcgatccaaaaagggatgagaagggcggctgggcgaggtggctcaggcctgtcatcccagcactttgggaggccgaggcaggtggatcatttgagatcaggagtttgagaccagcccggccaacatggcgaaaccctatttctactgaaaattaaaaaataaaaataataagctgggcatggtggtgtgcaccggtaatcccagccactggggaggctgaggcaggagaattgcttgaacccgggaggcggaggttgcagtgaggcgacaatgcgccactgcactccagcctgggctacagagcgagactctgctgcaaaaaaaaaaaaaaaaaaaaaaaggggtgagaagggcaagcaagagttcagactattagaagcaagacaccaagaaactcccagacaccaacacctaccagtttagggttattgtataaggagcaagagcttttcacattgtaacagccccaacattaaatcatcaataaaaagcaaaatgagggtaagcattctagtttataaaacatgcactatgattttctaattatccaaacaagtaacttacatgcgatgatacgctttccaacaagaggagaacgatgaaagctgtcaacatcccccaacatgcctgtcacaaatgcgcatcacagaaacccaccttcagaactctcatcaggaaacagatgccctctgctactcacattcagactggagaatacctgtcagcatatacacccctccttaccgaatttatacactttgtgaacaagtgttccccgagcacattgaccccacgcgaatggggggaagaggtagaggtcagatgagacccaggagggcataacttacagcctctgccacaggccactcacgtggtgaccacagtccagccgactgcactctcaggctgtgacctctccacggggctcagactgtatctagttctatcttcaatgtagtgtgtctgagatcgtttaactaaaagtgctttacaaaccgtgcaagcagccagcacgactgtccaggcccagggaaggtgatgggaaggagccagtgaatggggcccaggcaggcgccaccagaacgggcgagggggacgcggcctcccagcagctgggcacacccaggggacagagagtctgctcccacccatctcctctttcccctggagcccttgaacccatcaaatggatttaaggccactgaccagggcaggagtgacccaagcaaagttaaaaggtgtctagaaattccttgagcctctaactgcatcttaaactagacagccaggcacccgaagtctagaaatatatatatatatatttttttaaagacagagtctcgttctgtcacccaggctggagggcaatggtgcaatctcggctcactgccacctccgcctcccaggttcaagcaattctcctgcctcggcctcctgaatagctgggatcacaggtgcgtgccaccaagcctggctaattttttgtatttttaatagagacgggatttcaccatgttggccaggctggtctcgaactcctgacctcaagtgatccaccttgatccatccacttcggcctcccaaagtgctgagattacaggcctgagccaccacacttggccgacaaataaacaattccccccctccagtagatggggtctcactatgttgcccaggttggtctcaaactcctgggctcaagtaatcctcctgcctcggcctcccaaagtgctgagattataggtgtgagtcaactgtgttcagctgaaataaacgtttaaccaccaccttgacatcatatccaagaaacaaaagtagagtttcctttgtttgcccattttttgagacagagtttcactcttgttgcccaggctggagtgcagcagcatgatctcggctcactgcaacctctgcctcccaggttcaagcaattctccagcctcagcctcccgaggagctgggattacaggcgtgagccaccgtgccaggcttgtaaagcgtaacttttaataaaggtagttattcaattatgccatgtcatatacctctctcgtctggattcaactttcacaccactgtaatataggttttaaaagctgggtgtgctggctcatgcggacccacagcctaaggccaaacagccgcctgtgctgctgagtaaagggagcggtgcgaggtcacctcagggaggaagagggaggagccacaagagcaaagtgttcagctggctgaaagctcaagataaccggctctgccagaagcactgccattaggatttccagggaacccctcctagccatgcctgcctggctgctctggaggggcagcagcagccccataccaacgctgacctcctgagagaacaagacgaggagatctgtgccatggctgtccccacactctgggagaatgtgagttcagaaaggcgctgtatctaccctccctgatgggctcatttctgtctcattcaaaacctcggggccatgtccagtggacgctgctgcctcctgtgtctgcaagaaggaagagccatgaagttcccatggaacaaagcacggccaggaatggccaaagccgaagagcctcccatggtgtcacgtcgagcccctgccctcggaccagcaacgcagcagacgtcgagcccctaccctcggaccagcaacgcagcagacgtccagcccctgccctcggaccagcaacgcagcagacgtccagcccctgcactcggaccagcaaagcagcagacggaaagccaagaaggcccaatgccaagagcccaatcatgatagcacccagagggcaaaggtgcagactcctccctcactcccacctttcccaaacaccacctccaagctccagtcatacctctgtctcacaaacacccgctagggccttgtcaaactcacctcccactgacgaaggcgcttcacaaaagcatctagcaagataaagaatctgaaactgggaggctgaggcaggcaggtcacctgagctcagcagttcaagaccagcctggccaacatggcaaaaccctgtctctattaaaaacacaaaaattagccgggcgtggtggcaggcgcttgtaatcccagctactcaggaggccgaggcagggagagttgcttgaacccagaaggtggaggttgcagtgagctgagatgtgctcctgcactccagcctgggtgacagagcgagactccatctcaaaaacaaacaaaaacaaacatttctcaaggctgggcacggtggctcacgcctgtaatcccagcactttgggagaccgagttgggtggatcacctgaggtcaggagttcgagaccagcccgtccaacatagcgaaaccccatctctatgaaaaatacaaaaattagctaggcgtagtggtgcatggctgtaatcccagctatgtggggggctgaggcagagcagaacgggatgggatgaaatgggacaggacaagatgggaatgggacgagatggaaatgggacaggatgggacgacatggaacaggatgggatgggactgggatgggatgggatgggaatgggacaggatgggacgggacgggatggggcaggacagagcagggcagcttctgcaggaaggagcctctgcactggcagtggcactgacggcttcaaaggagctgcgaagacacaaactacagaaagaatagaactcaattcttccctccttttacctcaatcaggtggccttttggtcttactgtatttttggcaacctgtatttagcacctacagaaaaagcaggcccactagacagcccaacaacagaaccgctgcaggtgagaacatacgtgtgtaagaacatgtgtgtgggagcacacaatgagaaatagttttcttttttttttttttttttttttttttttgagactacgtttctgtcgcccaggctggagtgcagtggcacaatctcagctcactgcaacctctgactcctgggttcaagtgattctcctgactcagcctcccaagtagctggaactacaggcacacaccaccatgccaggctaatttttgtatttttagtagagacgatatttcaccatgttggccaggctggtcttgaactcttgacctcaggtcctccacctcccaaagtgctgggattacaggcgtgagccactgtacccggccttgagaaatggtgtttttttgtttgtttgtttgagatggagtctccctctgtcacccaggctggagtgcaatggcccgtctcagctcactgcacaggtgtctgccaccatgcccaactaatttgtgtatttttagtagagacgctgttttgccatgttggccgggctggtctcgaactcctgacctcaggtgatccacccgcttcagcctcccaaagtgctgggattacaggcgtgagccaccggacccagcagacagaaatggttttctatggcagagcagactgagcccgtccacaagccagcaccgggcagagggaagggcgccagagacaccgagaccctgtgggtatccctgtgtcagagcctcaagctgctccctaccaattctccaactctactgagtgagcaagaagacagtcaccatattcccaacacaacacactcacgatgatgcatttccacatttcactcaaatgctttaaagatttcaaaactacgaattcactttaggtacagtccatcacgtacagtctgcaaagaaaaccccactcagcaccactttcacgtctgacgacagaaggctaacgtgagtggcagtgagaccgtgccagagcctgcctgcctcacccccgccgctgcgcagccagaggccggggattaggccagacaccagcggctcgccaagagctccatttgtgaccgttccctccgtaggcaacccggtggtccccactcccaggaggtcaccacacggatgccaaacttagcacacagcggacagcagtccagaactccctggctcaagccggcctcccgctcagcctcccaggtagctgggaccacgggtgtgcgccgccatgcccgcaaactgggtccaatttgtctgcaagagaagcaaaggggatgccagggcttctcctattcctcagattttcgtttttaagtaaagtcattacagattaagaaaatacaataccggcttccaatgaacaattcatcttttaatgtaagtttaaaacaaaatggaaatccacactacaagttttccattaacataatgaccaaataaaaaatgactccatgttaaaaatcagtcactttttttttttaaagcttgattattaagacagacaatgcactaattctcccttctgagggcagcacgaccaattcccaacgttactcgtgtgtccagggaccgtccacactgccctgctgccccaccctttacccaaggagacgccagaaacccagccactggtccctagcaagaggccctcttttctcaccagggacagtggaggatagaacccggcacacagcatgagggtgtgggggaaagggggctcttctctggaaggatggcagtggcccgcaacgaccttgcatcctgcaagatgcccgcggggaggagtgtatccaaaagcaccctacaggacacgagtcaagacagaatcacaaatctcttctcgtccaggaaacttgactcccttaccttctgctaggtggaaaagcagacacgcttataagctactcaagttttttattaaaaccattgactgttggatttcatcaatccaaaatagcactgtagaatccttccagatggcacaatgacttgtaaacagcatctccataaagcagaagcctgaagactcagtcctatcacagccagagctgtgtgcgaacagacaagccctgagaagtgtgccagcaagagaccctgccccagctccccacgcctcgaccaccgagtcaagggcatgaagggcttggcagtgagggcaggagggtggccccaccctgggagccctgtatcgactgggtgctctggaggccgcccgtggtgacaggccagggctgctttcagacctcctggaaggtgcaggagccacagaaggccccagtgacatggaggaggtgtctgccctgccaagagcagcgagggtgggagaggtaggtcacacagccaccaccaaacaatggtgaagaaggcccactaaggacactgctcagcaaggaaacacacaggaagatctggagtgccaagttaaaaaaaaaaaaagcatctctcaagggagaggcctgaatggtgggagtgcccctcgaacagaaggaaggggctgcgtctgtggtgaggggacagcagagggatagtcaggcctcccactctgcaccacaggtctgtgaagtttctattaagactgtgcttgggccgggcgcggtggctcactcctgtaatcccagcactttgggaggctgaggcgggcagatcacgaggtcaggagaccgagaccatcccggctaacacagtgaaaccccatctctactaaaaatacaaaaaaattaaccaggcgtggtggcgggcgcctgtactcccagctactcgggagactgaggcaggagaatggcgggaacccgggaggcagagcttgcagtgagccgagactgcaccactgcactctagcctgggcgacagagcgagactccatctcaaaaataaaaaaagaaaaagaaaaaaaaaaaaaaaaaagactgtgcttggccgggcacggtagcttgcgcctgtaatcccaacactttgggaggctgaggcaggtgaatcatttgaggtcaggggttcaagaccagcctggccaacatggtgaaaccccgtctctactaaaaattcaaaaaaattagccaggcgtggtggtgggtggtggtcgggtctccccaactactggggagactgaggcaggagaatcgcttcttgaacccaggaggcagaggctgcagtgagccgagatggtgccaccgcactccagcctgggcaacagagcaagactccatctcaaaaaaaaaaaaaaaggactgtgctcatctgttaggttccttttttaaacttcagacttacaaaaaagttgcaaaaatagttcagagtccctgtacagccttacccagcttccctaatgctaacatcatacataaacataaccacagtgaaattatctaattccaaaatcagcactaacaccagactattcaccaccacaaagacctgactccgacgcaatcaccctgctccagggcccacgcgggtggtgccgggtgctctcttctctccatgaggctgattttttttttttttttttttttgagacggagtcttgctctgttggtcaggctggtcttgaactcctgacctcgtgatctgcccgccttggcctcccaaagtactgggattataagcgtgagccaccacgcccagcctccatgaggttgatttttaatgtcttgaaaatcgacacggaatagaaaataagcaagatttgcgtttccctgtggtgctgtcgaacgcacacacgtcacaaaaaagcccacgagatgacaaaaaagcctgaatgctgcatgtgtgtctctgactgggaataaggatcactggaaaatatttgcacctgagaagatggggctgaaggaggctgcatagagcaggagccctgcgatgagccggggacccccttggaggtttagcggacaggacgtcatccacacaaagaagagccggcaggtcccgggctcacacaggtctggaatggtgccactgcccagccagatccctgtccgcagccctgggaagaaggttctggaaggcactgccacagcccggggaatgatgaacccaaaactgaaccaagctccagcctgtctcacaaatcctaaaagcaacagctgaaagggacaaaaaggttccaaggaactatgtggatcccagaacaaagcccaagatgacttacaggaatatacaattatccagcacataatgaggtaaaattcacaatgtccagcatcccatcaaatattctcaggcatggaaggtggaacaatttgagcaaaaaataaataggacagcaatggattacagtgctggagtgcagtggtacgacagcctccagggctcaggcaatcctcccacctcagccttctgagtggctgggatgacagatacacgccactacgtctggctaatttttttttttttacttttagtagagatgaggtctccttacgttgcccagtctggtctcaaactcctgggctcaagcaatcttcccaccttggcttcctacagtgctgggattacaggcgtgagccaccacacccgacctacaactttgctgtaaacctaaaatttttcaaaaataaaaagtatattgaaaaaaattcctgggcatgtaaataagaaaatatgattacataggagaaaaaaaagtcaatcaaaagctacccagaattgacacagaaggcaaaattagtagatggagacatgaaatcgtgtaactcagttcctccccacggtcaaaaactaaaaacacggaagctaggaaaagacactggaatgaacctctagagatgaagatgacgctgtgtgagacgaaaatcacactgggtgggattcacagaagaacaggcattcagaagatctgtgaactcagagaaacggcatgtcaacaactcaaacatgagcaaaaacactgagtgtggcagggagcaccgagagagaagatcactggggcaaacaccgagtgtggcggggagcaccgagagagaagatcactggggcaaacaccgagtgtggcggggagcaccgagagagaagatcactagggcaaacaccgagtgtggcggggagcaccgagagaaagaagatcactggggcgaacaccgagtgtggcggggagcaccgagagagatcactggggcgaacaccgagtgtggcggggagcaccgagagagaagatcactggggcgaacaccgagtgtggcggggagcaccgagagagaagatcactggggcgaacaccgagtgtgacggggagcaccgagagaaagaagatcactggggcgaacaccgagtgtggcggggagcacagacagagaagatcactggggcgaacaccgagtgtggcgtggagcacagacagagaagatcactggggcgaacaccgagtgtggcggggagcaccgagagagaagatcactggggcgaacaccgagtgtggcggggagcaccgagagagaagatcactggggcgaacaccgagtgtggcggggagcaccgagagagaagatcactggggcgaacaccgagtgtggcgtggagcacagacagagaagatcactggggcgaacaccgagtgtggcggggagcactgagagagagaagatcactggatcaaaccccgagtgtggcgtgggtgaggtgcaggagcctaaccaacggtaaggggtgctcccaaaggaggtggagggcagaaaaaaatacgtgaaggaataaagcctgaacatttccacattttgatgaaaactgtaaactctagtgatccaagaagctcaacaaatcccaatcacaaaacatggagaacctgaccaaggcacatcacagaggtgaaaagaaaatcttaaaggcagtcaaaggtgagaaactaggtaaagaagaacaggcaaaagggacgacaggttctcggggaaacagtgagcacacagccaggggccagcacccgtaagtcctgcagaaaaacacctgtgaaaatctttcaaaaacaatgctgctggtaatggttgtctaactctggggaggaggttcctggagctctgcgctgctccccacatgccctgccctccgcatctgactgtgcatatcctttgcaaaatcctttccacgacactggtgaacatgtaagtgtcaccctgatttgtgtgagccactctcataaaattattgcaccaggctgggcgccatggctcacgcctgtaatcacagcattttgggaggccgaggtgggtggatcacgaggtcaggagatcgagaccatcctggctaacacggtgaaaccccatctctactaaaaatacaaaaaattagccgggcgcggtggtgggcgcctgtagtcccagctactcgggaggctgaagcaggagaatggtgtgaacccggaaggcggagcttgcagtgagccgagatcgcgccactgaactccagcctgggcgacagagcgagactctgtctcaaaaaaaaaaaaaaaaaaaaatgattgaacccaaggaggggtcacggaaccccagattcagggcaggtcgctgagaagcacagccacaggaacccagggcttgcggtgggtgctggagtgctggcagtcttgcgggactcagtcctctccctggtggaccccgtgccgtctccaggtagacagtgtccaggctgcacgggattgtgggacacccagctggtgtccgccacagaactgactgcctccctgctgctgggcagaaagcccacacaactggtcacagacgtcttttgcgttttctgtgttgactgtcgctgtggcatgagagcaaaggaaaaatctgagttttccccctcagaacccctactaactgagcttagaaatacatgaagtcaagctacacagacagatacacaaaaccacaaactcagtaatgattttaataccctgttctcaatcactgagaggacaagctgacagagaatcagtaagcacacttgtaagaagtaaagcagaggttcctcttcaaagactttcctccccatctaactaaaaataaatagtaacttctcttaaaagcaacatttattcaaagacctgtactgacattcttaaatatctgctagccttaataaagaaatcaatgtactttatgttcttagctcccacaatttagcctaaatatctgccctggcatgcttatactggtcgaagcaagcattaggtcacggcctgttcctcttccttagttgaaggtgtttttacctttctcagcattccacaaattacttcctccttcctttgttctcctctgcctttgcctcttttaaaaagttctaagttgctagccaatcgggacaaatacagaatgtgaggtcccgttccagccaatggaaaccggacacagcagttggtataaaaaaaccggacacagcgtcaggttataaatgaccctggtctccttcattcggtgtactctcgtggcaaaactgcaggcgagtgtaccctttctgcagaaggtataaaaaatggccttgctgaggaaattaaatttacgttcaagtgctatttctttacggcaccagggagcaagcatttcaaacacactgatggcccattcctgaaggatcacaagaagctaaaattcattacctgtataagggagtttaagttagattttcacccttttcatgttttcttacattttctacaatgggtaaacgatggaaataagaaaaacaatgtttatgttttgaaaatgtctcaatgggtctgccagttcatgttttccatgagcagcactgtgatgccacgctgagatgctccagggtccatgcagttcaagaacatggtcgtgatgtgttgaagcagacctgtcttggttgtccctcagatcccagctacagaagttaacgatcaactcagcatctgtaatgcacttcggatgtcagcctacaagagcagacccaatcaacatggttgagttcacagacaacggtatctaggatgtccggcacacccagaacctgcacttaagcaaactcgtggataggaagtcccccaaggctgcttttctctaaacactaggttaggaaaaaagaaaactgggaatacatttaaccgactccatcaactacataagaaagcacctttgagagtgaacttgtgtctaatcaccaccttgggacctgcctgcatctgaaatgagtgagtgatctacagtcaccaaggccctttctgtttccccaaaaattccttttctaaactccagcctatttcttcacattctacttcttattcaaggcctatgcaaatgctaaccctcagtggagcctccggcaagcccagtccccaggaaacacggtctccctccctcttcttcacctgcataccttctctcacaggagcctctggaagtctccctcaggacctggcaccttcttgctacatcataaataccttgagagcacgacgccagcctcattcacctgttcccacaggtgacatggctcccaccctgggaccaagagagtccactgtacacattaaactttagtttcctcttttttttactttttttatttttattttttttttttttgagacggaggcttgctctgtagtgcgagaccactcaggcaggtggagtacagtggcgcaatattggctcactgcaacctctgcctcctgagttcaagcaattctcccacctcagtcccccatgtagctgggattacaggcgtgtgccaccatatccagctgcttttttttttttttttttgtatttttaataaatagagacggggtttcaccatgttgcccaggctggtctcgaactcccgacctcagagtgatttgcccgcctcagcctcccaaagtggtgggattacaggaggaagccactgcgcccggcctagtttcctcttaggtggagtaatcacgtccacctcagaggatttgtaagggttagaaggggaagcagccgggccgatggaaacatgcaggaactatcccagctgggcctattgcccttcattctggaatctggcagagctctgcatggcatctcgcatgaaacaggctctaagtatttaatgaataggaggagacatgtcagacagtgggaataatcatgctgatctgcatgaggaaaatgtgtcaaaaaacaaaagccaaaaagtcacgaagaaagtgcttgtaatagagactagtttacttgtgagggctacgaataagtgaagctcaaaccactaggtgccaaacatgaaagtgggttcccagaccccagtgtttgctgactgcaacacagcggtgcctgcagctcacagggtgctcctccccgcctccctagccctcctggagactccacccatcacagtcccaggttccaggcaggcttcccaggccactcagctgctgcaagcacaatgtcctcctgaggtcaacgggcaggtggcaggagcctctgacctgcttccctccacgacatgggcacgttctgggactgcagttccacagtggtctcccatgtccctggaaagcagccgtccgcctctcctccacacctgccacactgctctcactcatcaggaaacttctcatcagaaaaacagctcgtgggccaggcacagtggctcccgcccgtaatcccagcactttgggaggccaaggcgggcagatcacctgaggtcgggagttcaagaccagactggccaacatggtgaaaccctgtctctattaaaatacaaaaattagctgtgcgtggtggcaggcacctgtaatcccagctactcgggaggctgaggcaggagaatcgcttgaacccaggaggcggaggttgcagtgagccagtatcgcaccactgcactccagcctgggcgacaaaagcaaaactctgtctccaaaaaaaaaaaaacaaacaaccttttgtggaaaaacgagtgtattttccactcctcgtctcaataaaacctgcgaagactgctttcatatacaggagtcgtgttttatgacaaaggctccatcaaggatgctgtaaaattacacacagccatctccataatatatggccccgagagttacacacatgaggttattgagttatttttcaaacgtccagactcctcatttccaattaaggcaggttggctgtagcactgttggaaagcctaaagctttgtttgcagccaattcagaggcgacagtttttccaaggctacttagagctgatgagagaaccccctgttaaaaagatctccaaaccagcaaatacatcacggtatgattttaagtcactgcaatccagatcatcttaaaagttctgcaggatttggaaaaacaaagacaaattattaaaccaagtgaccaggctgaagcacaggacaagatgaaagagggccaagaacaggcaacaccaccactcaaacgatccaagagactcctggtctaaaaagttagaggcttggtcaattttaaggcagcgtcttaacagaaagaattatgcaagccaagtaaactggctgagccccagggaagggctgcgtactgccagaggaatgggctggactctttccagctccgtaatcctgggagcagcgtcggtgtggaaggaaccctgacggcaagctgttacataagagcccagtcctgcactgcggggacatggtccgcttgctactggcatgcaaagatcaaagagaggagacagcgctgggatgccagcccacggctgggacacgtgctgcttctgtgagcatgcgcccaggaacagacgcacagacccacccgaacggggaaccgaatcttacttgtccatgagaatcccaggaggggaccaatgggccatcacattggaaccctctgaaactgcacacacatttgcaagcataggtatcaggggaggtaagtgatacagactcttctaagggtgtgaaatgtttgaaaagttgtcaataagcacacagactgacctgattcattcaacaacattttctcacccagcacacagactgaatagcttggtacacttgcttcccaggtgtaaaactacctgcttaataacaatgccttctcagctgggtgacaccgcactgatgagccagttcactggaggactgctggggtggtgcggcaagactgtttcaacgcactacgtcccgagcacgcagcattcatcttgtgcatatccttcatgacaaaacaagtatgcacaaagcactgctgccgcacaccagacacagcggcctctggacaggaagcaccaatcttcagtcaaagaatgaccgaccgacatgcaaactctggttgttcggacatgagtactggcagatcatttctaaaaaatgaaggaaagacagctgcaagttcagccagaacacctcaacaacttgttgtcaatgtgaaaattcaagctttcaaagataagaattttggaaaactccaagagcagacagcttctgaagaactaaaagtctccctggaagagacaggtgctgctttctgatgtagtaaaatcaagtggatccacgtcgggagatgcacacgagtcccgggcacccaatcggcccttgggtgcacactgtgtgctgacctgggtcacctccagatgtggacacacaggcacactcccacacacacgcgacggagccgcactcgccgcaagagagaccaaagggaagccctgagactcccctgctgctggaaacgctcacagcacaaacacctgctgggttttggtgtcgtatcaatgaaaatctccataattatatcaaaaagctatttattaaaaatatgcttccattttcccactagattttttttttgtatacttcaactagaacaacatatttaccacagactgatgcaggaacagcgaggagaaccctgctgtcttctatgaagccacacattaatggggtttgtacaattttaaggaaatgctcctctaattgctatttgttgttgttgctgttgtttttgggacggagttttactctgtcgcccaggctggagtgcaatggcgccatcttggctcactgcaacctccgcctcccaggttcacgccgttctcctgcctcagcctcccgagtagctgggactacaggtgtccaccaccacacccggctaatttttatatttttagtaaagacggggtttcaccatgttggtcaggctggtctcaaactcctgacctcaggtgatccagctgcctcggtttcccagagcactggtgggattataggcatgagccaggggacttgaccagatcactaattttttatactggaaaatacaggatttttttttttttaaagaatgtgctgcttatatgcaatgggcttattattcctgttgttaattggaattggtatacagacattttccaatccttcaggtttcaactggcaaatgccagcagacatacccacagagccagagctcctcaggctcctccacgtccaacggcgtctcacagtcctgaggatgaggacctgggtgaggggagcacgggagacacagccatcaaggcatccacctccaggacagacaccagccaagaaccccctcagggcaaggcctctcacaagtccaactccacggattccaccgtaagtgctgtcaactggatgcgcatttacaaaatctgagttttctcaaagaagctgaagctttccgtgtcctcagtgattctggactcccagcgccgtaccactccctgccagccacacagggggacccacaggaagcaggccttccccgtggcgggccttgctgctatccgcgctcctttctgtgcagtcgtccctgacggggaagggttgagcccagccaagtggatccctggctgcaggacaaaggtgtgcatggcaaggggcccacctgcctcaggctgaggcataaactttcccttttcactcaggaagggtaagacacagttcccagttttacagtgtgcttttgtggatgctgacccggtactgctcttggaatgtcaagatgaagatgatgcagaagcctctcctctgagcatcttctgattgacaggcaagggactggagtggagcccttggcagcaggcggtggccagggacaagcggcccgtgccacgtctcccagctagctcaccaccagcacacaaaccttcgtcctgggcatgggactctccatccctggtcaaagcaggtgcctcgggtggcaacacaggaccctcagacactgatctcctgttgttgaatcggtgcaatattcacccaccaaaaacaaccacaaagcgcctgtcaccagtgacaatgtagcactgtctatgtgaataaaattaaattgtgtttggagaatctggtgacgctgtgaaacagctgaagattacctgtaacctcagcgctctgggaggctgacaagagggacactgtgaaacagctgaagactacctgtgacctcagcactctgggaggctgacatgagggacactgtgaaacagctgaagattacctgtgacctcagcactctgggaggctgacatgagggacactgtgaaacaggtgaagattacctgtgacctcagcactctgggaggctgacatgagggacactgtgaaacagctgaagactacctgtgacctcagcactctaggaggctgacatgagggacgctgtgaaacagatgaagattacctgtgatctcagcactctgggaggctgacaagagggacactgtgaaacagctgaagattacctgtaacctcagcactctggaaggctgacatgaggactgcttgagcccaggagtgtgagaccagcctgggcaacacagggagaccccatctcttaaaaaaaatttttttttaacaaaacaataaaaaaacaaaaatagctgggtgtgttggcacctgcctgtggtttcagatactcagggggctgaggcaggaggaaggtttgagcccgggaggttgaggctgcagtgagctatatgactgtgccactgcactccagcctcagtgacagagagagattgtgtgtccaaaaaaaaaaatcccaatacactgttagtgtctcaagcccaggttagaaattactcgtctagtctctgacagaaaaatcaggtgggctaagcaaaggtgctttctggcccaggagtacagatgcagtggcaggcacatggctcagctggctgtgcacagccacccaggatcctggggcagtctctggacaaggcctcaaagaccccagacagactcccatcatccctctctcccatcagcatcatcagttttttaaaattgttaacaagctccatgctctgtgagacgcagtttccaagcaaggcattttcagtgttgcctcaacagaaactgcatcatccctgaacactgacctcctgtcacagcccaggtggctccgaacacggagcaggagcatgatgacacagcacgagtccacgcaaggacacctcctcatcaagacaagtcagaggcagaaccgagttcaggggccagtggctggctttgtttattcttcatttatccgtaagagaagcccagagagacaactacaagtgacccaagacactcataggtgagtggattaaacacccggcgtccatccagacaacagaatattaccaggccctgaaaagacaaaaaaggaccatagacgcatgctgctgagtgaaagcagcccgtctccaaggactacacgctgtacggttccgactctgacatccaggaaagggcaaaaccgtgcagacagcacaaagatcagcgaatgccaggggctggggagagggagggacggagggatgtgcagcaggaacacgggggacctggggcagtgaaactactctgtatgataccacaacggtgggtccacatcaggatacgttcatccaaccatagactgcacagcacccggtggaccctgaggtcgtgcggcctgtgggtgatgatgacactgtctccagggcggtcgcgactataacaaatggccgctcttgtggggatgctgagcccaggggtgcgggggaaccctctgtaatttatgttctattttgctgtgaacctaaagctaatataaaaaataaagtctactttttttaaagtgaccatcctgtcagaaagacaaaatggtcccagagcacagggcttggattcacacagcacagaatcggctcccagagcacaggaaggtccagtgcaccaggaccaagaagcagagtaagccgagtgacacaagagagggcagcctctgccccaggcttcctgcgctgggggccggtcatctgctgccccaggcttccctgcgctggaggccggtcatctgctgccccaggcttccctgcgctgggggccggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggccggtcatctgctgccccaggcttccctgcgctgggggatggtcatctgctgccccaggcttccctgcgctgggggccggtcatctgctgccccaggcttccctgcgctgggggccggtcatctgctgccccaggcttccctgcgctgggggatggtcatctgctgccccaggcttccctgcgctgggggccggtcatctgctgccccaggcttccctgcgctgggggccggtcatctgctgccccaggcttccctgcgctgggggatggtcatctgctgccccaggcttccctgcgctgggggccggtcatctgctgccccaggcttccctgcgctggaggctggtcatctgacgggaacccctgcagccacctggaccagctgcacacaccttggacgcctgtcgccctccaccctctgcagacaccctctcacaggctccaccctgctcgggttcacagacacatcccccgtctgccccggggctgcctggcatggcacccaagaccaagatggaaagggaggccccgcgtgtgggtggacaaatccacaacacgctggccctcaagttgtctcagtaatgttatatatttctctctcccccccacccgccctccccctccccagagggagtcttgttctgctgctcaggctggagtgcaatggtgtgatctcgactcattgcaacctctgcctcccaagttcaagcaattctcctgcctcagccttccaagacggccgccaccacgcccggctaacatttggatttttagtagagaccgggtttcgccatgttagccaggctggtctcgaactcctgacctcgtgatccacccaccttggcctcccaaagtgctgggattacagcacgagccactgcgtctggcattaaatttctctcttgattatgcagccactaaatatcacgctgggataatgggaaattaatgctaagctttaaaatgcagaatgtgaagccttatatccagagtaatccttattttgtaaaaagtacatgatatattcaacattttagatttacatgttttatcttgggtggaaggattacaggcgatttttactttcttctctatgctttatttactggtgttatgagttgaaatgtgtcccccaagaatggtatgttgaagtcctagccccccaacaccacagacgatggccttcctgggaaacatggtctttgcagatgatccaggtgagatcgctagggtgggccctcaccccacagaactagcttccttctacaaagggcagacgtggacactgagctgtgcacgcagggagaacgctgggtgaagagggaggcggagatcgtggtgatgcgtctacaagcccgggcgcaccagagactcccccatcccccagaacccgccgggcacaccagagactcccccatcccccagaacctggagagaggcctggagcagatgcccgcccccacccctccagcaccgcagaaggaaccggccctgcagacagcttggtctcagagccgtgggagaacagatccttgctgtgaaagctcctggtctgtggtgatttatcacggcagccccgaaagacccccacaccaagtttcactctctgtccatggacctctttaatggaaatcctgacttttccataaggcactgaatctgtgtaacttttagagtaaggaggacgacctacagttcactgcatgaaagcacagcccttccaacaaaggcaggcgaaatgtggaaccaattatatctgggtgcctacacgtgacgtacgccagttctttgtagaaagaacgaggcttgtctcagcgatactaatgtacagttcacatgaactcctaaccttagccagccacaataaggtatctgggattgagcgcttatttaaatcggtaggcacatcaatttaaatttaggtagtagctcagcctgtacctaacacatgaggaagccgaggcgggaagatcggttgactccaagagttcaagagcatcctgggaatgacagggagaccccgcctctagaaaaacatttaaaaattgctgcgtatggtgccgcacaccagcagagtcccagctactcgggaggctgaggtgggaggattggttgagcctgggagttcaagccttgagtgagctgtgggtggggggggcagcactgcagggtgaggtgaagggggtggttctgcgggaggaggtgaggtggctctgcgaggttaggagagggggcaggggctctgtggggtgagatagggggtatctgcagggtgaggtgaggggacagctctgtgggatgaggtgaggtgggggttctgcggaatgaggttgggggggcggcactgcgggaggaggtgggcggggtggggcctgcagaccctccaggctctcccgggggaaggagccccatcagggccagcactgcgccactcccaacaaagcaggcaacctagcctgccagtggagacctcttttccgcctgggctccagctctagagcaaggccagtcacctcagccccaccatcaaacaccaggctccacatgggcactgcctcgctcaactgcgtggtggcgggtggcctggaacgctgctgtcatcactgcacgtggacacatcatcaacctctcagcgtgacgtgccctcgtgctttcaggtaaaacactacagagaaacttcctgttggcaggtggaccccgcactccctagggcctgatccgctccctctcttctgctttacgggcactgacaggaagtatctgatgcgcactcactcacaccagccacgcacatgttgtgagcaatcctgtgtggcctgctcccccctcctgaccggcccctcctgactggccccagcaccgcgtggaagaacatggaggagctcatctgtctgaggataggaagcagcagagcacacgcaggtgagggcagagcggggaacccaagtcccgaggaagtttctcagtaagcgaggccccgcgctctgggagggcacccccaggaagcccacacataaagcaactggacacacgctcaactacgactgggcaatgacagtagcttaaaaaaaaaaagtacaccaccaaacagacaaagaccagagaccacttacataaaagccctgctgcctccccgggaagggatttcaaaacacttctttaggtgagcacgacagcacgtgcctttaatcacagctactcaagaggctgaggcaggaagatgacttgaggccataagtttgaggccaatctgggcaacagagcaagcccacctctaaaaaagtaaaaataaaaaaattaggcgggtgtggtgacatgcgtctggagtcccagctactcggaaggctgaggaaggggcatcatttcagtccaagagttgaggctgcagtaagccatgactgcactccagcctggtcaacaaagcaagacttgtctcttaaaaaagcaaaacaacaacacatctttatattatagggcacagaaaggagcaagattataaaactaaaatagggtgaaagaatgcaagagactcagaactatggcaaacttataactaaaattccaaactacaggaaactctcagagcaaacgctgcatcacataagctgctagcccggcacatgattgtgaagaatcaggagtcctctcagcaccaacagacagtcatggacacagcccacaggtggctcgacccaccagcctcaggcagcatggggttgagaggggaagcccagtttggccgactgtagaaccctgttctagtctcctatccaccctcaccaaggcactaaatcaccagcaaagactctgagaacatcaacatctgtgtaactaaggaaaatggaagtgcaggaaggaatacatttttgtaatcaaagggcatgaaaaaaattgccttcactgaaaacactgaaaaggtacaaccctattatgtctcctgctaggaaaaattttcctctgcttttaaaggattaatagccacaaaatattattttgttattctggtgtcctccagaaaatgagccaacagtttgaagggtatggggtaaagagaagagaaggaaaagctgcttttgaaaacactgttgactcgcaaagttaccagcactctatcaggctaatgcctaggtcaggagaagacagacgcagtcactactatggatcctgagggcgagaaactctggatgccacaaagtggcatgttcaaccttcctacaagcacacagaggtgaagcctggagaacaggcagggacaggcccagctggccatgtgctcagccacgcctacctcgcaaggtcattctgaggatgaaggcatcatggatccaaatgccaccttgacgctgaatgtactacacaataaaagaaccactgtaaatcacactattgactcttgcttggttgatgttctttcctttacagtaaagtgaactcgtggacaaacatcgtgtccacagaccaccataaatgtagtttgttgttttaaataaaactgaaatcagacttccaaaaagaaacatctaaaaacttctcctctcccatcccaccagagccatggcccacaacacagcccgacgccccgtcacacgctctcacaggacaactgcccacaccagttaacctggtgtcacggtggaggcgaggttgcggtgagtggagatcacgccattgcactccagcctgggcgacagagcaagactccatctcaaaaaaataaataaataaaaaatcttgtggaaggaggtaccacatatgcggtctgttgtggaacaaaatgccgttacgtggggcatgactgtattctgtagggcacatttgcaaaacagctcctctagtcacataggtaactgtttttgagacaagttctggctctgtcacgcaggctagagtgcagtggtgtgatatgagctcaccgtagcctcgacctcctgggctcaggcgatcctcccacctcggcttccccaactagctgtgactacaggcacgtgccaccacacctggctcatttttttttttttttttttttggtagagacagggttctcactatgttgtccgggctggtctcgaactcctgggttgcagcaatcctcccgcctcagcctcccaaagtgctgggattacaggcctgagccgccatgcccggctttctaggtaactttcctatcagccttcctgactgctgcagataaggcatgttctcacagggacaattcaggaaatgcaccaaagcgtcctcaaggcctgtccacgaagctcctccttccagccagaccctggggcttaggggtcaaattcctcacaccttcccccagcgctcctcacaaaggatgcactgcagtcaatcccaacttagctccagcaagaataatcccagcactttgggagccaacgccggcagatcacctgaggacaggagttcgagagcagtctggccaacatggtaaagccccgtctctactaaaaagacaaaaacttaccgggcgtggtggcacacacctgcaatctcggctactcaggaggctgaggtgggagaatcacctgaaccccgaaggcagaggctgcagtgaaccaagatcgcataactgcactccagcctgggtgacaaagggagattccatctcaaaaaaaaaaaaaaaaaaaaccttcagccagaaaatcaccaaagtcctaagtctggttatgccctttgttttctatttcttaataataaaaacacagcaaggggtttggtgctgtgagcaaggggctctctgagagtcggcacccacacgtgctggtctccaggacagacatgtctcaggccaacggcactgacagaagcacagaccctcactgccaggtcacggcgggcacgggaaacccacacctgggcctcggccacactcctgagggcgacaaaacaccagccggcgcgctctgagacttgcggtcagtcctagaggagaagcagcagctgctgagaaggccgcacgggcaaaggagccaccgtgcaccgtgacaagacaacatgttcgttggccatgcccggtgtcagcacgcagacacacaggcaccagaggctgcagcgaggaagacagatgtgcttccccagtgcttatggtctgggtggggacagaaaagagacaaggaaggcccagggcaggacatcagacacagggttttagttaaccaggactgtgatgccggcatctgcctggaggaaggaaggacagacttctgaagaagatggacctcagtgcctccttcacgctgataagcgatcccaccaagcatgacccacagcacaggacaaagccttgtgtccaggacagggtgccctccgggaggcagcagaaaggacagctgtggaatatggaaggggaaaaggaaaagggaacaggagacaaatcagcaacattaagaacatcaggccggacgtggtggctcacgcccataatcccagcactttgggaggccaggggaagggggagcagatcacttgaggtcaggagtttgagaccagcctggacaatatggtgaaaccctgtctctactaaaaacacaaaaaattagccggacatggtggcaggcatctgtaaccccaggtactcgggaggctgaggctggtgaagcccaggtactcgggaggcggaggaggcggtgagttgagacgtgccactgcactccagcctgggcaacaagagcgaaaccccgtctcaaaaagataaaaaaaaaagaacacgcagacagaaaagaatgacctaagaaggcacacgaggaacatcagcaaaggactgacagaaaaagactcatatttttatataaggaacacggggggaaaaagaaaaaaaaattaaaaggaaaagatgaatagatgatatggccagaggtttaaagaaagagacaacgagataaaagcaggaagccccagcaacactgggctgcctccccaggcccttcccagcatttcctgccagcagggcccctgccccaagccaaaaaggaaccacgttcgcctcgtcagggctgttgcacgacagccgcacacacctaagaaacaaactccttctgggccgcgcaacatggctcacacctgcaatccaagcactttgggaggccgaggcaggtggattgcttgagttcaggagttcaagaccagcctgagtaacacggcgagacgccgtctctatcaaacacacatacacacacacacacacatagacacacacagaattagccaggcattgtggtgtgcccctgcagtcccagctacttgagaggctgaagcaggaggatcgcttgagcccaggaggcagaggctgcaatgagccgtgatccggccactgcactcccacctgagtgagagtcagatcctgtctccctccaaaaaaaaaaaaaaaaaaaaagaagaagaagaaatattaactcctttgtccacatagtaaaactcagtcttccattaacttcaaaaagccaaactgataagtttttaagtaaagaacaaacacatctatagcgaagtgtggaaaatcactgtggtcactccccagctacagctgccatgcagtggtagtgcccctgccctcaagctggtcccagactcaaacaggaagccactgcacatgtgtgaccactggccaggcaaagagaggccaagacagctcgaaggacttgcgcatggccccagaaggctgcactatgtggcaagcactggatgcatacagatactcggccaagaaactccctgagagagctcacaccagcgctgttccctcagaagcccagttctccaccctagagaagtggcagcccttccacattcactttagccttgggctaccacagacatggtgaccaggacaaagaggcgtgaagctggcaaaaccaccaggtttgatgcacagaaaggccagcatcagcacccagttgcctgggcagaggaggaagaggatggcaggtacacaggccgttagaaacggcctcaccctgaccctgagcgtggtggcaagtggccgacccagattccctcaccctgctctggcacaccgcaggccagctgcatctggcaggagtgtaacagccagtgcccaggctgacgagcgtgagcactgccccacacacactcagaccctcaggaagagcatgaaagacgtcccagccgtgcccacagctacagcagcccctcctcgcaccccctgccaccctccctagagtccagcgctaatacaaccacctctggcctcagagtccccgggactcactcactcacttcactgatcagccgtggaatcctgaattcaaaccctacttcctaaacatcttttgaggcctacattcctcttgtaataaaaataaggaaaatgcaattttctgggattttgtaggaaaaaaagagaacataagtgaagatatctagcagagcatgtgcctctcacagaccttaggagttactgggaaatacaagtgaacaggccgctgtggagtgcggtttctaaaagtaggaggaatacagaaaaggcggccccaaccctgcctctgggagcaaaaccaaaaagagccacagccacagcagagaattcagaaaagccacctgcacaaaaggccagagcagccaagggaagctgggggcccaggccagtgagccctggggccaggtatcaggcccctcaaagagcagaaaacagattttttaggtgaagccgacggtctgaggaaatgagatgagctcacacacctgatgacagcttccctcagcaattccacccgcctccacaggactcagaccaagtcctggtgttagaataaatcactaggctacaagaaagctcaaacccccacaggttctagcactcctagccaccaacacaactctgttcaagatccacctatcaacaggggtggggtgggaaggcggtccccatcctcaggccattcttcctccgtgggttgcagccagggtttcctgtgggtcgtcttgtgcacgtcacggccctgcccacagcataaaaacatacaggtgtgagggagatgagcaagacagctagcttttcacaagagcaggaaaggctgggtgctgcgactcacgcctgtaatcacacagcgttgggaggcagaggaggaaggactgcttaaggccaggagttccaggccagtctgagcaacatagcaagatcctgttgtaccaaaacacacacacacacgaaaactggttgtcgtgttactaaaagtttccattacaacactgaagtttagaatacagtattactaggccaaaatatcctggcattttataggatttctttaacaaaatctgatcacatctaaactggcatctttctgctcacttctcaatttcaatctaaatttatttatttatttatttattttttgagatgggagtctcgctctgtcgcccaggctggagtgtagtggcacaatctcaactcactgcaagctccgcctcccgggttcacgccattctcctgcctcagcctcctgagtagctgggactacaggcgcccgccaccacgcccggctaattttttgtatttttagtagagacgggttttcacggtgtgagccaggatggtctcgatctcctgacctcgtgatccgcccgcctcggcctcccaaagtgctgggattacaggcgtgagccaccgcgtccagcctcaatctaaatttaaaacacagtttgctgttcagctacagggcagaatttcacacggagcaggcacctcacagatgccaacccggtgggtacggccctttgagtgtcacctaaagcctcataacatcatcaccaagcccatccccaaaagctgtagttagtaagccaccaggatttgatatttagaaacttttcccactaacaaaaaacaagcaagaataaattttaaacaaaggctgactgtaccaaggaaatggagataataaacagaaaaagactcatggacactggtgttgggagtgatggtcttagccctcagaccagactaagacaccctgcagagctgaggctgtcaggaaccacgcagagccacggaagggaaacacctgcccccgggctacaaaggccaccctctgccctctgcttactgctctggttctgccctccagacacaagcaggtccctaaagcagttgctatcctgctgacgtgctgacaccatcagatatgaacaagaatcccagttttatttttcctaataaataaatcatccatttagcaaaacgtcaacgataccaaaagctatgaaagcatccttggatttacaaagaaccctcgcttctcatttcccttattttcccatgcccaggcagagagccctctaagcccatgggaagcttaacagaagggggtggggagtggccaactgtggccagggcaagacagaaaccacatgtgcgtgaacacgtgttctacacagagccttatgtactgggccacagaataagcagagctgggcagctcctgctgccaaagtcaacatgttcaggctgcccggcctccacaggcgctttcctgaaagctgcctgcagagagaagggtggccagggcaggaggcaggatcctgaagctgcctgcagagggaggggcggccagtgcaggaggcaggttcctgaagctgcctgcagagagaagggtggccagggcagaaggcagcagcacaggggctcgggcccacgctggctgtccacacccagggccacgcctccatgacggtgccctccaccacatcccctctcgtgtgtgctggtgccaccacgggggcccagggacctttttgctctacttctctttcaaacttgcagccctgtgccagcagccagcactgccttcagaatccctgcacacagcggtgggaaaccttgactgcaccggaagaggagcaggctgccctggctgggccagacgctacacatcttgctgtcgagatggtctacatttcttccttttttctttttcttgtaatccttctgtcacctagagctggagtgcagtggtgtgatcatagctcactacaacctctgcctcccgagctcaagagatcctcctacctcaacctcctgagtaaccatgacgacaggcacacacaaccacgcctggctaatttttgtattttttggagagatggggtcttgccacgttgcccaggctggtctcgaactcctgacctcaggcaatcctcccacctcagcctcccagagtgctgggattacggccagtttacattcggaacccaccactatccccttgttgacagtaagcacatcccaaatcatttttcccaatggacaacacaaataaataattaagatccttattctagagtggggaaaaaaagagactagaattctcagcagaacttgaggaatccaatggccagtaacgaagatgcctcccagagtctcctggccatgttccatccctcccctcagccaggtactggggtgagatgcctcccagagtctcctggccgtgccccatccctcccctcagccaggtactgggctgagatgcctcccagagtctcctggccgtgccccatccctcccctcagccaggtactgggctgagatgtctcccagagtctcctggccgtgccccatccctcccctcagccagctactgggctgagatgcctcccagagtctcctggccgtgccccatccctcccctcagccaggtactgggctgagatgcctcccagagtctcctggccgtgccccatccctcccctcagccaggtactgggctgagatgcctcccagagtctcctggccgtgccccatccctcccctcagccaggtactgggctgagatgcctcccagagtctcctggccgtgccccatccctcccctcagccaggtactgggctgagatgcctcccagagtctcctggccgtgccccatccctcccctcagccaggtactggggtgctcaggccacaccggaccctccatctccttcctcctaccttcctcttcttctcaacaaaatctaagcaagttgtaaatgggccttctggtggcaatgatgtattaagacacgcagagcccttaccccatttgctacaggaacccaattacatctgggaagaaacaagcaggacaggaaaaaggtacattggtgtttttgcatccataaagttcacttcaatttaaatagaacttactgagtactcttttgctagatccaggcaaaatgtttttcaccctcagatacaaaaacatagaggaaaaaattcccttaagccagctgtaaaaaatgatggtattaaaaaaataaaacactggccccatgagaatcactgtagttaacaaaagaaatacagtaaccgcaatattataacctacaaacaaaaagccattctcagtcccccagcaggacctctccatgcctcccaggtcagcagaggacagaggacagcagaggtcacaggtcagcagaggtcccagcactcagagccggattccagctaaaagcacacatgagggaaaacagctgacagccagagctcccaatggggagctccaatgttccaaaccctcccccaggccctgggactctctgcccatcaaccagagcctggagggggagggagtaggagggggcgccgctcagccacaagtgcccattttcacatgaacaggtctaacttaaatgacacagcatcttctataagttactgcagtttaaagatgcctagccacagataattcctcagaactctaaaataaaaactgattctactaaacaatggagttatttatcttggcataattactacgcatatttttttgataataatggaagtatggtgttacctgtttctaaatcttaacaaaaacttatgttgaaaatggaagtggactgggcgcagtggctcacgcctgtaatcccagcactttgggaggctgaggtgggcagatcacgaggtcaggagaccgacaccatcctagctaacacgaggaaaccccgtctctactaaagatacaaaaaattagccgggcgtggtggcgggcacctatagtcccagctacttgggaggctgaggcaggagaatggcgtgaacccgggaggcggagcttgcagtgagccgaggtcgcaccactgcactccagcctgggcgacagccagactgtctcaaaaaaagaaaaaaataaaggaaatggaagtgaactcacagtggcacctacaaatcccttacagacctgcaaacctagtcctgtggctgtcagcagccgccaggaacccctggagcattctacggcaggacacagaaacagccgacaagctccccaggggtgagggtgccagggagactctgcactcccacaacgccctaggatgcagaggggcctgcccagaaagagcctctctctgctttcaaggccagactggggggaggcaggagggtggtaccaaaaacagcagcccttcccctccccacctccaacctggccacccagacagggaccccagcacagcaacagcaagcggagggggctcggctctggctgagctgacttccagcccagccaccaccacgggcctgcacaccctccgccacgggcctgcacaccctccaggatgccacaggcacagctgctcggactgcgcactcggggacactgaggcgcacgatcgcacctgccttacaagttcaacatttcagcaagacagaacctgattacttttccatcttaaatggagatgtcaattaaaaatgtaaaacattaagtccaagcctcttttcatatgaacaacactgcctttgttatcattaacaaaccactttcaaaacccccaatttttgggaaaggtaatttgaaagtcccatttcacagcaagcacaaatggaacacccacatgttgcaagggtcagcagtccgctgtcactcacggccacactcactgggaaccgcgtgctggggtcatcgggggtcacgcagccgcaccgcctgagaggactaacccttctgttttgccaagaaagatgtcagcttcaactacttttatactggagaaacaatttacaaactaaaattgttttaaagcctctattttcatgcagttttgtttctgtaaagtgttatttaatctccaaggaagtctttacagtagatacgaccgtgaccactgtcctgggtaggagactgaggctcggagagtggaagggaggggccagggccacagagctagcaccagtcagcccatcacacaaggctgtcggggaccctatgtcactgcggccacacctggcccaacctcagggcaggaccagcctagaatccatccaagctgggcacctaagtcacgcccagatgggagagaagagcacagcaccgtgtactgaagaagcgactgtggatctcatctcaacggctcacattccaccccaaggaatcaaagtgaaacacgggaatgacacaaataccaacatgaaaaatatcagagcacctgtaacattcttattcttctttatttgggacagggtctcaccctgcggcccaggctggagtgcagtggtgtgatcatagctcactgcagcctcaacctcctgggctcaagtgatccttcctccccgctcagcctccccaagtagctgagaccacaggcgcatgcatgccaccatgcctggctcatttttttattttttgtagagatgcggtctcgtcatgttactcaggctggtctcgcactcctgagctcaagtgatctacccaccccttcctcccaaagtgctgggattacaggtgggagccactgcacctggccagctattctttttttttttttttttttttgagatggagtctccctctgtcgcccaggctggagcgcagtggtgcgatctcggtttactgcaagctccgcctcccaggttcacgccattctcctgcctcagcctcccgagtagctgggactacaggcgcctgccaccatgcccggctaattttttgtatttttagtagagacggggtttcaccgtgttagccaggatggtcttgatctcctgacctcatgatccacccgcctcggcctcccaaagtgctgggattacaggtgtgagccactgcgcccggcaagctattctttttttaaaccctgcattttaatgccagataaaacaatggagaacaggcattcaagaccagcctggccaacacagtgaaaccctatctctactaaaaacacaaaaatcagctgggtgtggtggtgggtacctgtaatcccagctagttgggaggctgaggcaggagaaactcttgaatctgggaggtggaggttgcagtgagccgagattgcaccactacactccaggccctgcacaacaaagctagactctgtctcaaaaaaaaaaaaaaaaaaaaacaatggagaaccagcctcagtgaggtcctcaggaggccctcacatgcccatgtgggtcacggcgcctctggtcacactgcgcccaacctctgctcagcagggcctctctgtagcaacactgcagtctccctgatgggaggccacaacagacctcatgctaagggccttcctcgtattcaatctaaccaccacaggcaaacaaaagacaaaatcaatactgaggatctatagttcacaaaagtgacaaatggcattaaacaccttagattattactgtggcatggtcaaaaatgccaacatttcctatgtcatcaaacctaagtatcagtacatctattgttctcaatccactagagtgctagacatttaggccaattccaggtcctgtcagcagagttgctgatagcttgctcccctttaatcagagaagcctgtattttgaatccatcgatttttttttttccccagagacagagtcttgctctgtcgcccaggctcaagtgcggtgttgtgatcttggctcactgaaacctccgcctcccagttcaagcaacgctcctgcctcagcctcccaactagctgggatcacaggcattcgccaccacgtccggttaatatttacatttttaatagagatggggtttcaccatgttggcaggctggtctggaactcctggcctcaagtgatccacccaccttgacatctcaaagtgctgggattacaggcgtgagccactgtgcctggccactaattgctgattaataattttatttttcacactagtaagcagcattttggccaggtgtggtggctcacacctgtaatcccagcactttgggaggctgaggcaggaggattgcttgagagcaggggttcaagacaggcctggacaacgtaacaagactctgtttctacaaaaaaaaaaaaaaaattaaaaaaagaaaatgcagcattttgcttttccttgtcatacattaaggtcagcagtatccttttcacaaagaggcacagctcagaccctggggtgtggggtgctccctcatcgctgccccccttttcccatgtacctggcccctccatggcaccccttttatcacaaccaggctcagtccacctccagatcttgaaaaatgtctcacctgatcacaaacatgcccactacccaggctggcttcattctaactacaaaccatcccacagattaagagaagacaattctagacctattttcaaggatatctcagattccctttccttcaaacctcacctctatttccaaggaaagaattcagtcatatgaaagaaagcagtcaggtgtattttaaagtggcctgactccaggcgactgagataaggaacagatacaccaaactatgaagctcccgaaagaagctgcaggaaaggttctttcacgtttgctgggagtaacaacacaaaacagattatgtatttttggaatgttcactttaaaaccatgactcacacctggccaaaatatgaaaatttaatttagccaagttttctcttcaactgctgtcaatccacatatcagagaaaataacctgccagttcaccatgcgtctctggaaggagggaggactctgccctacagcgacacgtgcttgctcagagccaaggccaaagtctttttggagactgctgccgctcctctcaaaaaacatgccagtgactcccaggaggaggcaaggagtcagggctggcgaaccaggctcccactccttacctgccaaccatacacactggtctccagctcctaggaaaagccagaatagccatctagagggttcagcaacagcactatgcccagaagcacaggacagcccggcgagaccaccaggaacctaacaagagcacaacagctcccaggatacagaatcctcatccaaggacaacccagcaagaccaccaggatcctaacgagcagaacagctcccaggatacagaatcctcatccaaggacaaccaggcaagaccaccaggatcctaacgagcagaacagctcccaggatacagaatcctcacgcaaactgttaacacaacatgctcagagcacacaacacacagcacagggtgggggtctcagtcatcaccagaccatctgaggatgaagaaaattaaaggaggacaagaggaaataaacttcttttataggctattaacaacctatttaatttttcagcagatttcttctcactgtgacaccaaggatcccattcattaatccaaaaatgcttacctgttaccactctgaatacactctaagtgaaatccagaacaaaattcacaacatttcgacaaaactctatcaagtccaagaaaaccaacctggacactcacgcattattttgatacttatttttacaaatcaatgacaaaaacataaattgatagagaatgcagtgagtatttaccgattccatagctgaaagtcagtgctgacgaggactgtcttttaaatccaatggaggtgtgtcccagagcagggctgtatatattctgaaacaagagagtgagattagctcatgtcaataataatttcagcctcagttctttcatcgctctcgtctccctccatttggtccacacggtttattccatcgcccttcctctcccatgacccactgctcagctcctggtcactgtgccaaggccaaaacttaacttcattcatcaaatacctttacgtcacaatgcagcaattgcaacaacttaaaggtaaatccaaagtccagcacaaaaaagagtagatgacactgatacaatcttgtgaaatcaccataaaaccagattttagaggctctggggctttttatacgtaagaaaccaaataacccaagtgggcaatctcgccacagaaacaaaacattaccagtaagctaagtttttaaaaggccttttttttttttttggagacagagtttcactcttgtcccccaggctggagtgcagtggcgtgatctcagctcactgcaacctccacctcccctcctgggttcaagcgattctcctacctcagcctcccgagtagatgggattacaggcgctcgccacccacccccggctgatctggacctcctgacctcaggtgttccaatcacctcggccttccaaagtgttaggattacaggcgtcagccaccatgcccagccttaaaaggctaattttaactttaagaagcatattaagttttaaactacataaaaggtgcaaaaaaagataaggtggttttcatttccactgagtattttaagaggaaaagattatactgcagtaccatttttttaaaaagctgaataaagccatgcatggtggctcacgcctgtaatcccagcactttgggaggccgaggtgggcggatcacttgaggtcatgagttcaagaccagcctggccaacagggcaaaaccccgtctctactgaaaatacaaaaaattaaccaggtgtggtggcttgtacctgtaaccccaactacttgggaggctggggcaggtgaatcacttgaatctgcgaggcaaaggttgcagtgagctgagactgcaccactgcactccagcctgggtgacagagcgaaactcgtcttaaaaaaaaaaaaaaaaggcagctgaataaaactatataatttccctgaagagctctggggactccaagaataaaacaaaccagtctaaatgggggaaaaaaaatctatacccatgttacttcagtcccatccaaacatcaggctctcctccaactccaaacacttccgtgtgcagaaccagggaaggaagcacagacaggattgaaggcagctcccaggacagggcttgctggtgcagggttccccggctctgcacttagcatccgagagaatcgcgtgtttcctgagcaacactcctggcacatgcgttttgcaaagatggagtgaggtttttcctccttacactcctggaagatggagtgaggtttttcctccttacactcctggacaggattgttcaaagctgccattaacctcaaggaccattaaaaataagtgtgtgatgggtgcgctggctcacgcctgtaatcccagcacttcaggaggctgaggcaggcggattgcttgagcccagaagttggagaccagcctgggcaacacggcgagtccccatctctacaaaaaattcaaaaaattagctgggcatggtggcgtgcgcctgtagccggagctactcacaccactgcacagcagcctcaatccatcaatcaataaaaataaatgtgaatacgcagcttctagtcaccacacagcctggtttcagtgaaaagcagcaagtgtgccacgaagctttccgtaaaagagctcagagaggggaagagcatcagcagcaggaagccagcgaggaaccccagcatcgacctccagagtcctgagagcactcaaagcatcatgagtccaacgatttgcaagctcactgccactggcatttgggttcagcgcgccaacagggttgagcagcgtcggtcttctagatgccagtaaggccacccagcaaatcctggcaaccaaaaatgtctccagacgatgtccgctaaagggcaaaacacgccggtgagaactgctgctttaatgcagctgctgtttcccatgtatgaagaaactgggcccaaatcaggtgaaagtgaaaaacatcagttaaaagtgaaacaaaactcagttttctgttgtcttagggtcccacagggtatggaaagcaagttgggaagagaaaattctggtctgaaggtcttttctttctgactgacagacaatctcagtaactgatcccattatctctggaagacagtaccaatccagagcctctaaaatatttggaataaacattacagatttttcttaagagacagggtctcactgtgttgccaaggctgggaatggagtggtgcaaacacagctcactgcggcctcaacctcctgggcccaaggggtcctcccacctcagcctcccaagtaaagacattttctaaggtgtgaaaaaaagcttcatttagaatacatgttcacatcaaaaccaccaccacgactataaacaagctatgttgtcaaacagaaaagcaccaggctacacttcttactgtcagctcctgcctacagcaactcaggaatcaacaggcctgtggaggctgagtgcagacagagaccatggagacatgaagggtcagtgtgtgatgacggagtcagggagtcagggatgggaccatcacccatccatgtctgggggtggggctgagacacgaagggtcagtgtgtgatgacggagtcagggatgggaccatcacccgtccatgtctgggggtgggggtgagacacgaagggtcggtgtgtgatgacggagtcagggatgggaccatcacccgtccatgtctgggggtgggggtgagacacgaagggtcggtgtgtgatgacggagtcagggatgggaccatcacccgtccatgtctgggggtgggggtgagacacgaagggtcggtgtgtgatgacggagtcagggatgggaccatcacccgtccatgtctgggggcgggggtgagacacgaagggtcggtgtgtgatgacggagtcagggatgggaccatcacccgtccatgtctgggggtggggctgagacacgaagggtcggtgtgtggtgacggagtcagggatgggaccatcacccgtccatgtctgggggcgggggtgagacacgaagggtcggtgtgtgatgacggagtcagggatgggaccatcacccgtccatgtctgggggcgggggtgagacacgaagggtcggtgtgtgatgacggagtcagggatgggaccatcacccgtccacgtctgggggtgggggtgagacacgaagggtcggtgtgtgatgacggagtcagggatgggaccatcacccgtccatgtctgggggtgggggtgagacacgaagggtcagtgtgtgatgacaggaccactgcccatccatgtcttggggcaggggtgggggtaaccaaaaccagaatccagttaaaacaacagggagttgcttctacctatggaaatggcaacaggacaagatgataacccaggtgctaaggagtcggctacacgcattctgtgttaggaaacccaggaggtactaatggcggctctctctgaatggtggagcaatgtgaggttttaaatgctcttaccactctggactccttactctcatcaacccctttaagtgggttatttgccacgttagggatagggaaagaaaattatttaatacaatcaacgggtaaaaagttaaagttacctaagaagaaagagctctaggccaaacctataatcccagaactttaagaggccgaggtgggaggatcacttccgcacagaagctcaaggctgcagtcagttagggtggcaccactgcactccacctgggcgagcgactgagaccctaagaatatccaaaccattaaaagaatttttttacagaatttttcttttaaaaaaagcaattttaaaaaaaaggatcttggatgttatcaccaaaaagaagtggtatttgaggggatggacacagtaaccaccctggtctcatcggtaaacaaggcatccacggactgaggcatcctaccggactccactaacaggtgcgactatgggtcagtaataaacacacttttcaatatgtcaagtaataacacgatattcgcgctgacccaatcgcaccccacctctttcaacgccctgggctctcccctcgctttgttgcatgagagctgctttactcactgctctcgacgaacagtcacagccacgagcaccgtccgaaacagaatcacagcctccctgggaaggaagctgggcagacctgatgcttatttttggaaaggaacggaagttcaagattgctcatgtttttattacagtctcccttttctcccctaagagaatcacaagtttcaggagactctgactgacacaactgtattaatgtttaattcactcccactttaatcacttttttctttttttctttctttatatcaaagcacatcaataatcacttttttcaatcaggagatctacaactgcttgctaaccatagtcttcaatccgctaagatgagcaattctttctgtccacactgactaaccccaactgacagcagagaaaaaccacgaggcctgtggctgccccacaccgctgctccttcagacaaccaagggccacggtggtttcacagctgtgagctcaggcccctcagctccctcccgtgagccaccttcccaacaccctcagagcccaggagtccatgttagcaaagacaggtccctacactggccttggtctcaaaacgctgctagccagagctatgaccttatgcaaacaatgattttcattcgcgttaggctgggtgggagggtccacaggggagccactgacgatgggcatctgcccccgacactggctgactaaccagcaccattaaccctgggctccgaacggcagtcacaccagcctgtctcagggccaggtctgtcttttccctgcttcccacagaacggcccgcagtgcattcctttcatgagtacaggagcatacggatgggttttaagagactagtgcggagctgtggctttcttgacaaatactttttcagtaacttcaaatacatgcacagagaaggcatgagatgtgtggttagagttaacctgaaagcacaaggtggtgcctgcagcagcaggcactcagcacctgacccaactcaactcaaacatgtgagcccaccattactagaggtcaaaaatggtccaataaactccactcagttgttcacagctgttttattcataagcaccagaaactggaatcagcccagatgtgcttcgatggtgtaagaaaacgttttaaatggtccgttttccaggcatgataaatctacgcaatggcagccagcctgcggatgtaacaaaccgcacggctcgtgcacctagaaggtcacaataagcgaacaaaatgtagaagaggggtcagcccataaatgggaagaaagtttcagtattgggaaatcaaaacttaagcgggtaagaggacagggtacaaccttgtaagcgggtaaggggacggcgtacaacgggataatgaaactcaggcgacctccgggaagattgtaaccccatagtactcgaccagtgaggaactgggggagggacttgcattagaggagataaactacctgctgtgactgccccgggtgtacctgcctaccaggcacctgatcttgcaagactgccattaaaaatcttgcttcctggctgggcgcagtggctcacacctataatcccagcactttgagtcaggcagatcacctgaggttgggagttcgagaccagcgtggccaacatggagaaaccccgtctgtactaaaaatacaaaattagccaggcgtggtggcgcatgcctgtaatcccagctactcgggagactgaagcaggagaatcacttgaacccaggagacggaggttgcagcaagccaagatcacacctctgcactccaggctgggtgacaagagcaaaactctgtctcaaaaaaaaaaaagagagagaaagaaaaaagtctcatttctgctgttctgtgtgtctccaagcccagtctttgggtgtggacgggtgaatgtgtgtttctcaccatggataaataagctgagtccacccacaccacggagaccactcagcaacaaaacagagcgaacattacgctgagcaaaaaggccaatcgaaaaggttacatttctacgactccatttatatgacactcttatgacaaatttttcaaatggaggacaaatcagtggttctcaggggttagggaccagggtggggagatgggctggaaggggcaaatgtggctagaaaagggcaaagggccgatccttgcgattatggaactattcagcaccgcaacacggcagggacgggggcccccagtggtgaacacgcacagaactcaaatcaatcaatctctctctctaacacacacgtacaagtaaacttcaggcaacctgagtaagaccggtcagcgataccgtgtccacatcctggctgtgacgttctattaaggccacagttctccaatgtgttaccattcgaagagaggaggagactggccgaagtgtacaaagggctctcaaggatttcttacaacaaaacacaagctcaaactatttaaaaaaaaaaaaaaagtccaaaaaagaaagagtccaatattgacaatttcatatggttttatctagcaccaactcactttatcctcacaataatcccacagagtaggtatcattattatctcccctttgcacatgagaaaactgaggccctagaagtgtgagaaatttagtcaaggtcacattttaaatggtggggccaagacctgaaaccaggctggctggctccagtgcccacactcttcaccacgatcagtcttgaaactggaaatggaaaacatggacatgaatctgctattattatggcttaaaaatcttacaatgtaactttagaggacttaaagggaacactaaagacctaccatccagcctcatctcattttagttctcaatcaaaaaaagacacagccaattggattccactcccacaatggtgccaggagccccacaatcccaaggccagctggtgcagacaggtcacctatccactctgatcaaaccattctcctgacctcggtcggtctccttcgttttttcaggttgggggcggacaaggtgggccggttatttcgattttttcgggctgggggcagagaaggtgcagttatttgtttcctgtttctggtgtttcttttttaagggtggggtgctattcatttcgttttctctgatttaaagtgaaagagaaggctccagggaataaaggcaactacgcaaacttcagaactgaggtgagcctgaggaggaactagaaggaaaaccaggcttccttcttcagtgcaaatgtttctttttactacaggaaaaaacgaaacaggaaacaaaatgaatgttcccaaacaattctctttataccatttagcagaaaaaggtgcaaagtggatgaatgcagaacgagaacaagggggaacgatttcacacaaccgttcttccctttccataatgcctgccctgataggaatcaaactcctctgctaaagaacaaaagccaactatggaaggcaggagaaccttcagtcctcagaggaggcatccgactcctgccaaaaccttcccttcctcaccggatccaggggaatggcaaaaacaattcgtgtttgaaagtaaacagatacacagctataacaaaaaaaacaaaggaagctgtagatcagaaactgggaaatacctgaaaattagaggaggacaaaggcatgaaatcaaactagagaaagtgacacaaaagccaacagtgaaaacagccccaataacacacaggagaaggtggaggaaggacagtgctggactgtgcaatacctgcctccctcccgcaggaggcccggctccacaagaccccaaccagcgccggccgagttcacaagctccctgagcaacaaacaccaactccctgcgtggcttcactaaaacaagccttgaaagggaacaagaggctctgatggtcacttaaacatcacacacacacacacacacacacacacacacacacacaaatctgaaatcctgaccaatgaagacataagaccaacctttcagaaagcctaaatcaggcgcatatagatgaccaatttatttctagctcttagtaaacccacagaattccaaatcagcatcacagtctaatggcaaaactcaaaaggaaacatgaatatactgtgatctacttgtcttgagctcactgttggcctcaccattttatgatcggcgtcatggacactgggaaacagaaaagacggagaaatccgggaagcggctgtttcacttcagtgtgaagctcctactcaacaatcgcttagttatttgtgacctctcacaacactcatctgttctgtttctacaaaatgaataatccaagtggcagtagacatcaggacacctgttaccagcctgtcttttgccaagtaggaacctcagaatgagatacaactccatgaagaaccatctcttggtatgcaacaaggtcttcagtcagtcagtcaatcaattcagcagagctgcatgatacaagatcaatatacaaaagtcagctgtatcatcatcatacacaagcaatgaacaatctgaaaaagattaaggaaacatttccatttaaaacagcatcaaaaagaatatttagcaacaaatttaaccaaagaagtgtaaaacttgcaccctgtaaccacaaaacactgttgaaagaaaccgaagacctaaataagtggagggaaaaaatcccatattcatggatcaaaagacacagtgtctttacgacagcaacaccccccagggtgacctgatgattcagtgcagtaactatcagaattccaacggccttttttcaaaagtgatccaaaaatctagatggaattgtaaacctcttacatactacaacttacagaactatacaactttttcttaaaacttttttcagagtagaaaagacataattaaaatgtctaggggccggggtggtggctcacgcctgtaatcacagcactttaggaggccgaggcgggaggatcacttgatgtcaggagtttgagaccagcctggccaacatggcgaaaccccatctctacaataaatacaaaaaaattagctgggtgtggtggcacatgcctgtaatcccagctacttgggaggctgaggcaggagaactgcttgaacccaggaggcagaggttgcagtgagctgagatcgtgccactacattccagcctgggagacagagtatgcctcaaaaaaaaaaaagtctagtaatcgtatgatgccaggtttttctaaaatgattatttttaattattaagggggcaaaataaaacaagggcactgatttgacagtttttttaaactctttagtttgaaaggtttaaaattcttcaataatctagtgcctctaatcccagcactttgggaggccaaggcagatggatcacttgaggtcagcagtttgagaccagcctggccaacatggtgaaacgccatctctaataaaaatacaaaaattagccagacatggtggcgcgcgcctgtaatcccagctactcgggaggctgaggtgggagaatcacttgaacccaggaggcagaggttgcagtgagccaagatcgtgccactgcactacagcctaggcagcagagcaagactccatctcaaaaaaatagattaattaattaaaataaaattctttggccgggcacggtggttcacgcctataatcccagcactttgggaggccaaggcgggcagatcagaaggtcaggagatcgagaccatcctggccaacacggtgaaaccccgtctctactaaaaatacaaaaaaattagccaagcgtggtggcgggcgcctatagtcccagctgctggggaagctgaggcaggaaaatgttgtgaacctgggaggcggagcttgcagtgagccgagactgcgccctacactccagcctgggtgacagagcgagactacatctcaaaatgaaagaatgaatgatgaatgaatgaataaaattctgcaataaccaacataacattatttcctttaaaaatacaccactgtcataggccaggcatggtggcccatgcctgtaatcccagcactttgggaggccgaagtggatggatcacgaagtcaggagttcgagaccagcctggccaacatagtgaaaccccgtctccactaaaaatacaaaaattagccaggcatggtggcaggcgcctgtagtcccagctactcaggaggctaaggcaggagaatcacttgaacccaggaggcggagcttgcagtaagccaagatcgtgccaatgcattatagcctgggcaacagagcaagactccacctcaaaaaataaaaataaaaaaataagaatacaccactgtccctgaatgtgcactgttcttttaatttagaatgtgagcccacaatgatttgtacagcccaacatctaagatgcaatgaacagaatgtaaatgggggttggggggagggaagggactacacagcttctgagagaacagcaacgtccctgcagcgtgggattctcaactctcacgctcagacgttctagtacacagcagggactctcaactctcgcgctcagacgttctagtacacagcagggattctcaactctcacgctcagacgttctagtacacagcagggactctcaactctcacgctcagacgttctagtacacagcagggactctcaactctcacgctcagacgttctagtacacagcaggtactctcaactctcgcgctcagacgttctagtacacagcagggactctcaactctcgcgctcagacgttctagtacacagcagggactctcaactctcgcgctcagacgttctagtacacagcagggactctcaactctcgcgctcagacgttctagtacacagcagggactctcaactctcgcgctcagtcgttctagtacacagcagggactctcaactctcaggctcagacgttctagtacacagcagggactctcaactctcgcgctcagtcgttctagtacacagcagggactctcaactctcaggctcagtcgttctagtacacagcagggactctcaactctcgcgctcagtcgttctagtacacagcagggactctcaactctcacgctcagtcgttctagtacacagcagggactctcaactctcacgctcagtcgttctagtacacagcagggactctcaactctcacgctcagtcgttctagtacacagcaggtactctcaactctcgcgctcagacgttctagtacacagcagggactctcaactctcacgctcagacgttctagtacacagcaggtactctcaactctcgcgctcagacgttctagtacacagcagggactctcaactctcgcgctcagacgttctagtacacagcagggattctcaactctcacgctcagtcgttctagtacacagcagggattctcaactctcacgctcagtcgttctagtacacagcagggactctcaactctcacgctcagacgttctagtacacagcagggactctcaactctcacgctcagacgttctagtacacagcagggactctcaactctcgcgctcagtcgttctagtacatagcagggactctcaactctcaggctcagacgttctagtacacagcagggactctcaactctcgcgctcagtcgttctagtacacagcagggactctcaactctcaggctcagtcgttctagtacacagcagggactctcaactctcgcgctcagacgttctagtacacagcagggactctcaactctcacgctcagtcgttctagtacacagcagggactctcaactctcacgctcagtcgttctagtacacagcagggattctcaactctcacgctcagtcgttctagtacacagcagggactctcaactctcacgctcagtcgttctagtacacagcagggactctcaactctcacgctcagacgttctagtacacagcagggattctcaactctcacgctcagacgttctagtacacagcaggtgcgctgtcctttaacaaggacaaaggtcaacaaacgccccttggatgaatggctgattggcaggcattccacactgcaggctctgtccccgcccagcagacttgtcccctatcttgaaacactacttttccatttcattaatgcaacctgatggccggccactgtaacaaaagaaacatcaccaaaatgaattgtttctttcttaagacaaaagggagtttgctcctcacatatgaccttacgcagtttctgtctgagaatcatcatgttcgtcagccctgcctgtgctctcctcttcccactgtgcttcctcctgcatcacaaaggaaacccctgtgagcctgggaagtgggtgcgcaggcggagaaacagaaacggccactccaggctcaacctatccatcccggcctcttcctaagaccaaggcgctgctgactcaaccctgcttccagaagcctagggttaacatctgctccttcctcctgtttgcattcagtgaaatcctctcctctcccaggagtttccacataaaacctgcctctttgtttattaagaattgtttacagaactctcaagcagcaaaggcaaagtacagaagataaataagagcaagctggccggtgcgtgcgactggatggacaacatctttacccacatgtctgcatcagctctgcgttgttcaccgacaaatcccgtgtctggaagagtcctggcaggctgcacgggctggagagagagcgagctggtgagtggctgcccctcccatcaccaccactggccacaccatgatgatcacacacccaggcacacccactctgtgctctccacgcatcgcctcattcaacccccacgacagcccttaacagatgccacctctgtgtttcttgtgagaaacatggaacataactggcactcatctagcatggtctcgcagtagcactgaacctacaaaccactctcttcccaggcttccaccccaccattcccggtttctcttgtgaactttgtttccattttgtttcacttgctacatctccttcctccacctcctccctcaatgttgtcttcagccactgcaggggcactctcacctgcctctggctttaacgacgtgctgctgaatcccagctctgccaatcagagttgaacccactgaacccactgcaacaatgtccaactagagacactgtcaatcagagacaatgttcccaccttactcggctctcctcacacaggctgtgcacatacagagccctcaccccactccttcctgtatcccctgccttgctgcagggcaccactgtctaaccctccaaggcagaaaccagctgcctcctcctccctatcaaaagcccacttataaatcctgtccatttccagctcccccccatcactgtcactcctccctactgcaaccgctctgacttctagttcaagagtgtctcagtatttctttacctacatcatcataacaacttaattatctccacctccagccacacacaccatcaacttattccccacagtgctaaggggagaatttgccacatctggtcacttatttacacctcagtctggtgtgcagaagtcactgggctaacaaggaatatattcatgttgtacatcgtgatgcagtacacacacacacacacacacacacacacacacacacacacacccctggaaaataaaagcttcacaggacgaaagcttccactcctacatgggacacactccagtgtttccccaggctggcagccgctgtttgtgacctcaggacccatcgccgtggcagccgcctcccagagcccgtggcatgcactgtgttgaggggtgctgtctggctgcctccccagcctctgagcaaccgcaaacaccttccagtttaggagggtccctctccatcttcctagaatgcccttttctactgtgtccagctggcaaactcctattcattcttcaaagtcaagctcaggtcttgactttcttccttatacttctcaatattcttcaaattctctacggagatatgtattgcttttatatttttatactatgtcaccaccatacccgagaccttaccagtcacacactcacccccattcatattctatcacggtataatcttgagcccaggagttcaagaccagcctgggcaacacaatgggaccccatccctataaaaaattaaaaaatttggcatggtggtacacgcctgtggtcccagctactcagtagaatcacttgagtctctactcaggagaatcacttgagcctgtgaggtcgaggctgcagggggctttatcacagccccacactccagccatgggtgacagagaccctatctctctctctctctctctctctctctctctctctctctctctctcctctctctcacacacacacacacacacacgaaatatatggacacaggccacattatatacaagcattgccataataaaaacagctctcccttggcctctgagcattttacccttttgatccattcagcttctttagaacagatggatattcaccataagatgtagtttatggacaagagtaatttggaaatgaaaaaggaagacagtaaggaggcctccccttcaagagggtttcatgacaaggcccagttgagtggccatgactggccggatcctttggccctaacatatggatccctccaggctctttcagtctgctaacctacaagttaattagtccatttctaggaagaaagtgtccgttgtctcctctgcagactttccacttcctgacagcacaggaacctaacagcatgccaagttcagactcctttttctttgcacctcactaccaccgacaggctttcaaacatactattcagaacagagacacggcgttggccaccagtcccagctccagcaacactaaaaggcctccctaaaggagcagcaggagcgcaacagagaagaacagggttggacgtgggggctgggcacaccaccttcaccagagtaagagagaaggaacgggcttggacgcagcagggctgggcacgccaccttcacgagagtaagagagaaggaacgggcttggacgcagcagggctgggcacgccaccttcacgagagtaagagagaaggaacgggcttggacgcagcagggctgggcacgccaccttcacgagagtaagagagaagcaacgggcttggacgcggggactgggcacgccaccttctccagccccagagccccactgtggagagaaaaggggctgctctctgcctcagaatccaagaactcctgagaaaacagctacatcgacatctggtattaacatttgattgtttaaccacactataagggagaaggggacatggacactggcttctaaatacagaagtttccagctcccagctggttactctgagaagatgcccctagtgtgtcacctacagagaagggaggatgcccacctaccctgcctggcctgcaccacccactagaaataaacaacaggccccaaatgcaaacaggaccaagagaagggccatacggcagcagcaccccagtgcctccaagatgccactcacccatggtgcaccctacacacactcacctcctcaagacactatggattctgtgtgtctgggggtgaactgcaatttttttaatgttttccaagtaaatctaatttaaaaaaaaatcactgatctagcccttcctcacccaaactcccagtcatacagttgtcgaaataatgaccataaagcaattcttctctaacttgagaattctcatactcttcttctccacgcaagtcggaaagacctagtctgagaaagaaagccataaaaatgagagaatccagcgaagtcgctgcagccaggaggagcagcaccgcgcagtcctgtgcctcacccctgcccaggccacctgagccccacctgtcacagtaaggctgcagaagcatgcggctggtcagcagctaatcagcagaaggaaagctggcccgacaatccatgcctataaattccacaacagatgtctcctgaggtccaaaatctgctcttattaaagagtggcgtgtgggatgggcagagactcacacagccacaccacacacacaaggtctcaggactctagccaaggtcttctagtttgtagtggcctcatgtttgatgagcatctaataacaaagacaggaaagcactggatggagacgcggcgaggacactggctgtctggggcagccttgccctgaggaagttatgctctaactggtgagactgcaccaaggcacaagaaaacccacgacaaactgaagtgtccatgcggatggctaggtgaagcagggcgcaggcccaggtgtgaacactcaactgctgggagcccaagaccaactgatacacccacagccaccagctcttcatgagaggtgaagccagctgggcttctgggtcgggtggggacttggaaaactcttctgtctagctaaaggtctgtaaatgcaccaatcagcactctgtacaaatgcatcaatcagcgctgtctagctaaaggtttctaaactcaccaatcagcactctgtaaaaacgcaccaatcagcactctgtgtctagctaaaggtttataaactaaccaatcagcattctgtaaaaatggaccaatcagcactctgtaaaatggcccaatcagcgctctgtaaatggaccaatcagcagtacgtgggcagggccgaataagggaataaaagctggccacatgagccagcagcagcaacccactggggtccccttccatgctgtgggagctgtgttctttcactcttcacaataaatcttgctgctgctcactctttgggtctgtactacctttatgagctgtaaccctcagcgcgaaggtctgcagcttcactcctgaagtcagcgagaccacgaacccaccagaaggaaaacactccagacacatctgaaaatctgaaggaacaaactccggacacaccatctttaagaactgtgacactcaccgcgagggtccacagcttcattcttgaagtcagcgagaccgagaacccaccggaaggaaccaattccagacacattcacacgcagacgtactttcgttctgtcctgctgggagtccaagaccaactgactgtccactcaaggaacagaccaactgacgcacccacagccaccagctcttcacacacacacacacacacacacacacacacacacacacgctttcggtctgttcgctcaaggaacaggaagcctttttcacttcaacttctgcattcagttcaatgtgctggtgccgcccatcacctctaaatcaccgcaagtttcaagaacagccagttgtgtcctggagctgtgctgagcacgcccaccagcccagcaggtgctgctgagagcagagggttttgcagggtcacacattcttccaacaatatgactgcagaccccccagcaaaaggaaagattccccatttgggaaagtagactaaaattttcttctattaaaacatgataattcggccgggcacagtggctcatgcctgtaatcccagcactttaggagacggagatgggtggatcacctgaggtcaggagttcgagaccagcctggccaactcggtgaaacctatctgtactaacaatacaaaaatgagctgggcgtgatggctcagaacctgtagtcccagctacgtgggaggctgaggcacgagaattgcttaaacccaggagatggaggttacagtgagccaagatcatgccactgcactccagcctgggcaacagagtgagactcggtctcaaaaaaaaaaagataatccaagtttctcctgacagatgacattcatcaacaagagattcaagcagaaaagaccactgtctctaacagcaagtattatacaagagcctcaagcgacgtctgccttgggtgttgggacatagcaaacaggacggctgttccgcaagagcaggactgaagcaggcggaaatgaagacgcaggggcatcagccatcagagctcttcttcctggaataactattcctctaagctgctccttcagatacaaaataaaaagtaactctcaacactgacaagtcaacggaggacacgcgaaaaaccaaaaaacttttactatatttttgttttaataaagttattctaatcccctgaggtaactgtgagggaattaataactagagaactgttagagacccctgaaggttggacaatggtattgccgaagctttgtgttttgctcttcaataaacttatctactttcttaagctaactgaataaaatttaatatacatttatcaaccacatcttttaaaaagagagaaaagtaggaaactcaaagtagtttcctttaaacaaaagatggtcaaagttgatgaatttagaacatttgtccccaatatcctaaaaagtgacatacgaggaaggagatgtcacagaagaaaacgacaacacacacccaaacggcatcagcctgtgtgtgaccattttcacaacagggaagggaacgaagcgaacagatccatcactgaaagcgcagcacacaccttctaacctggaaatggagaaggaacgtccacttatgaagagggccaacaacagtggcctctcattccatgaaccaagcatgatgctaatatgctaatatgacagagaattttttaaaaagccaccaaaaaaataccaaaaagtgaaagactgtattgtttgccccaacatctgttttcttcactctaatgttcccaaaccagtgcagcaaacaggctggctcttcccgcctcccactgactcctccacacccctacttcctctctcctcattcacctcttcttctttctgctcttctgtgcctcccactctctcactgagcagcccctcacttcccagcatgccaccatctcccctgagcaaacagtcctccagagacagtcctccagagctctctccaacctgacatctctcccaagagcccactcaccagatgtccaaggggtttatgaaagccatggattcaaggctagagacgctgtccctcagaccagctctctccggctcttcctgtctggtagggaggctgtggtgccctggccactctcatttctcactggcctctgcacctcccatgcatccgctcctccgccatgcctctccactactcctaatgccactcccagctccagcaacccaccctccagggcacctcgacgctatgcccagttcaatctcctatgggtcagtgcagggcaatgcataatgcaaactaggcccgggggctgtggagttgggcagccatggttaaaatcattcttagtttcctcatctgtagaaagaaaaattcctggatacaaaatataagatgaatatacacaagtccattgtatttctagacaccaacaccaggcagagtccaccatgaaggcaagtggcagtgtcccaaggagagcccgctggccaggagggcaccgcaagcttggacacagcaggggcactggagatgggtccacgaaccgcgtgcgcagcccaggaggctggcacaactggtgtctgcatgaagactaggaacagctggcttcttatctcacaccatacacaaacatcaatttaggatacattaaaggtataaatgcaaagggcaaaagtacaaaatgtgcagaaggcgtaggaagctatctttatggccttgggatagggaacattttttttttttcaacacagagtctcactctgttgcccaggctggagtgcagtggtgcgatctcagctcactgcagcctccgcctcctgggttcaagcaattctcctgtctcacccacccgagtagctgggactactggcgtgtgctaccacatccagctaatttgtgtgtgtgtgtgcgtatttttagtagatacagggtttcactaggttgggccaggctggtcttgaacttatgacttcaggtgatccacccacctgggcctcccaaagtgctgggattacaggtatgagccaccgtgcccatccaagaaaattttctaaaaaaagacatactgggtcatgatggacagtttggaaggcattgcccccaagaaccaagcacagtcccttcgaagctaaagtattcaaatctcaagtcatcaaatgttactgcatttaggaggccgaggtgggaggactgcttgatcccagaagttcaaggccaaccagagcaacatgtgagaccgcatctctataaaaaattttaaaataaactagccaggtgtggggttgcatgcctgtgatcccagctgctggagaggctgagatgggagactgcttgagccaatgagttcgtgatcataccactgcactccagcctgaacgacagagcaagaccctgcctcaaacaaaaacagaaacaaaaacaaacaaaaattttaacctttctcttaaaaaaaacaaaaccaaaaaaaaaaaagaactgtattcttccattcatatagaagataaacatcacaatgggaaactccctctgtgtggcacgttgttcaaatccacatgcatgcacagtcccagagtcttctttcctacccgcagcactgaaggttcaaggaagtcccactgttttcagtaaactgaaaacttttttggaaaatgctgttttccagtatagacaactgaatcctaagcacaaatatataggacctctgaatatgtaaaaatttaaaagcagacaacactaaattaatgattttacttttaaggagataaaatgttccttgacttgcaatggggttacctcccaataaacccagtgtaaagtcaaaaatcctaagtcgaaccatcattaagtcagggactatctgtatacactttcagtgctaaaaactacaccaaagaaaaaacaagtgtcaaagttctccatgtaaaacagtgatccagggatatgggtgagaaaacccatctaaaatgcaatgtgatatttaggataaagctgaaacacaccacagcgcctcagcaattgaggctgtgaatacaaccacacaatcagcaaagaaaagcttgttctattcttcatctacaccactcacacacaacaccaaaggtgttctcagcacacctccatccacctcagatctattcttcatctacaccactgacacacaacaccaaaggtgttctcaacacaactccgtccccctcagaactctgtggaacgttttcattcccaatgatcaccaacagagccagctgtaagctcaactctaacactacccacagtgcagctgacctagactgatgggcggcctccggagaagtcaaagactccagctctactgcacacacccacagcaggagaggcctgtgtctctcacaggtgtggggtctgagccgcagcccactaccttaactccataatctgtgacttggctcttatgaggaagctgacaaagaatcagagactcagaggagatcacagcctttcaggactgaggtctaaaacacagaacctctagcccagtgctcacccgcaaccatttccctgcctcttcctacttctccagtcctcaaggggacaatggcagggttcacaggattcttcctccggaagaattcagtgtgctgtaattagaaatgaacattttatcaatatgttcacgtaaaatgtacatgttcccctggggggagggataaataacagtggaactaggaaaagcagaccaccagaaaatgtctcggtccagcgtggtggctcaggcctgtaatcccagaactctggaaggctgaggggggaggatcacatgaggccagaagttcagaccagcctgagcaacacactgaaacctcaactttgtaacaataaaaacagaataaaaacttagctgggcatggaggtgtgcacctgtagtcccaggcactcaggaggctgaggtgggagaattgcttgagaccaggaggtcaacactacagtgagctgtgagtaccaatgcactccaacctggatgacacgacaaaactctgtctcaaaaggagggggaggaggaggtaagagggaaaggaagaaagcataagaaaatatcaagcacaaactaagggccccaaaaaatccaactcacagcaacgtgggcagagccctggagaagccagaggacatccaggcaccacccagcaaggggctacagaaagggggccacctgcctccaagcctgccgggactgaaaataaatccatgtggcatcaacaggaacatctgtggctgtgtggcaatgcgtgtgagtgcgcatgaatcctggtgtggctggtgtgtgtcacagtcaaaacggaaagagagagcgcatcgtggtttataaaaaataagtttccttgcggccagacacagtggctcacgcctgtaatcccagcactttgggaggccgaggcgggcagatcatgaggtcaggagatcgagaccatcctggctaacaccgtgaaaccctgtctctactaaaaatacaaaaattagccgggcgtggtggtgggcgcctgtagtcccagctactcgggaggctgaggcaggaaaatggcgtgaacctgagaggcagagatcgcagtgagccaggatcgagccactgcactccagcctgggccacaaagtgagactccgtctcaaaaaaaaaaaagtttcctcgctatgcatgcgctaaaaccctctggagtgaagtcctaaaatatttaaatgaattttcattctgaagagactacagaacttctcaacacaggctctcttacacagactctattacacagacttttttaagatcttgcacatccaatgtcagaatatattccatcacccagcaacaaaagcagtcaggaaaaaaacttcagaaaaagaattattaaaaaatacgcaaacctggccgggcgcggtggctcacgcctgtaatcccagcactttgggaggccaaggcgggcggatcacgaggtcagcagatggagaccatcctggctaacatggtaaaaccccacctctactaaaaatacaaaaaattagctgggtgtggtggtgggcacctgcagtcccagctactcgggaggctgaggcaggagaatggcatgaacccaggaggcggactatgcagtgagccaagatcgtgccactgcactccagcctgggcaacagagcgagactccgcctacaaaaaaaaaaaaaaaaaaaaaaaaaacgcaaacctgactcttaaaaaattaaacataccctgcataactgaacagtgtccacaagcaggaatctctctggatggcaaggtggcagccgactatggcactcaccaaaaaggcaccttcccccatcatccatgcaaagacctttcccaaagccaccagacctccgttcaaacaactcaaatccggtctagaaattaaaaatccttgtactgaaagcaaaatcagggttagctgtgactaagatccaagaaataaactttttaaaaagtaataaacatgaattcatcagtatgaaaaaggtctgtgcacagtgagcagttggcacaccgatgcagtgcaccgagggccaaggcgaaggccgcagggggaggaggctcagcagagggaggacaccccagctgacaacgcacgcccactggtgccagtgctttggagaacatgccaggtcatgtctacgctttcctcactaaggatttaatttcagtattctacaatctaactctacactctcaaaacataattagaaacaatgttttgaatgtgatggagggatgcagtagagcttctctagaaaatgcttttgaatctgtctcagaaaaccacctgttttgtagagaccaagactcttcctccattttggctcaagctggatcctgagtaaaagacaatcccacaaacgcccctttatgcacagcttcccccacacgctgtttgtctctgtttctctctctctcaatacccctagattttaggtcaaaacaaacctgtttccaccagctggacagtatcattcaggaacggttttacgcatcaaagactcatttccagataaagctgaagctccagggaggaggcctgtgtcccacaaaggccaggtgctgacacggttagtcctttcctccccaccacccaccaggaatgttgctggaacccagacacgcacagcaaggttctgctgtttaccctgctccccggtggcaggaaggtgtgtgccctattctcactccaaccccatcacggcctggtgagcctccggcgctcctgccccttacagcacaagccggccaccacctcccacgggccctgacactgtcactcaacacctcaccacagcacccagcctctgcctctttcattagacataagcaaggatttttcctctagccaggaagtttttcaaatgtgaagtatttcatttttttcttcttatttttttgaaacagaatctcgctctgtcatccagactggagtgcaatggtgcaatcttggctcactgcgacctctgcctcccaggcccaagcaattctcctgcctcagcccccgtgtagctcggattacaggcatgcatcaccacgcccagctaatttttatattttcagtagagacagggtttcaccctgacctcaagtgatctgcccgccctggcctccaaagtgctgggattacaggtgtgagccacctcacccggcctcaaatgtgaagtatttcaaatcgaacttgttcacagtcaaggcaagcatggcatgcttgctttggccagcacatgtactaaaaattcgaacaacagagacgattaccatagcccctgtgcaatgatgacatgcaaatttgtgaagcattccatactttaaaaaaaacacacacagattgggacctgctctgcaaggcatcagatgccttccagtcagtaagagacaagagatacacagggtgctcccattcccacagcaagcaccaccctgcaccactagtattagcaccacccacatggaagggtgccagacacatacctactagctgcctgccacgcatggaaaattctttaggcaataccctccgcacccagaaggctaccagacctgttaagccttttcaaccagtttttgcaagcaagagaaatgcaattcttaagagcgggaacacccctttattacatgtaaagatacacaagctggatgaattgaataggggtgaacagtgatgacccatgaccaagatgcattaagaaacagatctgcacaggaaggtggaacaaggcccgtgagtgcagagcaagcctgctgggagggcaggggcttgtcttggaggaaagtgccaacaaagcctgtgccaactacagctgccgtgccgggccggcgtcaacaccgaaggagaggtgtgcagagacaaagcggcctgtcaggctgaacagggaggcagaaactccgcagaccaagaatacagtttccatagtaccctgtaactcaccaaggctgggacaaaggttaatgaaaagttcaaatctgaaataaataacaactcacttcggtattttacaaaaaaggtagttaagtattttttttgtgttcctgcataaaatactagtaagactcaaaacaggtagatactgatatgcaagttttaaaatcacaagcagaagaaacaacactctgtatgcccttccaggtggaaatgcagtcagcagaaaactgtctccatgagataaatgctcctgcccaaagcccactctagcaatgcttcctccctgaaccacaactctgaacaggctgccactcactgcaactccttgcacatgacagacttgctgggaagagcaggtgcgtactaaacattttctttgggctccagaaagcactaacggcctacttttgcaacggggcggtcgggggggtggagtggagggaggggggttgtgtagggtttgccatcagcgttaccctggagctagtccagccctggacttcgatatcacctgaaatccaatcatcaaactttgcccactgtttcttctccaaaagcaaggaaaagaaaagctatcatgagccccttcagggtctagcagcatacaagactgcttttagaaattctactccaggcatagtggctcacgcttgtaatcccagcactttggaaaacaggaaggaggatggcatgagcccatgagctcaagaccaggctggataacacagccagatcccgtctctgttataaataaataaataaaatgtaaaaaaaagagaaattctaccaaataaagatcaactatgatgtaacaaccaagtaaccctacagtgtgagaaatgcatgaggggcttaagctcagggaaccaccacctaaagagagaggcagagacctcagaggacatcaccacaggagcaggcaggctcccacccagacagtggcacactgccacccttgcaaacctaccacacagacccgttcagcacctgcccttgcaccacccacctggaggctcagcatccaggtgtgctggccccttgggtgagggtgcccaggcactcaccaactgaagtccccatctctccacggcaggcccacctcagaggaggcaaatgttaacggctgatttcttcccataaagctaagcccttatccatgtggcttgtttacaaaagtaaaacaggctgtttggacatggcattaaccaatgtattagtaagggaaggggagcaagctgttttctttaactaatatatataggtccaaccctagttcaaccactgctcagccgtttcgaaccactggctgagcaaattcagcctctctgaggttcaggtaaactaagaggtcatctccttggggcgtaagatgctacccctgaagcaacatcacacctctcatggacgtcactatcatcctccaccccaacctgcaaacatacctaggaccagtgccccagccccaaggagccacagaggctgaggatgatccgtcctccaaatgctcaggctactctgaagcaggaaacaaagacagcaataaccacaagcacagggacaatgtcctgcctgacacctgaattcttactctgatatctcaacatcctcttcaataaaatcaggaaataactgtatttttttaaaaaaacgattttgagcccgggcactgtggctcacgcctatagtcccagcactttgggaggctgaggcaggcagatcacctgaggtcaggagttcgagaccagcctgacccacatggagaaaccccgtctctactaaaaatacaaaattagccaggtggtgcatgcctgtaatcccagctactcaggaggctgaggcaggagaatcacttgaacccaagaggcagacattgtggtgagcggagatcgtgccattgcactctggcctgggcaacaagagcgaaactccgtctcaaaaacaaaaacaaaaaaaaaaattttttgttaaaaaaaaaaaaaaaaaaaccagcctagtatatgttcctgcctaagagaatatgaagctttgttttgttcttcagatggatccacacttagaaccaccatctttaaaaaaaaaaaactgtttaaaaaggacttccaattgcatttcatgaaggcagtgggtagaaaatccttgatcagtccctaattgggtgtgttttccatgaatgagctattgggatacagagtgtcgagaacaagaaaacagcttctaatatgaaaacagatgaggttctcctaaagcttctgtgacagctgcatctaaacagtttaacactgaggtggacgggcgcagtggctcacgcccctaatcccagcactttgggaggcccagacaggcagatcgcttgagccctggagttcgagaccagcctggtcaacatagcaaaaccccatctctacaaaaaacacaaaacttatccgggtgtggtggcaagcatctgtactcccagctgacagggaggctaagaaggaaaggtcacttaagctcaacaggcagaggtggcagtgagctgtgatcatgccactgcactccagcctgggtgacagagcgagcccccgtctcaaacaaaaacaaaaaccaaaaaaaacccacagactcaattctggctgccaggccatcaagggctgtgaagtgaagccctgagatccttgtggcaggaccctggacacacaatgacagtgccaccagccacagccatgcccagcaagcagcttcctgtccagtgagcaccaaggggcccttctcacacacagcctcccactcaaacctcgagcatccgcttctctcctcctccactctggggcacagaggctctcgccagcccccacagctgcttctccgcttgtcaccctgccacacaccctctgtccctgcagttccagggacagccgaggtgttctcactctgcaccaagtgcctcacgggccaggtcctgcttaaagcctgaatgaagcaaagcttggaaaggacccaacacaacctgccaccaactgaatgcctgccatccctccccaccctacgaagacactgcatgaaagccaccgagcacgtgactgcatgacccccacacaaagggcacgtccatcgttccaactacaaagctccacgtccaacaccagtggcctcctcacccccaatgcatatttgcaacccattagtaccaaaagtttaatcactattgctgccctgtctcctactaccccattccttgccctcattaaactcctaaagacagtggtccctagatgcctccctctcttccctatccagcgacttatcacaaacaccccaacaccctttcctctccatcagatatcactgaacctcaacaagggggcctgaggtgccaaagaaacatcacatagcacgatctagagtgtagcaaccacacagctaacacccaaatcagagggtcctcatgatcccatccatgcacccacatcccggctgtcgtccacaatcctacgaatcagagggtcctcgtgatccccatccgtgcactcacactccctgctgtggtccacaatcctacaacaatgctccactcttggcctcgtaccctaagtgtccacattccacctgttctcactcctcctacacagccacctttggccctaagaacactgcatccggacacgcaggccctcggcctcccaaagtgctgggattacaggcgtgagccaccgcgcctggcccaacatcatgtatttattacatgtaccagcatttatctaatattttcctaaaatacaataactttttctttttttttttttttttggagacaaagtctcactctgtcacccaagctggagtgcactggcacaatctcagctcactgcaacctccacttcccaggttcaagcaattgtcctgtctcagcctcccaggtagctgggactacaggcgcccaccaccacgcctggctcatttttgtatttttagtagagacagggtttcaccatattggtcaggctggtctccaactcctgacctcaggtgatccgcccaccttggcctcccaaagtgctgggattacaggcatggagagttgggccatctattctctcactgaagcagggatgactttgtcacatgcacccttgcagacactgggcaccttgcagacagtgggcaccctgcagacagtgggcaccttgcagacactgggcacaggaattcagtaagactgataggtgatgtttttagttagggagaatatatgtgcaaattatttccatgtaatataaaaagaaaaagtctcaactgtaaaatgagcataaacagtccaatggtgaaaccttttctcaaaaatctgaattgaaaggacaagttatattagtgctcaagaaaaacttctccctgatctgtcagaattcacaccatgagttccaaatcacacgaaagtactcaaagtcttggccaaagcaaacctactacagcacctaaacacaaatctccattttcttttttcttaaattagccttactactatattattaaaactctcaaaccaaaagttgaaactaaaaattgaagtattttataaaggacataagcacaaaaataccttccaaataatcttcaaatacgcctaattaaaagcaggcatttaattgcacaaatttaatgaatttaacatttaaaagtaaagttaaactgcttctgaggccttacagtaccctaaaatcattttcaaagtccaagacgagacggtgctggactagcagtcctagaaaaaccctcaccagcaccgccccgtccaccggagcgcacgtgagtcccggcatgcgggcagggcaggagagctctttctatccccacccacctctggctcactccatgagcacaagcaaagcagtgccccggacctggcatctgttcatgttttacttgcccatatcaccattgtatttagttcttggtagcagccatcaaccatcataaagcagcttcttttattctttgctacttcaaatcacacatgaaaaagaaaatgcaagaatagaaacacagaaatggaaatgggccaggtgtggtggctcacacctgtaatcccagcatgttgggaggctgaggccggaggattgcttgagcccaggaatttaagacctgcctaaccaacacagtgaaacccagtctctacaaaaaaaaaaaaaaaaagaaaaatttgcaggcatgaggaatgttggtgcatgcctgtagtcccaactacttggaggctgaggtgggaggatcactcgaggtggggtggtcgaggctacagtgagccgtgatcccaccactgcattccatcctgggtgacagaatgagaccctgtctcagaaaaaaagaaacacagacatggagagagaaggcagctatcatggggcaaatttaaaccaggatctctggaaatgcgttattttttttttaaattatacccacacaccccttccacattcttctatacttagaaagggggtgtgcaggccgggcgtggtggctcatgcctgtaatccgagcactttgggaggccgaggcaggcagatcacctgaggtcgagagttcgagaccagcctgaccaacatggagaaaccccgtctctactaaaaatacaaaattaccagggcgtggtggtacatgcctgtaatcccagctactcgggaggctgaggcaggagaatcacttgaacctgggaggtggaggttgcagtgagccgagattgtgtcactgcactccagcctgggcaacaaaagcgaaactccatctcaaaaaaaagaaaagtgtgcataccaacctggtgagctaggtaaggtgctcacatactggcaacagaaagcaggtgacatgatcaaagtcatagacaggcagagccacactgaagaatgcagtcctggctacaggtcccagctcctgcttcactgagcaccctgagggagcccttcctaagcaaggggagccctgcctaagcactggggagcactttatctcacaacaggaaaaggcattctttcccctcagtttctcagagacccagtgacttcaggatttgcaaacaattgtgttactgaatgtgtcacactctgctccagctgcagggaagaacctgagtgatgagagtacatgattctgactctgaccctgacttcctcttaacctccatacccaaatcaagacctgtgcatggagctggctcagaccggggagccagatgctgtctgaaaatatgccatcaattctttctactcacttaaaattcaagtacctaagacattcaccccccattttgtaaaaaagcaaacaaaaacataagactcagagacagaatgtaagaatacaacgaagtatacctggctggaagaacagcttttacagtgacagcaacaccctaatgggccctcaagacaaacttgtgcctccctccgacggtgtacaaggagttaggactttcctgtgaccctcaacaaatacttgcaagtataaagttcgttttaacttctagacccgctttgttttagtactgattgcagaagagggctgacaatcccaagctctaagcctttcttgtgattatcattcccaaattctctttcgctatgcatacattcctaaactcctactttctccaaattctcaaaacattctattttacagagagagacagggtctcactatggtgtccaggctggtctctaactcctcgcctcaagcaatcctcctaccccagcctccaaaactggcgggattacaggcgtgagccaccatgcctggcctgtcaagacattctaaattctattttgttcaatttaatatcacacagaaactaaatatgccttccatcagccatgaaaatgactaatgaaaatgtaaatgaccacgtggcccaatcctggtttccatgggaagaccagctggctcaccacccagctaagagttatggcctaaatcagaggtgatcggggtgatcagaggtgagcaaagcactgtttctgtaaagttttagttttattggaacacagccatacacagccatgcttttgcttcaatggcaaagttaagtagtttcaacagagaaacctatggctggcaaagttctttaccacttggtcctctgtagaaaaagtttgccaatgcctggcctatgtcagaattctaactacatctctacagactagcctaacaagtgggtcaagtgctaatagttttaagggtgtttcgggtttttgttttaaaagttaattatctgtaaagacaaatcaatggagacagatagtagattagtggctgcctggggtgtgaacagattaactgtgaattgacaggagggatcttactgaagtgccaaaaattttctaaaattggattatggtgatgatttcacaaattacttttttttttttttttttgagacgaagcctcactctgaggcccaggcaggagtgcagttgtgtgatctcagctcactgcagactccgcctcccgagttttcaagcaatcctcacacctcagcctcccaagtagctaagattactaaaggcacatgccatcaagactggttaatttttgtatttttagtagagacagaatttcgcagtgttggccaggctggtctcaaactcctgacctcaggtgatctgcaagcctcggcctcccaaagtgctgggattacaggctagagccaccgcacctggcccatttcacaaattacttttagtaagcaaacttaactaaaaatcactgaacggcatacttacaatgcatcaatttatgacggaaaaagtatttcagtgaatcttaaaaactgaaaaagaaaagtcaactatctgtataattgtactttggtaatctaagacctaaagtttagggtacaagctgaaataaaatcctaaaaaatctttaaaacatgtgtctagacgttcaaaatttaacctctggtatcaaatagctcatttgcgccgggtgcagtgtctcacgtctataatcccagaactttgggaggccgaggcaggtggatcacctgacctcaggagttcaagaccagcctggacaacacggtgaaaccccatctctactaaaatacaaaaattaaccaggcatggtggcacacgcctataatcccagctactcgggaggctgcagcaggagaatcgcttgaacctgggaggtggaggttgcagtaagccgagatcacaccactgcactccagcctgggcaacagagtgagactctgtctcaaaataaaacaaaaaaaactcatttgcaatttagagacaggaattacagccaagtgcaccccttaccccactcccctggagccacaagccaagagggcaaggtagggaggaccaaccatgcctggtgtcctgccaccaatggctccaggaaccccaagttctctcccacaccctgggcgtgattaaaactagtaacacctttctgttagaaaccacagcgggtgaggacacagctgtttactttttttttaatcaagaatgctgctctcagcactctgggaggctgaggcgggtggatcacctgaggtcaagagattgagaccagcctggccaacatggtgaaacctcatctctactaaaaatacaaaaattagccgagtgtggtggcgggagcctgtaatctcagctcaggaggctgaggcaggaggcaggaaaatctccagacctgggaggcagaggttgcagtgagcagagatcatgccattgcactccagcctaggcaacagagagagactctatctcaaaaaaaaaaaaaaaaaaaaaagaatactttgatggtatctttgaaagttaagaggtcctattcccctcactacttttagattcttgttttcacatggtcttcttgaaagaaactgcacacgcccgctttttcatacaatcacacatgcgtggataaacacataccatcttttattttattttctaaatagagacagggcctccttatgttgcccaggctggtgtcaaactcctgggctcaaacaatcctcctgactcggcctcccaaagtgctgggatgacagatgtaagccaccacgcccggctgcacagaacatctgaagcacatttcttttttgttgttgttgttgccgttttcataatagtatttaacaagataaatatcttggctcctttttgtttttattgccctgcccttcagggattaagtgcatttcttagatactcactacttctctgacattaaattttgtttcagttgcttacatcaacgtttcaaaacccagaaataagaaaattattgttcgaggtcaataaccatgtttataacaacttccaacttaaaatggaagaggaatcccttggagaacacacatttccttatggaagtttcctcaaaatttctaataggaatttcaactaagttaaagtactaatttaagtaggacaagacagaattctcttccttcccagacactattacaagccaaaccacgtttcacaggaacacgtcctgcctgctaaggtgtcccctaggacaaagctgcttgccagctgaccatcacttgtattgcatactttaaaaagtgtggctaacagaaaggaggcaagacagatgttatttaaataaaagcacaaagcatctgttcaagcacgaaaaaacatatgggaaaatacaagcacaggacactcaggacaatgtgatgtgctgaagacacagcggcaaacaaaagagaccggatgccactgacctgtccaagaagaagaacaggaagtattacatgaaggagaacaggaagtaaaacatgactggagacagaacttgtgaattcgaggcaggactctggagccagcctgcccagggtccagtgctggcgtccactcccaacttctaacttccctgggcaagtggcccaacttccttgtgcctcaactgacttatctctgccacaaggggcagaggagcacccgcacctcgggagttcccaagactgtctgagtggacctacatggagcacacagaagagcacccggcaggtagtacatgtttcacaataatccttccacaatgcaaatgacatacactctaaactcatcatgggggagtgcttcacaacaccccctggcacaccacagccaacacaaccacagccaacacaacgacagccgcgccacaaccaagagagcctgaagagctgctctcagtcactgcccagcaagtgtgggcagctgtagcttacagaccaaggccacagaccacaacttctgcaggcttgcctgggacacaggggcagataaggagagcacctgaggcctacgctgagtcccacagcaaggatccgacccacatgggcacagaagacttctactgcaggttgcaaatcttacatccttgacctagtgggtaaaaaaaccctaagaaaaggcaactttctaaaacaatcatactacactcatataagcaattaatttttaataagcactgctcatatattaatgccaattttctccttcacaaattataactctgtcttaaaccaagccactatgaaagcggctctaggccagactctcagcagctaccactgctacggttcctcaagctgctcccctgggtgcttccagggttcctcaagctgctcccctgggtgcttccagggttcctcaagctgctcccctgggtgcttccagggttcctcaagctgctcccctgggtgcttccagggttcctcaagctgctcccctgggtgcttctagggttcctcaagctgctcccctgggtgcttctagggttcctcaagctgctcccctgggtgcttccagggttcctcaagctgctcccctgggtgtttctagggttcctcaagctgctcccctgggtgcttctagggttcctcaagctgctcccctgggtgctgttagggttcctcaagctgctcccctgagtgtttctagggttcctcaagctgctcccctgggtgcttctagggttcctcaagctgctcccctgggtgctgttagggttcctcaagctgctcccctgggtgcttctagcgttcctcaagctgctcccctgggtgcttctagggttcctcaagctgctcccctgggtgcttctagggttcctcaagctgctcccctgggtgctgttagggttcctcaagctgctcccctgggtgcttctagcattcctcaagctgcttccctgggtgcttctagggttcctcaagctgctcccctgggtgctgttaggcttcctcaagctgctcccctgggtgcttctagcgttcctcaagctgcttccctgggtgcttctagggttcctcaagctgctcccatgggtgctgttagggttcctcatgctatctccccttaagtgctgtggcagcagtgcagagcccacatagctatataagctactcagtaagaaaaaccacacaggagctacacgcaccacatcatggacaaacctcaaaacacaccaggtggggatgtcactgaaaacagccccaaaactcactccttccaacactgcatgagtaagctgcaaaaactgtcagaatcaactcttcagaactgtggagtctaataaaaaacttctaacaagcagagaacgcctaatgaaaaagctgctcgatttgggcaggagagagctgtggagaggaacttacctgctcacacacctcatccttggagacagcagcccccattgctggtacaaaagagtgccgcagactcaattctcaaagaattggggctgtacattttgacctatctggtaggaatgtaaaatggtgcagctgttgttgaaatactttggcaattcctcaaaaggtaaacacagaactatgatataacacagcaattccactccttggtatatgcccaaaaagtgttcaaatggaaacctgtgcacacatgctcacagcactattgaaaacagaaaggtggaaacaggtagggcgtggtggctcacacctctaatcccagcacttttgagaggctgaagctggccaatcacctgaggtcaggagtttgagaccagcctggccaacatgctgaaatcctgtctctactgaaaaatacaaaaagtagtctggtgtggtggcgtgcacctgtagtcccagctacccgggaggctaaggcaggagaatcatttgaacccaggaggcggatgttgcagtgaaccgagattgtgccactatactccagcctgggcaacagaacaagattcggtcccaaaaaaaaaagggggggtggaaacgggggccaggcaagctggctcatgcctgtaatcccagcacttcgggagggcaagacaggcagaccacttgaggtcaggagttcgagaccagcctaaccaacatggaaaaaccctgtctctactaaaaatagaaaattagccgagcgtggtggcatgtgccagtaatgccagctactcgggaggctgaggcaggagaatcacttgaacccgggaggcggaggttgcagcaagccgagatcacgccactccaggctgggtgacagagcaagactccgtttcaaaaaaaaaaaaaaaagatggaaacaagccaagtgtcaatcaagacaggatgggtaaacaccctgcctacacccagacaatgcagcattattcacaagtaaacaggaatacagttccaagacatacaacatagatggactccaaaaacacgttatgtgaaagaagccggacactaaaggccatatattatatgaactcattcctaggaagtctccaaaatagacagatccacagtggcacagagtcaacagtggctgaagagctgcggagaagtggagcgcttccttcggggggaacagaaatatcctggaatagacataatggtgctagttgcacaaagttgtaaatgtgctacaggccatggaattgtacacattcaaatggtcagagtggtggggtgttcgttatgtgagtcttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagtcttacctcaataaaattaaagtagtatgtcagactcaaaagactacaaattccaggccaggcgcagtggctcacgcctgtaatctcagcactttgggaggatgaggtgggcagatcatgcggtcaggagttcaagaccagcccagtcaatatggtaaaaccctgtctctacttgaaaatacaaaaattagccaggcgtggtggtgggcacccgtaatcccagctactcgggaggctagggcagaagaatcacttgaacccgggaggcggaggctgcagtgagctgagatcgcgccactgcactccagcaaggctccgtctcaagaaaaaaaaaaaaaaagactacaaattccattcatatgaaattctaaaataagcaaaactaatccacaataacagaaagtgggctggcagtgcttggggcagtggagggttctggttacaaatgggcattctgcggtgatggaaatgtctgtgtcaagctggtgcttaatacctggggtatcaaaactgtcaaactcatcctactgtaccttctaaaatggctgcttttattatataaagtatacaggtataaacatcactgaagaaatccaggtacatgtgaaacacacaagtgtggagctgaatggagccacgcgaaccaatacacaatcgtcagattcagacccagaccccagctgagacggcacctcgcaatgacttgctcccaaagaaagatgttctggccagagccctggagaccccacacctggggactggagaccgcagccatccacctgcaactctgttctcagacacctctgctgtgcggtggccccaggaaagcagtgacacaaaaagaaaaaaaaaagctttctgaaacggtgctttagaggtttaaccaaaataaaactcaaccaattttcttcaaaacataaactcctgttcttgttgtactttagcacttgctttacgtaatttcatttcttttttttttttgagacggaatctcactgtgtcacccaggttggagtgcagtggcgcgatctccgctcactgcaagctccgcctcccgggttcaggccattctcctgcctcagcctcctgagtagctgggactacaggcgcccgccaccacgcccggctaattttttgtatttttagtagagacggggtttcaccatgttagccaggatggtctcgatctcctgacctcgtgatccgcccatctcggcctcccaaagtgctgggattacaggcgtgagccaccgtgcccggccacgtaatttcatttcttaggaataacattttacattaaagaaaatactttgccacgctttcactcatgattttgcagttccactggaaggctgaacatcactctggcaagttcagacatgttccattaatcatctccaaggctgcttgctacaaagaagctgtttcattcaacagcatctccttaaacaaaatccaagcctgctttgcctttggtaaccaaaacttgatttaacctcccaaagagggagccagcctgctgctggccactgcgtgccctaggcctcagcttcctgctgctgactggctgcctgcatctcctctgcggccccggcctcatgaagctgcccactggtcctgtggttcctcaggggtcctggcactggcaaggggacgcagcaaacccacaccgtcgtgaccctggtcacatacacctgtcttcaggaaaacttctctgtgatgaaagaacccagattcacagtggtgaactcttcaaaaactatactaaacaagggaagactgtgctagatgaaataaccatacatgcatttattcacatgggaaatggatcagacaatggctgccaatgctaagaataaattcttgatgagtttctaagaaatcaagacaaccttcaaggttgggccaagagcatggatgggaaaggcagatgtgcatctggttctgttttctgaccataataatgagatctacatgaaaggatgtcttgagaggagggaacagtggtaagagtgaagccagcagagagagcttggaaaagagaattcagacccatcttcaagttaacaaaaacaattactgactcatacgaagaaatcgggaaagtcaataaaacggatgcttctaaacctgttgatgaagtttttctgaagttgtgaaaatttccaacaaaaaagactaactctaagcctgaaagtatcctttcctttctttttgagccacgacacccggcctcttacaagttttttatttccaaccttaagtgaatttgtggaccaaatttcaaaacaactttttgtgaattcagttcctgcataatatgtttggtaaacaactaaaaaactgattcctagtactgtttcagtatttatcaaacaactgatcgtgttctataaaaaggtttaaaaaaataaaattcaggaacagtggcccatgcttgtaatcccagcacactgggaagcctaggcaagaggatttcttgaggcgtctgagaccagccccatgtctacaaacaataaaaaagtagctgggcatggtggtcgtgcctgcagtcccagctattcaggaggctgagcctggaggatcgcttgagcccaggaagtcgagattgcagtgagccaatttcgtgtcactgcactccatcctgggtgaccaagcaagaccctgtatccaaaaaaaaagaaaaaaaaaaggccaggtgcggtggctcacacctgtaatcccagcactttgagaggctgaggtaggtggatcatttgaggtccggagtttgagaccagcctacccaacatggtgaaactccgtctctactaaaaatacaaaagaattagctgggcgtggtggtgtgcgcctgtaatcccagctactcgggaggctgaggcaggagaatcatttgaacctgggaggccgagattgcagtgagctgagattgcgccactgcactccagcctgggcaacagactaagacaccgtctcaaaaacaacaagaacaaaaaacattaaaaaataaaattaaaattaaaaaataaaaatcacatgctttggtcataaaaataataagtgtatcctataaatgtcctgaggtcaggagttcaagaccagcctggccaatatggcaaaaccccgtctccactaaaaatacaaaaaattagccgggcgtggtgccaggtgcctgtaatcccagctactcaggaggctgaagcaggaaaattgcttgaacttgggaggtgggggatgcagtgagccaagatagtgccattgcactccagccttggtgacagagcgagattctgtctcaaaaacaaaacaaaacaaaaattaaatttgacactgggcacagcagctcacgcatgtaatctcagcactatggaaggttgaagcaggcgggttgtttgagcccaggaggtcgaggctatagtgatccacgatcacaccactgcactccagcccgagcaagacagcaagactctgtctcaaaaataagtaaacaaaaattgaatttgacctgcagggggtagtcacaattgaggaatctgagctgtggggcaaactgttcaaatgaagattctgacccacaggaacaaactgatccaaaagggaaatatgccagtcacgaaaggacaaatattgtatgaccccccaccccttacaggagaggtgccttggacagtgacattcataagagaagaaaggacaaatatcgtatgacccccccccccaacaggagacgcaccttgagtggtgacattcataacagaagaaaggacaaatatcgtatgaccacccccccgcaggagacgcaccttgagtggtgacattcataagagaagaaaggacaaatatcgtatgaccccctcccataggagacgcaccttgagtggtgacattcataagagaagaaaggacaaatatcgtatgaccccccccccccccttataggagaggtgccttgagtggtgacattcataagagaaagcagattggtggtcaggggttatggggagagtcgaggttatggggagagggatgaagagttagtgttaatgggtagccggtgtcgtctgggaagaccaagttctggagagggatggtggtgatggctttgcaccgtgtgaatctaataccagagaactgcacactcaaaaatggtacaaatggtcaattttatactgctgggctcagggaatccttcccctcagcctcctgaggagctgggaccacaggcacctgccaccacgcctggctaacttttgtattttttgtagaaacagggtatcttcatttgcccaggctggtctcaaacgcctgtgctcacgttatctgcttccctcggcctccgaaagtgctgagactacaggcgtgagccaccacaccccacttaataattccattttaataccgatttactaaacaaggaaaagctcatagaattactaactatgccatcttatttaggctacctaaattctctgaacttcatcttctaaataaataagaagaaatgtatcttttaacactaataactatggtcattcccattaaaacattaagttttgaaaactagggttctcatttaagcctgtctcacagcagctcagctctcagaatgttcagaagactctgacactgccctctcccctcctctggcactcattttggaaacctgcagagcatctattgaaaaagcccatcccagcatcttcttaatcactggtatacttccgtctgtcacgagcttcatttaaaaaaagcgtcacgctccctctccctccccctctccctctccccctctccctctccctctctccctctccctctccccatggtctccctctccctctctttccacggtctccctctcatgctgagtcgaagctggactgtactgctgccatctcggctcactgcaacccccctgcctgattctcctgactcagcctgccgagtgcctgcgattgcaggctcacgccgccacgcctgactggttttggtggagacggggtttcgctgtgttggccaggccggtctccagcccctaaccgcaagtgatccgccagcctcggcctcccgaggtgccgggattgcagacggagtctcgttcactcagtgctcaatggtgcccaggctggagtgcagtggcatgatctcggctcgctacaacctccacctcccagccgcctgccttggcctcccaaagtgccgagactgcaacctctgcccggccgccaccccgtctgggaagtgaggagcgtctctgcctggccgcccatcatctgggatgtgaggagcccctctgcctggctgcccagtctggaaagtgaggagcgtctccgcccagccgccatcccacttaggaagtgaggagcacctcttcccggccgccatcacatctaggaagtgaggagcgtctctgcccggccgcccatcgtctgagatgtggggagcgcctctgccccgccgccccgtctgggatgtgaggagcacctctgcccggccaccccgtctgacaagtgagaagaccctctgcccggcaaccaccccgtctgagaagtgaggagcccctccgcccggcagccaccccgtctgggaagtgaggagcgtctccgcccagcagccgccccatccgggagggaggtgagggggtcagccccccgcccagctgccccgtccgggagggaggtggaggtggggggggtcagcccccccgccaggccagccgccccgtccgggagggaggtgggggggtcagccccccgccaggccagccgccccatccgggagggaggtgggggggtcagcccccccgcccggccagccgccccgcccgggaggtgaggggcgcctctgcccggccgcccctactgggaagtgaggagcccctctgcccggccaccaccccgtctgggaggtgtgcccaacagctcattgagaacgggccatgatgacagtggcggttttgtggaatagaaagcggggaaaggtggggaaaagattgagaaatcggatggttgccgtgtctgtgtagaaagaagtagacatgggagacttttcattttgttctgtactaagaaaacttctgccttgggatcctgttgatctgtgaccttgcccccaaccctgtgctctctgaaacatgtgctgtgtccactcagggttaaatggattaagggcggtgcaagatgtgctttgttaaacagacggttgaaggcagcatactcgttaagagtcatcaccactccctaatctcaagtacccagggacacaaacactgcggaaggccgcagggtcctctgcctaggaaaaccagagacctttgttcacttgtttatttgctgaccttccctccactattgtcctatgaccctgccaaatccccctctatgagaaacacccaagaattatcaataaaaaataaataaattaaaaaaaaaaaaagcctcacactggataagtgtttttcaataatttcaacgtagtattccacagcaaattgtctagttcacatttaattcaaaattaattccctacgttaccacacaagcaatagactgttaagtttaatgctcccatggctttctacttatgcaaaaaattaacttcttcaaaacacctatggtggaagttcttcctgttcagactgcaattctatttacaaaaaacaatagtactgtagtactattagaccacaacgctaacgccaggcacagtggttcacacctgtaatcccaacattttgggagggtgaggtgggcggatcacttgaggtcaggagttaaagaccagcctggccaacatggtgaaaccccgtctctactaaaaatacaaaaattaatcaggcatggtggcgggcgcctgtagtcccagctactcgggaggctgagacacgagaatcacttgaacctgggaggtggaggctgtagcgagcgaagatcgcaccactgcactccagcctgggtgacagaacgagactccatctcaaaagaaaaaaaaagatcacaatggtggaatctaaccctcttatctaaaatttcttaaagtaacaaacattttgaaaagaataaatctggcagagcgtggtggctcacgcctgtaatcccagcactttgggaggccgaggcaggcagatcacgaggtcaggagttcaagaccagccaggccaacatggtgaaacctcatctctactaaaaatacaaaaaattagctgggcgtggggtcagacacctgtaatcccagctactcaggaggctgaggcacgagaatcgcttgaacctgggaggtggaggctgtagtgagccaagatcgcaacactgcactccagcctgggcgacagagtgagactccatcttaaaaaaaaaaaaaaaagaaaagaaaagaaaaagaaaaaaagaaaagaataaatctgtaacagcactggaaaacagaagaatgacatgtcaatagttgaccagaattaagcacctaaattaacagaaagtaaatgaaatcagacaaataacttaagtttagagaaaacagagaccaaactctacagaaggaagaagccgcagagatcaaactctacagaaagtcaggaccactgcagaggaaaagcaagcttcaaggatgaaaaaccaataaagctacacagttccaagttcatctactatgattactatgatggggaaaccacctgggggtcaggggccgaatctggcccaatgtcttttttagacagtccacaggctaagaatgaggtttatatttatacctggttgaaaaagaaaataacattttgtggtaagtgaaaattatatgaaattctaatttcagtgttagtaatagttgtaactggaaaacagccaggctcgttttaagtgtggccccggttccttccatgatacaacagcagagctgaagagctgtcagagaacatgcggccacaaggtctaactggcccttgacagaaaaactgagatggagttaaaaagacaagtctgcatattaaaagagcttcaagatgctaaccaatataaaaaagtcacaatctaaaccctaaaaatagcaaaatgtcagactcccacatatcaacagaaaatcctacaagtttccacaaaatcctaaaaagcttaactaaaaaagaatcatgaattagactggcgttggacttctctcatctttacagcagaggccacgacagagaacaggggcagcacactcttgccgtgaagagcagacagtccatcgaggcctttctgtgccacaccgcccgcccgcacacatccgcggaaagcctgctttcagctgctcagcaggtgggaacacttgctcctccagcattccaccatgagacaaaggaaaaagtcgcttctgtgtgtccaccagcacacgactcccatgtactcctgcacgtcacgtggacgagctaaagaagactcctctgctccacagccaccatcacactttcttgtttttgttattttttgagacggagtcggagtctcgctctgtcgcccaggctggagtgcagtgacacgatctcagctaactgcaagctccacctcctgagttcacgccattctcctgcctcagcctcccgagtagctgggactgcaggcgcccgccaccatgcccggctaattttttgtatttttagtagagatggggtttcaccgtgttagccaggatggtcttgatctcctgacctcatgatctgcccgcctcggcctcccaaagtgctggaattacaggcgtgagccaccgcgcctggccaccatcacactttctaaaaggtcagggtgccaatcacaacagggaccagtaaaaggagattgtgtcataaactcaacaagctgcccagaaaaagatgctggcagaacctgctgcactggccgtgggctcaggcacaccaggtaaacaccagagcgcatgcagcccaccccctacaagcaacgagcccccacctgctgacagttcaattctctgaagaagaaatgatgatcttatttatctaaaacccaaaagacttaattctcatttatgggaaacattcacaataggcaaatccagagagatagaaaagagagtaccagttgtcagggaaagggggaagggggacaaggactgatgacacaggggaccgcatgaggatggaaacttgctggaatgtgacagtggtgatgggtgcacaatataatgaatatactaaaaatcactaaactgtgagctgtaaatggtaaattttgtattctgtgaaccagatctcgttcatttttcaaaagaaagtcatcacccaacggggtaaaattcctaatgcctggcatccaacaaaatcactaggcaaagaaggaaaaaatacaagcctcagaaaacgacgattagtgctcaaaaaaacacaaatacaaaccataatgaggttaaaagaaataaaccaacatagaattgaaacaggtgttaaaattagtagacaaagacattaaaagctgttgaactgtattccacatgttcgacatggaaaatataaaaaagacaactcggtagcagcaaacaaaagatgcaaagagccaagtgtgggcggcaggggccctcccgcaactcgggcatgttcgagagtttttagagctccatcttcagctcctgctcccttccctggaggtcagtggccggagatgaaagccctagccctctaataatcatctggtcttcctggtgaccacccctaccctgtcagttcattagcttaaactctggtgtgatctgaaaggagctagttatgaataacaaatgacatcctatcatataagaaattccaatggttgcaggaactctgtgccaggagtgagaaggcgcagggagaaaaagaccacataatcttttattgaccaaagttgccaaacccacaagctgcaatcaggccaggagcggcggctcatgtctataatcccagaacctggggaggccacagcaggtggatcgcttgagcccaggagtttgagatgggccagggcaacatggctaaaccccatctctacaaaaaaaaaaaacagaaagattagctggctgggtatggtggcacgcacctgtagtctcagctatttgagaggctgaggtgggaaaactgcctgagcccaggaagttgaggctgcagtgagctgtgatggcaacactgcactccagcctggaccacagagtaagaccttgtctctaaaaagaaaccctgggctcaagtggccatccagcctcagcctcccaagtagctgggactacaggcacatgctatcacacccagctaagttttatttttatttttgtagagacggggtcttgctatgctgcccaggctggtcttgagctcctggtctcaagtgatcccccgccttggcctctcaaagtgctgagactacaggcgttgcatctgaccctgtatcactcttcaacacgcaggatgcactgcacagctgatcccaaatgctgttgtgaatctaatcaagataccgtaagacatactgcatatgtttttaaaaatcagataagacgactgggtgacttgctacccacagtgttttgttttgtttgtttgttgagacaatgtctcgctctgttgcccgggctcaagtggagtggcgtgatctcagctcactgcaacctctgcctcccgggttcaagtgtttctcttgcctcagcctcccgagtagctgggactacagatgcgcaccaccatacccaggtaagtttttttgtatttttagtagagacggggtttggttatgttggccaggctggtcttgaactcctggcctcaagtgatctgcccacctcggcctcccaaagtgctgggattacaggtgtgagccaccacgcccagactgcagtctttatcactttatgacactgtaatcatgaacttggaaagaagggtctattaacttagtgttaacttgaaaaggaaaaccaaagcagaaatctaaacaattatttggatgactacagcaaaactaagaggatttgggtttaagttgttgtagtagctatgccacatggcacagactctatcaccttctcacccacacctgcaacgtgagtgcagctcctccaatcatgaggtcggggggaaagtctattttgcaccccttgaacccagtctcactcaccgatttgctgttaccaacagaatgaagcaaaagttggccaggtgcaatggctcacacttgtaatcccaggactttgggaggctgagacaggtggatcacttgaggccagaagtttaagactggcctggccaacatgtcgaaatcctgtctctactaaaaatacaaaaattagccgagcgcggtggcacaggcctgtaatgttagctactcaggaggctgaggctggagaattgcttgggaacctgggaggcagaggttgcagtgagccgagatcgcgccactgcactccagcctgggcaacagagtaagacgctatctcaaaaaaaaagaaggacgaagcaaaagtgaagccatgtggcccctgcttctgctgccctactgttcttggcagccccaatggccagcctgctggatgttgaaacgtacagggctcagctgacaccctgccagccaatgtatcctacaggaagaatgatacactgtcaccaagtgggtttaacccaggaatacatgattggttaaacgttcaaaaaacaaaaccaaatgataaataaatgtaaaagaaaactataaaattcaatgtccattcctgatacttagcaaacttgtaatagaagggaacttcctcaacctcataaagtgcctttatgaaatcccacagcaaacatcatggttaatggtgaaaaagtggacacttttcaattaccatcagaaataagcctgtgtcagagcctgcagtgagccaccactgcactgcacttcagcttgggccacagggcgaggctctgtttcaaaaaaaaaaagaggaaaaaaaagaaataagcctgtgatatccactcttttttttcttttgagatggagtctcactctgtcgcccaggctagagtgctgtagcgcaatcttggctcactgcaacctctgcctcccaggttcaagagattctccagcctctgcctcctgagcagctgggaatagaggcaaacactgccacgtccagctaatttttttgcatttcagtaaagatagggtttcactgtgttgcccaggatggtgtcaaactcctaacctcaggtgatccacccaccttggcctcccgaagtgctagaattacaggcgtgagccaccgcacctggttgatctccactcatcacttcttttgaacaccgtactggagattctagtccaagagaaaggagataaaacgtacgcaaataagaaaggaaaaagtaggccaggcgcggtggctcacacctgtaattccagcactttgggaggctgaggcgggcggatcacgaggtcaggagatggagaccatcctggctaacacggtgaaaccccgtctctactaaaaatgcaaaaaaaatagctgggcgtggtggcgggcgcctgtagtcccagctactcgggaggctgaggcaggagaatggcgtgaacccgggagcggcagttgcagggagccaagatcgcgcccggagacagagtgaggctccgtttcagaaaaacaaagtcagttgtactttttccttttcttttgtttttgacggagctcactctgtcgctcaggctggagcgcagtggtgcgatctcggctcattgcaacctccacttcccgggttcacgccactctcctacctcagcctctcgagtagctgggactacaggcgcccgccaccacgcccggctaatttttttgtatttttagtagagacggggtttcaccgtgttagccaggatggtctccgtgtcctgaacttgtgatctgcctgccccggcctcccaaagcgctgggattacaggcgtgagtcaccatgcctataatgtcaccggcctataatcccaattcttacaagaaaaccaaaagcgaggaaaaatgaagtaacttactcatggtcatagcttatcactaagattcaaaccctttctacaaatcctgccctgtagaaaaagcgctgaaatgggatgcactattaggacaggcacacaaggggaaacacacccctcagatgacagtgaggagcttatccaggtccaggtcaacgcaggtcagtctgaggagaggcagccatgggtgttttgtgtacagactaaacgtaggtagggaatactggttaacaccatagactgagaaaggagggtaaatactaaagtattagtctctaagaaatctcatgaaagcagccaggtgcgatggctcacgcctctaatcccagcactttgggaggcaaaggcaggtagatcacaaggtcaggagatcgagaccatcctggctaacatggcgaaacccagtctctactaaaaatacaaaaaattagccgggcgtggccgggcgcggtggctcatgcctgtaatcccagcactttggtagtaccaggcgggtggatcacaaggtcaggagatcaagactatcctggctaacacggtgaaaccccgtctctactaaaaaatacaaaaaaaaattagctgggcacggtggcggacatttgtagtcccagttactcgggaggctgaggcaggagagtggtgtgaacctgggaggcggagcttgcagtgagctgagatcatgccactgcactccagcctgggcgacagagcgagactctgtctcagaaaaaaaaggaaatctcatgaaagcatgggagccaaagccttccttcctacatcctcaatttaaaagcatgactgaggctgggcgcagtggctcactcctgtaatcccagcactctgggaggccaaggcaggaggatcatttgagctcagaagctggagatcagcctgacagcagagtgagaccccacctctgttttaaaagtaaaaaaaaataaataaataaaactaaagcactattgaccctccaaactagttactatctggaaattctagcgatttccaaatcacagctttcgaggaactgtgtgcaaaacctaaaagcctgctgccccgaagtcctgtgtggagtggtgctctcaccactcaggaattcacgagacggcaagaactcatcaagttaccctgcagccctgaaggagtccacaggaagtgattctctttgctagaggctgctctgagaaaaagcttcaggtaacaaattaggccaccatggagacacttaagatatgatttcatgaccaggtgtggtgcctcacgcctataatcccagcactctgggaggtagaggtgggcagatcacctgaggtcaggaccagcttggcccacatgatgaaacctcctctctactaaaaatacaaaaattatccgggcgtggtggcggacacctgtaatcccagctacttgggaggatgaggaaggagagttgcttgaactcaggaggcagaggttgcagtgagctgagatgatgccactgcactccagcctgggcgacagtgagactctgtctcaaaaaaaaaaaaaaaaaaaaaaaaaagatatgatttcatttaccacccaaatcaactcacatacaactcacagcaaagaggaaacaggaaaacatgtaccttaagtccttactcccccagttaccaggtcctgaacatcagggacaatggctatgaccctcgaggcatgcagccctgccaaacatcacatgctcattttatctccagacacatctcctagaataaaatgggaagctgttgtacccatccttgaccctcaggtgactacttttaaaggtgctctccaccgggcagaaagagcatcaggatcagggcagaaacctaattccgaccaagctttagggttccgagtctgagagcaacttcccatcctttttctgagactgaagctgctgtcaacactgcccaataaacactcgcaggacacagctaaggaagacagaaaagtgagaggcaaatggggatgctgactttgcatcttcatgttccaacctgagtatcacctgtgcttttgtgtttgtgtggatctgtagggacggtaccaagatctctaagtcaggtgcaatatcaggagatctgcacatttactaaggggaaggggaagggagaaaaaaaaccgtctcagactcaacaataaacctaggaatgaaaagatccaaagcaaaggagcagcaaggctggaaaagctccggcggcagagcaggacccgagtcaccagcacatcacactcctctgacccatttattgatttatttgagatgagctcttgctctgtcccccaggctggagggcagtggcacattcatgtgtcactgcaacatcaacctcccattccactgcgcccagcttattccattctaatggctgtgcacaccgtttaaatactgaccacagaggtgttactgttttattaggtatctgccctaagtgtgccaagccttttatttgaggatccaatgaatatcacttagtggaaaggaagtaaaagataattacaacacaacaataaattattaccacagaggggagcagagagcaccgcaagaccaaaggtgagaatctaaccaatggcagaagtcacaagtgaaaaaagagctcaaccatgagatcaagaggctcactgggggccagacatagtggctcatgtctgtgatcccagcactgtgggaggctgaggcaggaggatcacttgagcccagaagttgggagaccagcctgggcaacacagtgagaccccgactctacaaaaagtacaaacattagccaggtgtggtggtacacacctgtggtcccagctacccaggacagcttggcttgagcccaggaggtcaaggctgcaataagtcaggatcacaccactgccctccagccgaggcaagaaagcaagaccctgcctcaaaaaaaaaaaaggatcattgggaacatggaggcctgaaggatgagtaggcatcagtcagggaaaggagagaagggaatttgaggcaggaagcaaagacctcaagaactctgatgagtccatacttactactgaaaataaccaatctctgcctagagaatagaggtggagaaagaggcagactggactagagtagaattccaccaggccctgaccagctgcttcactgaccacatccatcatctcatctcacctcatcctcaccataagcctgagaggcaggcaggacagtgggaaatgcaaggcatagggcaaacagcctgatagtaccagggcaagcccaagtgtcccatccacccaaactgtggccacgagtcttgattctacttccgttctacaagtgggtccgggaatgcatgcaaatggaggagagagaagagacgcaccgctctcccacagactgatacgtcatggaggagagagagatgcaaccaattcccagagactgacatgtcagtatccagggaatgagggttctgaagaacaccccaggccagcagacagaccctaggtgagcctggcaatctccccacccagtgtccatgcctccttgtagccaccttgcccggagtgcaaggcgggtgggacctgtgacgtgcttctaacccacagaatgtggtgaaaacaatggaatggctttcccttgactgggttgcattaggtggcaaagttgctgcgctgtcactcccatgactacattatgttacgtaagacttagtctactgaagcagaagactctttgctgttttgaagtgagctgccaagctgcaaggggccatgcgccaagcaagtacagggggcctctaagagtcaagaggagacctcaagggacagtcaacaagaaaacaaagacttgcgtcccacaatcagcaagagataacttctgccacaacctgaaagagctcaaaagcacaccatcccccactcgagcctctgataagatcacagtcccacccaacacctagattgcaaccggatgaaaccctgagcagaggatcccactaagctgtgcccagacttccaacccacagaaactgtgagataataaatgtgttgtgtgtcaatttgttacacagcagtagaaaataaatacactggcctggcatggtgactcatgcctgtaatcccagcactatgggaggccaaggtggaaggaatgactgagcccaggaccttgagaccagcctgggcaacatggtgagaccctgtctctaccttatgtaaaaaaaaaaaaaaaaatttaagaccagaaatatacccccacacatcatcccatttgaaagaaaagctttcatccatgctacttccttccatgcacaaataatgactggttgccagaaaggcagcacaggtcactcttcagaactccaaatgctctttccaacctaccaccaacacacatgatgccaaccccactgagaccaaggcagcctcccaagctcagagagactccgagaccaagttcttcataactgaactcacagcttcaattatttcatactcaatcactatattccaagttttttataattaacaaaatgctgccttcaaggttacatatgccaccaacgtcaatcctcagaacactgcataacatcccaaaacttacacatgtatcatccaaataaaaaaataaaatgtaagttaaatcttcaaacgcaaatttgtgctgatgatctagaaggaaagctgggccctgcctggccgggagctgcctcctttcttccccagctttgtgcagggccacccctgccctctcctcacccctgctggtgcagtgagatgaggacctcaagtaagggggtggcagccgggacttccacaattcagggcaatctctggcatctgttgttcagtcagtaattttccaacagaccctcttgactgtgacgggcagagaaaggctggggagctcttgggtcgtcagtgggttggagagatggactaactcacaggtaggaaaaaaggcaatgaccactccactggagaacaaagcccacagcatttaagctggagggacaagaaaatccaatcattctgatgatgcagctcctgaggctccgtggccaagctgggatgtgaaagaagacaattccattcccctccctcatcaccaggtgactgctgcctcccagagagctccctcatgaaagccccgtaacccaccacgctgcactgtttctatagcaaccagaaagaaaatataaagcaagcagtttcacatgaaaattattctctattaaaatgaaatattgcagtcaggaaaagaattttgataaagaactaggtagaagacatcggtaacattaatgctaattatttattcactacccacacaaaagataatttttcctaaaattttaagataatcttttatcgttcacactggaagtctgaaaacagtactacagcaagtcaacaacaaacaattacaatcaaaattctgttctatgctgtgatatctccacgaaacacaaaatgctctcccaagtttaaagagggataaggaacacgaaaacaactgaccccggccaggtgcgggggctcacacctggaatcccagcattttgggaagccaaggtgggtggatcaattgaggtgaggagttcaagaccagcctggccaacatggtgaaaccctgtctctactaaaaaaatttaaaaattaaccaggcgtggtggtgggcacctgtagtcccagctacttgggaggctgaggcagatgaagtgcttgaaaccgggaggtggaggttgcagggagccaagatcacgccactgcactccagcctgagtgatagagcgagactgtgtctcaaaaaaaaaaaaaaagaaaaagaaaacaactgagccaaacaatggagaaaacacagaaaatatgcaaattatgagaacaaaaaaaattcagccaatgccttctcacatcaaaataccaaaactacaaagccaatttcaggtataccaacccattctcaaaagatgaaatcaaattcaaatgaacctatctttgcctatctttgacatccctaaagccacctgtgacttgtcacagccttaataacccaccacaatcgggatggtcatatgtcccctgaagtcacagaaacagaactctcaactagcagactgttaacgtgtcctattatcctcaggttcttgggttattcgtagaatagcaaagcaaactacctgctttgtaacgatatcatttacacatcaacatcaggaataaatacaaaccaaaacctggccaaaccaggagaggtgcctggaccaggacaggcagacccaacgcctacgcttgcttctaaccagcctgggcaggtgggcaggttacaacacactcctgactcagccaggtggggctctgcagcctggcagttacagacactgagacctcaagccgcaggcactagcctgccaaaaaagacttctcctccttggtctcacagccaacagtttggacacatatcctagaggtatactacacttccagcaaagagatgggggcccaaggcccaccccaaaccacttcatcctcccctcaccacactctgaatctggttctctcagaggcatgatgagagctggggtggagaggtgtggaaaagacacagtcctgacttcagagtccctctgggcagactcatctcacagtatcgcgtaacacacaacacacgtttatacacgggcacagactggaacacatgatatggtaacaatctataatacgaggagctcgttaagctcagagatgaaaggggaagtgagtggaagaccacaccgtgagcatctattaataaaagcagacggagtaagaaacagagaaaaaggttctcctttggtcttgtctttctttgtctactatttaaaacacgagagaattagctagttaaatttatatctcagaaaacaggcacaatagaagtataaaagccatcacctttaagtcatttcccctttttttttttttttggagacagagtctcactctggtgcccaagctggagtgcagtggcgccatctcggctcactgcaacctccacctcccatgttcaagcgattctcctgcctcagcctcctcagtagctgggatgacaggcatgggccaccacgcgtaatttcttttttttctctctgagatggcgtctcactctgtcacccaggctggagtgcagtggtgcgattctggctcactgcaacctccacctcctgggttcaaccgattctcctgcctcaccctcccgagtagctgagattacaggcgcctgccaccacgcccagctaattttttgtatttttagaagagacagggtttcaccatgtggcccaggctggtcgcgaactcctgacctcaggtgatccacccgcttcagcctcccaaagtgctgggattacaggtgtgagccactgggcccggcagtatttagcattttaataataaaaatattggagaggccgggcgcggtggctcatgcctgtaatcccagcactttgggaggctgagcaggtacatcacctgaggtcaggagttcaagaccagcctggccaacatggtgaaaccccaactctactaaaaattcaaaaatcagccaggtgtggtggcaggcaggagaactgcttgaatgcaggagaactgcttgaacgcaggaggcgaaggtttcagtgagccaagatcacgccactgcactccagtctggggacagagcaagactccatctcaaaaataataacaaaaaattaaaaaatcagacctaatatttgtttcttggtatgtattctttctattccaatttattatggcttcaaaagaagcccaaaaaatcaaaaaagaaaaataaaacaatggcttaatgagaggagcgcttaataaactgaaattttgtttaacactttcaggaacagttcccaacgttgttgtcagggcacagtgacagtggcccagctgcctcgccagcagcacacacaggcctctggggccagcagagaaacactcccagtgccttcaagaaccccattttcacatccagggtccaggaaacagacatgcacgtcggactatcaccctagtgagaaagaaggaaagccacattggggttggttttttttttaacgtccttcaaatctatggaagacatcctcttctacacaactcataggaaaaaagatccctctgaggttaagcaacccgacgcctccacaccacaactgaacatcctcctacagcccccacccggtaactcattactttccaaagagaatgggtctcaaggtctcaaggacccactgccctccaaaaaagcaacctggacatcctgctgacaactgagcatcatacaaatgtgtccctttcgtccccgctgccctccaacagtcaccccccagagcgaagctgcctgtacaggccacgtcctctcctccagcagccggctacgcgcagctctccggcacagccatcacctgcaccactaaagcgggtggcagtttctgcccgtgacatttctcattaggactttccacaattcttgaggcttaatgcaaattccttattcccatgactaacatcaaagaaccacacctccaaagactgacactgggattattcctaaatttctcaaggatgaggtaatctggaggttaaacatgcctgaactgagctgtcctcacttgggccctccagacctttcacttgttgggtgtgtaaataatgacccaacactttttcttttcttttttgagatgttctcactctgtcaccggggctagagaccagtggcatgatctcagctcactgcaacctcaaccttcgggcctcaagacccacacctttggcagctgtgtaactagtgggtcctcctgttcctgtggacagcagtcccatcaacagcaagtcacgccaccacctaccccacaacccaacccagtccctgaagattcaggtgacagttaactgacgtcaagagagtgcaacatcactagaaaaacattaatgacggccagacgcagtggcgagactccactcaaacaaaaacaaaaaaaggaaaaaaaaaacactaattacaaggaaagtttgcctcctagataaaacacatgtgacctgatataaaaaatatctaggcctggcgcagtggctcacacctgcaatcccagcacttaaggaggccgaggcaggcggatcatctgaggtcgggagtttgagaccagcctgaccaacacggagaaaccccatgtctactaaaaatacaaaaaaattagctgggcttggtagcacatgcctgtaatcccagctattctggaggctgaggcaagagaatcatttgaacccaggaggcggaggttgcagtgagctgagatcacaccactgcactccagcctgggcaacagagcgaaactccgcccccaaaaaaaattaaattaaattttaaaaaggccagacgcagtggctcacacctgtaatcccagcactttgggaggccgagggggcggatcacgagttcaggagattgagaccatcctggctaacacggtgagaccccatctccactaaaaatacaaaaaattagccgggggtggtggcaggtgcctgtagtcccaaccactcgggaggctgaggcaggagaatggcatgaacctgggagtcggagcttgcagtgagccgagattgtgccactgcactccagcctgggtgacagagcgagactccatctcaaaaaaaaaaaaaaaaaaactagccgggcgtgatggcacacacctctaatcccagctactcgggaggctgaggcaggagaaatgcttgaacccgagaggcagaggttgcagtgagctgagatcgtgtcattgcactccagcctgggcaacagagcaagactcagtctcaaaaaaaaaaaattaagtctttcctgccaagtattattgccttccttctcagaccacaagcctttttaaaaatcctaacttttaggccaggcgtgatggctgacgcctgtaatcccagcactttgagaggccaaggcgggtggatcacaaggtcaggagattgagaccattctggctaacatggcgaaaccctgactctattaaaaatacaaaaaaattagccgagcctggtggtgggtgcctgtagtcccagctactcgggaggctgaggcaggagaatcgcgtgaacccaggaggcggaggttgcagtgagccgagatcacaccactgcactccagcctgggcgacagagtgagactccatctcaaaaaaaaagaaaaaaaaaatcctaacttttaagatttccaaccaaatattaattaggtatctattaatatgtgcatagaagtaacagaagatataaaacaaaaacaagtccaagatgagcctaaccatgtatttgggcaaacagaatccccgttcttctttctatactccttctagcagcaggcttcaacctccaaaatctctaacccccttctgtttggacccaaaaccactatcttggcccacattttacactgtcctgacaaaatatctgagggcaaataccagtctgccttggccattaaagtcatttaggcaacacatctgccgagctgagcagagccagcaggtacccatctaacacaaggctccgtcctgggctgtgcccctcaagaattccccagatagccatttcctttcctcaactgagatgcccacttctccctccagaatgtgggcaaatcacaccagtgacgtccacatctgtcaaatgtccccagggcagagaatggagagtgacacacagtaggcacaaaataaacagcacccagcttctgccccaccaccccgttccccattcctgctttcttttctgtctcctttgctctatcgtttcacaaagccactctcctaactaatgtttgccccattccctccactgggaatcaattcatcttctctttttccaagtctttttaatgaataccagttaacaccatgaagtcttcacaattcacctacacagtgtgctttcgagtccccttccctatttcaagtttctccaggttctcttgtagggatcttcttaaggctgcatgtgatgtcttgtgcctgtcatcccagcactttgggaggctgaggcaggaggactacttgaggccaggagttcaacatcagcctaagaaacatagcgaaaccccatttctacaaagaatttttaaaaattagcgcacgtctgtagttctagccactcatgacgttgacgcaggaggctcacttgagcccagaagctcaaggatgcagtgagatatggtcacgccactgcactccaccctgagtgacagagcaagaccttgtctcaaaaaaagaaccatttaggcaccatggtgttgcaaagccagtgctttcatctaggcatccaccgcctgcaaactctgacacatcatcttctgcctcaaaacaagtaagcaaatgaaattcaggtctatcattgcaaaccctacacaacccaactccagtcatgcttccaggttaatctgctgtcatcttccatcttcttggatgggctttcgtgttcagacacgtctggctgacattctcacgttacatgcggccttcccagcctttgtccccagccttcccgaagtcgaagatgcccttactctgatttctgcagtgacattctactgattctttttttaaaacagaaacatagcttacagttaaaaaaaaaaaaaatagcacttcttcccttaaatctcccaggtcacagagcctttccctcctctgatctatgatctctcttttcataagaaccaatatttaatgcaagctttagtcaactaaatgcatctttctcccagatctcagaacaggaggccacagcactgcacccagtgagcagccaatgaacatctgtgaaggaaatcagtgaaacatcagaaaaagcagagtttgtctagtttcagaagtcccttctataaaacatgtagctccttccagctaaaagaagacacaaagctgttctcccactgtagagcacactgcaccccatttggaaaagcagtcaggtgagccacacgtcagccacaccgtgctttacaaacatgccaatgtgtgaacggtcagtcacaaagacataaaaaaagatgactgccctcatcaaaactgccaaggtcatgaaaaacagggaaacgctgagaaatggttgcagacgagattaaggagacatgacaactaaatgcaatgtgggatcccggatggcatctgaggacagcaagggaacattactggaaaaacctccagcttgctcacccctggaacctgtgaatgccttaggttacgtggaaaagggaactgaggttactaatcagcagagagggagatgacctcgcagtgctcgggtgggcccaatttgtaaccacaaggatccaaaagtgaaacaagggccaggcacagtggctccatgcctgtaattccagcactgctggggggctgaggcgggaggattgattgagcccaggaggtcgacgctgcagtgagccttgattgtgccactgcactccagcctgggcaacagagccgagactctccaaaaaagcgggtgggcagcaggagtcagagagatgccatgaggctggctttgaagactgaggaaagcactacaggccgaatgcaggcagcctctggaacacggaaaagacaagaacacagattctcccctggagcctccagaaggaaccagccctacctacccagattttagcccaggcagatcatgttaggcttctaatcaacagaactataaaacaataaatctaaggttatggtggttagttacagcagcgctggaaaaccaacacgggcagcactgacacaagtcccagcacttctccaacgcccaagagctgttctctgtctcccttccacaccctccatttgccttcactcatccccctgaaccaatatatttatgggcttagaagaaagctattaaggaaaaggcacagattaagttctaagacagattttctcctcaactctctaaaacttcaccgtaccattagcttctactaaatgtccttttttacaagagtcagtttcaacatcatcttcttttaaaagccagtcatctggtgagaacccaagtttagcagaatcagatctaaagactttgccaaagaaaaatcaagcatgaatgtaaatctcattgaatatgcttaacattttacctgaactgtaagtgcaagcgtgcatcacttttctgagtttcacactaaaagataaaggatacaattcaaagatacctctcgcatgtgtcaggggaaaaatgcctgtgagaaaatgtttaggccgggcatggtggctcacgcctgtaatcccagccctttgggaggccaaggcaggcagatcacctgaggtcgggagtttgagaccagcctgaccaacacggagaaaccccgtctctacgaaaaatacaaaattagccaggagtggtggcgcgtgcctgtaatcccagctactcgggaagatgaggtaggagaatcgcctgaacccgggaggcggaggttgcggtgagccaagatcatgcctgggcaacaagagggaaactccatctcaaaaaaaaaaaaaaagaaagaaaatgttttgagtgttagcatatttaatatattaagctctaaagaacttcaaatttcagatagactattctcaaagtaacaaaaatatctatgtatgtaatttaaataaattaggagccaaacatacaattatagtgaagaaaaaatccacaaagtctaaaaattccttgaaatccgaatcaactgtggggctgtggaatactaacactacaagctctcgagacgctcttcggctgcctgaaagctggatttcttctttgtcaccatcagaaaaggcaaaggttattcagtgctctgcacatcctttaatcagccagacatcttagtcaaaatcatttttaaaaacttaatcctttcaagagtggtgctctggggtttttttggttttttacttttatttcctgttttgcaagatgtaaaaccacatctagaaacatggtggatactaacaaagcttgatttcttaagagaaaaataaggtccttcactgcgtcttaccttctctattttagataagtttaaacagtacagccataatgatttcaagtttacatcatcatccagaattaaaccaaagtcttctttgattgtgtcagatatgaatgcagcagtaagctaatcctaactctagtaaaacctcaggaaccaagcagcctacgcaatcttccctttacttggaaatactgcattccaaaatttattctaagccattagcatcctaagtctgaaaagagccatagggagtcgaggaagggcaacttactatcaatgcaccaagaaaagaggtttatttgctaattttacataaaaaataacctctgatatcataaagttattaggcatttacaaataacatttcaatttcagccattcttaaaagtcacattttttagagttaagtaatgaaggggaaagtcttctgaattttaccatgacaaaagaaattttcatatggtataaaaatggtttgttgagaaaaagccaacattttcaaataatgaacaggtacacattggttgctttacacgtggaaaaaagagccctacagatttccaggataataaataattcactgcacagatgcgaaggacaggcctggaaacaggtctcaccctccaccagccacaaggacgctgtaactgagacagcagcaccctgacagctgtctcaaccttgacctccaagaggaagagagaaagcgggtgtggggaagcccagaagactggattttcactcaacaggattcggtcctctaggcccctgaaaaatctcagccatacagacaggacggcttacttttattttcacactgaaaaccctcttaaccctttattcacagagccagctttagcactgtggggtttctggctaggcgcggtagttcacacctgtaatcccagcactttgggaggccaagacggctggatcacctgaggtcaggggttccagaccagcctgaccaacatggggaaaccccatctctactttaaaaaaaaaaaaaaaaaaacactaactgggagtggtggtatgggcctgtagtcccagctactcgggaggctgaggcagaagaatcacttgaatccgggaggcagaggttgctatgacccaagatcgtgccactgcactccagcctaggtgacagagactctgtctcaaaacaaaacaaaactgtgaggtttcttagagctagaatagtatctgaatgttttcaaccacaatcaaccagttcccctccaccaaataccctagccccttactgtaaacccaaaaatctaaaacaagtcgcaatctcccaaatatacccacaattagtctttaaaaagcaaacttttgccaattacataacagtttcatttacaaagaaactttgaaaacctaaacatacagaaaaaaatcaatagggcacacctccatttcgttgtctttccctccaaagagatcattttttcttcattaaaatgctaaaactttcatatcactccacctgctcagctacatgtgaccagaggggcctccggacaaacgagacacttaatcctcataagcagcagcagcaaaccacacttagtccagactgatttcaacccatcctttacagtcactgagaccttgatggaaacgatgaggaaatctgaataaaaactgcttctggcccttctactctggcctgaaaacagcagtcctgctaaaagtgctttcacagaaagcactttcttcccacaaagacaactctccctttatgtttctttatctcttgttctgccttaattgtgaaaactgtcttcccacctttatctaagttataaaagcaaacttgtaatgaaaacaaaagggggctgagcacagtggctcatgcctataatcccaacactttaggagactgaggtaagccaaccccagaaggctgaggcctacacaacacaggaagaccctgtttctacaaaaagtaaaataaattagctgggcacggcggcacatgcctgtggtcccagctactcaggagtctgaggtgggaggatcgcttcagctcagggagtcgagactgaagagagccacgttcacgcaactggccgctgccctccagcctgagcaacacaccgagaccctgcctcaaaaaaaaaaaaaaaagacttactaaaggaagtgatattacactaagacgcaaaggctgagtaggagttatcttggagtttggggggatctgcatgagatggcagcgaggtatgtcgaggccatgccacaaactatggcacatggcccaactgaggaaaggcaaggccaacgcagccagaatgactggaagcttggggcagggtcaagaatggggcatggtatcagagttaggccacagtcaccatttgggacgttatcataaaaataacatttgaggccaggcatggtggctcacgtctataatcccagcactttgggaggccgaggcaggtggatcacttgaggtcaggagtttgaaaccagcctggccaacatggtgaaactccagtctctactaacaataaaaaaaaattagccgtgtttggtaggaggtgtctgtaatcccagctacttgggaggctgaggcaggagaattgcttaaacccaggaggtggaggttgcagtgagtcgagatcatgccactgcactccagcctgggcaacaaagcgagactccgtctcaaaaaaaaaaaaaagaaaaaaacaatttcaaattaagagaacacacactgaaaacatttcaaaatttcaagacaataacttttatttgaattcattccatttttctataaagtttatcaaacgggccacactgaattcccacagagcactgactacacaagagtcacaaactgacgcagccaccagacaagggatgcaccatcattttcaccgattaactacaaataccttgctattaagagacactcacccattacacttacgatttgaggatgaagggagttacacagagtaatggacagatcaaaacacttattttggcaacaaaatgcagattattttctgagccagcatttactgatactctctaattatgttatttaattgatgatgggctctctgcccatatgcaaaataagactcctcttatatttgatgaagcataacctttctatgtcaaatctacttaaaaaggcacaaaaagaggccgggcgcggtggctcacgcctgtaatcccagcactttgggaggccaaggcaggtggatcacaaggttaggagttcaagaccagcgtggccaacatggtgaaaccccatctctactaaaaatacaaaaattagccaggcgtggcggtgggcgcctgtaatcccagctactcgggaggctgaggcagagaactgcttgaaccccaggagacggaggttgcaatgagccaagattgcgccactgcactccagcctgggcgacagagcgagactccaaaaaaataaaaataaaataaaataaaaaggggcacaaaaacttcttggaaaaatactgtccaacacaaacagcatagtttccttcactctatttgtagggagttctacttgccaccgtatcaacactgtaattaccgctaacatggcagccgctcgtcatcaacagcccatctgggagggtgtgatggcactgctggtatggggtgcccagcatggccagtccggagaaaagcatctggcggtggcaatgcaagtcagaaggctgacgcaaatgagagctgcaaaagaggaactcaggttttaaaggtgacacctttaaaaacaaaattctggtaaattgtgttatgtatattttactacagcaaaaatagaacagaagaaaaaaactgctgaaagtttcaagtttaggtcaaatttagcactatcttgtggggaacttttcaacaaacttaagaggcatcacgaagaacagagaaaacgtcacagcaacttggtctttgttccctcccatccagttccattcagatggccagcctatcgaaggagatcctgctcttcggggagaaactacagaaagaggagaacaacagctgaatggagggtaggggaggccacaccaactatacgagatccaatgcaagggtcacaatgaaggctgagcaagacatccgcccccccccctttttttctagtttaactacagttgcagagtaaaatcagaggacttctgtaatcattctctaacagaactcgaagtcttccagggcagccaatacttactaagagaaatcaaggtctcagagaaaccaaagaaacagcctcagggtctccgattttgaacgttatgccatagactaggtctgcacacaacaaaaacagtaactgtttcgatggcactttttccacaggtaatatcatcttatatgtttggctaagtctcaacatcccaaaaaggatcaaaagattctctaagttttgcagttcaacaactgtgcacacttttatttctcatttcaagtgttaaggatattgctctaatgactgcataaaactctctcctcatgtaagaaagcctgaaatctaatttctctaccataaaaccctgttcttgcaaaaggatacaaaactactcataatctacaaaaacgatgaatcctaagcatgttacatagaaggaaaacagtttcaaagcatagggagctgttagaccagcttcatcttcccaagcctcttccaaaacttcttggaagctgatatataacactaaccttccaaaaacacaacagaagcagaaaatcttaatggggcaccaggaaaagagcaagcctcgagaaaaatcaagactccccccgaccaaccttcccaaataacacaaacacaagagttaacagtacaatccctctttgagaggggactgaatcaatgtggcagggccaaccctacacacacacacacacgcgcgcgcgcgcgcgcgcgcacacacatacaccacacacacagctaccgccctgccaggggatgatgaaatgaggaacggaaattaacatttcaggcaacgtctcacattgttccttgaggccaagggctgctgttgcagccgccaccgccaccgctttcctcccagccaccccccacacccgcccgcctaccctccccctaacaccccccacacggctgcccgcattcctgcccctcctcggcctacgcgcgcctcctgcaaccccgacgcccccaggtccccagttcgccctccccctccggctcggagcccgagagccgcctgctctcatttcaaaacagcgataataatagggacgctgagaataacaactacgaccagcacggcgaaggcgcccctctcgcgggtcagaggtcggcgccccagctccgcagaacccggcgcccggccagcgccccctggcagcccctcccggcagcctcaggtccccaagacctgcaggcccgccccgaagccccccgtccgcccctcacggccgctccgagcccccgaggcccgccccggagccccctgtccgcctctcacggccgccccgggcccccacggcccccaggcccgccccggagcccccaatcggcccctcagagccgccgcgggcccccggccacccaggcccgcccggagcccccgtccgccccttacggccgacccaagctccgccgacctcccaggccccccccggagccccctatgggcccctcacggccaccccgggcccccaaagacccccggctgccccgaacccggacccgtaggcccgctccgggacccattattggtccctcacgatcgccccgggcccccaaagacccccgcccacccggccccgaccccccaggcccgcccggaggcccgcggcgcagctccgtcgccggggaaggcctgcaggccgcaaggccgcgcgaatgccccgtgcccgccccgaccaccgcccccagaccagcggcgcctctcaccgtgctccgagggctgcgcggctccgcgacggctcagcggcggggcgcgggcgctgcccatgcagcccgcggccgcgtttcccgggccgcgcggcccgagcggcaaggcggcggcggcggcggcgcgggctcgggcccggcagagctgcgagggacggcgggaggcgagcccgcccctcgggcgcgcccacggctcgggcgagagccgcggctcccggtgcggacgctactgatggggcgtctggccgcgggctcggcggcggcgcctccccggctggggccctcggtccatcgcgcaccgtctcagggcggcctct

SEQ ID NO: 229 - DNA, 222941 bp, Homo sapiens; identical to SEQ ID NO: 228

SEQ ID NO: 230 - DNA, 222941 bp, Homo sapiens; identical to SEQ ID NO: 228

SEQ ID NO: 231 - DNA, 203904 bp, Homo sapiens
aagtttctgcaagctgctttattttttattttcatttacattagaaaataatctctcccttgcttgattttacaagggtaagggtggtcacatgactgacagagacaaccatggtgacacagctcttttcagctgttcatcaccagcaacctggatttcctatgcccagaacagcaatgcactgaactcaagtacaaattaaatttaatcccaactttagtccagtctgagattagcgcattcaaagaatctgtcataacgtttactatagactcttgtcgcccacagaatcagtttccagttcgtgtgtgacatgttctattgttgaatcagtacagagttcttatgtgtgtgagttttctatggtgactacacaaaacctcaggcttacaattgtggaggtcagaggtcaaggtgctggcagggcaggatccttcctttcctccatcatgggggctgctggcagaattcagtttcttgcagggctgggacggaggtccccagtcccagctgcttaggggccaccacactcctcggccctcctctaaggccagcagcgcaggtgcggccctcctcgggttctaacctctcctgcttctggcatctctcagactcagcaggaaaggctctcaagctttaagggcccatggggctgccctgggcctgcaagatgacctaggacaatctccccatgtgaggcactcacaaggtctgggggtcacaacacgggcatcttgggggccattatcctgcctacctcaccgtaattccagggtccttgacatttttcgtaataaaaagtttaaaagtggtaattacagaactataaagctgcatcggatgccccagccccatcaccctccagggccattcccctcacacctgccctcccctgcagcactgagcgaatcccagacactgcagagccttttccagttcacgtctctggaagagcccataaaacagaaacagtataaaccatagtgccattcattatcttacccagaagtttaacggtcatattttaacatcaaatagggactcagtgttctgagttccctgctcgtctcagagtcttcaatccaccccccaccccaccggaacaagccgtttctcaagtgagctctttaaggccaaggcactgtgggctccaggacctccagcaatggccaggctgggcttgctgcagaggagcacgacgggcaccagcagatgtggccccgtgtgacccctcagccttgctgtcctgcctgcaaccaggggctctccacggagctctgatgaagacatcagtgagacccgccgcatctccaggcagcacccctgctttccggcaggacggggctgtcaggcacaccacgacctctctcgacccccacagaggctgagacctctcagtgcccactgctcctgggccggccacaatggccactttctaaagcttgagtctatggttctgtgcactggccacacctcttggtgttacctcattccagacgagggtgggtctgccttgcaggtctaacagtcccacagtggtgacggggaccggcagcaactcctgcaggcctccttccacttggtgtaatccttcacctgctcaaatccaaccagacctacacggctagcggatacgagcctttcatagatggcacttgctgggaaacctgtgagaggccgtccaggctgacccagaaggggaaagctgggggcagacagagggcacagctcggccttgagggtgggcaaggcgaaaactcgctttcctgtgccccacatcatggaaccggctagctacggggaaacaaagctacagaaccacccagatgccaggacaggccggatgtgtgaagaacggggggatgccaaccttgtagtgcccgttgttggcagcgtcgtgcaaaggcgtgtcgtcatctaggcccttggtgttcacctccgcacctgcagccagcagctgcttcgcgacgtcgtagtagccccggttacaggcctcgtgcagcgccgtccagcctggaaacagacactcaggacgtacgttatttaatcctcagaacttccctcctgtctctggaggcagcgccctgaggatgtgctacagtgcggggacaagccaggtggggagctgccctgtagtgagggctgcagtttagggaagcaggtgctggcccagagaacccctaaattctctttactgtggcacctcgttagcacgatccatatctagcttattaaccctacggactgacaacctgcagggctaatctgcggcaatcaccctaaaagggtaggaaatcagtgaacacacagtgtagtaaacagcagcctcatcctcaccgatctggaggcgtatgtgcctttgcaaaacacggaggggaaacctcccgtgtcggaaacggaaaccaaggctgagagcctcctgaaggctgaagagctgctacagcaggagctccaggggcgcccaggctcgggctgcacgacgaaggccaccccgggcaggcagctcctggctggggagcttggagtccaccatcggacggtgtggccgcacgcatccgtggaaacagagctcggccccacggaagcacacggcactgctctagagaagtttcttttagaaaaatgctttaaaaaaaaaaggtgctaaattaggtttgggtcagacagctataaaccagggcagttggagaaatctagaaggattctacacacacgattttgctcatctgttccccttacactgtggacagacagtcctgggatatgtggaccactcatggtttgatgggggtattttatgtaaagaaagggaatattaaactctaatcatggagctcttaagcccctgggccgtatcaggtctggggaggctcgctcagttctctccgggtcccaggcaagccccaggacccagccctgtgaagtgagggagtccagtccagggtgtcgacccagccggcctcccggctcagaggtgccctctgctggagaatgcagccatgtgctagacacaccagggacaggtccctccaggggcctggagtgaggtttatggaacacagcagagtaaaatttaaaattcctcagttctcttacagataggccaggcatgggggctcacagctataatcccagcactttgggaagccaaggcgtgaggactgcttgaggccatgagttcaaaccagcctgggcaacttagtaagaccccgtctctacaaaaaataaaaaaattagccaggcatggtggcgtgcgcctgcacccggaaggctgagttgggaacatcgcttgagcccaggagttcaaagcttcagtgagtcgtgatcacgccactgcactccagcctgagcaacagagcgagaccctatctaaaaataaaaataacaataaaacccagcaaacaagtttactttgaaatactttccaagaaacactgatttcttctcagcaacagggaaccccactggagtgagtgtggctgtgaacaccccgagccctgcagagcagacgcgcaccccacgaggccacagcccatccaacccgatgggaggctcacggctccaatgggggaggctcagggctccagcggggggtaggctcagggctccaatgggggtaggctcagggctccagccgggggaggctcagggctccaatggggggaggctcagggctccagcgggggaggctcagggctccaatggggggaggctcagggctccagcgggggaggctcagggctccaattgggggaggctcagggctccaatggggggaggctcagggctccaatggggtgaggctcagggctccagcgggggaggctcagggctccaatggggggaggctcagggctccaatggggggaggctcagggctccaatggggggaggctcaggactccactgggggaggctcagggctccagtggggctctctggcccttgccaggcacagggtgcccacctgcgaagtccttgacgttgacgtctgccccctcgctgatgagctctttgatgcgccgggcgtccccgcggatggcggctcggtgcaggcgggtctctccacgctcgtttctcttgttcactttatctttggtttttgaggcagagttgggcgttcccttctgacacactgtagactgggaggggtgctttggtgttgtgtccactgcaggccaaggaggggacagatgggcattactgtggggtggtcctgctttgtccaatcttcaagagcccaggccaccatcacgaggtccctttgcacagggcttgtcctcagcacagccatgaggctgcgaccaggcagagccccttccctgcgccagggaccacccacaggccgggctcacctgggctgttggcagactcctcggccgtcatctgcatgagaagggccacctgctggcgctcggagagggggtagccggctcggattccagacagccccatgccaaacagcagcccggccttccgggtgacaggctccttcttaatcctcttccgctcagggccctgcttctctgtgaggcgggcgagggagagagggaggagagatttcatgccatggtgtcctccaaagctaggtccttacctaatgttacggagccccctgcgtccacctgacagctgacagagcagaaaggaaggtctgtgtatggggaaagcacagcggtgctgggagcattggtgccgcccacctcacctctcagcagtgactgtgagaccatttaaacacctcgttaccagcccctcaagtctgctaagcctgggcctccaccgagcatccactcactccaggcacctctcctgggcctccccagacctcgtaccacacatgaatgcggtgggacagcttagcaccggtgacctggctcacacaggacaggtctctgttcaatacacgtgtctgtaattcaattccaccttccccgtccctcctccaaacagtgcagatataaaatggcagacacagtttaaaacacatcagtaaatcaaggccaactggtcagtactgtacctttcttcttgcttctaggaacctccatctcatgccatggtgcttcgaggagcgtaccagccttgcagcaccacaacagggactgggctggaggcatctgaaggcatcaacacagagcactaacaagacacggtgtgagagctcggctgtttccacctcagcctcctcgtaacaagcacaccctgcactcatctgacccgttacagaacactcggctggcgtctaacgcaactcacgtgctgtgtcttttaaaagaggcaggaggcaggggcggggaagagaagaccccaagcaccaagagtcgggggcacagaagatgcctcctcctctgcctgaccagtgccctcctgtggatggaaatcaggggccagacacctctgaatcctcctccagctgccctgcgggttctggggttttctaggtcatggggtgaaactgcagaggtgcagcgcagaggcaaggctctgccaaggcctgactcggggaagaagggccaccaggaagacgtgggcctctgaagctctcctctgaggcacctcccttcccttccattcagcactcccaagaagcctctcttcaggacttctccctcggctggtgtttgatcctacagaggtgggagacatctctaacaacggactaactggatcccacacctgcccggtcactggaacacagaacggtcttaactagtctctcagctcagctcccagggcccgactctcttgctgttcaccaccatggtccccgtgaatgtgcccgtcgatttcctaagaggacgctgcccacccactctagttctttccaaggtatctgaggctgatttcttaggaattcggtctggggcatgctgagaatgtggattcgtatgtcctatgggacaagcctgcaggaaggcacacacctggccacatcgacctgcgtcacactcatgggcaaaaccccaagtactgcaggctgccatcgccaccaccagctagtctgtaaacagtcctcaacgcacagatctgagaaagcacttgagctttggccccagcccctcatagaacctggcaaacacggtggttggggaggcagcctcgccaccggccaatgagccccagcctacagccatcattggcgtagccacaccttagcagtgagcttgggtcacaggcgcttggctgtgggtctctgcgtgcgccccatgctttccctgcaccctccatgctgcccgggggccggccctccccaggcttgcttctcatagccacctctaaacaacagaagcaggcctgcggctgcctccctctaggaaagaggcgacgaagctgctggagaaaccccagctcccccaccgatagccctcaagtcctcctctctccaggaggggcccacactcaccgagcagctggtctgcccacagtcgcctggagaagcagctgagaacctctgcagggccctgatccccaagacctagccacgcacattcagaggcctgctccctccgtcacccagagcaggggggttaatgttttggagacacgaagccccctgagaacacgaggaaagcagaatccccgagatacacagactttgcaaagctgcacacagcacaggagactcctgggagcagacggcatctccttattccattgaccatcagaagtgaaaagcgagtgggccccacttctgtgctgcatgtggccactaggggtggacacagggaggagctggggcagagttggggttgcggagggaggagctggggcagagttggggttgcggagggaggagctggggcagagttgtggctgcggagggaggagctggggcagagttggggctgcagagcgaggaggcggggtggtgttggggctgcggagggaggagctggggcggtattggggctgcggagggaggagctggggcagagttggggctgcggagggaggagctggggcggtgttggggctgcggaggggaggaggcggggtggtattggggctgcagagggaggagctggggcagagttggggctgcggagggaggagctggggcagaggtggggctgcggagggaggagctggggcggtgttgggaggagctggggcggtgttggggctgcagtatgtttacatcccgaagtgcaggcgttgccatgctcttaagttatcaaaggaccctaggaggcgtgtgtcagaggaacaggcagaggcaaaggcgttccttagaagtcagtctttaggctggcaggccaggagcccacgctgcgtccccgctctgaggggcagcaaagagctgctttgtggcaaacagaacatgtcccactcctgcagggcggccatctcaggtgcagctcacacccaacatgtgcagaatgggcaggactcggtgcccccagagacttcctgggtgggctccagggcctgagcctcagggtcagggccacatccctcccgctccccaccaggccctccctctgcttctgctctgagctttggtgaagaaagcctgagttggcttcccttacgcggccaggacagctttacagggctggctcccagcaattcgcatggaaggtgctgccaacctcctggtgaattctggtgcctggagccaccacagggaccttgctctgccccacactcaggaaaagcttgctcccaggaagcagcaacttttcacccagctctccctgtcctgaaacaggactttttacttgtcctgacaccaaaaaagtccaatatgaaaccagatctcccaggatgccaatctctccactgtgaaacaagcacctgcagctacgagcatctacaacgcccacaacacgcgccagacaccacccaagctccggagcccagcaaacttgcacgtctgtcagctctgagacactggccactccagtggcttctggggtagagggaaagccccacccacggagcgagacccccatgtgccacagcccatggctcaacaatgcctgctctccattccaacccagcgacaccatggtctgagagcagctgagcgggtccttgacgtgcacacacacagcccgtacctgtacctgcactgtcaggcaccacacaagtgggtcccgcactgcctgcctgcctgcccctcctaccccaggcctgggatgacctggagccgtgtgcccctgagaaacgctcctctgagaggagaggctgcaaaacctgctccctgccctccacacagtgcagagcgcaggaggcgcggggtgttgtctgcaggtaagaaaagggtgagagcatctggagctacccctaggacagccagcaagttcctgtagcattctgcaaatttcctgtttctaccgtccaaatggaagccaaatacaatttctatgaattccaaatggtattcaccaagttgcaaagtggaaaactggcaagtctagggactaagtgcggctacagcaccacagacagatgtggccctgggtgcctctgaccccggggtgggggtgggagccactccacagcactcagaagcccccttccacccctgccctgcagtcggaacacggcctgcaggctctgagggctttgtgggctcaggcagcctggggctgagggcagaggtccagggagagcggtggagggtgccaggagaggctgtgtcttcccaagtcaagcatgttggcggtggcacctgtgtccgctgacctgagcctgggcggccacccacctcatctttaagaaacaaggcccgtagggcctttcttcaaaccacatccacctcgccagccctctgaggctggcagcacacctcactacccagctggccagtggaagattccacggaaccctctcctcctcagcacagagctgagacccctccatgagccccatgccccttcctggtgctggtgctgctggagcacggccttggcctggggcagcaggggccacagtggacaatgcttttgggagctggagcccacttcctgcccctgcatccagccatggcctttctgaggcagcagagactggaggcgagcgtcccgaggcaaacggcggtggcacctggctctgtgcaggtgggatgggggggatgtgacgcgcctgggggtgccctgtgctggtgggatcggagcgggggctgtgaccttcccgaggggtgctctgtgcaggtgggatcggaggggggatgcgaccttccttggggtgctctgtgcaggtgggatgtgatgtggggggcctgcaaccttcctgggggtgctctgtgcaggtgggattggggggggctgtgaaccgcctgggggtgctctgcagggagtgtcttctctatctggctgcctttttttttttttttttttttgagacaaggtcttgctctgtagccaaggatggagcacagtggcgcaatctcagctcaccgcagcctccacctcccaggctcaagcgaccctcccacttcagcctcaggagtagctgggaccacaggtgggtgtgcctctggctgcttttaacatcctccctttgctgttctgaaaacttcacgtcagagtcatatttaaatgtgtaattactgctctttctcctgcttataattcattatactttttgaatttgaggcttgtgtttttatgaaccttgaaaagccctctgctgccggcctctggagccaccgtctccctgccctgctctctcctctgccgaggtgcctgttaagctgcattctctcctccacagctccccgcttcctgcaggcttcctgtctcactttctttctgtgctccagagtctaggcaatctcttttgttagaacttccaattcaccaatactttcttatgttgtgtctaataagctacatcatctgctcactgggttttttatttcagtgattatagttttcatttccagatattccatatgccttaaaaacatctgcatgatactccatggttttaactcccctgatgaatactgtgcatttaaccatcccagcacgtgaggtccctggggctgacccctgctgaccctctcagaacagctttcttcctcaacgtcttgtaattccaaccaggctcttcgtctgtctacactctgggagccggaaggccgggatgaggaaggtgtgtctctccagggagggtttgcttttgctgtggtgggggccccagggagtgtggggcacttccagcagcataaaacagcacaaatccaaatgccagccccaccagagggcaggaatgggtcagaagtctcattggtgacctctcaaagcccctcatccctcctcagcacctgtccctcttagctggggggacagtgtctaccctgatagcccagtgtccaggaagtgtggccctctcgaggggacaagctttccgtggggtctgggcccaaagccccttcctctacctccctgggaggtctgaagctgggctccaaggcagagaccctgaggttgggccccagggacgtggaggtgtgtggcctcagctgctcatctgaacaaatgccttttgtatcaatcatttagcacctctaatttctaggcttttctagcaagagtcttttaggagacacaggccacgatactgtcaacataggaaaatgtgcaactcctgcgtcccaccgtaaaactcgaagacgtcaaaatacattcttgattctgctccacaaagggatgtttccatggcgatattttcaaacaacagaaagttcacggccgatggcggttacagctcatggaactgatgggcagggccgggtgcagctttgtagcacggctgctgctcacagattctcttccatttgactaaaaaccatgctgtccacaccaaacatctggcctcatccggatgttcaaagccatgaaatacagcacttctggccaagaagtctaaatcacagccgatctacacgaggcggatggtccacaacgccaagttcctacccgggcactgagctcaacgctcgcacaactccaaacgagggcgcaaccatattcccactgacatcctccttggggcagcaagacaagctccgaacagcctgtcctgggccaacaagagaagctggcgggcgcccgctgagcactgtgagccatcttgtggtgagactggcttctccttccaatctccaggtttctctctctttctgccttctttctgtcagttaccgtcattgatcacttaaagaaagacagggcctacccctgtctgctgcgtgacctcagccctcccgcctgccgatgggagctgggtcatctcttacgcctttcagctttggcttcttccgcagtgtatgtgaaggggtcacacagaggtaaggctgtgcgtccagcccttgcctgcacaacctccatgccttccccatctccaggccggggtggggtaggggtagggtggggtggggcggaaggaccagttccacaggaagcctgtggaggcaaacagggttatgtggcaagggtgggaaggagcagggcctgagccccatggtggtttcaccagcatccagcggtcaccatggtgaacaagaagccaggaaggaaggaagcaatgtcggcaaaagggctcagatgacaaccaaacagaacggtttcccaccctgggcctcctttccacacacacagcatcgtgggtattttaaaataaacaagatcaacgtccaaacctgcgctgaggcctgagctgtgtccgtcactcctgcagggcacaggcctgcctggccgaatgcatgggcggtgagagcacagggctggggggacccctctgtcgaggggccacagctcctcacacagcagagctttatggatgaaagggctgagaggcacagacaggctgagaaatgggcccaaagtcccacagcatggagccaggaggtagcagacggcccctgcccgcccccctcacttggctgactgctcccacggcagccaccacctttatcctgagtcccggggtcctccatcaaatcgctgagcctcgggtggtcttgtggaccccagcttgtctgtgttgtgttgacaacatgggcctggctaccggcctaagtgcacttctgaggggtgtcagggaagcctttgctgcggcttggggattacagaattttaaacagcaagaaccttccctttgctagtccaagcttccctttgtatgagaaactgcttacgtctagagaggaaaaatggttgagaaataggaggaccagagaccaatcacgcggagttcttaatcatgtgaaaatattttattttgacgtgctttttcttgagtgcctgaatgtggtggctcttagggtaaccccagaatcctcactgcggcaacaagacctggccaccaccctcacctcgaccaccacggccttcgctgcagccccactctgactccccgggggctgctcacgtgccagcacccactggccaagcatcctccggcaggacccaagtcctctgtattcagaggccgaccctgctttccagagactcacgaggtggcagagagtcaggctgtggcaggggcccctgtgtatcgaggagaggaggaagagtctgcagaggtttctagggaaggagatagtgtggaagtgactgtggctctggtcctgcctgggaggagatctacaggggaggggcctggccttgggctggccctgccctgcgtgggatctgtgccctgcgtgggatccctgccctgtgtggggtgcgtggggtctgtgccctgtgtggggtgcctgccctgtgtggggtgtgtggggtctgtgccctgtgtggggtgcctgccctgtgtgggatgcatggggtctgtgccctgtgtgaggtgcctgccctgtgtggggtgtgtggggtctgtgccctgtgtggggtgcgtggggtctgtgccctgtgtggggtgcttggggtctgtgccctgtgtgagctgcctgccccgtgtggggtgcgtggggtctgtgccctgtgtggggtgcctgccctgtgtgggatgcatggggtctgtgccctgtgtgaggtgcctgccctgtgtggggtgcgtggggtctgtgccctgtgtgggatgcctgccctgtgtggggtgcctgccctgtgtgggatgcgtggggtctgtgccttgtgtggggtgcctgccctgtgtggggtgcgtggggtctgtgccctgtgtggggtacctgccctgtgtgggctgcgtggggtctgtgccctgtgtggggtgcctgccctgtgtggggtgtgtggggtctgtaccctgtgtggggtgcgtggggtctgtgccctgtgtggggtgcctgccctgtgtgtggtgcatggggtctgtgccctgtgtgaggtgcctgccctgtgtggggtgtgtggggtctgtgccctgtgtggggtgcctgccctgtgtgggatgcgtggggtctgtgccctgtgtgaggtgcctgccctgtgtggggtgcgtggggtctgtgccctgtgtggggtgcctgccctgtgtggggtgcgtgcggtctgtgccctgtgtggggtgcctgccctgtgtggggtgcgtggggtctgtgccctgtgtggggtgcctgccctgtgtggggtgtgtggggtctgtgccctgtgtggggtgcctgacctgtgtggggtgcgtggggtctgctacacgcttggtgagaaactgcatcagggcttcccgccgtgtgttgctaacatccccacacacgtgagtgccttgggaccctcgtcaacacactgagctgaggccactggtccacggcacactgcagtgcacatgcccttcctggccagaggctcccaggggcgccatgctctccaggcacctgccccgcctgcgagcacagcctggcccctgctgcactctgctctctctgcccgctcgggtccactgcagctgagcgggtgggagaagcctcttcaacttcacacacttgtcgcctctagcactgggcaaggtctggcattcagagttccaagaagtcccacagataccagtggctaagtctgtcttccctccaggaatggggaagcaggagccgtcagaacagccgtctcctatctgaggcaccaggaacaaacatgacgtcaggaaaagactgaaggtgccaagcacctaacgctgaaggaaccagcatgtgcctggcagcactgcagagagcacaccccaggcaccagagaccagggtgtcattcacaggtcaaagcaaaataagaaaatcataatttttccccttgttccaaagaaacatccacgtgcagagggcaggcagcttcggcccatggcgctcctgacgagggctccctcgtggctgccccaggacaagcaggaccccggcggtcctaggcagggagaagcgagactcagggtcacagacgaaggcgcaggagaaacagcggggcaggaggctccccagaaccccagggaggccaggcaatgatgcacagcaacctcaaaaacattcgctggttgactgattatttatttatctattttattttttatggacagggtctcactctgtcgcccaggctggagggcagtggcgcaatcacggctcactgcagccttgacctcctagcctcaagggatcctcccgccaaagtgctggaagggtgaagggtgtgagccactgtgcctggctacttttagattttttaagttttgggaaaccttacacatataaaaaagtagacaaagtagtatcatttgaagcaaatcccagatatcatataatttaatatgaatgctttcagtgataaggctttttaaactgagaccacccttgaggtggtagaggacagacttcaaaagcagatacaagaggccccgggcagacagggcaggcagagcagggcaggcaagatgggctagaagtcccagggcaagctggtctgagagggctcggtgggcagagctgtcttggggccgggacatggcaggtgccttcccactccttgctgcacccacagcccttacagaggcctggtcctaggacgggctcttgcccagcgctctggaagacacagaggtgatgctgtcacatgctcacgtctgcctggacagcctccaggctgctgtgcagggaccacgcggatgcacagcctcggggactgctttaaactgggctgattcacaacagacagaatcacattgttcttggcaggcggcccccagccctgactaagcaccgcagaggccacatctccatggcactggaccgcgggcagggccgactcaaccctgcatctgggaggcgggaagccatccccacagcaacatggaggtctctgagggagacgtgccagcctctgccacttggacacagccaaggcatccggcacggtggtgaccctgcatccctcccaccatagcaaggggcacccacacccctccagagaggcctgactgctggggaccagagaagagtctcttgtctgtcacgtgtcagttaaccctgcaccaatgtttctcttctcatccctgctggtgtgcgcctctccctccaccccactcatttctgagcaagaacggctcctctgggggaaggaggggacgcggcgtgtgtgagagccacagcgcccagcagcctcccggcccagggtggggctgaacgcactggagttggactcgctactatttatttatttagagacggagtcttgctctgttgccaggctggagtgcaatggcgcaatcttggctcactgcaacctccacctattgggttcacgcaattctcctgcctcagcctcccgagtagctgggattacaggcacccgccgccacacctggctaatttttgtatttttagtagcgacagggtttcttcatgttggtcaggctggtctcgaactcctgaccttgtgatctgcccgcctcggcctcccaaagtactgggattacagccgtgagccaccgcgcctggctgtggacttgctactttaagagggtcctggttaaaatgcaagcttctaggataagcaacgctccacactcatacatcagaacaatcttcctaggaaatctagttttgcaacattaaacaagaagttattaaaattggccccgaaagggtgataaacacaggaggacaaatactacgtttcttaggtctttttgttacaatccttgcctggaaaattctattttcaaaatgttctttactgttttcccacctcacagggattctcacctaccctgtcctcacctaggcctgcccctcacagagtaaggacatggtgttcaacacgcagttccaggagcacccagggctgtggcagaaaatatcccagagacccacagagagcgagaatggcctcagtgggccagcacggctggcaccacgcaggcgctaaccatcaacagacagaccccggaagcttctgacaacacaacagggccctgggtgagagcttctctgcaccatgatgaaacggccaccacaaagagacctgagcagccagatggggtgggcaccaggtagccctgggaacgccaccttaccaagtgggatcattctcccaggaagcagaagcagatgcttgtctcattaaccctttcagcaacacctccagagacatcacagaaacacctcaaaggtctgaggccaactcccgcatggccactgtgcaaagagctaacagctacgtatcaacatgacggccttctacaaccaaaaccagcatggggaccaaagacggcaaacacagggtttcaggcctggactgactttctctaggcctaaagcccgagagtacacagcaccgctgggagctccagggagtcacccaggccctcccttctgggggctgaggtcccttacacaacccatccacacattctgtccactcacttccccgtgtctcccagtgttcttcctcggagctgtccgctgctgggaagaggagtcctcctgggcctgtgctggtgtccctgcagccttcctgtccccagatgtgctggcccagagacaggagccatgtgcctggcactgcacctgcccctcacttcccatctgggaaaaccagccctctctgctggcctttcactcagcagagtctccacctggctactgtgagcacatccctggagcaccccacataggacaggaggggccacaggcctgcggcagccacacaatcataaaggctgaagcttgctgagctgtgctgacaaaagctggggtgtggatcctctttactggctgtgcctgctgccgttcctcttcaacaatctccttcgtatcacgagctcttctcacctggaccacttcccccatctgctctcaagcccgcatcctggcacagcctctacgccttgtgctatggctgcattcaagaagtctcaggaagccagggacagagccgagggcctgactcagcactctcccggttcactccaggctttgtggccagcttagtgctctactgcctccaaccttccccagcagggctgtagagaagctggatgaccaggaggacaaggaggcctctggacacaagaatcaccaaagagcaagcacggccagcgcagaggcctctgggctccctgcaagcagctcaagacagaatccactgggaaggtgtcactgcagaaggcgctgaccccaccaggagcgtgtgcacatgaacacacatgggcttgcacacgggcacacaggcatgcacacatgggcacacaggcacacacgtacacatgggcacacacaggcatgcacacacacacgggcgcatacacaggcatgcacatgcacacacatgcaaacgcacacatgggcatacacacatgagcgcacatatatacaggcacacacaggcacacaaaagcatacacatactcaggcacacatgggcacacatacacgggcatagacgggcacgcatacacaggcacacatacaggcacacacatgggtacacacaagcacatacacgggcacacacatacatgggtacatacaagtacatacacacacgggcacacacacgggcatacatacaggcacacacatgagggcatgcacacagatacacgggcatgtgcacatgggcacacatacacacaggcatacacacttgggcacacactctggcacaggcacacagcacacacattcctgctctgcagcctcagaccccgcctgtgcttgggaagacctccctgcctcctgctcacttttagggctccctttggtttttactacaagcaatggagtttcttcctgtgcctttgtggccctgaggggaaccactgtctccctcccgtgtccagctgtcagaagacccacaggtgagcagccccatacctcgcccagggctggacatgcaccgggtgcatctccacgtgtgtgggacccaagagtgaagctctccaatcggccccatgggcctgagcctcgggtgcaaaggaggtggcatgtgggggcctgtgctccgcccctgctgcctcttgcctggacggcgtgcagggtgctagagtgcgtcccagtgcaaagccggaggtgcgggggccagggacgccctgcctgggctgctccgggctgcctgtggagggctgactgcaggaggggccgcgggctggtacctgtgtccgagtccttctgctccccattggcgcccgcggtgaagggcagcttccgcttgctggctcgctccctcacctccttcccgccatcgccacgctccagttttggggtcttggttagagaaactttatctttatcctagaaaagaaagggatgctttcagtcgtgatgtccaaattacattctcaagctctcaagattttgtttcatatgccaggagaagcgcatctcttatttgggcaatgaacaccctccctgcaccccagggcgtggctgtgtgaggctggtcaccgaccgcagaaccttcacccagaagcccggggtcgggctgtggctcagccctgactctggcccatttctcatcctgcgcaccggagggacgctcaggaaatcgctggtgtgtgtggagaaagcagaggagacacacacgcgctacctctcactccgcagacacgcgctacctcccactccgcagacacgcgccacctcccactccgcagacacgcgccacctcccactccgcagacacgcgccacctacctcccactccgcagacacgcgccacctcccactccgcagacacgcgccacctcccactccgcagacatgcgccacttacctcccactccgcagacacgcaccacctcccactccgcagacacgcaccacccacctcccactccgcagacacgtgccacccacctcccactccgcagacacgcgccacccacctcccactccgcagacacgcgccacccacctcccactccgcagacacgcgccacccacctcccactccgcagacacgcgccacccacctcccactccgcagacacgcgccacccacctcccactccgcagacacgcgccatctacctcccactccgcagacacgcgccacctcccactccgcagacacgccacttacctcccactccgcagacacgcaccacctcccactccgcagacacgcgccacctacctcccactccgcagacacgcgccacctacctcccactccgcagacacgcgccacctcccactccgcagacacgcgccacttacctccccctccgcagacacacgccacctacctccccctccgcagacacgtgccacctcccactccgcagacacgcgccacctacctcccactccgcagacacgcgccacttacctcccactccgcagacacgcgccacctacctcccactctgcagacacgcgccacctcccactccgcagacacgcgccacccacctcccactccgcagacacgcgccacctcccactccgcagacacgcgccacccacctcccactccgcagacacgcgccacttacctcccactccgcagacacgcgccacctcccactccgcagacacgcgccacctcccactccgcagacacgcgccacctacctcccactccgcagacacgcaccacctcccactgtgcagacacgtgccacctcccactccgcagacacgtgccacctcccactccgcagacacgcgccacccacctcccactccgcagacacgcgccacttacctcccactccgcagacacgcgccacctacctcccactccgcagacacgcgccacctcccattccacagacacgcgccacttacctcccactccgcagacacgcgccacctcccactccacagacacgcgccacctacctcccactccgcagacacgtgcgctacctcccaggagggagacggtgcgacacacacagcgcttgggacgtggggagggggacggtgcgacacacacagcgctcgggacgtggggagggggcagtgtgacacacacagcgctcgggacgtggggagggggacagtgcgacacacacagcactcgggacgtggggagggggacggtgcgacacacacactgcctttccccatcagtaagccttctttctgtaactttccctaggtaagctgccggcaaataccgtgcagtggtcagcgaagccttcagagcaccggaggcctcagctgctccagggctgagatgcccaactgttcctgggagaagcccaagcatccccagccacggtcctgcctcctgggaccctgatacatcttccagctcagtcactctgcatccaccaaacgtgcatccacccaacctgcatccaccaaacctgacagttaatctgagacatccctgagtgaccatgaaagagctttccagaacatgctgcaagctcagagtgcaactggagtcaaagagaagctgccaagcagaccggagcccacctctccagtgagacacggggacaggaggagggtgccagacgggtctctggggagacggggcctcaggaacgtaacacccaccccagcagtgcaggtccctcccgggcctccggagggttaacacccaccccagcagtgcaggtcctcccggccctcggcctgggtgcccagatgcagctcccccgccgcctggctgcagctccactgagcttttctatggccccctcggagtgcagtccccacctggaatgagataggcatcttccttggggtcggggaacgccaggaaagaatggcacacaccagcaagaagctccaatcttaaactccttcctccaagaacactcctggcccagggggtgggttccaccagacatctgaagagaggccaccatcaccctaatctcagaacctgatgagggaaagtttctaccaaacatgtgaaggttctaccaaacatgtgaagaggccaccatcaccttcatctcagaacctgatgaggggaaggttctaccaaacatgtgaaggttctacccaacatgtgaagaggccaccatcaccttcatctcagaacctgatgaggggaaggttctaccaaacatgtgaagaggccaccatcaccctcatctcagaacctgatgagggcattctatgaaaagaaaatgataaaccaacataccttatgaacatagacaggatatataaaaaaagacaacacaaatgataggaataagaatagattcgagaatgcaagacatttaaaaagcaatgtaattcaccacattaagaaaataaagaaaagaaaaccacgtgctcatgtcaacagctacagaaaaggcctgggataaaattccacactgtttgtgatgtgggaggaaagccccacactgatcaaggcctccagggagcctggacagaaggaacactgtccccaggtccacggtcaaggcaagactgcctacaggcaccacccaacaggcacttcacaaaagaaaatatccaaataagacaacgaacacctgaaaaggtgattctcatcaggaaaatgcaaatgacagccacgaggagatgcacaccagcacccccaccaggacagttgggagaagacaggccctgcagaccccagcaaacgcccgggaggctttgagggagagctgcaggtgcgtttcccatgacgtgttcacaaacaagcacaaggatgttcaaggcagttttgttcgtaatacaaaaaaaatgacacaactaaactgcccgtccaaaggcaaatgaacaattctagaatacaaatggaataccgcagggggtgcgcgccgtgagaaacgggtgcacaccatgagaacggggacgtgcagcatcaacactgagggtgagcgccatgaaaatggggtgcgcgcagtaaacacaggaggtgcgcgcagcctcgtggaggagccccgtgcatgcagtggcagatgcagcgggcaaccaaggtgggaacatctgtaccccaaagatcagccctcctctggaataagactgggctcaatccctttcttcacacatggaagcttctagaagacagcacaggaggacatgttcaccaccagaagacaagagaacacacaccacaccaccatgtgacgccaccacacgcccaaccacacagacgtcaggcccacacactgagccctggcagggatgtggattccctggtggttcttggggcacactggctcatcgacagaagagcccacaaatgctgggcatggccacagccacgaagggagagaatgccaacaggagcaaaatcctgcaagtcagacactgtggagcaactgatgtctcccacggaaatctcaacagccaaaacctaccagtggagacagaagtcagggcagaggtgacttttcgaatggggaacattactgaaggcccctagcactccggaatgttgtgtattctcatctgggtggtgattatccctggttttacagatgaaatgccagctataatgtctatctatagttcactttaaaagttcacaaatttctttttcgcttcccagctccttacacctcaacgagctgcgcaaggaaaagcacacatgggcaaggcgcctgtgtgacacgaggcttgccccgagctgcctacaacagggagcgtggcacagccaccaggaaggcggctcccatccacctgggctcagagcctgctgggcagctggggtgggacaggccctgtttcggcccctctaacctttcctcaccagcacaagaggactgtcagcaggaaccacgtgcacatgctacagaatgttctcatttcctaaatgcaaatatctccaacattaaatccaatccttaccaggcacctcctgtaaggccccactatgccccaaggaccaccagatagtgacagccatggcacaatgaccctgccgggccccaccagcctgccggccacctggcttctcctccttatgacacgaggtaggctctgcacatgtcatatgcagattccctatcacatcacgacttccactcatgggaagcacacacagaggaaagagaaagttgtagtaactgaaaaatggccacgtccagttgacaccctccccctggagctcaatctttctggtaagaatgagagtcgtgttgtccactgactgcagcacagaggtgccatccggtccttccagttccatcaccagctcagctgccttggtatccaaactgtctatgtgcggggtccgcctgtgtgtggggtgcggggtccgcctgtatgtggcatgcagggtctgcctgtgagctctcttctgttccactcacccatgggtctgtcctgctaccaagaggaagcacactacctcatgcctgtagctttagaggaagcaatgaaactacactgtctgcatcctccaattctgttctttctcaaggtggctttggttattctaggtcttttcaatttccctattaactttggaatcgtcttatgaatttctacccaaaaaagcccacagggattttggctggcattacactgaatctgtacatcaatgtggagagagatggcatccagttttgagggtttcctgatctatgaatattgtataactctgcatttaggtgtttctgaatttctctcagttctcaggaatattttgcagctttcagggtacaggttttgcagcacatcttcggtcaaatttaccccaaaataatccgtattttttatactactgcaaacatttttacaatttcagccctctattatttacgagtatttagaaatacacttctgcataatgggtttgcactggaacaccatgctacgctcactgattcttgtagcttttgtgcagatgtcttgggctttcctccatcaatgtctgtgaataaagacagtgttcctctttcctcttcagtctgactttcgtgctgcctggagtctgcaggacgatgctgactgcagtggagatggccagtgtttctttgtctgttctcaattttaggtggaaagaattcagtctttgacattaaatatgatgtcagttgcaggttttcacagatgctctctgtcaggttgaggaaattcctctctattcctagtttgcagaattttttttaaaataatgaatgtgtgttaacttttgtcaaatgtttttgctgcattagttggtatgatcacatggtgttttcagtcttataacaacttgaactgattgatattggaggttcaaccttgaattcttggaatcaaccctacttggttggtcatggtacattattcattttattttataagctgatgaattcaatttgctaaaattctttttaaaatttgtatgtttgtgttcatgagggccattggtctgtagttttcttatcctgtagtacctttgtctggctttggtatcagtatagtactaacacaacaactgtctatctagatagaaaacaagaacctctatgtttacctcacaccacatacaaaacatgaacctctacgcttacctcacaccatatacaaaacatgaacctctatgcttacctcacaccacatacaaaacatgaaaatctatgcttacctcacaccacatacaaaaattaactagaaatggatcatagacctacatctaagaactaaaactatcaaacttacagaacacaggaaaaacttctgtgaccttcgtttgccaaagataggattttaaaagagagcacgagttctagaagaaaatattaaatagaatggacctctatcttgggagttgggcaagagtgaagacatggaggctgctcagagcaccctatacaacactgtctaaggacccagagccaaggggattttcttggctttttctttcttaaagtgggaagtttttgctttattctaataatgaaaatcaggaacacagggaaggacttccacttcttttttcttccccgacacagattctcactctgtcacccaggctggagtgcggtgatgcgatctcagctcactgcagcccatgcctcccgggttcaagcaattctcctgcctcagactcctgagtagctgggattacaggcatgcaacaccatgcccagataatttttgtatttttagtagagatggggttttgccatgttggccaggctggtctcgaactcccgacctcgggtgatcctcatgcctcggcctcccaaagtgctgggatgacaggtgtgagccaccgcacctggccaggaacttccacttcttaaacgtgatgtgagaacctgaggagctcggcgttcacagcatcaggtaagcctcagtgcagacggcatgtggcagagctgagaatgcacagaatgcaaattcgctgcttcagagctaaacctccagtgggaggagatgaggacagtgtgttctacagagaggaatcacgcaggggaggggcggggcagggcggaggcagcatgcaggcatgtgaactgggtggtgggggaagcccaactgtcaggtaagcagaaatggtaggagctggcgggccacaggccgtgtgctctgagccctaagactgggaagagaagcggatccaagtccagcaagcccagcaagtctggcttcctctgtgatgctgctctatgtccttttctgccttagtgaaaagatggacagaaatcaccctctccacgagcccatgtgggcccacagcggtctcaggggtgtgtgagcccagcttcgccctcctgtgctctcgccatcagacacggcctcctgctcctcccgaagcatgcgggggagttctgggctctgttctgagtacagaccccatgccagactggctcgtgaaaccacagcctgaggtgggacacgccgaggcccagccatgcgcctcccagcttctcagctaaggtcactctggaatacttatcttgagggacgtagctcccagctccccacctgcagcactgacaaagctatcttcggggaggggcctcagaccagatgtgagtctgtaactggcacagactgggggggtttctgctgagactcgctggagggctcacatgctcagttctcaactgcagcctccatgcccatggacgccatctccagcctctcggcctccacacagctcgccaggtctcagtggggctgtgaatgtgggttcctaacaagctccagcagctcaggtgactgctcgtcggaggacacactttgagaaccaccaagtgaagctcagggggctgtgaggctgcctgtgctctgagtggcgtgcatggagcacaatgagacagggtgactgtgccatggggtggggacgacaggggacccatggggtggggacgacactgttctctgtagccctgcacacctttggatcagaacacactcaacgatgcagacacctgctggttcttcccgaggcagctcagcggttctgggattccgtggtcggcaatggtgagagaccgtctgcagaaggggccctttctctgacacgcctgccactgtgctcactggtgcagccaaagggacacgcacaagccgtcaggtcagcgcggcatcaggatgcactgcagagttgtgggctccatttccatcttccacgtatatgtcactgagatcacgattcttttggaaaaatctaaaaatatattgtttttgataacataaagctatatctggagaaaagggagtttatggtagaagactgagcagaaaccatttcagcctgtaccaggagaaggcaggtcagatgtgtgcacctgagttctggcacttggggctcacttcctccctaaggaatacagcctcttctaacagcagctgcaaccaggagtgcgtcttcccaggcattctatttcaagctactgttcaagctaagaaagctccaccaggcctgagagctccctactccctgtaatgcgtttaaaatttgtctgcctccatgaggaaaatgcctggctttactgtgagtagttggaaaaacaaacaaacaaacaaaacaggacaggctgggtgtggtagttcacgcctgtgatgcggaagctgaaggatcacttgagctcagaagcttgagaccagccttggcaacatggtaagatctcgtctctacaaaagatacaaaaatgagccgggtgtagcggtctgctcctgtggtcccagctgcaagggaggctgaagtaggaggactgcttgagcctggggcagtggggcagggtggggggttatggagggtgcagaagttgcagtgagctgagactctaccactgcactccaccctgggtgacagagtcagaccctgtctcaaaacaaacaaacaaacaacaacaacaaaaaaccacacatacaactgaacccataacacagctaccttactggaaaagcccagagtgaaatccacacatccctcacagcacacgtgtgaacagagctcgcatcgacattatcaggccagttcatcaagtctctcttctccttaaacaagagaacaactcaaagcagctgagcgcacacatcagcgctggggctgccggcaaatcaggacaccctgcctcctgcgccaacacgacctgctctctgtggctcttccggcctttctcgtctcgtgctaccctgccgagactgccttccctgcaagtccactgacacagggctccaccacgcccagcctgctggtgtgtcaagcggctcagagaaccacctcctcaataagcatatctgagacctgagccaggagagctccctctttcctccactgcttactgatcttcatcagaccaggcacagagaacaggagtgacaggtgccacctcgccatcaatgccagggccaggatctcctttccccacattccttctgcatcctacccaggccaccactaccacccttaccctaaaacctgcgggcacagaggctgggatcctctgtgaagcgcaggccaggttcactcagcagtctgttcacacagctgctccagaactccagcatcagaccctcaagggcacaacccaaatctctttgttcctagagcacaccccaggtgcagaagccaagcagccctttcacagacgttctgaggtcctgggacccccacccacatcacccgtgtgaacatgacaggtttttgatccaaacacacagctcacgcctccacactctcggggtgaaaccacaccatacacgacctctttgggagccaatgctcagtggaggcatggagcatgctgaagccgaagcttggtggcagtggcaggagctcaagaggatgggggcgaggcctgagctgtatgcaaagtattctgcacccttgcagagctggctgctccccgtgaatgctgagtcccaggacccaaccccacgagatgaggaagatgaggccagggcggcgacgtgaagctatcccaacactctgactgcttagccacagaagagcagggaccaccgggaagcgtgacctgcccttgcgcctttctgcctcactgctgaaggccgcacatcagcaccctgaccacccacctcctcaggagctcagcaggacacgcccatcacgaccaccaaaccctgactctccgtaggcttcacacacacgtgtgtccccgcctgtgagctcggcggtgtggtgctgaccaagcactggcttcagctcatccttcgctggtggctgcaagccatggaacccacccagccctgcacacggcacgaggagcttgggacagagcaagtgggagcagacacttggatgctgcccagacatcaagggtctcagagctgctgtcgtttagcacctgcacgtgtccgtattcacaaaatgcttcacgattcaccaaaaagaagtggactgagtcgccatcatgttgctgctgaggggaaggccgtcttgctggttatgttcgcgtgtggaacccctgctgagctcacaccacaccaaacccacaacatgagcagagaggctgcagcacagcagcacaggaagcagcaagaggcctcacaggtagtgacctggggaccagaaggcggcccagagcaaccggcaaccaggaacacactgaggggaccctgcccaccagggaccaccgagggtcagacaggtcacagatgaacggcctgccacactggccaagaagttaggaggagcaaggaggcacgaggatcaaaggacgacagcgacaggatggcaggagctgacacacatcctgcacagcaaggccctgcctcaccattcactccaccagacacgatactgtgcctgctgcagagacaggaagctgactcaggagacacctgacttgttgacggtcacaaagataacacatggcaaagcctgaacttgaacctggatctgtccaagttcacattcgctgggcacaccccagaactcggcgtctcccctcacagtgcaggacaggaagtctgtacttcctaacaccccagaacccagcagcacccgccaatactgcaggacaggaagtctgcaccccaggaaactgcatcaccccccacactgcaaggcaggaagtctgcacaccaggaatcagcgttaaccgcacattaataaaatgcagtggttttgattggcatcccattttcctattcacatttagaataaaccacagttggaagtaacgtggcccagcattgcttgcagtcaggatatctgaatgcctgacaggcctaacaggagccaggacagaaatcctggacttctgggggtagaaacgtgcagccacattgaggctcaggccaacttctgtacataaagctattatttaacgcttgacttcggtccccaaataacaaatacaaaaaaagcaaggccactttgggaaagatcactcctcaccaccctctccactcctggctgcagacagaggcacgaggaaagggccggagggcggagaacaggccacaggcgggcagcaccccattcccacctcatccccatctgggtgcggtgagcatgcagggctgggagggggcagcattacctttttcccagtctgcttctccaccatgtcgctgctgaggggaagctcttcctgctgtggtgctttagggcacccacccttgggcatcgtcctgctcctcacccgatcttcatttacacggccggcgcttcatcatcaaccgtctgcttcaaaagagaagacacacaattcactgaattcagaggcagctcaaaactcatccactctcacaccgcactcaacagactcagtaactagtcaaggcaggcagctgctctgatcagggctggggcccgggccaggcccaggaagggacttctcaggatacgcctcccataaaggggtcaccagcaacaggaatggcagctttgagcaggaaggagaacagagaagggtcaagcactttgtagtggcagaaagggacgcatggcctagggtgtggctgtgttctgggtggcagtcagcagcacctggatcctgggtcccacctggtacaggctacacccaaaacggtcaggcaccacaaggcagtcccttccccgcattacaggcaaggtcacaacacgcagcgcagtaccccagccctcaggtctggcaggtcatgtccacagccccagcctcacgccccactcaccacctgggaaggagctcctgtccccaccaggcctgtgctttttgcacacccagttccctaacttggtaggcaaggggtgtctctgagcgagtcccagcagctccgaggtcccaactccacgcccatggaagcagacgccccctcgggcctcaggctccagctcctgggtttcccaggaaatccgaggacacatactgtattaattgtatattatttttatttattaatcatgttttattttaggaaattttgccatcttaacaagtttctggccagggagagactgcccctctctcagggctggcaaattcctagatagccaagggctcccatgcaacccaatcaccttcttacccaagttcacgcccaggccaagccctgcctgaaaccagcgcagagccaggtaaaggaaactagaaagtgtccctacagcacaaagcctgcaagaactttccgaagcagccactcccgaactatttgctctgccccgtccctctctttctgcaggaaacccaacaggcagttgggggaggccttccccgagcccctgcttccgactcccacccccgtggtgtgaggctgcccctctgcgacacacggtgcgagcgcacttcttccttcccagcctcgtcctggtctcttctgtggcgatgccaacttccccacgccacgcctggcatggacactctcggagcatgggcctcctccctgcctgtgggccttctaggtttgttcaccatcacagccaggcctcccgggtgcactcacgagaggaatgggggacacacctacacacccacacccaaagccactgtccccccatcatgtcctcgccgcaccgtcagttagaaaacatttcatacaaatggaactgtgtgcacgtctctgccctttccgccacagcagcacctctgtgcgcgaccatgccgggagaagcagcttctgcaactcgctcccctgcatttacccatctcgctcatgcacgaagtatggcttttgaaacacgatgtgcagacccatctgtgagtggcagctccactgtgagcctctcccacctccaccccgtcagctaaaggatacgttgcatgccacctgcccctggacgcaggcttggctgagaccacaagatgcttctcctccaacaccatctcatgacctgctttgtctttctaaaataaatgataaaatcccaccaactgctgtcttggtatttaactggtacaagaacacaggtgaagttattctggagagagggacaggtcgggtcaacgtattcactgcctgacacctccacccgcggtgcaggtgagcaggtgtttccatccaccatccctgatgcctgaggccagacatattttctctctctacctgaaccaatgaattttacattctcttccaattttccaccacaaaaccggaatgtctcagcctggagaaagggcatctcagcacctgactcggaaggctgttcaagctcatggctgtctagaaactcagtggtaatgtttacaagtttaaggattatctggaattaacattttaaaaaatccagactgtctgctctcaggacggaaaaacggggccttcaccatgtagagtccaccgtcctgatcccagatgtgagtctgtggcccacggacacactcaacagctctggcgtggtcagggcgcagaccccacggcctccggacggtgtctgggccccgacagtgcggggcttatcacttcactcctgagacacctgattctcttcatgtccctagcttggtgctttgcccaggcaccttccccaatggaccagggatctgggagtccactcaggaggtggaggaagtgggtcgcacccaccaggcaaaatacttttcacggcctgcatcacagcgaacactccggggactcgggagtgttgtcccaggtgtacgctgtgttttctggagacgtttctccagccacctgcacgatgacagctaagaccatccaggccgtggcccttccaggaccctcgtgtccgcctggccttggctacaacatgttaccgatggcagcgatgtgctcgaggccctgcaaccccagcccccgcctctccatgaaccaccaccctcatcacagtcatggagatggtgacagctgagatgtcctgctgaagcatctgctggatgtggatgaagctggtttggatgtagctgccatctagcccaggctacacctcccaggacccgcctgcaggcaccaggcgtgcagcacgcggcccactctagagtctttttcaatgagagaccagatgaggacagaggctccagttgcttttgttctgttccaagacttgccatcccagtcctcccagaagctgccctggtgatgcctctggcacctttggcccccacactgccctgtgttccctccaccaggctcagggctggtcagcctcaccccttgccgtgaaatggcagagccagccgagggccgaggaaccgttactcagccgtgtcagtgacttctaccaggggctgcacggcactcaggagtcaggccaacaggctctgctgactcatgggtgttgtctgagggtgggggctgtgatgatgtccccaggcctccctggcagggctgtcacataaaacagtccttgaagctgggagtcccctctttagacagttccgcagcccctgtgccttctcatcacgatgctgcacagccgaccacacaacagaaggcaccgggtctcactcccgggggagactcttccctggaaggtgacttggctgtccctgcctagactcattttaagtgcagcctaaatctccctcatttccaagttatcaggcaaagtctattttaaactcacgacccttgaatcagcaggaaactgaaacacgcctcaggccactggggctgactcacgccctgtgctgagcggcaaggcacagccgcgggaaggtaaacgcagagccgaggggccggccagcacctggccctgaccgcccccaggccacgcattccttgttacttcacctcctggcggatggcaaccgtcccagcttcgtggactgtcagggtcaccgagagtccagggtggtgggagtcccccacacgagccactggcacactccctgaagcagaagccacggcgccaaagctgtgggctcagggaacttgcccattacctggcagccccgcatctgtgccaaaataagacacaactcagcccagcggagtggacagtgtctgcggccagctctgggatccagggccagctgatgctgggaacagccgtccttgccctgtgcctctccacactgcgagagcccctgcagcccagaggggctccacctcccctgcaatggggctcaaaagacaatccttctacggggctggcaggacagacgtgacaggaacaacgatggcctgctcctcccggaaggtggcttcaagagcactcaggaggtgacagatgctgtcaagaccggcccagggaaggcacagggcaggtttcccagcacccaccacgcgccagcgagcacagagccttcgcctgaaccatccaggcaccgcgccctccccctccgcacacacaggagcccagctgcgattccctctgctccacaggagatgcagcgagcaccaaagagccttcctccaggattaagcctgatgcagaagtggttacactgactacggcaaggtcagtttggcaaaacccccaggaatttcagcctatctggtctcttcagctgacaagagcaggcactggtggggaatccggcgctgcctctccccggcttctaggatctgagctgggccaggacaaccctgagacacctgtcgggcggggcaggactggggctgcagggcgggactgtggggaggggactgtggggcggggcctgcagggcagggtgtggggcgggagctgcggggcggggactgtggggccgggtggggagccgcagctgcggggcaggggctgcccaggagcactccttgccagaggccttggcatcaccagggagtccgtggaccatggagactcacgggtcccctcgggccttctgaacccaaacctgcattttaagcatgttctgttctgcacactaacacctgagaaggaccgtataagaaaaaacttgtaatgacacaactaatcttaaaactcacagaaaaaaaaaaagacttctttggggttgaaattcaccttcaataaagggatggaatgtaagcagagctgaccatgaacaacctgggtctgggtttgcactgcgtgggttcacttacacgcagattttcttccacctctgcctctcctgagacagcaagacccatctctcctcttcctcttcagcctcctcaacgtgaaaacccggaggacgaaagccattcgtggagacccgctgctgctgcgcgaggcttaagtctattttctcctcatgatctcagtattttcacgtctctagtttgctctaccctaacagtaagagcagaacacacataacatacaaaatgtgtgtgactggctttatgtggtcaggaaggctctggtcaacagaaggctgttagttaagtttggggaaagttaaaagttctacacaaattttcaactgcacaggaggctggcgcccccaacccctgtattgttcaagggtttgctgtaatttgtattaaaacaccaagcccccttacacctgggtgagtctctctccctgaacagatgtgacaacattaccctccgaagactcccagagagaaagagaacacttcaaattcagatttgtcttccacagtatgttgatagaacaggcctttacgtacgtcctgggcaaatgctcctctccttatgtaagttaataactccaccaaccactagtttgtgtaatgaccatttaaatatcgaatggtgcccaaggcccctgagaagggatgtgattcagcccctcccctcacgcaggcacgtggcctcagaggcccaggaggaggaagacaggaagtcagcagcagggtggaaaaggggagggaagcccttcaagggaagctctcccagaaccttcaatcccagctccaattccaaagacaggaacacactcatgactgacaggatcaaacaccaaaggcctgtttgccttgagggggacactggggagggtggggaagggggagtgaggaggagctggaagcagcagtcctgtgtggcaccaggggcttgctcccacgtcggccctgggcacagccccgcatggtgatgaggtgtggcctgcctgcagcacacggccatgctccagataccttagctttatctgaagagttcttttgtttgtttgtttgtttgtttgagacagctgtgttgcccaggctggagtgcagcggtgtgatcacagctcactgtagcctccgcctcctgggctcaagctatccgctcacttgagcctcccaagtagctgggagtacaggcccgtggcaccatgcccggctaatttctgtactttctgtggagtcgggtttcgccatgcttccgaggctggtgtctgaaggatgctttacggcaacccctgccttttccagctgagccctgccggctgttgtgcgctccgtggaaagggagaagcacggtctccagcggctgcgtcaggagtggtgccttgtgcacacctcacagggagagaagtctccaacggactgagcggaggaaaaaagaaaaaaggagaaaaggaaaaagagctgcatacctggcaggcctactgtgtgcaaagcccttgagtgacacaccctatgacccacagcactgtggcaatcccaggtatggaagagaagcaccactggcctctcacctctcaccatctcagtgggcaaggggagagcaagcagcccagggcaggggggctgagccgagggcaggggggctgagccgagggcaggggggcagagccgagggcaggggggcagagcccagggcaggggggcagagcccagggcaggggggctgagccgagggcaggggggctgagccgagggcagggggtctgagctaagggcacgggggctaagcccagggcaggggggctgagcccggggcaggggaagagccgagggacagaggccctcacaggaaccaggccctcccgcacaccgcctgacagtccacgtcagcgtctctgtccagcctccacacacccctgcacgttctgaagagccctccccaagagtccaactctctctccttcctcctcagggccgcaccagctctctctccttcccctcctcagggccacaccaactgtggggttccagctatcactctgtgcaaaggactcctaacatgggtgtcctccgtctcaccccataagccacactggccaaggccaggcaggcaccacacatcgcgaggtagaatctctttgctacggtttgaatgtttgtgtcggcccctcccctgcaccccaaaattcacaggttcaaaccaaacccccagtgtgcccagctactttttgtatttttggtagagacagggtttcaccatgttggccagggtggtctccatctcttgacctcatgatctgccggcctcggcctcccaaagtgccccacggcacaacgctctctactgcagccctgtttccactcacattttctgttatcacggcggggggtggcagcaccgagagcgcgttcagcattactggcctctgctttgcccctcagacacatgcttggtcactgggctgtggaacatacaggagccccgtgctccggaacacggaccacccgacaggagcacggacacagcagtcggggcgacgtgggtgcctcacagaagagggaaaaagccaggagggcggcacgtgggcgcaaagttctcagcttcgttagtcatcaagaaaatgcaaactaaaaccaaggtaagtgtgagggttactactgagtttcaacttgactggactaaaggatgtgtaactgttcctgggagcatcttgaggaagctgccaaaggagattcacattgagtcagtggacggggagaggccgacgaaccctccatctgggggggcatgatctcatcagctgccagcacggcagatctgcggaagcactggactggctgagtcttccagcctccatctttcttccatgctggatacttcctgccctcgaacatcagactccaagtgcttcagcttttgggttcttggacctacaccagtggtttgccaggggttcttgggccttcggccacagactgaaagctgcgctgttggcttcccgacttttgaggtttggggactcggactggcttcctggctcctcagcttgccaacagcctattgtgggacttcacctcatgactgtgtgagtcaatactcccaataaactcccctccatatatacatttatcctattagtgctgtccctctagagaaccctgactcgtacacacaagtactggtgaaggggtggagcaaaggaaactagtccactctcatcagggccaactcacgcacctggcaatctctactcatactgaacacaagtatgccctatagcccagcaatgccattctggacatacacgtccaaaagaaaagcaggtgcacagacacaagagacacgcgtgaagtgcttcatagcagtggggtttgcggcgtgccactaggatgtgagggtggaacactacacagcagaggaggcaaacacatcacaacgtaagtcaatctcacaaataatgttgaggaaccctgtctctacgaaaagtttaaaaattagccgggcactgtggtgcatgctggcggtctcagctaccagggaggctaaggcaggaggatcacttgagcccaggaggtcgaggctgcggtaagccaagatcatgccactgtactccagcccgggcgtcagagccagaccctctcccctctcccctctcctctctctctctctctctctcacacacacacacacacacacacacagagtaataatgttggggacaaaatacatgatacatttacataaatttctgaaaatagcaactacagtacttagggatgcatacttagttgacaagacatccgcgaagcgtggaaaatggctgcctggcggatggaattggaagggacggtgaaacgggttctaagtgaaggctgcggaggcgtttgctttgtggtctgctaagttgtacatttttactgggtggacgtttgggttctcagctgaagcagtctttcagaaggtgacagagataaaggccacactatgtccttgcaaggcctcagaggtgtcactgaccttttgctgcaggacctgttcttctcaggggtcttggcctcctagaggaaggagggccccatcgccctgctaggccctactgggaccctcaagggcatgagcatgacgacggagcagcttcaggcttcccagcatgtcgggcaggcctagccatgcccaatacacactgcagggcacccactgcagagtgcaacagggagcttggagcctgacaaggagacacacagctctgtgaagacgaaggggaggaggagcaaggaaaatgcttcttttacacagaaggcgccaagatacaaactaaatgtgatgaagacaaagaaaagcaggcgtgtgtgttaaaggtacaattgcacagctaaaaataatcatggccgtaaggcagggacggcagatggagggtgactcagcagatttcctccaaggcttgcgagggtggaaataaacacacggaagtgaccagcagagagaaacacgcagggaagaggaaggttagaaaggtctggggtgtcacgcaccgttgctgggaatgcagaggaggacggtctgcagaaggggacgcagccaccgccccccccaccccgctgcagaaggtgcacaccactcagcaaccacccacccactgctcaatctacccccaaattacacaaatagggccaggcacggtggctcacccctgtggtcccagctactcaggaggccaaggcaggggggtcatttgggcccaagagtttgagacccgggcaatgtagggaaacctcatctttacaaaaatatcaaaaaattaatcagtcgaggtggcacgcacctgtaatcccagctccttgggagcctgaggcaggaagaccccttgggcccaggaggtcgaggctgcagtgagctaagattgcaccactgcactccaaccttggtgacagagcaagaccctgtgtgaaaaaaacccaaaccccaaaccaaaaaaacacaaccggggcatgaaaaagtgcttggcccagagcagtgccccaaagcatctcctaagaaaggggcttaacacaaagcctgcccgccaggggctgctggtggcatccgggcacatctgcacgtggggctgacaggactaaggaggttccacagacacacgaccaggcggagacgcagagaaaagcaggtacagcaagaagtccactgggcaatgcagaggtggggaatgcagagggggaatgcagaggtggggaatgcagaggtggggaatgcagaggtgggaaatgcagaggtggggaatgcagaggttggaaatgcagaggtggggaatgcagaggttggaaatgcagagggcacctacacttctgatgacagcgaaatatgtaaggctggctcaaccatcaatcagtcaacgtcacccagcatgccaacaagctaaagaagaaacaccacataatcacaactggtacagaaaatcatttgataaaattcaaaactcacgataaaaattcctaggaaaacaggagtgtggagaaacatcctcaacacgataaaggccaactaccaagaactcaaggctgacatgatcaagagtgacgtgctgagggctgcagatggaatggcatacagggcagaaaggaagaaatggaataaaactgtctctctctgaagatggtgtaagtgtccatgtcgaaaatcacaaggaatctatcaaaaattccaagaaactttatttaatagagttcagcaaggacacagaatccaagatcaacacacaaacacctatcctatttctgcaataatcctatgaaaacaagaaataaagacagtaccatcctatttctgcatgctaccaataatcctatgaaaacaagaaatacacagtaccattctatttctacatgctagcaataatcaaataaaaacatgaaataaagacagtaccatttataggtgctccaaataaaaataaatgcttaggttcatatggaacaaaactagaaaaacctatacacattttaggaaaaaacaggagaaaatctttaggacctagggccaagagttgtcagacatggcaacaaaagcacaatccataaaagaaaaaactgataaacgacctcgacaaaattaaaaacttttgctctttgaaagacctagtttaaagagtgaaaagacaaactgcagacagggaaaaatatctgcaaatcacaagtcagatagcaggcttgtatgtagaagaaagaagtatcaaacaacaaacattaattagaaaataagagaaaacacacagacattcagaagaggtgcacgtggtgaacaagccatgaaggcactcgacatcctaagccgttagggaaacacaacttaaagccgcaatgagatattactgcacaccaatcggaacagctaaaatacaaaatactcaaggatgctggagaggatgtagaaaagctggaactctctcgcttgctgtgggaacgcaaagtggtgttgctgctctggagaacagcaaggcagccttacgaacctaagtgtgcgcttgctgccccactcaacaactgcaccccaggacatttatctgagaaaatggaacctcatgtgaacacaaagacctgtttgcgaatgttcacagaactttcactgataatagacaatggggaaaacccttcaacaggtgtcccagcggtgtcctcgaaactgggtttcattcacatcacggcatcccctcagcagtaaaagggatggctatggatacacccaagcgtatgggtgaatctgcagaggcccctgctgagtgagtggacacacccaggcgtacgggtgaatctgcagaggcccctgctgagtgagtggacacacccaggagcacgggcgaaatcagcggaggcccctgctgagtgagtggacacacccaggagcacgggcgaaatcagtggaggcccctgctgagtgagtggacatacccaggagcacgggcgaaatcagcggaggcccctgctgagtgagtggacacacccaggcgcacgggcgaatcagcggaggcccctgctgagtgagtggacatacccaggagcacgggcgaaatcagtggaggcccctgctgagtgagtggacatacccaggagcacgggcgaaatcagtggaggcccctgctgagtgagtggacatacccaggagcacgggcgaaatcagtggaggcccctgctgagtgagtggacatacccaggcgcacgggcgaatctgcagaggcccctggtgagtgagtggacgcacccaggagcacgggcgaatcagcggaggcccctgctgagtgagtgcacaaagcccacctcttaggtcactccctgtggactctactcccacggcttcctccaggacaaaaccaccaacctcggggaaacaggcggggactccgtgaggagggctcatgtctgtcggtggctgtcgaggaggctctaggaccaggtatccaggataagacgggggatctgaatcaagtctgcagggcggtcaccctgtcttccaatgtcatgttcccggccactgggcgaaggtggggaagggcacaagggatgctgctatttttgcaacttcctgtgagtctataatgatttcacagaaaaaaggaaaaaaaagggagaaaaaacacaaggggtgtaaggagactcccatgggtgatgaatagtctatacttttaggtgatggtgtttccccaacggtatacgtttcccaaaacccactgagctgtaaatttaaaatgagtgaattttatgtcaattgtaattcaataaagctgttaaaaaattaactagaaacagaaaaaaattttaattcccatagaaagaaggaataaagtaaaaaaacagtatgaggtaggaggtaagcttcctttcataaaccttgttttgtgtatttggctttggaatcatgcattttacatcatttaaaacattaaatataaaatgagactgggtgcagtgaatcccagcagtctgggaggcccaggcaggcagatcacttgaggtcaggagttcgaaaccagcctggccaacatggtgaaactctctactgaaaatacaaaaaattagccgggcatggtggtgcgtgcctgtaatcccagctacttgggaggctgaggcactgggaggcagaggctgccgtgagcagagatcacaccactgcactccagcctgggcgacagacaagagtgagaccttgtctcaaaaataaaataaaataaaataaaataaaataaaatgtaaaaacataaaattttgtttatgtattcacattaaatataaacattttaataatgtttaaaatgatttaaatatacttgaatgacattaaacatttaaaggatttaaagcattcaatataaaaatacaaaaagcaatctctacaacttcaaaaaggaagaggaagcaatacacttagctgtgtgtccggtcaggggcaggacacaaagcatttgtcaacaatgaccatgcagccaccaccacaccaggagcattcctgacagcacgcagcttctgggtgggtgggaaggctcgggagacctggctcaggatgtgagtcaggtgctaggggagccagtggagagggaggggctgcttcccaggtggccgctcgcacaccgggagggctgctgctggctctggcagaaggcccaaattccttggtgcacagacacggctgcggatgtgtggacatgtccgtggggctacgtgagggtccccgtgacgtggcagcgggtttccacagtgcagtcattgatggggtggtgtgggggggagccacggcacctctgtgacctagtatcggaagcaaggggctgcgtgagggtcctcgtgacacggcagtaggtttccccagtacagtgactggggggggggggggggggcgggggcggaggaagctgcagcatctcttgtatcggaagtcccacggcttcacttccacctcatcctgttcctcctcggcgagttccaacctctagcccacactctgcagagaacggtgctccacttctgaagggaggcagatcaaagattctgtggacactctttaaacttcccccagtggcttttgattaaaacctggtaatttgactgtacagttctagttagtgccatatgccctgaggacaaaaattaaaattttgaaaaatattataagcaaaacaccttcctttttcttgagacggagtctcactttgtcgcccaggctggagtgcaatggtgccatctcggctcactgcaacctctgcctcccaggttcaagcaattctcctgcctcagcctcctgagtagctgggactacaggtgcctgccaccatgcccggctaatttttctattttgaggagagatggggtttcgccatgttggccaggctggtctcgaactcctgacctcaggtgatctgcctgctttggattcccaaagtgctaggattacaggcatgagccactgcgcccggcctgatgaaatacattcttaatattaacttcatgtgtttctttttactctataatgaggctaatagaaaatttaaaattagatgcacagttcacatcatatatctcatggacagaacaactctatgggacagaagaccccgatctctgacaaacaggcaaaaatcccagagaaaagaacaaagggagaatttacagattaaagacttaaaagacatcaaagaatcttagtgtgtagaccctgtttggaaaccagttcaaacaaagaactgctgaagaaaatggcacatttaggaaagagccttttgataccgctgggtgtgtggtgacactgagaaagttcaaggcacccagcgattcaggagatagagatttatagatatgtatttaggtacagggtctcctctgtcgcccaggctgcagtgtaattaaataatcacagctccctacagcctcgaactcctgggttcaagggatcctcctgcctcagcctcccaaaatattggggctacaggcatgaaccaccacacctagcctgtgtgctatttttattttcatttagtctaagatacggtgatggttttgaatgttttcggcggatgcaatggtgtggactcgggtttggttccgggttaacgggctggggtggctcctgcacgtgggccccacatgctgggaaccgtcatcaccactgtgttcaccacactctctcttaagaagggcacacaaaacattcaaaaaaaatttaaaaactcagtagcatgcagtggctgatgcctctaatcccagaactttgggaggctgaggtggaagggatcattcgatcccaggagtttgagaccagactgggcaacatggcaagattccatctccatattaaaaaaaaaagataataatcttaaaagacacaattccagaagctgcagaatgtgtcacagaaatgacttccttacgtattaaagaatcctcacaataaaggatcattttacaagcagactataaacactgaaacagacaaaaaactaaaaacccaactcatgagaaacacctggtgaacgctcttcagctccgtgaagtcctgggatggcccaagcacctctggtgggctgtaccttttcagaaagaaacactgagccccccaagtccccgaggacagagatgccttacagctccacacgtccctccacaacggcagcacctgtacccgcagctctggggagaaatgacacctgcaggccaagacaaatgcaagaaaacagcctcgtctgctcactgattctcaccaacttcctctataaaatgaggacaagaacccattctcctaaaggattttgtggggattaaatgaaaaagcactatctaaatccaagttatcatcactgtaatggctttagaaaaaagcaaacgacaaacacaacgagagaggcgctgagaccaggcagggctctcctccggcagggcctggtctgcactgccctctctgaggaaagtgccccgctgccctgacctccctagtttcacacctccacacctccaaggaggttatcctggtacaactgagaaagcaagcaattcccttagaaacgtccatttctttcctttatgctcaaatgttttattactccttagggctgctttgttttttaacgcaagggtccacagttgagaacgtagttacaaactcaagaaacgagctgcaacagaacagcggggctgctccacgcttctcagccattttcccatcctgtgcacccggggaatttcacacgtggtcccccagagtgacagggaacccccagggaagaagggcccctgtggggcatgcagaaaaacgcctgccccctggtgtgaggtcacagactcagtggccaagctcaacaatgctctgggaactccagtcaaagatgcatcacaacttttgggtcatgcctaaggtcaattccagaatcattttagcatgttaaacagacactgaaaataaaacatattttattttttaaagcagctttaggttcacagcaaaattgagcatgaagtacagagggttcccctgcacccccgggctcagcatccccacgagagtggccgtttgttacagctgagacccccctggacacagcatcatcacccacaggccgcacgacctcagggtccaccgggtgctgtgcagtctatggttggacgaacgtatcctgatgtggacccaccgttgtggtatcatacagagtagtttcactgccccaggtcccccgtgttcctgctgcacaaccctccgtccctccctctccccagcccctggcgtcactgatctttgtgctgtctgcacagttttgccctttcctggatgtcagagtcggaaccctacagtgtgtagtccttggagacgggctgctttcactcaggcctggcagctcgtctgtttttagggccttgtaatagtctgtcgtctggatggaccttggttgactgatccattcaccctctgcaggacatcttggctgcttccaagttttggcaattatgaataaagccattttgtgaaagtgaaataatacagaacaggaaacattagggggcactgcacaccatcacagaaagggacggtattattctgtgagtatgttcccagtatgtgggcgtgtgttgtgaacagagagataaactactttctcaccactggaagcagtcaggacaattcaaatgctggcctaactggttaagagccctcaatctgtggtcagatatatctaagtttctcaatctataaaatacagaaataaggccaggtgcagtggctcaagcctgtaaaacaagcactttggaaggctgaggtgggtggatcacttaagcccagttcaagaccagcctgggtaacatgatgaaaccctgtgttttaaaaaaaaaaaaaaaaaaaaaaaaaaaaacagagagagagagaaagaaagaaaaaacactgttcccaagctgcgggctcaggacaatgtctgatgcctggcctagccctcatcaatggccttcacaatccctgctgactgggagtcaacccccagtgagtgtactgccaatacggccaagtttctgaagttggtgacatgtgagggtaccccaagactgaacagaaacaacctcctctcaggttctgagtgggtccagctcttcttacccctccaagcctgccattctctgaggagtcctctcttcctccactgctctgcttcctctcacaaagggggagtgtcccaccacgtccaactccaggctggcaaagtgacgagaaaacaccccacccatgtgggcagtgggcatgcggcatgctatggggccatgagaagcagccaggtgggtaggccagaccctgacccagagcaagcagagcccagcgcagtctcagccacgctccatgaggggccacatccacgagggcccaggagcaacatcccaggcacaccccagggatgagcagcacaggccgccaaccacgtcataccacactcacttgtgcaaaacaccctcaaactgcaaaaagcccacccacgtgtccaccagcagaagagcaaatgagtccaggtggcccacaacacacggggcgcacgtgtccatagacagcacactggattcgaagagccagacacgagtgtgtctgctgtggccttctgcatgcatgagggccccatggtgctgggggccaggcagacagtcaagcagcagagtggaggggaggtccaggaggagatcccacaggtacatgtgacatgagctctatcgtatgtgcacctaagatgtgtgccatttcctccacggatgttataccgcaaagaacaataaaaaacgactaacactgattgctgaccacctccccaaataactaatcaggacacaccctgatgccccatgtccggcctgtgggggcactgtggaaagcacaggaagtgagctcagtgcgtgccttccccattgtcctggcgttccatgcaggctgggagacgcgggtgacagcctcacaccacccctgttcccagaagaggccagtgcacccccaagcaggggctgcaacagggctgcacagagggctccagttccttccagcacaggaacaaatccacaccgaggcatccgtgagtcccacaggtcccagaagcatgggagcagcttgaggcctctgcattcaggggtctctgccgtcctgagcttcaggatgagtgggttcccacctagcacgcagtacgcagtgggttagggcaggtgctctccctcctctccctatgaacgctataccactcccatgaaagcctgtgcgtgctgcctcaggaccctgtagcagaacagcgagtgacgtcgctttggcagggaacctttggtttgcaaagccccgtcacacacacaagctgaggtaagatgacaagtctgtgtctctgcacctcagctgagccctcaggacacagcacatgagcgcccaggggcctgcaaacagcaaggaccaaggcatcactgaccgtgacaggccccagtgtgtgacagtgagaggccccagtgtgggttctcacaagcttgttttacggtttgacccagagagtacctgtgagtttcccctacagctggtgcttctaaagggctaggagaaacgcagggcaggatccccacacgccagcagctgactggccagacccctgcctgtgctgaggcatccgccgcaaacatgaccgtgcaacatgcttcaagatgccctgtgactctctcagatgggtcttttattagagtttctaaataaagaagtgatggccaacatcacaggaaaccttagatactattcctgccagttggtttgaaaaagctttaactgttaatttgctgatcgttttcagccacacggttttctgccatgtaatccacagaacccaggcctctggccacttgtccaggatacctctggagctcagagccactgtccttgtgggctactcaagacttgaggggttcaggcaagagccacatcaacagagctggacctggtgcctggctgggagcaggtgccggggagcagccaccaaatgcacacacgccagggcacgcaactgcccgcacctccaagattgtcgtcagacctagaggcgggtgtgcgtccacagacagcacactggattcaaagacccaggaaggaaggagtctgtttgctgtgggcttctgtggtgctagggaccaggtgaacactgaaggaggggccagacggagtccaggaggactcctgtagcaggacattgcccagatttctcacaatgtcctctacaattaagagcacaaccactgttccttctgcactggtgggaacccagcacttcaatgagacacaaggttaaagtgacgctttgtaaggacggaaagccacctgtgggcaccacaccccccgggtgggccacgacagggagcacaggcactaggagacccggcctgtcctaaaagcacgccctacaaggagtccccactctctacctatctgcttctaatgttctgactacatgagagatgataaaagggtttcaatacaagtgtaacattttaaatataaaggaatgtctttccattagaaaacaactgcaggccgggcgcggtggctcacgcctgtaatcccagcactctgggaggctgggtgcggtggctcatgcctgtaatcctagcactttaggaggccgagacaggtggattgcttgagctcaggaggtggagactagcctgggcaacatggtgaaaccctggctctaccaaaaaaaaaaaaaaaaaaaaaaaaaaaaattagccaggtgtggtggtgcacacctgcagtcccagctatttgggaggctgagatgggaggattgcttgaacctggcaggcacaggctgcagtgagttgagatcacaccactctactccaccctgggcaacagagtgagaccctgtctcaaaaaacaaaaaacaaaaaactgcaaattaaaacgccaaacgcacagattaatggaggaagccccatgcccaaatgctcccaaggaaacgtcagaaaggagaggacttcaggtggctcggaatcctccgccacgtgaccaagcccagctgagcactgggtctcattggatttgccatcagacactcacagtttttgtcactgttaaccctactgcacaatacatgaacatggtctaagcaattctttttttttttttttttttttttttttgagacagtctccctctgtcgcccaggctggagtgcagtggtgcgatctcagctcactacaagctccgcctcccgggttcacgccattctcctgcctcaacctcccgagtagctgggactacaggcgcctgccaccatgcccagataatttttttgtattttttatagtagagatggggtttcaccgtgttagccaggatggtctcaatctcctgacctcgggatccacccgcctcggcctcccaaagtgctgggattacaggcgtaagccactgtgcccggcctggtctaagcaattctaaccatgcagacaatgtgcaggtctttcctaggtggaaagcaagtttgcccaagtcgcacgagcaaggctggagtcagcaatgcctgttcctctccctctgttctctaatggtgtggtcttcagtctactgtgtgtggaatccccctctattgggaccacagctcctgggctgcaagcacctgctgagcatgagggtccagcttccaagctcactgtcccacgggtgacaagcaacacagtgacctgcctcccacatcagctggtgccagtatcatggtgactccctacacaccaggaccactgtgtcgcgctctgccactcaggagccccaggggcccccactatggccatcccaggacgccgcccgtcaggctcccaggacactgccccaagcacccagcttcagtgggtgtgctgccccgagacgcactctcactgtgccggggggtgggacctctgcagcccagcacgtccactcagtgtccatgtgctgccatgagcgccacactgtgtcctccaggatgtgggtctctgttagtccctcccctaccaagccaggacagccacctgcttacaggggtgctgacaaatactgactacctgcaaaattgaaacatgggtttgaaaagggcctgagtggaaatcctgtacttaacatacactctgttaaaaaaaaaaaaaaaaaaaaggaccaggcgctgtggctcacacctgtgtaatcccagcactttgggaggccgaggcgggcaatcacctgaggtcaggagttcaagaccagcctggccaacatgatgactgtctctactaaaaatacaaaaattagctgggcgtggtggcatgcaactgtaatcccagctacttgggaggctgagacaggagaattgcttgaacctgggaagctgaggttgcagtgagccaagatcacgccactgccctccagcctgggcagcaaagagcaacactcagtctcaaaaaaaaaaaaaaaaaaaaaaaagagcgagcttttgtagaaacaggtttaaaagaaaaaataatctctgctcttttcagcatttagaaaatcagccaggcaaaacaatcatttccctttcttagctaaaaggtttgccaaatgaatacttggagcaaaataagcctaattagtaacaaaaaaatcacccagatataaatgcgtaatttaaacccataatgaaagcacatgaggaactcctttccctcaaagtcaccaccgagggcctcactggacttaggacccaggaaggaatgatgagtccatctgctcgtgacctgagtctctaaaccaggaggacagacgtcctgggtaaccgctgatgggtgagcgttgcacccccaggatccctgtaattataggttctcaaggacaccaacaccagaatccatatcccatctagaaacttcttcctgtgatgcctgccaaaaggtccatttttcagtccattatcacaatgaaggtgaagttttgctgtttaggtcaaaatcatgcattaggcaatagaacgacctagagatgtctgaattccccctcagtacaaccaaaggagtaagagaggcccaggtttgcttgaaggcttacactagcaaacaaacaaacaaacaaacaaacaaagagaaaccaagaactgggaaagctggtcggtagcatcacacaggtcagatctgaaagccccatggtccgaggagcccatcctgccctgagtgcacgcagcgcatgtgaagagtcagatataaaggtggctctttcacaaaccatttcggaaatttagacgaaccctcaatttatttagaatgggttattatattttataatttctacacagaaaatattttctaaccatatcattttataacaaattagcaatagctaatgtttcctttaaaatttttcaagcacacagaaaaggatgaaggagaatacaaacacacatccaccatctgttcattttgccatatttgctttagaattctaacatttaaaaattacaaattacataatggttgaagccccttatataagccccaccctgctgtggctgctcctcagcgtcgatctgattttggggctaagcattcctctcggcgctttgatactcacgctacacacaagcctacaccaaagccggccgctgtctttgcaggtaacgcattggacggttcctgccgtaccttttcccttcaagttgtgctctggggtctatctgtgtggatacaggcagttctactattcttatgacaactgcagtgtgcgctcctcgttgtctgaaaaatccattctcctgttgactaacatttgttttttccaactttttgcgaatacaaacaacactaaaatgagtatttgtctgtttctttacatatctaaagtttataactagaaatggaatttctagcaagaaactgtaaaatgctttgtaaaatatctgatgaaatgtcacactgtatagtcattcacaaacatgtcatctttcacttttgattagggcagatgtcttctgttgtaatttttgttgttgttgtttttgagacggagtctcgctctgtcgcccaggctgaagtgcagtggcaccatctcggctcactgcaacctccacctcccgggttcaagcggttctcctgcagccccctgagtagctgagattacaggcatgcgccaccatgcctggctagtttttgtatttttagtagagatggggtttcacaatgttgtccaggctgatcttgaactcctgacttcaggcgatccacctgcctcggcctcccaaagtgctgggattacaggcatgagccacagcgcccagtcctgttgtaaatcttttatcaagagatcttggttagacaaggggaaacagtactttgcacatcatctttttttctaacatgattacattctacaaaaagagacaatataattaacaaatttcatttaaataaaaactataaactcaagtgctaacaggaggctgttcattggcaaaacaaaatcttggaagaggcacaagggcccagagagctctgaaaccccagaaatcacacagaaaatgtacaggtatgtggacagtcctggggagaggatgcacagcttttgcccaattctcagagagtccagacctgaaaaacgtttaggaaggcaccttttcaatgtccaaatgtgggcagtgatgtgggagtgaacatcagccaatagagtcctggacggacattctaccttccaaagcagaccagactcaccaacacacccagaaagaacatttttaaaatataaatggcttcagaatcctttaacatatgcccaggaaaaaattaataagtcataacccaagtcatgtggactgtttatatgcaatattagaaaagaaatcaaggtttccactgcgaaaagcctgaaacccacagctctgtttctaaggtgaatgagatgggtgagatccgcggagaagactggacttctgctgccatcatggcaagcagacccggtttggaaacaatgctgtgggtccatttctctctgcattaaatacaccacaggatttttcgttttaaattattaatcaggcaatcaaaccaaaaggaagcagacaatttaagttgtaacagggcaatctgcagattctcacaggttggagggataaggccccaacgtgaacagaccccaccaagcagcttcccagccttccagaaggttccagaaggcctgtgtgggctgctgggctcgtcaccttagcaacggctctaaacatatgtgcagtgacaccagctgatttctgaaagctgtaaatagaggataatggcataaaaaaaattccagattaaaggaccacccactgcctcctctcccaccccatccagcccataaatcccaccgttaacactgggagcaatgccacgtatgcaaacgtggctttaatcccctcacacacctattcatctgcataatgatatacctacaaaagcaaaataaggtccttgggttaactctctctgcacaaacgtgcacaaacaaaaagtggccaagagatggcagagtctggcacggatggaccagcccacagcagccacggcccacggcgggagtgctgcacctccacccacagcggccacggcccacggcaggagtgctgcacctccacccacagcggccacggcccacggcgggagtgctgcacctcctccacgaacagcagccacggcccatggcaggagtgctgcacctccacccacagcggccacagcccacggcgggagtgctgcacctccactgcccacagcggccacggcccacggcgggagtgctgcacctccaccgcccacagctctgcttcccaccctccacctcacaccaccatgggcacttggtcccttctctcagggcccttctagatcttggcgtctgggcctcaaagcacaacacaggtactgacaggtaggtctccaccatgagagagaaaaagatgaggtcaactgcctgggcaaaggttccaggtggaacatcaagagctgctggtgaatgagagcggcagcccaggctcagacctcagaaccagcttctatctttgaaggatgcagcccatttcacctgagagtcggaaaacgttgaactccccagagatgttgaggccttgggaagacagcattcggtccaggataaaccagcaatactctggaccaggtttgcaaagaactcgcccaacaggaacaaggcaaagcgtgaggaggaacgggcagggagaggccagcgtgaactcgctgcggcctgcgtggctctctcctagcacaccacgtgcctgagcaggatatgccttttccttatttcccctctatcatctttctgaggcattatatggaaaactgggtgaataaatccccaagtatgagctgacattcttaagagaaaaaacaaacttgatacttcatggtgtaaaaatctatttatgggccctacagaattacttctcactatagtcctcattaaaattaaatactaaatactctaaggaaacacacaattgcatgttaaaacatgaaaaacattattacagaataaccaaacttttgttccctcagagtgcctttctgtgatcgtttatgcccaactggcaaaggagtgggaaagggacggaggtgaatgaaaagaaggctcatatcccagagcccaaaacaggcatcatttacatgcttcataattccgaatttgggatgcacaaaccaataaagactatgtactcatgtctgtttgcaaatataagcgctttttaaatttttatttgagacgcagtcttgctgttgtcacccaggctggagtgcagtggtgcgatctcggctcactgcagcctcagcctcccgagtagctgggattacaggtgtgtgccaccacgcctggctcatgtttttgtatttttagtggagacggggtttcaccatgttggccaggctggtctcgaactcctgacctcaagagtgatccacccagctcggcctcccgaagtgctgggattacaggtgtgagccaccgcactgggcctgagcgcattttttaaaaagcaatacctgtgttcccaaaaacagaaaaattgacatttagttataagctccaacactttaattgcttaaactgaatttgtggcaaattatttcaaagtaaaaatcagctcagatttgtgtttttatgtgtaatctcttaaaagccagggtacacaggtattcctaacacataatgtatgtgtgagtgagtgagcgagcaaatgagacagagctcgaggtgggctggaggcatgtgagggtgcacgcgaaacacagtgcctcctcttggagttgccagaattcacctcgttcagaacctcaccccagtcagaaaacacaaggcagcaactggccggaacttggtcagtcacatccataaaccaccaattaccttcacagaccacgactaacaggtttattacagatgagtcacagctcatgttttcaaggaagggtctccaactgagcagtcaccagtgcagcctgcgtcagggcgcgcctccctccagcggtccccgcgtcgcccatgtctgacacagtttatgcttcgcaggcggtaaggctccgctcctcactcccatggaccaacagagtagggaaaacgaaggcacgttggaaactacggatcacgggctgttttgggtgtgggaaatccacccacccacactcacggccagctctgaccgactgaacccaggggcacatcacagacataaatatcggtgcaggcggccagccactcctcaagcccggccccgcccctcctgctcccagcggaagcttttggtgcaggacttcccgggcctcaatctcctcatctataggctgggaacaaaccctggagtctgtgctctgggaggagcacacacgggcaaccctggctcaggacagattcccagcccctaagtcatcactagggcttaacgatccatttcaaattacatctgcacggtgctttactttcatacgttattttatttggagcctctaacgagcctcagctaacagatggtattatttccacatggcaaacaaagagacaggagctgcaaccatccaaagacacctccttgctatgaatgcctggccaggcctccaggcaggaccagcaactccagaccccgtcagggccaacacgggccactgctgtccacacactcctagaaaatatccatctgtctgaagcgagtgacacagattttaccctcttgaggataaaataatcccatctgccaaaatgacccacaaataaaggctcctccttgtctgaacgctgcctcagcgtctgagggataagcccacaatgcaagcgtccgggaggacactccaggctgaggggcccaggaagaaagagggccagaaatgagggcaccctcatgcatgctgggagctgccgacaccttcagactgggaagaacaaagagctcccaagcacgagggcacgggagcacagcggagggcacgggagcacagcggagggccagacgtgaggccagaggcggctggagcagcagctcccacccaatagcagacgaggcgtgagactctcaaccaccttccaagttttctcttcatcttcaagagaacctcaaactgtattttccttagtttcattaccaggctccttgtagaaaataccagtgaaaaagaatggttggcagaactgaaaatctcaggaaaaagcacaaacacagcacacagcagaagcaggcgcagatgaggcaggaggaacggcaaggccaagcggtgctccagggaagcccagctcggatggtttctcaaccactccctgcttaaaaactgcttcacggcctgaaagggcactaaaatctgggagcatccaccaggaaatggaaaaggcaaactcccaacataaccacaaaaagacactgtacaatctccaaactgtaaagatggaaaaaaaaaatggagcggcaaaaaaacatattacaagccccccctccccaccccccggcaaaaggagagagagaagacccatcacgacaaacggatggaaagcactcgaccccacagagctcagtgccgacaccccccggcacctggtgccccatctggggaggctctgccctcgtgggtggacgaacgctggctgctattaagggctagcactgggaggcagtcccgtccattcctctgtccctgcagccacggaaggacgaagccccaagcacggaggcagagaccaggccctccagtggccccaggctctccaacttccagcttccagaactgtgagaaataaatttctgttctttataaatgaaccagtctcaggcattttgttacagcggcataaacaggctaagggaaaaaagtaaatggactaagaaatacaagaccaagtttgtcagattggaatggaaaaagtaatccagctggctcagcacgagctgagtgatgtttaatccatgaacaaacatttcagaaaatacacaccaggtgcatgctgtgcacaccaggtacatgctgtgcacaccaggctgggcttcctctatcaatgctaggtacagacttgaggccagaatgcattccaggaggtaaggtgagccactataatatggcaaaaagttcctttcacaagagagctaagacggtccgacatttatgcaaataaaagcctctgagtaaagaacaagaatcaacagaacaggccagacacaggctcatgcctgtaatcccagcactttgggaggccaaagcaggcggatcacttgaggtcaagagtttgagaccaggctggccaacatggaatgaccctgtctccactaacaacacaaaaaaaaaaaattagccgggcgtggtgccgggcgcttgtaatcccagctactcgggaggctgaggcaggagaatcccttgaacccaggaggtgaggttgtaatgagccaagatcacgccacggcactccagcctgggcgacagagggagaccccgtctcaggaaaaaaaaaaaaaaaaaaaagaatcaacacaacagagaaaatgcgcctcagccacggagcagatattaaagtgcctttcagtaaagaacagacaaggagacaaccctaacccagactacaagacagaagatctgaaagcaagaccaagctggagctaaacatataaaatcatccaataatcacatagaaaataacacaataatcacgcaatccatttttcaagctcccagggaacaacagtcatccaaacttgatcacacagacaactacaccacacgcctaaaaactgtgagagtcaccttctgaagtgacagtgcagttcagatgggaggatggtgaccagaaaacacagccttcaatctgggaattaagaaatgcatttctaaggatgagggaggagggaaaccagagtaggaatttcgaatattcaaaattggaaatgacagagatgctatacagcaaggtgggagatccaggtaaagtggttgttagagggaaatgtatttatatttatcgctagaagacatcccaataaagagactctaaaagttagaatacaaccaaaagaatagaagaaaaacatgagaaatgtacaaacataaacgaaacaaaaagcaaacatgtaacagagactaaacaaagtcaaaggtgagttttattttaaatgacctataaaatagagaacaagctacacgacacaataggaaagcaactagacaaaataggaaggcgcgaactgtctgcgaagcaaatggcccaatccccaaggttggtcagtagcaggaagagaaggctctgctgggcgaaaggccagctaaagggggtgactgagcacatgggctgggctcctaggcccgtggaggtgtctctcgttggtccgggcatcagaggaagcagcaagcagcttgctgaaatggaaatgtgaatgaaaacactgccacagcagcacctgggtgagggcttctttcaatctctggcagtgtagccttgacaagctgacacataagcctgactgtcgcacatgtgtgtacctgtatgtgtgtacgtgaacatgtacacataaaaagagttccgttcggccgggcacactggctcatgcctgtaatcccagcactttgagaggccaagataggcggatcacgaggtcaggagatcaagaccatcctggctagcacggtgaaaccccgtctctactaaaaaatacaaaaaaattagccgggcgtggtggcaggcgccggtagtcccagctactagggaggctgaggcaggagaatggcgtgaacctgggagatggaggttgcagcgagccaagatcacgccactgcattccagcctgggcgacagagcgagactccgtaaaaaaaaaaaaaaaaaggttctgttctccaggttgtgaaaatgtgactattttacattctatttctccttatcggtttttcctaattttctaaaatgttgagtattgcttcagtaataaaggttactttttaaaaaagaatacaaagagatgaccacaaacatctccaacattaggcatctccaacattaggaaaaacatattcagtttttcaccagtaagaatggtgtcagtcagtgggtgtttctcagaacgtcctccatcagactgaggaaactcccttctgttcttactttgcagagcactttcctcatgaataggtatgggattttgtctttttttttttgacagcatctcattccatcacccaggctggagtgaaatggcatgatctcggctcactgcagcctctacctcctgggctcaatggatcttcccacctcagcctccagggtaactgggactacaggcgcgccaccctgcccagctcatttttgtattttttgtacagatagggtttcaccatgttgcccaagctgctctgcaactcctggactcaaacagtcctcccatctcagcctcccaaaatgttgggattacaggcatgagccaccatatctggcctcaaataccattttttaaaaaaatcttcttagatgatcttacggcatttcattttccttatgtcaatatggtacactacattgatttttaaatgctaaaccaaatttgaacttctgagataaaccccgcttgctcatgaggtatcgctatcctttctatctcctataacttaaatttacatcagtattaatgtgggtgtttctctaattttggtatcaaggtgtccctgactcatagaaagactggatgtgtaccctcctctgttgtggaagggcttctatataactgactttccttattctttaaatgtatagtacaaatgaccaagtcagtcatccgggactgaaggtttctttgtgggaagggtgttaactaaaatttcaatttctttaatagatacaggactatttaagctatctatttcttcttcagtaagctgaactagtttaagtcttttgaagaatttgtctatttcatctcagctgtctaatttattggcataaagttaacaaattcccttattgtactttgaatggctataagatcacagcaatgtcccttttctcatgtccatactaaaaatttgttgcttctttttctcctgatccatttggctaaggggctaccagttttattgtctttaaaaaaaaaaaaaaaacacccagccgggcatatcacctgaaatcacgagttcaagaccagcctcgtcaacatggtgaagcctcatttctactaaaaatacaaaaactagccaggagtagtagagcgcacttgtaatcccagctactcaggaggctgaggcaggataatcgcttgaacctgggaggcggaggttacagtgagtctagatggcaccactgcactctagcctgggggacagagtaaaacactgtctcaaaaagtaaaaaaaaaaaaaaaaaaaaaaaaaaagaataataattatagtaatcaagacagtgtggtgttagcaaaagaatcgataaatagaatgatggaacagaaaagaccaaaaacaggccaggcgcagtggctcacgcctgtaatcccagcactttgggagaacacggtgaaaccccatctctactcaaaataccaaaaattagccgggcgtggtggcgggcgcctgtagtcccagctacttggaaggctgaggcaggagaatggcgtgaacccgggaggcggagcttacagtgagctgagatcgcgccactgcactccagcctgggcgacagagcgagactcatctcaaaaaagaccaaaaatagacccacataaatatatagtcaactaatttcttaacaaatgtaaagaaattgaatggcaaaataatcttttccacaaatgatgctggaaataattgaatatcctcatgcaaaaaacaaaaacctctaaccttaccttatgccatacacaaaaattatttcataattgaagtaaatatgactgaaaactatgtatcttgtagaagaaaacttgctctacgatgctggcttagagagatttcttaaagacacaaaaagcacaaagtacccaagacaaaactatgaagttggacttcatcaaactaaaaactttagctgctctaaagacactattaagaaataaaaatacaggccaaatacttgttaaaacacacacacacacacacacacacacacacacacacacacacacacacacatattcaaacaacaaatagctggtaaaggacctgtgtctagaatccataaagaactctcaaaaatcagcagacaacccgatttttagaaatgagcaaatggcagatatgaaagtgaagacacatgcttcaccaaagcaaatacatggatagtcccttccccccaccaaaaaagccacatgaaaagacaagcaacatcatttgtcactagggcactggaaattaaaaccgcaattcactagaatggctaaaatggaaaagatggactacaccatgtaacggcaaggacagagcagatggaattcccattcaacgctggtgggaacacaaaactgagtggtcactttggaaaagagtctggcaggttcttaacaagttaaacattcatgtaacatgtgaccgagaaacccagacccagaaaaggtaccacatccagccatctgatgctttgcatgcaactactcatatcagcttgactcccaacagctaaaactaggaaacaacggacatgtctataactgcttattggatgaacatgcgacatatctaccccctaaaaagctactcagtaaactactgacatacaccacagaacccagatcaatctcaaaaggaagatgaaacacaccagacacaagagtccacactcaatgattccattcatattaaattctagtaaagcaaaagctacagtgaccgaaagcacatcagcatcctgggtccaggaaataggatgacatgctgctgcaaagaggaaagggggaactttcttggggtgatggaaatactactctgtatcatgactgtgatggtgggaacaagacagttccaactgattccttaaaactctcacatctgtagtcatgagcaacatgatgctcatgttgagtgtggtcaacaggccacattcatgatggtggtatgtgctaccataagatgctaatggagtggaacgggtcccatggcataaacacctaccactgtgttacgatttctttccacgattcagcagggtgactcagcaacaggctctaccatgtagcttaggtgtgtgggaggctctgccttctggatctgggtacgcacactctgtgatgctcagaggacaagatcacctaacaacgcatttctcaggatgcatcccccgaccgctattaaaattgatgcattccaaagtatttaaactgtacctcaaagaagctctcagagagaatgcacgggagtggacgatggcgggcacaagagctcgtcaagagcactgttgtgaagaaaagcagagaggcggcggcggcagctggtggtgggcatgggcgaggggttccacggcaaagaatgaaattgaatgcccatcaccccacgcccacaggccgccaaacacatctggaaaagcagaatacattcctgaaggggatggcatccatggccctagggaaggaagaccagatcccaacaggagcaggatgaggctgtccttgatactgagcaggtggctgacttcaccacacaccctccactacctccgcaaatcactccaggcattcattacccactacaccaaataactgattctcatttcataaatatacgtattcaaagaggatcctagcgaactttttcaagaaaacactggatacagactctcgggcaggtctgtaagttaaggcatggagacgaagcttctctctgtgtttggcattgaggcaatgctgctgtgggcactgcagacataggccctgtgacctgggcgcaggttcgtgtcatgccacacagcatgcaattccatggacacaaaatgaccagaacagcagactcagagaggacgcagaggctgcagggggaacaaggagtgacgattaaaggtccaagtttctttctgaggtgacagcaatgttctagaactgacagtcctggtggttgaacagacccgtgaatacactaacaacctttgaactgtgcgctttatctgggtaagcctacggtctgtcaatcctctcaatcaagctggtattatctcttttttggagacagtctcactctgtcgcccaggatggagtgcagtggtgcgatcgtggctcactgcaatctctgcctcccaggttcaagcaattctcacgcctccgctgaaatgacaggcacaagccaccaggcccaggtaatttgtgtagaggcgggggtttcaacatgttggtcagattggtctcaaactcctgacctcaagtgatccgcctgcctcagcctcccaaatgctgggatcacaggcgtgagccattgcacctggccgattatcttctttgaaaagcatgagacacgtttccctagggatggaatgctggacacgagacaagacttgtcctaaggactggatctcacagtggccaggtatgcatcacgccacgcggtgcagagccctgggggaaggcaagtcaagaagccaggggtctaggcaccgcaatgtctcaaggcagccccccaagaaaaccaagcagaaggccacagtgacgccctcctgctctcaggtcagtggcaggagggcacttgctgatgctgggcacagaggaatgtcagggcagatcttcaaggctcacacccttcagagcttctggcaagctcaacacagtgagcgagccctgcccccaagagtgaggcccctgtcagggccacttcctctcgccctggcccatccagatctcacacacactgtggtagatctttgaagggtaaaagctctgtccgctccactcatcagcaccaaagtgttctgtgcctggcccttctccacccaattcaccagtttattgaagcctcagctgggtgagtcccgcttgcctctgaaaatgtgtgtgctcagccaggcagattcttgagtgcgtttcctatgtgctgctgccctccttcaagatgaccacatgggcccccaagcagggcccctacctgctttgtcagcatcttgtcctttccctcttttctctcacggcttgttctacttcacggcatgtttaagcaaagggggtcactacaacaaaattattttaaaacaaacatacttcagaaaagtttatggaaaacattaaaccttgaatatattaactttacaggatccatttacttcaccctaacactgagttaaaattataacaagagaaagtagggctgggcgcggtggctcacgcctgtaattaatcccagcactttgggaggccaaggcaggtggatcatgaggtcaggagttcaagaccagcctggccaatatggtgaaaccccgtctctactaaaaatacaaaaattagccgtgcatggtggcagacgcctataatcccagctactcaggaggctgaggcaggagaattgcttcaactcaggaggcggaggttgcagtgagccaagatggcgccactgcactccagcctgggtgacagagtgagactccaactccaaaaaaaaagagagagagagagagagagagaaagtaaacaaagtttctatttatttctccagaggatctcaaaagtagagctggaaataccagcagtaagaggaacaccagtccaaggcaactacaaggaactggtcactttttcatttttttgagacagagtcttactgtgtcacccaggctggagtacagtggtgcaatctcggctcactgcaacctccgccttccgggttcaagcaattctcctgcctcagcctccctagtagctgggattacaggcatgcacaaccacgcttgcctaatttctttgtatttttagtagagacagggtttcatcatgttggccaggctggtttcgaactcctgacctcagctgatccgcctgcctgggcctcccaaagtgctgggattacaggcgtgagccactacgcccgaactggtcacatatcttatggaacataatgtttttcatgatcaacagccactatgggaacacaacacacatcagccctgagacacccgaaacaagacagagcagcctctgcagcctctcatgcagggagcgtggggcatgtctgccacagggtgaggggcggcgggcagagatggagacataaaggcggagctggcttccagccttgtgaaccagcccagctgaatgccccaagtctgtaaataattgatgggagccagagcacccagccctgcagggctctcgggagctgcccgcccaacagtcccatgcctggcactccctcaggtgccgcctgcaaggtcactccactgcttctaaataatgcactgcacagatggaggaaagtatacctttacccattcaaatcttccaaggcacgcattttcacaaattttacatatatataactaaattttgcattcagccaaaaaaaaaaaaaaaaagaaaacttcatgttgaaacactgtatctcaccctagaatttgaaaagcctccttttccttctcactgtcaatcttttttgaagtctcaaaaatgattttactaacattagacaaatacccaaatataaaaagtgcttgacacagtcaacactgcagcagtgaggtccactatgccagcgcagtgcagagccagcccacctccctgcaccagtggaaatgtcacagagggcagagggcagcgtgcccagcacctgctcttgatagggagggcacttctaggctggaatactcaagagatttgattgtgtgtcatcaaagcatgctttaaatacaaaagctggcagggcacggtggctcactcttgtaatcccagcactttgggaggccgaggcaggtgaatcacctgaagtcaggagttcaagaccagcctggctaacacggtgaaaccacgtctctactaaaaatacagaaattagccgggcatggtggcgagcacctgtaatcccagctactcataagggaggctgaggcaggagaaatcgcttgaacccaggaggcggaggttgcagtgagccgagatcacacctctgcactccagcctgggagacagagtgagacactctcaaacaaacaaaggctgtgagtggcctggaagctcgttcttctagctcctttggcaaagaaaatgcccccaaaggagtgagggcaacagactttccaagtcccaggaaatgcacagattcacatgctgaagacccaccagatgcaggaaggaaacgccagaacaacatgtttgctttcatctaaaaacatcagaaaaagtctaaatgttgctgacatttcctgggcagctgccctgtggtctcccgtctggccaaggagcctcaacccagttgctcccaacatactcccatcccaggcgaacctatgctggtgatgctcgggaggcgggcagagggctcacggagggagggcggagggctcacaccctgaggctcggaaggcgggcagagggctcacaccctgaggctcggaaggcgggcggacggctcacacagacccacaaggaccaaagaggaacgtgcaggactccaacacaaacggaggacgatggcagaacagaagagctgattaagtttctgctgcttgtaccataaacttttcatcagccagactgtttgcctgaaagacctaatcaaggctgacaagaattcaaagccatttcaaagtgctcctcaggggtgaacgtggccccatgtccggcacatgctctgctctgaacgctctctcttccagcagggacggccccagacatcgagtatcacaaccaactcaaaaatagactgaaatgtcacagtatcgccaggatcaaaagaaggtctcttaaaaataaagggtttcttccattaataagtaaaacaagaaaaaacccaaagatgctcacttgaacttcatcttgttatgagcatccacccgtcgagggcaggtcttgtgttactgagcgcagcctgacaatcgcatctgcaccgaggccctgccacggcggttcacggcaagggtctgtggctctcctgtgcgcagcccaatggaaaggcagagtgaccgatgagataaacaccacaggaacagggtgctccccccagcacagctcgggagaccagggctcaggaacgctaagtgactcgcccaagaccaccagaaatgagttgggaggctgaggtgggaggatcacatgagccccgccctgggggctgaggcgacagtgagcccagatagcgcccctgcactccagcctgggcactggagtgagacttgtctcaaaacaaatacaagaaagaatctggaaaaccttagttactatgaactagtgcttttcactaacaaaacacaagtattttttaattctcacgtttctgatcatctttgtttataacatttataggttacaaacaatgaactattgtgggtttttaaaaactgattacagactttcaggacgtccaaaggagacatctttgtcaagggagtaaagtggagaattccagagacacgcacagttctcggtggcaagccatccgctgaggtgagaaggatgtgatccatcagccaaccctgcctagatgatgacaccagctccggaagccagatggagcagctggacacattcagaacagtgctttcaagcagacactgcttgttccaatgtcagctctataaagaatgtaacagggccaggcgcggtggctcacgcctataatcccagctctttgggaggccgaggcgggcggatcacgaggtcaggagatcgagaccatcctggctaacacagtaaaaccccatctctactaaaaatacaaaaaaaaaaaaaaaattagccaggcgtggtggtgggtgcctgtagtcccagctacttgggaggctgaggcaggagaatggtatgaacccgggaggccgagcttgcagtgagccaagatcgcaccactgcactctagcctgggcgacacagcaagactccgtctcaaaaaaaaaaaaaaagaaaaaagaaaaaaaaagaacgtaatggtacaattttggggaccccaaaaggataatgcacataataaacaacaaaagcctgaggcttctcccaggccctgtggctgtaatctcccggagtcccaggcatcctgctgctgggaagggccagctcccaagtgacctgtgaccatcttggaggggttggtggctgccttgtcagcagggcatgtcccaatgctaatggttcaacagccaggcttgacatcttttattctaaaaatctaccacagaatagccaaagggcagtggtggggatgaggatgagtctgtaggagggacagtgtaaggaaggtggagccatctaggggcactgctcagaggtaggctcggccagagctacaacacaccttcgaagatgagtggggttgggggcggggtgagtcagcttcaacacacccaggattcacctctcatctgtcaaatctgctgataaaagtcacaccatgaaggaagggcagtcagggactgtgctcaccacgtgtcccggggacaggacacttgctgccagtctccagcacctcacagggaaccagggggcaggtgagcttgtggagaaacaggaatcctcgtgcattgctggtgggaacatataatggtgcaactgccaaaaaaaaacagtgtgacgattcctcaacaaattacaaaaggactaagcatatgatccagcagttccccttctgggtagatatacaaaagaactgaaagcagggcccccaaaagacagttgtacttcgacgttcacagttcacacagcatggttcccaacagcaaacccgagtgtcccctggcggatgacagagaagcagaatgcgtctgcacacagcataacgcgactcagccctaacgaggaatgcctgtcacagccaatgctgcggactccactcacagggtccagggacaaacagcagctgcacaagaggaagggccctgagggaggagtctgggaggaaccactgctcatcggcaagccaatccatggccacaggacaacgctgctgaaggtactggaagccagggtgctggctgcccctttctggggacacctttcctttcttttcctatttttattgaacactgggatgaaagtaatgaaaagtagtaaatcctttcaaaacaatcagatttagttatgatgctcaatttctgaaatcaatctcttcaaatagccagtaaatgcttcctttccaaagactgaaccctcttactgctttgaacaatggaggaagtgagtgaggcaccagatgcaacttttgacccaaggacacaggtcaagctgtgacagttaacaaccagggtggctggagatgctgcacccacccacgtggctttgctagaatgccaccacgtgcgggcagacacaggccacagcccccacacctcactctggcatcagcactggtcccgcatggagctgtgccggcttgcagaagacgtagagcacacaggcgtgttccttcccttctgttggccacatcacagctgcatattcacgggagtgaacatcatctacacaacagcttccacgtttgcaaacatgcacagcttagcgaccacgtttcaaagagccacgtggataactgcctatattactggtactcaatttccaggttgggttggtaactggattgtttacaacacaaaggataactagttgagaagatggataccccgttttccatgatatcatcactacgcattgcatgcctatatcaaaacatctcatggaccccataaatacattcatctatgtactcacaaaaactttaaaaataataattaataaataaacagaatgactaagatttcaactgtttacccaggatgctgcctgcagctcatttcagtgacaacccacaagctgccctcgctggccctgtgtgctgaggacgggacatctgcacccagccctagataaccccacgtgcaaaccacttcccctgtgccgctaaaacccacatctcacatttcagttatagtttgttttttgcctgtaggttttttttttgagaatagggtctccctctgctgcccaggctggagcgcagtggtgcgatcatggctcaccacagcctcgacctcctgggctcaagtgatcctcccacttcagcctccagagcagctgggaccacaggcatgcaccaccacacctggctaattttctattttttgtaaagacaaggctatacatttcttatatatgtctaaatcgtcagtattaaacactgacagagcaaagcctttctctgcttcaaattttaatattccaaaatatataaaacatcattgtcactgtcctcatctaaaagactgattctggaagaaaaaaaaaatcaatctgaaacaagatcacggaaatgcgatctgtcccacacacaccatctttaacatgaatggtgcctccaaagaacaaatgctagatgcaaactgcttgagtatgcttctttatttttagtaaagactccagaaaatcccagagcagccatttcccatacaactcaatcgcacgtacagccctttaaaaagcagactcccagggaactgcagccagctcctggagccagccccagcagaggagcaggaagaccttccagcctgcgccaaggagcagcgcacacgtctgctgcagcccctcggcccccactgcttcgggatgcagatggcagcactgtgacctcactgtgcctacctccttgttccggccctgcagtcttgattcttcaggctaatcccacactctgagccttggctgctggccgaaactgttattaatggcacagagctgctcatttcagcttcttttaccacgaaggtagccggctgttcacctctctgcctctccacactgaagcaggaactgggtaactgtacaagaggcattttcaacggtcttcatatctgagtctcaacagccagcagaagatgtttgcattttagtctacactacattctatgtgatgcagaaagataagatagtttttattcaattcttgtgtaaaagctacaaaaccctaagaacagagagtgccatggatgccaaaatcagcatcacatagtttatatgttttttaacttttaggttcgggggcacatgtgagggtgtactacataagtaaacacatgtcggcagtgggcggggggggaggttgtacgtgttattctatcacccagtactaagcccagtacccaacagttatcttttctgctcctctccctcctcccgccctctcccctcaagtagacccccgtgtctggtgtttccttccctgtgtttttaagttcttatcatttagatcccacttgtaaagtcagaacatgtagtatttggttttctgttcctgagttagtttgctgaggctaatagcctccagctccatccatgttcccataaaagacatgatctcgttcatttttatggctatgttatcttatcttattttgtattagggatggggcttcactatgttgcccaagctggcctgaaactcctgggttcaggcaatcctctcgaattggtctcccaagtagctgggactacaggtgaacatcaccatgcccacttttccatcttcatcacttgataaacatttataatgaatgacattaaattacacatagcaaaattctgagaaactatataccacaaatcctacaaaatttaaaagattaaaaaaccatggattattgttatgtgcattagccaatgtcagtggttccaatatttactttcaccactaaaatggcacgaaagcatgaagtcgggaatgacagcattctagaagccagtgcacctgagatgaaattcatggtatgttcggaacctagaacgtcgatggtcaacactaggcagcttcatctgtcatacgtggactccctttcaaaactccaggtgtgtgtgtctgtcatgtggctatggagaggaagaggagaagaaaagatttcgattcactaaaaactcctgttaagcctccaagaaagatccaagtaatcagatacctggtcagtcacagcctctctgcatgaagcctctctgcatgtggttaagacctgcaaacctcaacagaatccacggtctcttgcccctgcactgagcctgtgtcgggacttggccactgctctgcatcaggtgagaggctccttgtctctcacatccagatggatccgatccaactcacacagtgaacgactccaaacctgggcagccctgggctccaggatcagcccaccccagcccctgctgcaatggcacctcctactctcattgtggaaacctgtcaacccaattacagacaccctggctaggcccgtacttcttcctgtaagcctgaaaccctgctcagctaccctaaaccaccacctctgcgcaccccttaggaaaccccagcagcacatcccccttcttcctcccgcagagggcctgccccaagcagcaggaaacggggtgacacaggccttccttggcctcagcacacacagaaccatcacagcgccgggggcggggggtgctgcagggacacattccagctgtgcacttctctgggggccagcacagaccactgagcatgagctgcctcattcaggccaggtgactgtcttcatcatcattcaactttgaaacttagggtttgtgccagtccacctgtttatgttccatacttacatatcccaagccattaacaagtgttttcttctttggttatgatgctacagaatcagcagaggaacatccgcatcaccagaaggctctgcaggcagcactgaggcccatcctgctgggagaatgccgctctgagggcagtgggactgccagcaaaggacacaggctcagggagaccttccactcctgctgaaacaccaatcagtagaagatcaccacccagaaatatcactttcaagcttaaggatcacaagttacaaagataaatgtctctaaggactaagggagaagtacaaagtaaaaagatttaagcttgggaaaattaaccctaaacatttaaaaacaaaacaaacaaaaaaaatccgcactctagataagaccttcaaaacagcatgcctgtcagagggacagtaaaggtcagacggggcagcaatggggtatgagctggcacagccttgcaacaccctggatgggcggccaggggcttgtgagagtggctccaggcaggaggaccctgaatttatgggagggggcaagactaaccctcaagtgctcctcagatacgtttcattaaatgcactgaaagttttgtaaaagatgcaagtttcaacatgagatacaattatttacccaatctgacatgtggcttaacaaatgtgagtggattaggggatttttgttttattcttctgaaataccaactgccttcttcttccccttctgaaacaaccactggacaaactgaacggcacatatgcttttcgggatctcagcgtaagcagctcccactgctagggatgaagagtgctcctctgtctgcctgagtgaaacctcacgacaccttgcacagcccgcagtccttgctgactggaagcagaaccaaaacctgagctggagagagtgcacgaaagttccatctagacccaaacctaaattgcacagctacagaatgaagtgaacagcactgaagccggaagggacaagactcaatcccacgtgactgaacccatgtgtccagcaccagagatactgggcggagcacacatctcagctgtgtaaaaagtagaagttcctcttcaaagactttcctccccatctaattaaaaataaatagtaacttctcttaaaagcaacatttattcaaagacctgtgctgacattcctaaatatctgctagccttaataaagaaatcaatgtactttatgttcttagctcccacaatttagcctaagtatctgccctggcatgcttatactggtcgaagcaagcattaggtcacggcctgttcctcttccttagttgaaggtgtttttacctttctcagcattccacaaattacttcctccttcctttgttctcctctgcctttgcctcttttaaaaagttctaagttgctagccaatcgggacaaatacagaatgtgaggtcccgttccagccaatggaaaccggacacagcagttggtataaaaaaaccggacacagcgtcaggttataaatgaccctggtctcctttatccggtgtactctcgtggcaaaactgctggcgagtgtaccctttctgcagaaggtataaaaaatggccttgctgaggaaattaaatttacgttcaagtgctatttctttacggcaccagggcacaagcatttcaaacagctgggaacacgcctatccctgttaaaaaaaatatacgatgtttccagataaaagaattctgatcagaaataggtaagttttcatttaaaattttttcctatactctgccttctgaagcagtctctaaattcaccctgtatttgacggtgcatgcgaatttgttatttatgcttaaatgccagccaaggagtaagattcagtctgcattaggagatatacctaatgctaaatgacgagttaatgggtgcagcacaccaacatggcacatgtatacatatgtaacaaacctgcacgttgtgcacatgtaccctaaaagtataataataataaaattaaaaaaaaaaaagattcagtcttgcaaagttttgaaatctctcaagggggaaaaaaaaccttacatagttcacaattctgagtccagaatctaggagaaaccaccaaaactttctttgcattctgtcaaattcaaacgcactctgtgtgccaagcctcactcactttatgtccaccaagcaccacacgctgcttcccgtgtatgtggcccaggcccctgtgaaacaaacacactctctgtggtagactggaagaacacgggcctgcaggttccagtcaggaagtggagtgctagccctatgcggtgactcatgcctggagcacagcacttcaggaggctgcggcaaggaggactgactgaggcaaaaagttcgagaccagcctggccatcgtggcaaaaccctgtctctacaaaaaagaaaaaaaaaattacccaggtatgatggcatacatgcctgcagtcccagcaactcaggagcctgagcaggaggacagcttgagcccgggagttggagggtgtggtgagctatcattgtgccatgccactgcattcctgcccagccgaccaagtgacacgctgatttaaaacacacacacacacacactcaatggaaggcaaaagaaaaggaagaaaaaaaagacatggagcctttctttccagccctggagcctgggtgtaccccagacttgctgggcccacgaggaccctgccacttccacctgtgccctcaggcaacatgtgggggcccacacagactgaagtatgaaatggattcagcccccatcagcctaatgcagcttcatgagtgatcccaggtatgaccagcagaaaaccaccaggcaacacaagaattaagagaactcataaatcattattttcttaagacaccatgtattgtcttacaccgcaataggtaactgaaacacatcctactcacggtaagaacaagctgaaatatggaaagttgtttgagatgctacttaaacacagatttaactccagagcagagcctttccatgtatttttcttaacctattcgccctcaaaacagcgctgagcacagcagtcagaccctaaagcagaggtgtccaatcttttgacctccctgggccacactggaagaagaactggcttgggccacacataaaatacaccaatgctaacaacagctgataagcttagaaaaaaatctcataacgtttacaaatttgtgttgggccacattcaaagctgccatgggccgcgggctggacaagcttgccctatctcacactgttccctgtcagactgtaaacactactcagaatcacacaatctcatctcggctccaagtggaagcttgctcagcaccacggccaacctgatcccactgcagatgttccaacagcctggcacgcagatggcccagggaaaagcctcatcgaatgctgaatacctgtgagatcatttcttacaaagccaaatgaacaacactatgttaattttcaaattttggcatggaaatcacattctaagacgcttcccaagctttctggaggatgctatgaattctgttttataggtaacaagtctggaagccaaaataatcaagatttaataaaatggcctcaaaagtgacaagactctccttcccttatgacagaccatgtttgctttcctttttactagatgattaactcaattctttcaacaatcctgtccagtgatgactatcttgttggctggtcagaaggggaagttccagagctggtttttgtagaaaacctcagattctttcaatcccaggccatcttatcacgtagtctaaacccttgtgtcatcacctcctgacgtttccatcagcagaggcagagctctcaccttaaagagcatgaggccaaatcactggctgcaaagcacagaacacagacatccttggccacacaagagtgagagccactgagcccaaccagggtgcaggggagcctcccagatgagaggcctgtgcttggtcccacagggtgcagccttaccgtgctgctgagacactctgcccaagaaatggctccaggattttctgaaactcgctttcaaaatatttccaagctcttatgtcttgtgtatgccttaataattgaaaaagaggtatgttcactcaagaaagggaagagcagtaagccaagtagggggccttttaccgcaattcttcctgggcagtgtctgtggaaggtggtctctccgcagaaacccaacgttttttttaactttgttttaggttcgggttgcaggtttgttacgtaggtaaacttgtgtcatcagggtttgttgaacagactatttcatcacccaggtgttaagcccagtacccaacagttattttttctgttcctctccctcctccacccccaaccctcaagcagaccccagtgtctgctggtccctctctgtgtccacgtgttctcatcatttcgttcccattcataagtgacaacacgcagtatttggttttctgtccctgcattggtttgttaaggataagggcctccaggctctatccatgttccacaaaagacatgatctgatcacttgaacctggaaggtggaggttgcagtgagctaaaatggcgccactgcactctagcctgggtgacaaagtgagactccatctcaaaaaaaaaaaaaaaaaaaaaagacatgatctcattctttttcatggctgcacagtattccacggtgtatatgcaccacattttctttatccaatccgtcactgatagatgctcatgtggattccatgtcttcttctgtgaatggtgctgcaatggacattcgcccgcatgtgtctttatggtagaatggtttctattcctctgggtatatacccagtaatgagactgctgggtcaaatggtagttctggttttagctcttagaggaatcgccatactgctttccacagggttgaactaatttacactcctgccaacagtgtataagtgctccctttaatccacagactcgccagcatctgttattttttaaccttttcgtaacagccatgctgactggtgtgagatggtgtctcgctgtgagaaacccagttttcacgatcagctggtttccactcgctgaaatcagcagactcttgttgaaaaggctgccatcttgccttggctaacccgagctgtttcctgtatctgtcatgagggtgctgagacatgtctagacagaggtgcggcacagtcaactggacaccatccatgacttggccctaacaaagcagctctcttgaatgtgtgctatgggtacaccaagtcccacttccgggggcacccagggcaggggtcagcaaaggctttctggaagggtccagatgacacacactttgggctttgcaagccactcacggcctctgtcacatcatcctgttgctgctgtgaacgaccctttaagaatgtgaagaccatccttcgcaatctggttgtacaaagacagacccacaggctggattaggtccgctgattgtggtttgccagcccctggcctggagctttgccagtgtgcaggctggatgcccagccacggctccttctgctaggacgacctctcctctatgacagactccaagatgccaccccgagactcaccggatactcactacctcaactctccaccccgcacccatcggtgaggaagagcaggcacctcagggggacagtccatacatcccccttcgtgtttcccatcgaaacacaacagtccactccacgtgggagttcagcgttctctcaggggtgggtagagcgccgctccagactcctgccgcaggggccagtgctggcccagcagtaccgggagcccctcctcctgagcacagtggcggcgcccagagcggcagacctcccaccactgcttccactggggaaaggccggggatgctcaacgcaaccttagccggcaactcaggggagagacgctctcaaacgaccgggagtctcaggggagcgacgctctcaaacaacccggagtgtacagctgccatggtcacccacgctccctcttaggccacggcacacaccagtccctgccgcctgctcccctctaccctgttcctgacccgtccctcctcagcctgacaagtccacattgcttgggggcctctataaatcctccatggcacaaaacctcccttgaccaggaaagctcccaaaggctccaagcagcaacagctgcaggttttttgcagattggtgagtacagctccacgcatcccatcctgactacccccagcggctgcatgtccacctgctgctgcctcttgcaaactatgacttgttcaaaagcaggtggggagcctgggcaacatggcgaaaccctgtctctacaaaaaacaaaaatcagtcaggcacggtggtgtgcttgtggtaccggctactccagaggctgaggtgggaggatcacttgagcccaggaggtcaagtctgcagtgagccatgactgcaccactgcactccagtgtgggtgacagaacaagactcactctctcaaaacaaaaaacaaaaaaagaaattgtccttgcaaccaactgctgtgctccgtttatctgaaaaccctgtttatctgatttctagtcctgttcacagtgctcactacgctactcattggtttaaaaaataagtcctacatcaaaccagattccaacaattccaacatactctgtccactcttaacatgttttcgagctttttttttttgatacagattcttgctctgttgcccaggccagactgcagtggcacaatctcggctcactgcaacctccgcctcccaggttacaagcgattctcctgccatagcctcctgaatagctgggattacaggtgcctgctgccgtgcctggctaatttttgtgtttttttttttttttttttttttttttttttagtagagatggggtttcaccatcttggccaggctggtctcgaactcctgacctcgtgatccacctgcctcggcctccgaagtgctgggattacaggcatgagccaccgcgcccagcccagagcttcttttgtgcagcattttctcttgctctcaatttaatttcttgctctaagggaaaagacagcaataaaaacacgcagctcttaaaaaaaaaaaaaaaagggctgggtgccatggctcacatctgtaatcccaacattttgggaggctgaagtgctataattgcttcagcccaggagctcaagaccagcctaggcaacacagtgagaccagtttctaaaaaaatacaaaaattagtcaggtgtggtggtgcacgcctgtggtttcagctactccagaggcaggcgggatcgcttgagccaggaggttgacgccacagtgagtcctgaccaagccactgcactcaaatctaggggaggagaaagactctgtttccaaaaatttaaaaaatgggcacacagaacaaagaggcagtgggactctaagagaaggtcttcgtgctcgcctggagggaacaagggttgcatagagacttgggagtcaaccaagatgtaagcagcagactgagagaccccccactggcacccattcctccacagcaagcccacagctgccctacaatgatcacatcactaccaagctctggcctgacaatctaccctagaaaggaccaaccacaccagatcacagcataagcaccccaaacccaagaagttttcccaagagagaatatgaaacaataatcttcaaagggctggtctccaaacaaaaggcagtgcagcgacctacacctaggtacgcccgagaaatgcccacacgtctccacgacactcgcaggtctgtgttcacagcagcgctgcaaagggccaaacagagaccattcaggtgtccatcagctgatgggtgcatgacccgcatgaccctgccacagggagggctgtgctctgatgcctgctgcagcaagggtgcgcctccacggcaccaagctctgccgcagcatgggtgcgccgcaacagcacaaagctctgccgtatcagacacaaaggcccacagattgtccttcacatgaacgtctggaataggcagataaatccacagacagaaaacaagactagtggttgccagggtggaaagaggatcctggaaagggagggggtgcggtcacagaaggacaaccaggggggtccttgtggtgacgcaagggttttaaggtcccgactgtgggacacaggcatctgcatctgtgatcaactgtacagaactcaataccctttccaagtaagggtgaaacagctgtctaagaccagagggtttcatcaatgccgatatacaccctaggggtgatactgttcagtgtgcaaaatgccaccactggggaagcttggcaatgtgtacaagggactgctccctgttctttcttacatctcatgtcatctatggttatctcagaagaaaacaaacaaaaaccaaacacggggggcccagcccacctcaaaccccagctgcaggatggaagctcagagaggctgggggcctggccccttcaggaagagccaggccaagaccatccagtaacgagaacgcaaaccttctggcttcagagctctcactgaggaagaatctcaggcatggcaggaagaagacacactgctgttcaactggaaaaggatcagactcagtaaaatgctctttgcattcttccccacgcccctccctgccctggagctggggtggagctgcttcttctcaggactcaggcgaggggagcccatgtccaggggtggccagcctgcactttagtgtgggcctgtgcccaactatgtggcagctctgaggatgagaagatgtttctggaaggagctgtgagccacagtgcagtccagaaggggagacaggcgtgcccggtacctgccccagccacaccctgggcccagttaggatcctacaggatcctgagccctcctgccgttatccagggcaaagatggcaaatggctcctgcaagatgacacccagggccttgaggcaaattcccccaaccaagcaaagagaagaccagaggctggagcacacctcctgctgatggaaacagcccagcagcgaccacagggccttccaggcagctcagcgtcaccgcacacatttgacaaatgaccgactgaagcctaggacgcccaggtgagctcagcatcctcccctgacctgcacccacctggccttgttcctccacggcaggacccgagagcagaagggagctttcatcacggtgactgctgtgctgggaaaggtttccatgatgctggtcagaggcagccgaagatggcagcaacctccctgctgatgtcagccccagacgacccccaggccggctcctgagtgctcagtacagcagcctctcaaaaggccaagcctccattcaccccacggcactcaacacacccaagaacagaaccctgcaggcgccacgagacgcccaagaaccaagccctgcggacaccacgagacaaccctagggctccgtcccttgcttgagctctcctagttgagaaaaatgtgtttggcaatgttatagctgccccgtctcatgacgaaggggacttgttcaggtgagaaacgttcaactgcgcgctcgcttactgaaaaccgccgagggggaagacgggacgagcgtcttgactttcagggtgcacgtaagtggctggtcccaccaaggaagtgccagaaaaagatgcaacgactctcactacctcccaacactttcgcaaatactcactgaagaaaggccacctacacagagaggcaggttcagcatgacaccactaggcaattctcacagaacagaaacaaataaagaataagaaagagatgacagacaagcaccgccagtgtccattctaccatttggtgtcgttttatgtcatttaaatcaagtcattccctgcacagacaggtgtccagctgctcggtgcatggaggccagagccacagaaggggccgctgacgccagcagcttctctctggtgcccaggctatgtggtctgtagtctgtgcaccacccacagatgagttctctcaaggaccagctcagattccgccatgctgcaggaaggtccaggcaggcgccgctccccacattcaagggtgctgtgcactccctgcccacatgacgacacccaaggaggggtgtggagggcgatgcagactcccccctgcaccccctcaggatgactagatggatatgagaggtggtctcgggtgtggagggcgatgcggactccctcctgcaccccctcaggatgacggagaggagaggtggtctccatcaaggccacgccctctgcccaggccagcaatgtccatcatgttcctgagcaaaccgagctcttccacaggaggaaagggaggtagacctggtgaccgtgtgactccactggcatcaagaggaactctactgactggcctgttacagaacaggaggctgctccatagaaatcagctggaagaaagaacccacagaggctctaaagatgggaccggtttgtcacgggccaagaacatggtgaagccaggactgagcactcacactgaaaccagtgggtccccaggtggactgaggaaccacaaggaccaccacggcgggcacccggccctcgcatgcacacacgggcaactttacaacctggcctgggaagaaggaccggcgcccactcccaggaggaaaagcagcggcagcgcacggcaagatggatcctgacactcagagctggggaaagagccacacgtcctcctgcagcccgagcctctcactgagattaagaggggctctggggcaggcggaggcggcggcagcgcccagcgacggatgcggccaccactgcagggcctgccgccggtgtggagagcccgagtcacggagccccatgctgcccctcacagcacggacggggtcgacaaggcagtggcaggcggagtgagaggcggctcagggcaccagctgcccactgagtcactgtgagaagagcgaaggccaaggcttgggaaggtttccagctgacagagacgccactgaaacatgagctgataaaacaagatgatgttggagatttactaaaatactaacattaagatattaatactaaaaattaaaatactgaaattaaaaaatgtttaaagaaagaaaaaaatttttttgaaaacatgaacaagtgcaaggaggagatggatcaacccgagctggtcaaatgctagtaaacgctgagcccggggacccaggacactgttctctcagattttgtgactgaagatattccccacgcaaagttaaacaaatgttgagagtcagaaagccaccctgtggcagggactcactgaaagttacttcctacagctcctgcaccacccgttcatcagtggtccccgtttacggaccccggaagctcccgggtgacccagtccacctcagagagtatcacccacagaatgcaagctgactggtgtgtgcctgcctacctacatacaccccgaggaaggcacagcacccacagtacgtgcgttcactgcaaggaaagaatcttccagtcaccgttcctctgtccccattgtcgctgtcataaagaactcttctcccgctgcatatcaccggggttcaaataaagcccttctgagggatgccctgtgggaatgacagaagcaatggaaaaggccttcacagatcatccaatgcaactggaaaactaagacgtttacccaagattgtgaagcaatttaatagctgaacttgaacaaaaacacctatttccaaaattatccccagataagtggtaaggctgtggtaagcggcagcatccaacacagcaacaccggacccctggctagaataacccacacagtgatacagatgcgcaggaagctcaattccaaaacacacgccttccaccgggggcaaccccaacagggagccaggccaccctctccagccacgccagcaccgccgtccacccagctgctccttcgagccgtgcacggcctgagtcacaggaaaagcccagttctgctgagtggacggctgcaaggggaggctaaatatggctcatagcagtaccagacaccagcgattcgagagaaaacatcggcatgtgactgaggctgacgtcggaagttcacattcccacgagctgctttacttcacgaaatgaaaacatcatgtaactctcgctgatgcataaggaagacctgcagaaacgctgcagacacaaccccacgcgggaggcatgcacacgacacccctcccacacctacctgggatcccccaagaacccagcacccagggacacctgacagacgcctgtgtagggttacaagattggtagaaccttattcttacttttagttagagctgctattaattgcacttgacacagaggtggggcctgagtcttggcaggcggtccacacgggacagggtcatcaggagtgaccaccaagcgggctggggccctggcccactcgacatctccagaagggtctgacgaccacaatacctgcaggacaggagctccgcacttctgcaaagccagagtggagacaacacgcaagtgtgaggcccgcagagaggggtgttaacccgagacaaaaatgatcaatagttttactggtgattttcttcaccctcccctctccccatgacatcccttaaagagatcctttattcacggcaattctttttaaaaacattaatatcagacttcaaagatttacagtattttcatagaaatcaatgagattttatgcttattgaacctagtaattctcttcacttaaaaaatattactagagagccgaggtcagcgagttatggctcaccatgtgtttttgtaaaaaaaataataataataataatcacactcacctgtttacataaaatctatgactacttctgttctacatgggcagagctgaacgatacaacaggaactgtacatccagaaaagcctaaaataccactaatcggcccagtacagaaaaagcctgtcaagccctgctctgtgagagaattcagagccgatggcctctgccggccgctgtgtgtgtgagctacactctgtcctatgcttccaggatgcgccatctacagagcaacctcaggagagctgtgggaacagctgctcgggccatctcccgcgtgctacgatcagaggagaaaagctcctccagagagcatcgggaaaagcacttcaactctgctcaggtaaggaccagaaaaaaacaggaactaaaacatgccagctgaagaactccatgatgaacgtggacacacacgtgtgcacagagctgaccccgaacaccacggcttggctgcacacggcaagtcacccatcgatttgttttcaacaaatacactgaaaaacttattagagatttgtgaccatttggaaagaattacaaaccatacagcccaggaataccgaaaaaagtcagaaaaagtatgtcatgaatgtacaaaatatatgtagatattagtctatcatttcctaccataaactatacacagattataaaaaattaaacgcttataaatacttacagactgtacatggcatcgttcagcagagggaaacgtaaacaaacgtaacgtcgcaggctcaagcagaagtgtatacaactcagtgcgggacataccacactgcacgctgtaatgatctcacagccacagcctgtgctaccgcggtgagctcaagtgtgtcggtatccgcttaaaacaccgtgtgacactaatcgtctccgcgtgagcagctggtctctccagaaattgtgtatcacagtaaacaaattatctcaagccttaagctagttgcggtagcatgggcctggagtcccagctactcagaaggctgagataaatggatcgtttgagcccgggagtccaagactgcagggcactatggtcatgcctgtgacaagccgctgcgctcccgcccaggcaacacagcaagactctatctctttttttttttggagatggagtttcactcttgtcgcccgggctggagtgcagtggcacgatcttggctcgctgcaacctctgcctcccaggcccaagcgattctcctgtctcagcctcccgagtgattacaggcgcccgccaccacgcccagttaatttttaaatttttagtagagacaggggtttcaccatgttggccaggctggtctcaagctcctgacctcaagtgatccgcccagcctcagcctcccaaagtgctgagattacaagcatgagccactgcacccagccgactccgtctcttaaaaaaaaaaaaaaaaaaaaagcctcttgcagttctcaagtctttttcattgtgtttactcaataccataaaccctaaatgacaccacagacccacacaaagtgccactagcgatgctggcagtgctcccaagaagcagagctcccaggagttgtgactttaggaaaagctaaacttgcgtgacacgccgcagcctgtgctctgctgtggatgcttttcaaaatcgataaatccagcagaagggccatcacaaaaaaagaacaggacatccgtgaagccatcaccgcagctacagcaacaggcttgaaaatttttttgtgaaatacctttttatctcactgaaaacgcagctttaaaattaattcccaaacagcacggatatatgaaaatgtgtgggtgcaggattgctataagaaaggcaaataccaatagactctagtctgattccagaaaagtgaagccattatacaacaactgaaagtaaaaggaaggggaagcagctggagaagtggatgccagcaaaggatggtttgacagttttagaacgtttggctttaacaatgtcaagataacaggagaagcagcttctgccaaccaagaggtagcagatgaggtcccagacaccatgaggaatatcatcgaggaaaaaggacatgtgcctgaacagggttttgtttttgtttttttgagtcagactcttgttccgtcacccaggctggagtgcagtggcatgatctcagctcactgcaacttccacctgctgggttcaagctattctcctgcctcagcctcccaagtagctgggaccacaggcgcccaccaccatgcccggctaatttttgtatttttagcagagacgagggtttcaccatgttggccaggctggtctcaaacttctgacctcaagcgatccacccaccttggcctccctaagtgctgggattacaggcgtgcgccaccacgcctggccctgcctgaacaggttttgaatgcaggtgaaactcccctattctggcgaaaaaaatcctgtaagaacatttgttagtaagaaagagaagcgagcactgggatagaaggcaagaagggataagctaatgctactgttttgtgcaaatgcagtagggtttatgataaggactgcctttatctataaagctgcctacctcagaaccttgaagggaaaagataaacaccagctgccaggtatttggttttgcaacaaggctggaaagaacccctttttccggactgcttccattgatgctttgtccgtgaagtcaggaagtaccttgccttgccagtaaggaactgccttaaatgttcttttgacaatgaacaatgcccttggtcccccagaaccccgtgagttcaacagcagaggcgtcaacgtggtcttcctgtccccaaacacagcgtatctaattcagcctctagatcggggtcataggacctgtaaggctcattacacacagcatgctatggaaaggactgtcaacatgggagagagagagagagagcatcatgagtgtctggaagatgacaccatgaaagatgccatcattgttatagagaaagccatgaaagctgtcaaacccaaaacaatgaactcctgctggagaaaactatgtctggaggttgtgtgtgattccacagggtttacaacagccaatcaaggagatcatgaagagactgcggacatgtgggccggggcaggagggctggggggcggggagggatgaagggtttcatttcaaaactcaagagctaagagataccacaccagagaaattagaagacaacctggtggtgatgagtgcttctgacccacaccaggtgacgaggaggaggtagcagcagtgacagaaaacaaagtgacatcagacactcctgcagaggggaggggttcccacgactcccacccgcttttaacttcttgtacaacacacacctgtctgtgacatgggcactgaaactaaagccaacagtgagggaggactgtgaccatacaggaacatttctagagaaatgacaaagcacttcgtaagttacaccaaatgcgcctgcctctcctgcctccccttctacctcttccacccccgccccatgagaacagcatgaccacccctcctccttctactcaatgaaatgatgaggatgaagaccttcatgatgacccacttccacttaatgagaagtaaacatattttctcttccttatgattttcttaacaacaccttcttttctctagcttactttactgtaagaatacagtatacaatacatacgacatataaaatatgaggggcatggtggctcacacttataatcccagtgcactgggaggccgaggcggaaggatcacttgagcccagcagtttgagaccagcctgggcaacatggcaagcgagactctgtctctttaagaagcgggaaaaaaagtgctttgtatatgtcagtgttggattaaaatgtgttgactgtttatgtgatcaggaaggcactggtcaacaaaattaaatactcggggtataaaaggttatatgtggacttgactgtaccaggggtcagtgccactaatccccaagttgttcaaggaccaaacatatataatgatttcatcaacgtgtatgtcaaccatattgattaggtcaatattgatttgtaattcttgataataatttcaaatcatggcattgaagcctaaccacaaaaacctcctcagaaaatagcaaaaacgtagagctttaaagatattaagctaaatgtacgtgctataaggctacagatacagcaggctggaaatagtctggctgagaacacacaactggccagcatgactagcaagtgctcaagtagcttctcttgtttgaagacactggtgtacacaaagatttctgcctcctgggttcaagcaattctcctgtctcagcctcccgagtagctgggattacaggtgtgtgccaccatgcctggctaattttttgtctgtgtattttagtagagacggggtttcatcatgttggccaggctggtctcaaacttcaggcgctgtggtttaaaactcttttatccatgttttaaggggttgatgggtggggcgaggtggggaagggctttccaaggctgaaaacctcttcaggggttggtgggtggggcgaggtgggaagggctttccaaggctgaagacctttttgggtcaaggttctgacggcacactggggagcgtcaagacgcctcctgcagtcgtagacaagccgggctgaggcattcactgtcgcttagaactgaaaacttagggtcgtccatgcccagaacgtcggcagtgcggaccagccccaggaaggcctttctcactggcttctagaaggtggggccggcccccatgcctgccccggcacacggccattctgggagctgctggcagccggcgggctagaaggggtgcacaccgtctgtatgtgcgtcacaggctcatgcttttttaatcctatcttgaaaacttagggctttctcacaaagaccttgtgccagttcctaagtggaacaacaattttataaaataattttaaatggctcaaatcaagtgttaccagtgaacggggctttcattatatgtcgaaagctgaccatggggaacaggcccacaggggcctcctgctccacaccctgtcagggcatccaaaaccagctcatgtaactctgctttccaggagtccaacttgaacatttttttaaagagacaaagtcttgctctgtcgcccagacagagctcagtcacggctcactgcagcctcaacctcctgggctcaagtgacacttctgcctcagcctcctggctccaacttgagcttacagttttctgctccaccactgctctctgcctcccacctccaggtgactgggacgcgagcgccccaagcagcacggaagagctccgtgcagtgcacggatttgcgaagaacgtgttggttcttgtgattcacaaagaacttggactgagtacaacgggcaaagaagatgtcagctgtatttttaacattctgttcagcaagaagagtatacataataatttcccaaaaaatataatttttgaaaatgcagaaaaataaaaaatttagaaagaaatacatggctgcagacactgaccttttcagttttccaatcatcatttctcaaaacacacactttcatctctatttaccaaacactattttctgcatctccaaacccctcaagcttcagtccaggtccaagtatcaatgggtatatatgaagctcctctgccaccagaaattcactatggaaagatgttatttctggtaccccagttgcaaaacaatgatgcctgtttttttctttttgagacagagtctcattctgtcacccaggctggagagcgatggcgtgatctcggctcacttcaacacccacttcacaggttcaagcaattctcctgtctctgccccccgagtagttggtattacaggcatgtgccacgacgcctggctaattctgtatttttagtagagatggggtttctccatgttggccaagctggtctcaaactcctgacctcaggtgatccacccacctcggcctcccaaagtgctgggattacaggtgtgagccactgtgcccagcccaatgatgccattttaactccttttctcctaagtggattagagctccctgagccttcagatagcttccttggggctactccagagaacgaccagcagtctccacctgcataagaaacgggacacagggcacgaagagcagccccaggacctgcccgctgccttgggacttgtgaaagcattttttgtgtaatgccaaacaggtctttgttaaaagacaataaccaataggagacaggcttctagatctgcagaaactctagaaataaatgaaggaaagcctgacgagtacctgcctgctttccagggaagagaagtgagcaaaggcagagaagaagctggaggcctcgtggggcatctcctgcacgggcagcagggctgcgtaaccaccacgagcactggggcttatgggaggaaggagtgtgtgcagttccggccccaaaggtgaccaggcctacacggggcaatgcagctcagaggtcgtgggcagaggacagctgaggcaggcagacggagcacgcatccctgcttcccagtgtgggcccactctgctgggcaaggttctaaggggctccgagtgaagcccctgagcacacggtaaacaatcgatccaaaaagggatgagaagggcggctgggcgaggtggctcaggcctgtcatcccagcactttgggaggccgaggcaggtggatcatttgagatcaggagtttgagaccagcccggccaacatggcgaaaccctatttctactgaaaattaaaaaataaaaataataagctgggcatggtggtgtgcaccggtaatcccagccactggggaggctgaggcaggagaattgcttgaacccgggaggcggaggttgcagtgaggcgacaatgcgccactgcactccagcctgggctacagagcgagactctgctgcaaaaaaaaaaaaaaaaaaaaaaaggggtgagaagggcaagcaagagttcagactattagaagcaagacaccaagaaactcccagacaccaacacctaccagtttagggttattgtataaggagcaagagcttttcacattgtaacagccccaacattaaatcatcaataaaaagcaaaatgagggtaagcattctagtttataaaacatgcactatgattttctaattatccaaacaagtaacttacatgcgatgatacgctttccaacaagaggagaacgatgaaagctgtcaacatcccccaacatgcctgtcacaaatgcgcatcacagaaacccaccttcagaactctcatcaggaaacagatgccctctgctactcacattcagactggagaatacctgtcagcatatacacccctccttaccgaatttatacactttgtgaacaagtgttccccgagcacattgaccccacgcgaatggggggaagaggtagaggtcagatgagacccaggagggcataacttacagcctctgccacaggccactcacgtggtgaccacagtccagccgactgcactctcaggctgtgacctctccacggggctcagactgtatctagttctatcttcaatgtagtgtgtctgagatcgtttaactaaaagtgctttacaaaccgtgcaagcagccagcacgactgtccaggcccagggaaggtgatgggaaggagccagtgaatggggcccaggcaggcgccaccagaacgggcgagggggacgcggcctcccagcagctgggcacacccaggggacagagagtctgctcccacccatctcctctttcccctggagcccttgaacccatcaaatggatttaaggccactgaccagggcaggagtgacccaagcaaagttaaaaggtgtctagaaattccttgagcctctaactgcatcttaaactagacagccaggcacccgaagtctagaaatatatatatatatatttttttaaagacagagtctcgttctgtcacccaggctggagggcaatggtgcaatctcggctcactgccacctccgcctcccaggttcaagcaattctcctgcctcggcctcctgaatagctgggatcacaggtgcgtgccaccaagcctggctaattttttgtatttttaatagagacgggatttcaccatgttggccaggctggtctcgaactcctgacctcaagtgatccaccttgatccatccacttcggcctcccaaagtgctgagattacaggcctgagccaccacacttggccgacaaataaacaattccccccctccagtagatggggtctcactatgttgcccaggttggtctcaaactcctgggctcaagtaatcctcctgcctcggcctcccaaagtgctgagattataggtgtgagtcaactgtgttcagctgaaataaacgtttaaccaccaccttgacatcatatccaagaaacaaaagtagagtttcctttgtttgcccattttttgagacagagtttcactcttgttgcccaggctggagtgcagcagcatgatctcggctcactgcaacctctgcctcccaggttcaagcaattctccagcctcagcctcccgaggagctgggattacaggcgtgagccaccgtgccaggcttgtaaagcgtaacttttaataaaggtagttattcaattatgccatgtcatatacctctctcgtctggattcaactttcacaccactgtaatataggttttaaaagctgggtgtgctggctcatgcggacccacagcctaaggccaaacagccgcctgtgctgctgagtaaagggagcggtgcgaggtcacctcagggaggaagagggaggagccacaagagcaaagtgttcagctggctgaaagctcaagataaccggctctgccagaagcactgccattaggatttccagggaacccctcctagccatgcctgcctggctgctctggaggggcagcagcagccccataccaacgctgacctcctgagagaacaagacgaggagatctgtgccatggctgtccccacactctgggagaatgtgagttcagaaaggcgctgtatctaccctccctgatgggctcatttctgtctcattcaaaacctcggggccatgtccagtggacgctgctgcctcctgtgtctgcaagaaggaagagccatgaagttcccatggaacaaagcacggccaggaatggccaaagccgaagagcctcccatggtgtcacgtcgagcccctgccctcggaccagcaacgcagcagacgtcgagcccctaccctcggaccagcaacgcagcagacgtccagcccctgccctcggaccagcaacgcagcagacgtccagcccctgcactcggaccagcaaagcagcagacggaaagccaagaaggcccaatgccaagagcccaatcatgatagcacccagagggcaaaggtgcagactcctccctcactcccacctttcccaaacaccacctccaagctccagtcatacctctgtctcacaaacacccgctagggccttgtcaaactcacctcccactgacgaaggcgcttcacaaaagcatctagcaagataaagaatctgaaactgggaggctgaggcaggcaggtcacctgagctcagcagttcaagaccagcctggccaacatggcaaaaccctgtctctattaaaaacacaaaaattagccgggcgtggtggcaggcgcttgtaatcccagctactcaggaggccgaggcagggagagttgcttgaacccagaaggtggaggttgcagtgagctgagatgtgctcctgcactccagcctgggtgacagagcgagactccatctcaaaaacaaacaaaaacaaacatttctcaaggctgggcacggtggctcacgcctgtaatcccagcactttgggagaccgagttgggtggatcacctgaggtcaggagttcgagaccagcccgtccaacatagcgaaaccccatctctatgaaaaatacaaaaattagctaggcgtagtggtgcatggctgtaatcccagctatgtggggggctgaggcagagcagaacgggatgggatgaaatgggacaggacaagatgggaatgggacgagatggaaatgggacaggatgggacgacatggaacaggatgggatgggactgggatgggatgggatgggaatgggacaggatgggacgggacgggatggggcaggacagagcagggcagcttctgcaggaaggagcctctgcactggcagtggcactgacggcttcaaaggagctgcgaagacacaaactacagaaagaatagaactcaattcttccctccttttacctcaatcaggtggccttttggtcttactgtatttttggcaacctgtatttagcacctacagaaaaagcaggcccactagacagcccaacaacagaaccgctgcaggtgagaacatacgtgtgtaagaacatgtgtgtgggagcacacaatgagaaatagttttcttttttttttttttttttttttttttttgagactacgtttctgtcgcccaggctggagtgcagtggcacaatctcagctcactgcaacctctgactcctgggttcaagtgattctcctgactcagcctcccaagtagctggaactacaggcacacaccaccatgccaggctaatttttgtatttttagtagagacgatatttcaccatgttggccaggctggtcttgaactcttgacctcaggtcctccacctcccaaagtgctgggattacaggcgtgagccactgtacccggccttgagaaatggtgtttttttgtttgtttgtttgagatggagtctccctctgtcacccaggctggagtgcaatggcccgtctcagctcactgcacaggtgtctgccaccatgcccaactaatttgtgtatttttagtagagacgctgttttgccatgttggccgggctggtctcgaactcctgacctcaggtgatccacccgcttcagcctcccaaagtgctgggattacaggcgtgagccaccggacccagcagacagaaatggttttctatggcagagcagactgagcccgtccacaagccagcaccgggcagagggaagggcgccagagacaccgagaccctgtgggtatccctgtgtcagagcctcaagctgctccctaccaattctccaactctactgagtgagcaagaagacagtcaccatattcccaacacaacacactcacgatgatgcatttccacatttcactcaaatgctttaaagatttcaaaactacgaattcactttaggtacagtccatcacgtacagtctgcaaagaaaaccccactcagcaccactttcacgtctgacgacagaaggctaacgtgagtggcagtgagaccgtgccagagcctgcctgcctcacccccgccgctgcgcagccagaggccggggattaggccagacaccagcggctcgccaagagctccatttgtgaccgttccctccgtaggcaacccggtggtccccactcccaggaggtcaccacacggatgccaaacttagcacacagcggacagcagtccagaactccctggctcaagccggcctcccgctcagcctcccaggtagctgggaccacgggtgtgcgccgccatgcccgcaaactgggtccaatttgtctgcaagagaagcaaaggggatgccagggcttctcctattcctcagattttcgtttttaagtaaagtcattacagattaagaaaatacaataccggcttccaatgaacaattcatcttttaatgtaagtttaaaacaaaatggaaatccacactacaagttttccattaacataatgaccaaataaaaaatgactccatgttaaaaatcagtcactttttttttttaaagcttgattattaagacagacaatgcactaattctcccttctgagggcagcacgaccaattcccaacgttactcgtgtgtccagggaccgtccacactgccctgctgccccaccctttacccaaggagacgccagaaacccagccactggtccctagcaagaggccctcttttctcaccagggacagtggaggatagaacccggcacacagcatgagggtgtgggggaaagggggctcttctctggaaggatggcagtggcccgcaacgaccttgcatcctgcaagatgcccgcggggaggagtgtatccaaaagcaccctacaggacacgagtcaagacagaatcacaaatctcttctcgtccaggaaacttgactcccttaccttctgctaggtggaaaagcagacacgcttataagctactcaagttttttattaaaaccattgactgttggatttcatcaatccaaaatagcactgtagaatccttccagatggcacaatgacttgtaaacagcatctccataaagcagaagcctgaagactcagtcctatcacagccagagctgtgtgcgaacagacaagccctgagaagtgtgccagcaagagaccctgccccagctccccacgcctcgaccaccgagtcaagggcatgaagggcttggcagtgagggcaggagggtggccccaccctgggagccctgtatcgactgggtgctctggaggccgcccgtggtgacaggccagggctgctttcagacctcctggaaggtgcaggagccacagaaggccccagtgacatggaggaggtgtctgccctgccaagagcagcgagggtgggagaggtaggtcacacagccaccaccaaacaatggtgaagaaggcccactaaggacactgctcagcaaggaaacacacaggaagatctggagtgccaagttaaaaaaaaaaaaagcatctctcaagggagaggcctgaatggtgggagtgcccctcgaacagaaggaaggggctgcgtctgtggtgaggggacagcagagggatagtcaggcctcccactctgcaccacaggtctgtgaagtttctattaagactgtgcttgggccgggcgcggtggctcactcctgtaatcccagcactttgggaggctgaggcgggcagatcacgaggtcaggagaccgagaccatcccggctaacacagtgaaaccccatctctactaaaaatacaaaaaaattaaccaggcgtggtggcgggcgcctgtactcccagctactcgggagactgaggcaggagaatggcgggaacccgggaggcagagcttgcagtgagccgagactgcaccactgcactctagcctgggcgacagagcgagactccatctcaaaaataaaaaaagaaaaagaaaaaaaaaaaaaaaaaagactgtgcttggccgggcacggtagcttgcgcctgtaatcccaacactttgggaggctgaggcaggtgaatcatttgaggtcaggggttcaagaccagcctggccaacatggtgaaaccccgtctctactaaaaattcaaaaaaattagccaggcgtggtggtgggtggtggtcgggtctccccaactactggggagactgaggcaggagaatcgcttcttgaacccaggaggcagaggctgcagtgagccgagatggtgccaccgcactccagcctgggcaacagagcaagactccatctcaaaaaaaaaaaaaaaggactgtgctcatctgttaggttccttttttaaacttcagacttacaaaaaagttgcaaaaatagttcagagtccctgtacagccttacccagcttccctaatgctaacatcatacataaacataaccacagtgaaattatctaattccaaaatcagcactaacaccagactattcaccaccacaaagacctgactccgacgcaatcaccctgctccagggcccacgcgggtggtgccgggtgctctcttctctccatgaggctgattttttttttttttttttttttgagacggagtcttgctctgttggtcaggctggtcttgaactcctgacctcgtgatctgcccgccttggcctcccaaagtactgggattataagcgtgagccaccacgcccagcctccatgaggttgatttttaatgtcttgaaaatcgacacggaatagaaaataagcaagatttgcgtttccctgtggtgctgtcgaacgcacacacgtcacaaaaaagcccacgagatgacaaaaaagcctgaatgctgcatgtgtgtctctgactgggaataaggatcactggaaaatatttgcacctgagaagatggggctgaaggaggctgcatagagcaggagccctgcgatgagccggggacccccttggaggtttagcggacaggacgtcatccacacaaagaagagccggcaggtcccgggctcacacaggtctggaatggtgccactgcccagccagatccctgtccgcagccctgggaagaaggttctggaaggcactgccacagcccggggaatgatgaacccaaaactgaaccaagctccagcctgtctcacaaatcctaaaagcaacagctgaaagggacaaaaaggttccaaggaactatgtggatcccagaacaaagcccaagatgacttacaggaatatacaattatccagcacataatgaggtaaaattcacaatgtccagcatcccatcaaatattctcaggcatggaaggtggaacaatttgagcaaaaaataaataggacagcaatggattacagtgctggagtgcagtggtacgacagcctccagggctcaggcaatcctcccacctcagccttctgagtggctgggatgacagatacacgccactacgtctggctaatttttttttttttacttttagtagagatgaggtctccttacgttgcccagtctggtctcaaactcctgggctcaagcaatcttcccaccttggcttcctacagtgctgggattacaggcgtgagccaccacacccgacctacaactttgctgtaaacctaaaatttttcaaaaataaaaagtatattgaaaaaaattcctgggcatgtaaataagaaaatatgattacataggagaaaaaaaagtcaatcaaaagctacccagaattgacacagaaggcaaaattagtagatggagacatgaaatcgtgtaactcagttcctccccacggtcaaaaactaaaaacacggaagctaggaaaagacactggaatgaacctctagagatgaagatgacgctgtgtgagacgaaaatcacactgggtgggattcacagaagaacaggcattcagaagatctgtgaactcagagaaacggcatgtcaacaactcaaacatgagcaaaaacactgagtgtggcagggagcaccgagagagaagatcactggggcaaacaccgagtgtggcggggagcaccgagagagaagatcactggggcaaacaccgagtgtggcggggagcaccgagagagaagatcactagggcaaacaccgagtgtggcggggagcaccgagagaaagaagatcactggggcgaacaccgagtgtggcggggagcaccgagagagatcactggggcgaacaccgagtgtggcggggagcaccgagagagaagatcactggggcgaacaccgagtgtggcggggagcaccgagagagaagatcactggggcgaacaccgagtgtgacggggagcaccgagagaaagaagatcactggggcgaacaccgagtgtggcggggagcacagacagagaagatcactggggcgaacaccgagtgtggcgtggagcacagacagagaagatcactggggcgaacaccgagtgtggcggggagcaccgagagagaagatcactggggcgaacaccgagtgtggcggggagcaccgagagagaagatcactggggcgaacaccgagtgtggcggggagcaccgagagagaagatcactggggcgaacaccgagtgtggcgtggagcacagacagagaagatcactggggcgaacaccgagtgtggcggggagcactgagagagagaagatcactggatcaaaccccgagtgtggcgtgggtgaggtgcaggagcctaaccaacggtaaggggtgctcccaaaggaggtggagggcagaaaaaaatacgtgaaggaataaagcctgaacatttccacattttgatgaaaactgtaaactctagtgatccaagaagctcaacaaatcccaatcacaaaacatggagaacctgaccaaggcacatcacagaggtgaaaagaaaatcttaaaggcagtcaaaggtgagaaactaggtaaagaagaacaggcaaaagggacgacaggttctcggggaaacagtgagcacacagccaggggccagcacccgtaagtcctgcagaaaaacacctgtgaaaatctttcaaaaacaatgctgctggtaatggttgtctaactctggggaggaggttcctggagctctgcgctgctccccacatgccctgccctccgcatctgactgtgcatatcctttgcaaaatcctttccacgacactggtgaacatgtaagtgtcaccctgatttgtgtgagccactctcataaaattattgcaccaggctgggcgccatggctcacgcctgtaatcacagcattttgggaggccgaggtgggtggatcacgaggtcaggagatcgagaccatcctggctaacacggtgaaaccccatctctactaaaaatacaaaaaattagccgggcgcggtggtgggcgcctgtagtcccagctactcgggaggctgaagcaggagaatggtgtgaacccggaaggcggagcttgcagtgagccgagatcgcgccactgaactccagcctgggcgacagagcgagactctgtctcaaaaaaaaaaaaaaaaaaaaatgattgaacccaaggaggggtcacggaaccccagattcagggcaggtcgctgagaagcacagccacaggaacccagggcttgcggtgggtgctggagtgctggcagtcttgcgggactcagtcctctccctggtggaccccgtgccgtctccaggtagacagtgtccaggctgcacgggattgtgggacacccagctggtgtccgccacagaactgactgcctccctgctgctgggcagaaagcccacacaactggtcacagacgtcttttgcgttttctgtgttgactgtcgctgtggcatgagagcaaaggaaaaatctgagttttccccctcagaacccctactaactgagcttagaaatacatgaagtcaagctacacagacagatacacaaaaccacaaactcagtaatgattttaataccctgttctcaatcactgagaggacaagctgacagagaatcagtaagcacacttgtaagaagtaaagcagaggttcctcttcaaagactttcctccccatctaactaaaaataaatagtaacttctcttaaaagcaacatttattcaaagacctgtactgacattcttaaatatctgctagccttaataaagaaatcaatgtactttatgttcttagctcccacaatttagcctaaatatctgccctggcatgcttatactggtcgaagcaagcattaggtcacggcctgttcctcttccttagttgaaggtgtttttacctttctcagcattccacaaattacttcctccttcctttgttctcctctgcctttgcctcttttaaaaagttctaagttgctagccaatcgggacaaatacagaatgtgaggtcccgttccagccaatggaaaccggacacagcagttggtataaaaaaaccggacacagcgtcaggttataaatgaccctggtctccttcattcggtgtactctcgtggcaaaactgcaggcgagtgtaccctttctgcagaaggtataaaaaatggccttgctgaggaaattaaatttacgttcaagtgctatttctttacggcaccagggagcaagcatttcaaacacactgatggcccattcctgaaggatcacaagaagctaaaattcattacctgtataagggagtttaagttagattttcacccttttcatgttttcttacattttctacaatgggtaaacgatggaaataagaaaaacaatgtttatgttttgaaaatgtctcaatgggtctgccagttcatgttttccatgagcagcactgtgatgccacgctgagatgctccagggtccatgcagttcaagaacatggtcgtgatgtgttgaagcagacctgtcttggttgtccctcagatcccagctacagaagttaacgatcaactcagcatctgtaatgcacttcggatgtcagcctacaagagcagacccaatcaacatggttgagttcacagacaacggtatctaggatgtccggcacacccagaacctgcacttaagcaaactcgtggataggaagtcccccaaggctgcttttctctaaacactaggttaggaaaaaagaaaactgggaatacatttaaccgactccatcaactacataagaaagcacctttgagagtgaacttgtgtctaatcaccaccttgggacctgcctgcatctgaaatgagtgagtgatctacagtcaccaaggccctttctgtttccccaaaaattccttttctaaactccagcctatttcttcacattctacttcttattcaaggcctatgcaaatgctaaccctcagtggagcctccggcaagcccagtccccaggaaacacggtctccctccctcttcttcacctgcataccttctctcacaggagcctctggaagtctccctcaggacctggcaccttcttgctacatcataaataccttgagagcacgacgccagcctcattcacctgttcccacaggtgacatggctcccaccctgggaccaagagagtccactgtacacattaaactttagtttcctcttttttttactttttttatttttattttttttttttttgagacggaggcttgctctgtagtgcgagaccactcaggcaggtggagtacagtggcgcaatattggctcactgcaacctctgcctcctgagttcaagcaattctcccacctcagtcccccatgtagctgggattacaggcgtgtgccaccatatccagctgcttttttttttttttttttgtatttttaataaatagagacggggtttcaccatgttgcccaggctggtctcgaactcccgacctcagagtgatttgcccgcctcagcctcccaaagtggtgggattacaggaggaagccactgcgcccggcctagtttcctcttaggtggagtaatcacgtccacctcagaggatttgtaagggttagaaggggaagcagccgggccgatggaaacatgcaggaactatcccagctgggcctattgcccttcattctggaatctggcagagctctgcatggcatctcgcatgaaacaggctctaagtatttaatgaataggaggagacatgtcagacagtgggaataatcatgctgatctgcatgaggaaaatgtgtcaaaaaacaaaagccaaaaagtcacgaagaaagtgcttgtaatagagactagtttacttgtgagggctacgaataagtgaagctcaaaccactaggtgccaaacatgaaagtgggttcccagaccccagtgtttgctgactgcaacacagcggtgcctgcagctcacagggtgctcctccccgcctccctagccctcctggagactccacccatcacagtcccaggttccaggcaggcttcccaggccactcagctgctgcaagcacaatgtcctcctgaggtcaacgggcaggtggcaggagcctctgacctgcttccctccacgacatgggcacgttctgggactgcagttccacagtggtctcccatgtccctggaaagcagccgtccgcctctcctccacacctgccacactgctctcactcatcaggaaacttctcatcagaaaaacagctcgtgggccaggcacagtggctcccgcccgtaatcccagcactttgggaggccaaggcgggcagatcacctgaggtcgggagttcaagaccagactggccaacatggtgaaaccctgtctctattaaaatacaaaaattagctgtgcgtggtggcaggcacctgtaatcccagctactcgggaggctgaggcaggagaatcgcttgaacccaggaggcggaggttgcagtgagccagtatcgcaccactgcactccagcctgggcgacaaaagcaaaactctgtctccaaaaaaaaaaaaacaaacaaccttttgtggaaaaacgagtgtattttccactcctcgtctcaataaaacctgcgaagactgctttcatatacaggagtcgtgttttatgacaaaggctccatcaaggatgctgtaaaattacacacagccatctccataatatatggccccgagagttacacacatgaggttattgagttatttttcaaacgtccagactcctcatttccaattaaggcaggttggctgtagcactgttggaaagcctaaagctttgtttgcagccaattcagaggcgacagtttttccaaggctacttagagctgatgagagaaccccctgttaaaaagatctccaaaccagcaaatacatcacggtatgattttaagtcactgcaatccagatcatcttaaaagttctgcaggatttggaaaaacaaagacaaattattaaaccaagtgaccaggctgaagcacaggacaagatgaaagagggccaagaacaggcaacaccaccactcaaacgatccaagagactcctggtctaaaaagttagaggcttggtcaattttaaggcagcgtcttaacagaaagaattatgcaagccaagtaaactggctgagccccagggaagggctgcgtactgccagaggaatgggctggactctttccagctccgtaatcctgggagcagcgtcggtgtggaaggaaccctgacggcaagctgttacataagagcccagtcctgcactgcggggacatggtccgcttgctactggcatgcaaagatcaaagagaggagacagcgctgggatgccagcccacggctgggacacgtgctgcttctgtgagcatgcgcccaggaacagacgcacagacccacccgaacggggaaccgaatcttacttgtccatgagaatcccaggaggggaccaatgggccatcacattggaaccctctgaaactgcacacacatttgcaagcataggtatcaggggaggtaagtgatacagactcttctaagggtgtgaaatgtttgaaaagttgtcaataagcacacagactgacctgattcattcaacaacattttctcacccagcacacagactgaatagcttggtacacttgcttcccaggtgtaaaactacctgcttaataacaatgccttctcagctgggtgacaccgcactgatgagccagttcactggaggactgctggggtggtgcggcaagactgtttcaacgcactacgtcccgagcacgcagcattcatcttgtgcatatccttcatgacaaaacaagtatgcacaaagcactgctgccgcacaccagacacagcggcctctggacaggaagcaccaatcttcagtcaaagaatgaccgaccgacatgcaaactctggttgttcggacatgagtactggcagatcatttctaaaaaatgaaggaaagacagctgcaagttcagccagaacacctcaacaacttgttgtcaatgtgaaaattcaagctttcaaagataagaattttggaaaactccaagagcagacagcttctgaagaactaaaagtctccctggaagagacaggtgctgctttctgatgtagtaaaatcaagtggatccacgtcgggagatgcacacgagtcccgggcacccaatcggcccttgggtgcacactgtgtgctgacctgggtcacctccagatgtggacacacaggcacactcccacacacacgcgacggagccgcactcgccgcaagagagaccaaagggaagccctgagactcccctgctgctggaaacgctcacagcacaaacacctgctgggttttggtgtcgtatcaatgaaaatctccataattatatcaaaaagctatttattaaaaatatgcttccattttcccactagattttttttttgtatacttcaactagaacaacatatttaccacagactgatgcaggaacagcgaggagaaccctgctgtcttctatgaagccacacattaatggggtttgtacaattttaaggaaatgctcctctaattgctatttgttgttgttgctgttgtttttgggacggagttttactctgtcgcccaggctggagtgcaatggcgccatcttggctcactgcaacctccgcctcccaggttcacgccgttctcctgcctcagcctcccgagtagctgggactacaggtgtccaccaccacacccggctaatttttatatttttagtaaagacggggtttcaccatgttggtcaggctggtctcaaactcctgacctcaggtgatccagctgcctcggtttcccagagcactggtgggattataggcatgagccaggggacttgaccagatcactaattttttatactggaaaatacaggatttttttttttttaaagaatgtgctgcttatatgcaatgggcttattattcctgttgttaattggaattggtatacagacattttccaatccttcaggtttcaactggcaaatgccagcagacatacccacagagccagagctcctcaggctcctccacgtccaacggcgtctcacagtcctgaggatgaggacctgggtgaggggagcacgggagacacagccatcaaggcatccacctccaggacagacaccagccaagaaccccctcagggcaaggcctctcacaagtccaactccacggattccaccgtaagtgctgtcaactggatgcgcatttacaaaatctgagttttctcaaagaagctgaagctttccgtgtcctcagtgattctggactcccagcgccgtaccactccctgccagccacacagggggacccacaggaagcaggccttccccgtggcgggccttgctgctatccgcgctcctttctgtgcagtcgtccctgacggggaagggttgagcccagccaagtggatccctggctgcaggacaaaggtgtgcatggcaaggggcccacctgcctcaggctgaggcataaactttcccttttcactcaggaagggtaagacacagttcccagttttacagtgtgcttttgtggatgctgacccggtactgctcttggaatgtcaagatgaagatgatgcagaagcctctcctctgagcatcttctgattgacaggcaagggactggagtggagcccttggcagcaggcggtggccagggacaagcggcccgtgccacgtctcccagctagctcaccaccagcacacaaaccttcgtcctgggcatgggactctccatccctggtcaaagcaggtgcctcgggtggcaacacaggaccctcagacactgatctcctgttgttgaatcggtgcaatattcacccaccaaaaacaaccacaaagcgcctgtcaccagtgacaatgtagcactgtctatgtgaataaaattaaattgtgtttggagaatctggtgacgctgtgaaacagctgaagattacctgtaacctcagcgctctgggaggctgacaagagggacactgtgaaacagctgaagactacctgtgacctcagcactctgggaggctgacatgagggacactgtgaaacagctgaagattacctgtgacctcagcactctgggaggctgacatgagggacactgtgaaacaggtgaagattacctgtgacctcagcactctgggaggctgacatgagggacactgtgaaacagctgaagactacctgtgacctcagcactctaggaggctgacatgagggacgctgtgaaacagatgaagattacctgtgatctcagcactctgggaggctgacaagagggacactgtgaaacagctgaagattacctgtaacctcagcactctggaaggctgacatgaggactgcttgagcccaggagtgtgagaccagcctgggcaacacagggagaccccatctcttaaaaaaaatttttttttaacaaaacaataaaaaaacaaaaatagctgggtgtgttggcacctgcctgtggtttcagatactcagggggctgaggcaggaggaaggtttgagcccgggaggttgaggctgcagtgagctatatgactgtgccactgcactccagcctcagtgacagagagagattgtgtgtccaaaaaaaaaaatcccaatacactgttagtgtctcaagcccaggttagaaattactcgtctagtctctgacagaaaaatcaggtgggctaagcaaaggtgctttctggcccaggagtacagatgcagtggcaggcacatggctcagctggctgtgcacagccacccaggatcctggggcagtctctggacaaggcctcaaagaccccagacagactcccatcatccctctctcccatcagcatcatcagttttttaaaattgttaacaagctccatgctctgtgagacgcagtttccaagcaaggcattttcagtgttgcctcaacagaaactgcatcatccctgaacactgacctcctgtcacagcccaggtggctccgaacacggagcaggagcatgatgacacagcacgagtccacgcaaggacacctcctcatcaagacaagtcagaggcagaaccgagttcaggggccagtggctggctttgtttattcttcatttatccgtaagagaagcccagagagacaactacaagtgacccaagacactcataggtgagtggattaaacacccggcgtccatccagacaacagaatattaccaggccctgaaaagacaaaaaaggaccatagacgcatgctgctgagtgaaagcagcccgtctccaaggactacacgctgtacggttccgactctgacatccaggaaagggcaaaaccgtgcagacagcacaaagatcagcgaatgccaggggctggggagagggagggacggagggatgtgcagcaggaacacgggggacctggggcagtgaaactactctgtatgataccacaacggtgggtccacatcaggatacgttcatccaaccatagactgcacagcacccggtggaccctgaggtcgtgcggcctgtgggtgatgatgacactgtctccagggcggtcgcgactataacaaatggccgctcttgtggggatgctgagcccaggggtgcgggggaaccctctgtaatttatgttctattttgctgtgaacctaaagctaatataaaaaataaagtctactttttttaaagtgaccatcctgtcagaaagacaaaatggtcccagagcacagggcttggattcacacagcacagaatcggctcccagagcacaggaaggtccagtgcaccaggaccaagaagcagagtaagccgagtgacacaagagagggcagcctctgccccaggcttcctgcgctgggggccggtcatctgctgccccaggcttccctgcgctggaggccggtcatctgctgccccaggcttccctgcgctgggggccggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggacggtcatctgctgccccaggcttccctgcgctgggggccggtcatctgctgccccaggcttccctgcgctgggggatggtcatctgctgccccaggcttccctgcgctgggggccggtcatctgctgccccaggcttccctgcgctgggggccggtcatctgctgccccaggcttccctgcgctgggggatggtcatctgctgccccaggcttccctgcgctgggggccggtcatctgctgccccaggcttccctgcgctgggggccggtcatctgctgccccaggcttccctgcgctgggggatggtcatctgctgccccaggcttccctgcgctgggggccggtcatctgctgccccaggcttccctgcgctggaggctggtcatctgacgggaacccctgcagccacctggaccagctgcacacaccttggacgcctgtcgccctccaccctctgcagacaccctctcacaggctccaccctgctcgggttcacagacacatcccccgtctgccccggggctgcctggcatggcacccaagaccaagatggaaagggaggccccgcgtgtgggtggacaaatccacaacacgctggccctcaagttgtctcagtaatgttatatatttctctctcccccccacccgccctccccctccccagagggagtcttgttctgctgctcaggctggagtgcaatggtgtgatctcgactcattgcaacctctgcctcccaagttcaagcaattctcctgcctcagccttccaagacggccgccaccacgcccggctaacatttggatttttagtagagaccgggtttcgccatgttagccaggctggtctcgaactcctgacctcgtgatccacccaccttggcctcccaaagtgctgggattacagcacgagccactgcgtctggcattaaatttctctcttgattatgcagccactaaatatcacgctgggataatgggaaattaatgctaagctttaaaatgcagaatgtgaagccttatatccagagtaatccttattttgtaaaaagtacatgatatattcaacattttagatttacatgttttatcttgggtggaaggattacaggcgatttttactttcttctctatgctttatttactggtgttatgagttgaaatgtgtcccccaagaatggtatgttgaagtcctagccccccaacaccacagacgatggccttcctgggaaacatggtctttgcagatgatccaggtgagatcgctagggtgggccctcaccccacagaactagcttccttctacaaagggcagacgtggacactgagctgtgcacgcagggagaacgctgggtgaagagggaggcggagatcgtggtgatgcgtctacaagcccgggcgcaccagagactcccccatcccccagaacccgccgggcacaccagagactcccccatcccccagaacctggagagaggcctggagcagatgcccgcccccacccctccagcaccgcagaaggaaccggccctgcagacagcttggtctcagagccgtgggagaacagatccttgctgtgaaagctcctggtctgtggtgatttatcacggcagccccgaaagacccccacaccaagtttcactctctgtccatggacctctttaatggaaatcctgacttttccataaggcactgaatctgtgtaacttttagagtaaggaggacgacctacagttcactgcatgaaagcacagcccttccaacaaaggcaggcgaaatgtggaaccaattatatctgggtgcctacacgtgacgtacgccagttctttgtagaaagaacgaggcttgtctcagcgatactaatgtacagttcacatgaactcctaaccttagccagccacaataaggtatctgggattgagcgcttatttaaatcggtaggcacatcaatttaaatttaggtagtagctcagcctgtacctaacacatgaggaagccgaggcgggaagatcggttgactccaagagttcaagagcatcctgggaatgacagggagaccccgcctctagaaaaacatttaaaaattgctgcgtatggtgccgcacaccagcagagtcccagctactcgggaggctgaggtgggaggattggttgagcctgggagttcaagccttgagtgagctgtgggtggggggggcagcactgcagggtgaggtgaagggggtggttctgcgggaggaggtgaggtggctctgcgaggttaggagagggggcaggggctctgtggggtgagatagggggtatctgcagggtgaggtgaggggacagctctgtgggatgaggtgaggtgggggttctgcggaatgaggttgggggggcggcactgcgggaggaggtgggcggggtggggcctgcagaccctccaggctctcccgggggaaggagccccatcagggccagcactgcgccactcccaacaaagcaggcaacctagcctgccagtggagacctcttttccgcctgggctccagctctagagcaaggccagtcacctcagccccaccatcaaacaccaggctccacatgggcactgcctcgctcaactgcgtggtggcgggtggcctggaacgctgctgtcatcactgcacgtggacacatcatcaacctctcagcgtgacgtgccctcgtgctttcaggtaaaacactacagagaaacttcctgttggcaggtggaccccgcactccctagggcctgatccgctccctctcttctgctttacgggcactgacaggaagtatctgatgcgcactcactcacaccagccacgcacatgttgtgagcaatcctgtgtggcctgctcccccctcctgaccggcccctcctgactggccccagcaccgcgtggaagaacatggaggagctcatctgtctgaggataggaagcagcagagcacacgcaggtgagggcagagcggggaacccaagtcccgaggaagtttctcagtaagcgaggccccgcgctctgggagggcacccccaggaagcccacacataaagcaactggacacacgctcaactacgactgggcaatgacagtagcttaaaaaaaaaaagtacaccaccaaacagacaaagaccagagaccacttacataaaagccctgctgcctccccgggaagggatttcaaaacacttctttaggtgagcacgacagcacgtgcctttaatcacagctactcaagaggctgaggcaggaagatgacttgaggccataagtttgaggccaatctgggcaacagagcaagcccacctctaaaaaagtaaaaataaaaaaattaggcgggtgtggtgacatgcgtctggagtcccagctactcggaaggctgaggaaggggcatcatttcagtccaagagttgaggctgcagtaagccatgactgcactccagcctggtcaacaaagcaagacttgtctcttaaaaaagcaaaacaacaacacatctttatattatagggcacagaaaggagcaagattataaaactaaaatagggtgaaagaatgcaagagactcagaactatggcaaacttataactaaaattccaaactacaggaaactctcagagcaaacgctgcatcacataagctgctagcccggcacatgattgtgaagaatcaggagtcctctcagcaccaacagacagtcatggacacagcccacaggtggctcgacccaccagcctcaggcagcatggggttgagaggggaagcccagtttggccgactgtagaaccctgttctagtctcctatccaccctcaccaaggcactaaatcaccagcaaagactctgagaacatcaacatctgtgtaactaaggaaaatggaagtgcaggaaggaatacatttttgtaatcaaagggcatgaaaaaaattgccttcactgaaaacactgaaaaggtacaaccctattatgtctcctgctaggaaaaattttcctctgcttttaaaggattaatagccacaaaatattattttgttattctggtgtcctccagaaaatgagccaacagtttgaagggtatggggtaaagagaagagaaggaaaagctgcttttgaaaacactgttgactcgcaaagttaccagcactctatcaggctaatgcctaggtcaggagaagacagacgcagtcactactatggatcctgagggcgagaaactctggatgccacaaagtggcatgttcaaccttcctacaagcacacagaggtgaagcctggagaacaggcagggacaggcccagctggccatgtgctcagccacgcctacctcgcaaggtcattctgaggatgaaggcatcatggatccaaatgccaccttgacgctgaatgtactacacaataaaagaaccactgtaaatcacactattgactcttgcttggttgatgttctttcctttacagtaaagtgaactcgtggacaaacatcgtgtccacagaccaccataaatgtagtttgttgttttaaataaaactgaaatcagacttccaaaaagaaacatctaaaaacttctcctctcccatcccaccagagccatggcccacaacacagcccgacgccccgtcacacgctctcacaggacaactgcccacaccagttaacctggtgtcacggtggaggcgaggttgcggtgagtggagatcacgccattgcactccagcctgggcgacagagcaagactccatctcaaaaaaataaataaataaaaaatcttgtggaaggaggtaccacatatgcggtctgttgtggaacaaaatgccgttacgtggggcatgactgtattctgtagggcacatttgcaaaacagctcctctagtcacataggtaactgtttttgagacaagttctggctctgtcacgcaggctagagtgcagtggtgtgatatgagctcaccgtagcctcgacctcctgggctcaggcgatcctcccacctcggcttccccaactagctgtgactacaggcacgtgccaccacacctggctcatttttttttttttttttttttggtagagacagggttctcactatgttgtccgggctggtctcgaactcctgggttgcagcaatcctcccgcctcagcctcccaaagtgctgggattacaggcctgagccgccatgcccggctttctaggtaactttcctatcagccttcctgactgctgcagataaggcatgttctcacagggacaattcaggaaatgcaccaaagcgtcctcaaggcctgtccacgaagctcctccttccagccagaccctggggcttaggggtcaaattcctcacaccttcccccagcgctcctcacaaaggatgcactgcagtcaatcccaacttagctccagcaagaataatcccagcactttgggagccaacgccggcagatcacctgaggacaggagttcgagagcagtctggccaacatggtaaagccccgtctctactaaaaagacaaaaacttaccgggcgtggtggcacacacctgcaatctcggctactcaggaggctgaggtgggagaatcacctgaaccccgaaggcagaggctgcagtgaaccaagatcgcataactgcactccagcctgggtgacaaagggagattccatctcaaaaaaaaaaaaaaaaaaaaccttcagccagaaaatcaccaaagtcctaagtctggttatgccctttgttttctatttcttaataataaaaacacagcaaggggtttggtgctgtgagcaaggggctctctgagagtcggcacccacacgtgctggtctccaggacagacatgtctcaggccaacggcactgacagaagcacagaccctcactgccaggtcacggcgggcacgggaaacccacacctgggcctcggccacactcctgagggcgacaaaacaccagccggcgcgctctgagacttgcggtcagtcctagaggagaagcagcagctgctgagaaggccgcacgggcaaaggagccaccgtgcaccgtgacaagacaacatgttcgttggccatgcccggtgtcagcacgcagacacacaggcaccagaggctgcagcgaggaagacagatgtgcttccccagtgcttatggtctgggtggggacagaaaagagacaaggaaggcccagggcaggacatcagacacagggttttagttaaccaggactgtgatgccggcatctgcctggaggaaggaaggacagacttctgaagaagatggacctcagtgcctccttcacgctgataagcgatcccaccaagcatgacccacagcacaggacaaagccttgtgtccaggacagggtgccctccgggaggcagcagaaaggacagctgtggaatatggaaggggaaaaggaaaagggaacaggagacaaatcagcaacattaagaacatcaggccggacgtggtggctcacgcccataatcccagcactttgggaggccaggggaagggggagcagatcacttgaggtcaggagtttgagaccagcctggacaatatggtgaaaccctgtctctactaaaaacacaaaaaattagccggacatggtggcaggcatctgtaaccccaggtactcgggaggctgaggctggtgaagcccaggtactcgggaggcggaggaggcggtgagttgagacgtgccactgcactccagcctgggcaacaagagcgaaaccccgtctcaaaaagataaaaaaaaaagaacacgcagacagaaaagaatgacctaagaaggcacacgaggaacatcagcaaaggactgacagaaaaagactcatatttttatataaggaacacggggggaaaaagaaaaaaaaattaaaaggaaaagatgaatagatgatatggccagaggtttaaagaaagagacaacgagataaaagcaggaagccccagcaacactgggctgcctccccaggcccttcccagcatttcctgccagcagggcccctgccccaagccaaaaaggaaccacgttcgcctcgtcagggctgttgcacgacagccgcacacacctaagaaacaaactccttctgggccgcgcaacatggctcacacctgcaatccaagcactttgggaggccgaggcaggtggattgcttgagttcaggagttcaagaccagcctgagtaacacggcgagacgccgtctctatcaaacacacatacacacacacacacacatagacacacacagaattagccaggcattgtggtgtgcccctgcagtcccagctacttgagaggctgaagcaggaggatcgcttgagcccaggaggcagaggctgcaatgagccgtgatccggccactgcactcccacctgagtgagagtcagatcctgtctccctccaaaaaaaaaaaaaaaaaaaaagaagaagaagaaatattaactcctttgtccacatagtaaaactcagtcttccattaacttcaaaaagccaaactgataagtttttaagtaaagaacaaacacatctatagcgaagtgtggaaaatcactgtggtcactccccagctacagctgccatgcagtggtagtgcccctgccctcaagctggtcccagactcaaacaggaagccactgcacatgtgtgaccactggccaggcaaagagaggccaagacagctcgaaggacttgcgcatggccccagaaggctgcactatgtggcaagcactggatgcatacagatactcggccaagaaactccctgagagagctcacaccagcgctgttccctcagaagcccagttctccaccctagagaagtggcagcccttccacattcactttagccttgggctaccacagacatggtgaccaggacaaagaggcgtgaagctggcaaaaccaccaggtttgatgcacagaaaggccagcatcagcacccagttgcctgggcagaggaggaagaggatggcaggtacacaggccgttagaaacggcctcaccctgaccctgagcgtggtggcaagtggccgacccagattccctcaccctgctctggcacaccgcaggccagctgcatctggcaggagtgtaacagccagtgcccaggctgacgagcgtgagcactgccccacacacactcagaccctcaggaagagcatgaaagacgtcccagccgtgcccacagctacagcagcccctcctcgcaccccctgccaccctccctagagtccagcgctaatacaaccacctctggcctcagagtccccgggactcactcactcacttcactgatcagccgtggaatcctgaattcaaaccctacttcctaaacatcttttgaggcctacattcctcttgtaataaaaataaggaaaatgcaattttctgggattttgtaggaaaaaaagagaacataagtgaagatatctagcagagcatgtgcctctcacagaccttaggagttactgggaaatacaagtgaacaggccgctgtggagtgcggtttctaaaagtaggaggaatacagaaaaggcggccccaaccctgcctctgggagcaaaaccaaaaagagccacagccacagcagagaattcagaaaagccacctgcacaaaaggccagagcagccaagggaagctgggggcccaggccagtgagccctggggccaggtatcaggcccctcaaagagcagaaaacagattttttaggtgaagccgacggtctgaggaaatgagatgagctcacacacctgatgacagcttccctcagcaattccacccgcctccacaggactcagaccaagtcctggtgttagaataaatcactaggctacaagaaagctcaaacccccacaggttctagcactcctagccaccaacacaactctgttcaagatccacctatcaacaggggtggggtgggaaggcggtccccatcctcaggccattcttcctccgtgggttgcagccagggtttcctgtgggtcgtcttgtgcacgtcacggccctgcccacagcataaaaacatacaggtgtgagggagatgagcaagacagctagcttttcacaagagcaggaaaggctgggtgctgcgactcacgcctgtaatcacacagcgttgggaggcagaggaggaaggactgcttaaggccaggagttccaggccagtctgagcaacatagcaagatcctgttgtaccaaaacacacacacacacgaaaactggttgtcgtgttactaaaagtttccattacaacactgaagtttagaatacagtattactaggccaaaatatcctggcattttataggatttctttaacaaaatctgatcacatctaaactggcatctttctgctcacttctcaatttcaatctaaatttatttatttatttatttattttttgagatgggagtctcgctctgtcgcccaggctggagtgtagtggcacaatctcaactcactgcaagctccgcctcccgggttcacgccattctcctgcctcagcctcctgagtagctgggactacaggcgcccgccaccacgcccggctaattttttgtatttttagtagagacgggttttcacggtgtgagccaggatggtctcgatctcctgacctcgtgatccgcccgcctcggcctcccaaagtgctgggattacaggcgtgagccaccgcgtccagcctcaatctaaatttaaaacacagtttgctgttcagctacagggcagaatttcacacggagcaggcacctcacagatgccaacccggtgggtacggccctttgagtgtcacctaaagcctcataacatcatcaccaagcccatccccaaaagctgtagttagtaagccaccaggatttgatatttagaaacttttcccactaacaaaaaacaagcaagaataaattttaaacaaaggctgactgtaccaaggaaatggagataataaacagaaaaagactcatggacactggtgttgggagtgatggtcttagccctcagaccagactaagacaccctgcagagctgaggctgtcaggaaccacgcagagccacggaagggaaacacctgcccccgggctacaaaggccaccctctgccctctgcttactgctctggttctgccctccagacacaagcaggtccctaaagcagttgctatcctgctgacgtgctgacaccatcagatatgaacaagaatcccagttttatttttcctaataaataaatcatccatttagcaaaacgtcaacgataccaaaagctatgaaagcatccttggatttacaaagaaccctcgcttctcatttcccttattttcccatgcccaggcagagagccctctaagcccatgggaagcttaacagaagggggtggggagtggccaactgtggccagggcaagacagaaaccacatgtgcgtgaacacgtgttctacacagagccttatgtactgggccacagaataagcagagctgggcagctcctgctgccaaagtcaacatgttcaggctgcccggcctccacaggcgctttcctgaaagctgcctgcagagagaagggtggccagggcaggaggcaggatcctgaagctgcctgcagagggaggggcggccagtgcaggaggcaggttcctgaagctgcctgcagagagaagggtggccagggcagaaggcagcagcacaggggctcgggcccacgctggctgtccacacccagggccacgcctccatgacggtgccctccaccacatcccctctcgtgtgtgctggtgccaccacgggggcccagggacctttttgctctacttctctttcaaacttgcagccctgtgccagcagccagcactgccttcagaatccctgcacacagcggtgggaaaccttgactgcaccggaagaggagcaggctgccctggctgggccagacgctacacatcttgctgtcgagatggtctacatttcttccttttttctttttcttgtaatccttctgtcacctagagctggagtgcagtggtgtgatcatagctcactacaacctctgcctcccgagctcaagagatcctcctacctcaacctcctgagtaaccatgacgacaggcacacacaaccacgcctggctaatttttgtattttttggagagatggggtcttgccacgttgcccaggctggtctcgaactcctgacctcaggcaatcctcccacctcagcctcccagagtgctgggattacggccagtttacattcggaacccaccactatccccttgttgacagtaagcacatcccaaatcatttttcccaatggacaacacaaataaataattaagatccttattctagagtggggaaaaaaagagactagaattctcagcagaacttgaggaatccaatggccagtaacgaagatgcctcccagagtctcctggccatgttccatccctcccctcagccaggtactggggtgagatgcctcccagagtctcctggccgtgccccatccctcccctcagccaggtactgggctgagatgcctcccagagtctcctggccgtgccccatccctcccctcagccaggtactgggctgagatgtctcccagagtctcctggccgtgccccatccctcccctcagccagctactgggctgagatgcctcccagagtctcctggccgtgccccatccctcccctcagccaggtactgggctgagatgcctcccagagtctcctggccgtgccccatccctcccctcagccaggtactgggctgagatgcctcccagagtctcctggccgtgccccatccctcccctcagccaggtactgggctgagatgcctcccagagtctcctggccgtgccccatccctcccctcagccaggtactgggctgagatgcctcccagagtctcctggccgtgccccatccctcccctcagccaggtactggggtgctcaggccacaccggaccctccatctccttcctcctaccttcctcttcttctcaacaaaatctaagcaagttgtaaatgggccttctggtggcaatgatgtattaagacacgcagagcccttaccccatttgctacaggaacccaattacatctgggaagaaacaagcaggacaggaaaaaggtacattggtgtttttgcatccataaagttcacttcaatttaaatagaacttactgagtactcttttgctagatccaggcaaaatgtttttcaccctcagatacaaaaacatagaggaaaaaattcccttaagccagctgtaaaaaatgatggtattaaaaaaataaaacactggccccatgagaatcactgtagttaacaaaagaaatacagtaaccgcaatattataacctacaaacaaaaagccattctcagtcccccagcaggacctctccatgcctcccaggtcagcagaggacagaggacagcagaggtcacaggtcagcagaggtcccagcactcagagccggattccagctaaaagcacacatgagggaaaacagctgacagccagagctcccaatggggagctccaatgttccaaaccctcccccaggccctgggactctctgcccatcaaccagagcctggagggggagggagtaggagggggcgccgctcagccacaagtgcccattttcacatgaacaggtctaacttaaatgacacagcatcttctataagttactgcagtttaaagatgcctagccacagataattcctcagaactctaaaataaaaactgattctactaaacaatggagttatttatcttggcataattactacgcatatttttttgataataatggaagtatggtgttacctgtttctaaatcttaacaaaaacttatgttgaaaatggaagtggactgggcgcagtggctcacgcctgtaatcccagcactttgggaggctgaggtgggcagatcacgaggtcaggagaccgacaccatcctagctaacacgaggaaaccccgtctctactaaagatacaaaaaattagccgggcgtggtggcgggcacctatagtcccagctacttgggaggctgaggcaggagaatggcgtgaacccgggaggcggagcttgcagtgagccgaggtcgcaccactgcactccagcctgggcgacagccagactgtctcaaaaaaagaaaaaaataaaggaaatggaagtgaactcacagtggcacctacaaatcccttacagacctgcaaacctagtcctgtggctgtcagcagccgccaggaacccctggagcattctacggcaggacacagaaacagccgacaagctccccaggggtgagggtgccagggagactctgcactcccacaacgccctaggatgcagaggggcctgcccagaaagagcctctctctgctttcaaggccagactggggggaggcaggagggtggtaccaaaaacagcagcccttcccctccccacctccaacctggccacccagacagggaccccagcacagcaacagcaagcggagggggctcggctctggctgagctgacttccagcccagccaccaccacgggcctgcacaccctccgccacgggcctgcacaccctccaggatgccacaggcacagctgctcggactgcgcactcggggacactgaggcgcacgatcgcacctgccttacaagttcaacatttcagcaagacagaacctgattacttttccatcttaaatggagatgtcaattaaaaatgtaaaacattaagtccaagcctcttttcatatgaacaacactgcctttgttatcattaacaaaccactttcaaaacccccaatttttgggaaaggtaatttgaaagtcccatttcacagcaagcacaaatggaacacccacatgttgcaagggtcagcagtccgctgtcactcacggccacactcactgggaaccgcgtgctggggtcatcgggggtcacgcagccgcaccgcctgagaggactaacccttctgttttgccaagaaagatgtcagcttcaactacttttatactggagaaacaatttacaaactaaaattgttttaaagcctctattttcatgcagttttgtttctgtaaagtgttatttaatctccaaggaagtctttacagtagatacgaccgtgaccactgtcctgggtaggagactgaggctcggagagtggaagggaggggccagggccacagagctagcaccagtcagcccatcacacaaggctgtcggggaccctatgtcactgcggccacacctggcccaacctcagggcaggaccagcctagaatccatccaagctgggcacctaagtcacgcccagatgggagagaagagcacagcaccgtgtactgaagaagcgactgtggatctcatctcaacggctcacattccaccccaaggaatcaaagtgaaacacgggaatgacacaaataccaacatgaaaaatatcagagcacctgtaacattcttattcttctttatttgggacagggtctcaccctgcggcccaggctggagtgcagtggtgtgatcatagctcactgcagcctcaacctcctgggctcaagtgatccttcctccccgctcagcctccccaagtagctgagaccacaggcgcatgcatgccaccatgcctggctcatttttttattttttgtagagatgcggtctcgtcatgttactcaggctggtctcgcactcctgagctcaagtgatctacccaccccttcctcccaaagtgctgggattacaggtgggagccactgcacctggccagctattctttttttttttttttttttttgagatggagtctccctctgtcgcccaggctggagcgcagtggtgcgatctcggtttactgcaagctccgcctcccaggttcacgccattctcctgcctcagcctcccgagtagctgggactacaggcgcctgccaccatgcccggctaattttttgtatttttagtagagacggggtttcaccgtgttagccaggatggtcttgatctcctgacctcatgatccacccgcctcggcctcccaaagtgctgggattacaggtgtgagccactgcgcccggcaagctattctttttttaaaccctgcattttaatgccagataaaacaatggagaacaggcattcaagaccagcctggccaacacagtgaaaccctatctctactaaaaacacaaaaatcagctgggtgtggtggtgggtacctgtaatcccagctagttgggaggctgaggcaggagaaactcttgaatctgggaggtggaggttgcagtgagccgagattgcaccactacactccaggccctgcacaacaaagctagactctgtctcaaaaaaaaaaaaaaaaaaaaacaatggagaaccagcctcagtgaggtcctcaggaggccctcacatgcccatgtgggtcacggcgcctctggtcacactgcgcccaacctctgctcagcagggcctctctgtagcaacactgcagtctccctgatgggaggccacaacagacctcatgctaagggccttcctcgtattcaatctaaccaccacaggcaaacaaaagacaaaatcaatactgaggatctatagttcacaaaagtgacaaatggcattaaacaccttagattattactgtggcatggtcaaaaatgccaacatttcctatgtcatcaaacctaagtatcagtacatctattgttctcaatccactagagtgctagacatttaggccaattccaggtcctgtcagcagagttgctgatagcttgctcccctttaatcagagaagcctgtattttgaatccatcgatttttttttttccccagagacagagtcttgctctgtcgcccaggctcaagtgcggtgttgtgatcttggctcactgaaacctccgcctcccagttcaagcaacgctcctgcctcagcctcccaactagctgggatcacaggcattcgccaccacgtccggttaatatttacatttttaatagagatggggtttcaccatgttggcaggctggtctggaactcctggcctcaagtgatccacccaccttgacatctcaaagtgctgggattacaggcgtgagccactgtgcctggccactaattgctgattaataattttatttttcacactagtaagcagcattttggccaggtgtggtggctcacacctgtaatcccagcactttgggaggctgaggcaggaggattgcttgagagcaggggttcaagacaggcctggacaacgtaacaagactctgtttctacaaaaaaaaaaaaaaaattaaaaaaagaaaatgcagcattttgcttttccttgtcatacattaaggtcagcagtatccttttcacaaagaggcacagctcagaccctggggtgtggggtgctccctcatcgctgccccccttttcccatgtacctggcccctccatggcaccccttttatcacaaccaggctcagtccacctccagatcttgaaaaatgtctcacctgatcacaaacatgcccactacccaggctggcttcattctaactacaaaccatcccacagattaagagaagacaattctagacctattttcaaggatatctcagattccctttccttcaaacctcacctctatttccaaggaaagaattcagtcatatgaaagaaagcagtcaggtgtattttaaagtggcctgactccaggcgactgagataaggaacagatacaccaaactatgaagctcccgaaagaagctgcaggaaaggttctttcacgtttgctgggagtaacaacacaaaacagattatgtatttttggaatgttcactttaaaaccatgactcacacctggccaaaatatgaaaatttaatttagccaagttttctcttcaactgctgtcaatccacatatcagagaaaataacctgccagttcaccatgcgtctctggaaggagggaggactctgccctacagcgacacgtgcttgctcagagccaaggccaaagtctttttggagactgctgccgctcctctcaaaaaacatgccagtgactcccaggaggaggcaaggagtcagggctggcgaaccaggctcccactccttacctgccaaccatacacactggtctccagctcctaggaaaagccagaatagccatctagagggttcagcaacagcactatgcccagaagcacaggacagcccggcgagaccaccaggaacctaacaagagcacaacagctcccaggatacagaatcctcatccaaggacaacccagcaagaccaccaggatcctaacgagcagaacagctcccaggatacagaatcctcatccaaggacaaccaggcaagaccaccaggatcctaacgagcagaacagctcccaggatacagaatcctcacgcaaactgttaacacaacatgctcagagcacacaacacacagcacagggtgggggtctcagtcatcaccagaccatctgaggatgaagaaaattaaaggaggacaagaggaaataaacttcttttataggctattaacaacctatttaatttttcagcagatttcttctcactgtgacaccaaggatcccattcattaatccaaaaatgcttacctgttaccactctgaatacactctaagtgaaatccagaacaaaattcacaacatttcgacaaaactctatcaagtccaagaaaaccaacctggacactcacgcattattttgatacttatttttacaaatcaatgacaaaaacataaattgatagagaatgcagtgagtatttaccgattccatagctgaaagtcagtgctgacgaggactgtcttttaaatccaatggaggtgtgtcccagagcagggctgtatatattctgaaacaagagagtgagattagctcatgtcaataataatttcagcctcagttctttcatcgctctcgtctccctccatttggtccacacggtttattccatcgcccttcctctcccatgacccactgctcagctcctggtcactgtgccaaggccaaaacttaacttcattcatcaaatacctttacgtcacaatgcagcaattgcaacaacttaaaggtaaatccaaagtccagcacaaaaaagagtagatgacactgatacaatcttgtgaaatcaccataaaaccagattttagaggctctggggctttttatacgtaagaaaccaaataacccaagtgggcaatctcgccacagaaacaaaacattaccagtaagctaagtttttaaaaggccttttttttttttttggagacagagtttcactcttgtcccccaggctggagtgcagtggcgtgatctcagctcactgcaacctccacctcccctcctgggttcaagcgattctcctacctcagcctcccgagtagatgggattacaggcgctcgccacccacccccggctgatctggacctcctgacctcaggtgttccaatcacctcggccttccaaagtgttaggattacaggcgtcagccaccatgcccagccttaaaaggctaattttaactttaagaagcatattaagttttaaactacataaaaggtgcaaaaaaagataaggtggttttcatttccactgagtattttaagaggaaaagattatactgcagtaccatttttttaaaaagctgaataaagccatgcatggtggctcacgcctgtaatcccagcactttgggaggccgaggtgggcggatcacttgaggtcatgagttcaagaccagcctggccaacagggcaaaaccccgtctctactgaaaatacaaaaaattaaccaggtgtggtggcttgtacctgtaaccccaactacttgggaggctggggcaggtgaatcacttgaatctgcgaggcaaaggttgcagtgagctgagactgcaccactgcactccagcctgggtgacagagcgaaactcgtcttaaaaaaaaaaaaaaaaggcagctgaataaaactatataatttccctgaagagctctggggactccaagaataaaacaaaccagtctaaatgggggaaaaaaaatctatacccatgttacttcagtcccatccaaacatcaggctctcctccaactccaaacacttccgtgtgcagaaccagggaaggaagcacagacaggattgaaggcagctcccaggacagggcttgctggtgcagggttccccggctctgcacttagcatccgagagaatcgcgtgtttcctgagcaacactcctggcacatgcgttttgcaaagatggagtgaggtttttcctccttacactcctggaagatggagtgaggtttttcctccttacactcctggacaggattgttcaaagctgccattaacctcaaggaccattaaaaataagtgtgtgatgggtgcgctggctcacgcctgtaatcccagcacttcaggaggctgaggcaggcggattgcttgagcccagaagttggagaccagcctgggcaacacggcgagtccccatctctacaaaaaattcaaaaaattagctgggcatggtggcgtgcgcctgtagccggagctactcacaccactgcacagcagcctcaatccatcaatcaataaaaataaatgtgaatacgcagcttctagtcaccacacagcctggtttcagtgaaaagcagcaagtgtgccacgaagctttccgtaaaagagctcagagaggggaagagcatcagcagcaggaagccagcgaggaaccccagcatcgacctccagagtcctgagagcactcaaagcatcatgagtccaacgatttgcaagctcactgccactggcatttgggttcagcgcgccaacagggttgagcagcgtcggtcttctagatgccagtaaggccacccagcaaatcctggcaaccaaaaatgtctccagacgatgtccgctaaagggcaaaacacgccggtgagaactgctgctttaatgcagctgctgtttcccatgtatgaagaaactgggcccaaatcaggtgaaagtgaaaaacatcagttaaaagtgaaacaaaactcagttttctgttgtcttagggtcccacagggtatggaaagcaagttgggaagagaaaattctggtctgaaggtcttttctttctgactgacagacaatctcagtaactgatcccattatctctggaagacagtaccaatccagagcctctaaaatatttggaataaacattacagatttttcttaagagacagggtctcactgtgttgccaaggctgggaatggagtggtgcaaacacagctcactgcggcctcaacctcctgggcccaaggggtcctcccacctcagcctcccaagtaaagacattttctaaggtgtgaaaaaaagcttcatttagaatacatgttcacatcaaaaccaccaccacgactataaacaagctatgttgtcaaacagaaaagcaccaggctacacttcttactgtcagctcctgcctacagcaactcaggaatcaacaggcctgtggaggctgagtgcagacagagaccatggagacatgaagggtcagtgtgtgatgacggagtcagggagtcagggatgggaccatcacccatccatgtctgggggtggggctgagacacgaagggtcagtgtgtgatgacggagtcagggatgggaccatcacccgtccatgtctgggggtgggggtgagacacgaagggtcggtgtgtgatgacggagtcagggatgggaccatcacccgtccatgtctgggggtgggggtgagacacgaagggtcggtgtgtgatgacggagtcagggatgggaccatcacccgtccatgtctgggggtgggggtgagacacgaagggtcggtgtgtgatgacggagtcagggatgggaccatcacccgtccatgtctgggggcgggggtgagacacgaagggtcggtgtgtgatgacggagtcagggatgggaccatcacccgtccatgtctgggggtggggctgagacacgaagggtcggtgtgtggtgacggagtcagggatgggaccatcacccgtccatgtctgggggcgggggtgagacacgaagggtcggtgtgtgatgacggagtcagggatgggaccatcacccgtccatgtctgggggcgggggtgagacacgaagggtcggtgtgtgatgacggagtcagggatgggaccatcacccgtccacgtctgggggtgggggtgagacacgaagggtcggtgtgtgatgacggagtcagggatgggaccatcacccgtccatgtctgggggtgggggtgagacacgaagggtcagtgtgtgatgacaggaccactgcccatccatgtcttggggcaggggtgggggtaaccaaaaccagaatccagttaaaacaacagggagttgcttctacctatggaaatggcaacaggacaagatgataacccaggtgctaaggagtcggctacacgcattctgtgttaggaaacccaggaggtactaatggcggctctctctgaatggtggagcaatgtgaggttttaaatgctcttaccactctggactccttactctcatcaacccctttaagtgggttatttgccacgttagggatagggaaagaaaattatttaatacaatcaacgggtaaaaagttaaagttacctaagaagaaagagctctaggccaaacctataatcccagaactttaagaggccgaggtgggaggatcacttccgcacagaagctcaaggctgcagtcagttagggtggcaccactgcactccacctgggcgagcgactgagaccctaagaatatccaaaccattaaaagaatttttttacagaatttttcttttaaaaaaagcaattttaaaaaaaaggatcttggatgttatcaccaaaaagaagtggtatttgaggggatggacacagtaaccaccctggtctcatcggtaaacaaggcatccacggactgaggcatcctaccggactccactaacaggtgcgactatgggtcagtaataaacacacttttcaatatgtcaagtaataacacgatattcgcgctgacccaatcgcaccccacctctttcaacgccctgggctctcccctcgctttgttgcatgagagctgctttactcactgctctcgacgaacagtcacagccacgagcaccgtccgaaacagaatcacagcctccctgggaaggaagctgggcagacctgatgcttatttttggaaaggaacggaagttcaagattgctcatgtttttattacagtctcccttttctcccctaagagaatcacaagtttcaggagactctgactgacacaactgtattaatgtttaattcactcccactttaatcacttttttctttttttctttctttatatcaaagcacatcaataatcacttttttcaatcaggagatctacaactgcttgctaaccatagtcttcaatccgctaagatgagcaattctttctgtccacactgactaaccccaactgacagcagagaaaaaccacgaggcctgtggctgccccacaccgctgctccttcagacaaccaagggccacggtggtttcacagctgtgagctcaggcccctcagctccctcccgtgagccaccttcccaacaccctcagagcccaggagtccatgttagcaaagacaggtccctacactggccttggtctcaaaacgctgctagccagagctatgaccttatgcaaacaatgattttcattcgcgttaggctgggtgggagggtccacaggggagccactgacgatgggcatctgcccccgacactggctgactaaccagcaccattaaccctgggctccgaacggcagtcacaccagcctgtctcagggccaggtctgtcttttccctgcttcccacagaacggcccgcagtgcattcctttcatgagtacaggagcatacggatgggttttaagagactagtgcggagctgtggctttcttgacaaatactttttcagtaacttcaaatacatgcacagagaaggcatgagatgtgtggttagagttaacctgaaagcacaaggtggtgcctgcagcagcaggcactcagcacctgacccaactcaactcaaacatgtgagcccaccattactagaggtcaaaaatggtccaataaactccactcagttgttcacagctgttttattcataagcaccagaaactggaatcagcccagatgtgcttcgatggtgtaagaaaacgttttaaatggtccgttttccaggcatgataaatctacgcaatggcagccagcctgcggatgtaacaaaccgcacggctcgtgcacctagaaggtcacaataagcgaacaaaatgtagaagaggggtcagcccataaatgggaagaaagtttcagtattgggaaatcaaaacttaagcgggtaagaggacagggtacaaccttgtaagcgggtaaggggacggcgtacaacgggataatgaaactcaggcgacctccgggaagattgtaaccccatagtactcgaccagtgaggaactgggggagggacttgcattagaggagataaactacctgctgtgactgccccgggtgtacctgcctaccaggcacctgatcttgcaagactgccattaaaaatcttgcttcctggctgggcgcagtggctcacacctataatcccagcactttgagtcaggcagatcacctgaggttgggagttcgagaccagcgtggccaacatggagaaaccccgtctgtactaaaaatacaaaattagccaggcgtggtggcgcatgcctgtaatcccagctactcgggagactgaagcaggagaatcacttgaacccaggagacggaggttgcagcaagccaagatcacacctctgcactccaggctgggtgacaagagcaaaactctgtctcaaaaaaaaaaaagagagagaaagaaaaaagtctcatttctgctgttctgtgtgtctccaagcccagtctttgggtgtggacgggtgaatgtgtgtttctcaccatggataaataagctgagtccacccacaccacggagaccactcagcaacaaaacagagcgaacattacgctgagcaaaaaggccaatcgaaaaggttacatttctacgactccatttatatgacactcttatgacaaatttttcaaatggaggacaaatcagtggttctcaggggttagggaccagggtggggagatgggctggaaggggcaaatgtggctagaaaagggcaaagggccgatccttgcgattatggaactattcagcaccgcaacacggcagggacgggggcccccagtggtgaacacgcacagaactcaaatcaatcaatctctctctctaacacacacgtacaagtaaacttcaggcaacctgagtaagaccggtcagcgataccgtgtccacatcctggctgtgacgttctattaaggccacagttctccaatgtgttaccattcgaagagaggaggagactggccgaagtgtacaaagggctctcaaggatttcttacaacaaaacacaagctcaaactatttaaaaaaaaaaaaaaagtccaaaaaagaaagagtccaatattgacaatttcatatggttttatctagcaccaactcactttatcctcacaataatcccacagagtaggtatcattattatctcccctttgcacatgagaaaactgaggccctagaagtgtgagaaatttagtcaaggtcacattttaaatggtggggccaagacctgaaaccaggctggctggctccagtgcccacactcttcaccacgatcagtcttgaaactggaaatggaaaacatggacatgaatctgctattattatggcttaaaaatcttacaatgtaactttagaggacttaaagggaacactaaagacctaccatccagcctcatctcattttagttctcaatcaaaaaaagacacagccaattggattccactcccacaatggtgccaggagccccacaatcccaaggccagctggtgcagacaggtcacctatccactctgatcaaaccattctcctgacctcggtcggtctccttcgttttttcaggttgggggcggacaaggtgggccggttatttcgattttttcgggctgggggcagagaaggtgcagttatttgtttcctgtttctggtgtttcttttttaagggtggggtgctattcatttcgttttctctgatttaaagtgaaagagaaggctccagggaataaaggcaactacgcaaacttcagaactgaggtgagcctgaggaggaactagaaggaaaaccaggcttccttcttcagtgcaaatgtttctttttactacaggaaaaaacgaaacaggaaacaaaatgaatgttcccaaacaattctctttataccatttagcagaaaaaggtgcaaagtggatgaatgcagaacgagaacaagggggaacgatttcacacaaccgttcttccctttccataatgcctgccctgataggaatcaaactcctctgctaaagaacaaaagccaactatggaaggcaggagaaccttcagtcctcagaggaggcatccgactcctgccaaaaccttcccttcctcaccggatccaggggaatggcaaaaacaattcgtgtttgaaagtaaacagatacacagctataacaaaaaaaacaaaggaagctgtagatcagaaactgggaaatacctgaaaattagaggaggacaaaggcatgaaatcaaactagagaaagtgacacaaaagccaacagtgaaaacagccccaataacacacaggagaaggtggaggaaggacagtgctggactgtgcaatacctgcctccctcccgcaggaggcccggctccacaagaccccaaccagcgccggccgagttcacaagctccctgagcaacaaacaccaactccctgcgtggcttcactaaaacaagccttgaaagggaacaagaggctctgatggtcacttaaacatcacacacacacacacacacacacacacacacacacacaaatctgaaatcctgaccaatgaagacataagaccaacctttcagaaagcctaaatcaggcgcatatagatgaccaatttatttctagctcttagtaaacccacagaattccaaatcagcatcacagtctaatggcaaaactcaaaaggaaacatgaatatactgtgatctacttgtcttgagctcactgttggcctcaccattttatgatcggcgtcatggacactgggaaacagaaaagacggagaaatccgggaagcggctgtttcacttcagtgtgaagctcctactcaacaatcgcttagttatttgtgacctctcacaacactcatctgttctgtttctacaaaatgaataatccaagtggcagtagacatcaggacacctgttaccagcctgtcttttgccaagtaggaacctcagaatgagatacaactccatgaagaaccatctcttggtatgcaacaaggtcttcagtcagtcagtcaatcaattcagcagagctgcatgatacaagatcaatatacaaaagtcagctgtatcatcatcatacacaagcaatgaacaatctgaaaaagattaaggaaacatttccatttaaaacagcatcaaaaagaatatttagcaacaaatttaaccaaagaagtgtaaaacttgcaccctgtaaccacaaaacactgttgaaagaaaccgaagacctaaataagtggagggaaaaaatcccatattcatggatcaaaagacacagtgtctttacgacagcaacaccccccagggtgacctgatgattcagtgcagtaactatcagaattccaacggccttttttcaaaagtgatccaaaaatctagatggaattgtaaacctcttacatactacaacttacagaactatacaactttttcttaaaacttttttcagagtagaaaagacataattaaaatgtctaggggccggggtggtggctcacgcctgtaatcacagcactttaggaggccgaggcgggaggatcacttgatgtcaggagtttgagaccagcctggccaacatggcgaaaccccatctctacaataaatacaaaaaaattagctgggtgtggtggcacatgcctgtaatcccagctacttgggaggctgaggcaggagaactgcttgaacccaggaggcagaggttgcagtgagctgagatcgtgccactacattccagcctgggagacagagtatgcctcaaaaaaaaaaaagtctagtaatcgtatgatgccaggtttttctaaaatgattatttttaattattaagggggcaaaataaaacaagggcactgatttgacagtttttttaaactctttagtttgaaaggtttaaaattcttcaataatctagtgcctctaatcccagcactttgggaggccaaggcagatggatcacttgaggtcagcagtttgagaccagcctggccaacatggtgaaacgccatctctaataaaaatacaaaaattagccagacatggtggcgcgcgcctgtaatcccagctactcgggaggctgaggtgggagaatcacttgaacccaggaggcagaggttgcagtgagccaagatcgtgccactgcactacagcctaggcagcagagcaagactccatctcaaaaaaatagattaattaattaaaataaaattctttggccgggcacggtggttcacgcctataatcccagcactttgggaggccaaggcgggcagatcagaaggtcaggagatcgagaccatcctggccaacacggtgaaaccccgtctctactaaaaatacaaaaaaattagccaagcgtggtggcgggcgcctatagtcccagctgctggggaagctgaggcaggaaaatgttgtgaacctgggaggcggagcttgcagtgagccgagactgcgccctacactccagcctgggtgacagagcgagactacatctcaaaatgaaagaatgaatgatgaatgaatgaataaaattctgcaataaccaacataacattatttcctttaaaaatacaccactgtcataggccaggcatggtggcccatgcctgtaatcccagcactttgggaggccgaagtggatggatcacgaagtcaggagttcgagaccagcctggccaacatagtgaaaccccgtctccactaaaaatacaaaaattagccaggcatggtggcaggcgcctgtagtcccagctactcaggaggctaaggcaggagaatcacttgaacccaggaggcggagcttgcagtaagccaagatcgtgccaatgcattatagcctgggcaacagagcaagactccacctcaaaaaataaaaataaaaaaataagaatacaccactgtccctgaatgtgcactgttcttttaatttagaatgtgagcccacaatgatttgtacagcccaacatctaagatgcaatgaacagaatgtaaatgggggttggggggagggaagggactacacagcttctgagagaacagcaacgtccctgcagcgtgggattctcaactctcacgctcagacgttctagtacacagcagggactctcaactctcgcgctcagacgttctagtacacagcagggattctcaactctcacgctcagacgttctagtacacagcagggactctcaactctcacgctcagacgttctagtacacagcagggactctcaactctcacgctcagacgttctagtacacagcaggtactctcaactctcgcgctcagacgttctagtacacagcagggactctcaactctcgcgctcagacgttctagtacacagcagggactctcaactctcgcgctcagacgttctagtacacagcagggactctcaactctcgcgctcagacgttctagtacacagcagggactctcaactctcgcgctcagtcgttctagtacacagcagggactctcaactctcaggctcagacgttctagtacacagcagggactctcaactctcgcgctcagtcgttctagtacacagcagggactctcaactctcaggctcagtcgttctagtacacagcagggactctcaactctcgcgctcagtcgttctagtacacagcagggactctcaactctcacgctcagtcgttctagtacacagcagggactctcaactctcacgctcagtcgttctagtacacagcagggactctcaactctcacgctcagtcgttctagtacacagcaggtactctcaactctcgcgctcagacgttctagtacacagcagggactctcaactctcacgctcagacgttctagtacacagcaggtactctcaactctcgcgctcagacgttctagtacacagcagggactctcaactctcgcgctcagacgttctagtacacagcagggattctcaactctcacgctcagtcgttctagtacacagcagggattctcaactctcacgctcagtcgttctagtacacagcagggactctcaactctcacgctcagacgttctagtacacagcagggactctcaactctcacgctcagacgttctagtacacagcagggactctcaactctcgcgctcagtcgttctagtacatagcagggactctcaactctcaggctcagacgttctagtacacagcagggactctcaactctcgcgctcagtcgttctagtacacagcagggactctcaactctcaggctcagtcgttctagtacacagcagggactctcaactctcgcgctcagacgttctagtacacagcagggactctcaactctcacgctcagtcgttctagtacacagcagggactctcaactctcacgctcagtcgttctagtacacagcagggattctcaactctcacgctcagtcgttctagtacacagcagggactctcaactctcacgctcagtcgttctagtacacagcagggactctcaactctcacgctcagacgttctagtacacagcagggattctcaactctcacgctcagacgttctagtacacagcaggtgcgctgtcctttaacaaggacaaaggtcaacaaacgccccttggatgaatggctgattggcaggcattccacactgcaggctctgtccccgcccagcagacttgtcccctatcttgaaacactacttttccatttcattaatgcaacctgatggccggccactgtaacaaaagaaacatcaccaaaatgaattgtttctttcttaagacaaaagggagtttgctcctcacatatgaccttacgcagtttctgtctgagaatcatcatgttcgtcagccctgcctgtgctctcctcttcccactgtgcttcctcctgcatcacaaaggaaacccctgtgagcctgggaagtgggtgcgcaggcggagaaacagaaacggccactccaggctcaacctatccatcccggcctcttcctaagaccaaggcgctgctgactcaaccctgcttccagaagcctagggttaacatctgctccttcctcctgtttgcattcagtgaaatcctctcctctcccaggagtttccacataaaacctgcctctttgtttattaagaattgtttacagaactctcaagcagcaaaggcaaagtacagaagataaataagagcaagctggccggtgcgtgcgactggatggacaacatctttacccacatgtctgcatcagctctgcgttgttcaccgacaaatcccgtgtctggaagagtcctggcaggctgcacgggctggagagagagcgagctggtgagtggctgcccctcccatcaccaccactggccacaccatgatgatcacacacccaggcacacccactctgtgctctccacgcatcgcctcattcaacccccacgacagcccttaacagatgccacctctgtgtttcttgtgagaaacatggaacataactggcactcatctagcatggtctcgcagtagcactgaacctacaaaccactctcttcccaggcttccaccccaccattcccggtttctcttgtgaactttgtttccattttgtttcacttgctacatctccttcctccacctcctccctcaatgttgtcttcagccactgcaggggcactctcacctgcctctggctttaacgacgtgctgctgaatcccagctctgccaatcagagttgaacccactgaacccactgcaacaatgtccaactagagacactgtcaatcagagacaatgttcccaccttactcggctctcctcacacaggctgtgcacatacagagccctcaccccactccttcctgtatcccctgccttgctgcagggcaccactgtctaaccctccaaggcagaaaccagctgcctcctcctccctatcaaaagcccacttataaatcctgtccatttccagctcccccccatcactgtcactcctccctactgcaaccgctctgacttctagttcaagagtgtctcagtatttctttacctacatcatcataacaacttaattatctccacctccagccacacacaccatcaacttattccccacagtgctaaggggagaatttgccacatctggtcacttatttacacctcagtctggtgtgcagaagtcactgggctaacaaggaatatattcatgttgtacatcgtgatgcagtacacacacacacacacacacacacacacacacacacacacacccctggaaaataaaagcttcacaggacgaaagcttccactcctacatgggacacactccagtgtttccccaggctggcagccgctgtttgtgacctcaggacccatcgccgtggcagccgcctcccagagcccgtggcatgcactgtgttgaggggtgctgtctggctgcctccccagcctctgagcaaccgcaaacaccttccagtttaggagggtccctctccatcttcctagaatgcccttttctactgtgtccagctggcaaactcctattcattcttcaaagtcaagctcaggtcttgactttcttccttatacttctcaatattcttcaaattctctacggagatatgtattgcttttatatttttatactatgtcaccaccatacccgagaccttaccagtcacacactcacccccattcatattctatcacggtataatcttgagcccaggagttcaagaccagcctgggcaacacaatgggaccccatccctataaaaaattaaaaaatttggcatggtggtacacgcctgtggtcccagctactcagtagaatcacttgagtctctactcaggagaatcacttgagcctgtgaggtcgaggctgcagggggctttatcacagccccacactccagccatgggtgacagagaccctatctctctctctctctctctctctctctctctctctctctctctctcctctctctcacacacacacacacacacacgaaatatatggacacaggccacattatatacaagcattgccataataaaaacagctctcccttggcctctgagcattttacccttttgatccattcagcttctttagaacagatggatattcaccataagatgtagtttatggacaagagtaatttggaaatgaaaaaggaagacagtaaggaggcctccccttcaagagggtttcatgacaaggcccagttgagtggccatgactggccggatcctttggccctaacatatggatccctccaggctctttcagtctgctaacctacaagttaattagtccatttctaggaagaaagtgtccgttgtctcctctgcagactttccacttcctgacagcacaggaacctaacagcatgccaagttcagactcctttttctttgcacctcactaccaccgacaggctttcaaacatactattcagaacagagacacggcgttggccaccagtcccagctccagcaacactaaaaggcctccctaaaggagcagcaggagcgcaacagagaagaacagggttggacgtgggggctgggcacaccaccttcaccagagtaagagagaaggaacgggcttggacgcagcagggctgggcacgccaccttcacgagagtaagagagaaggaacgggcttggacgcagcagggctgggcacgccaccttcacgagagtaagagagaaggaacgggcttggacgcagcagggctgggcacgccaccttcacgagagtaagagagaagcaacgggcttggacgcggggactgggcacgccaccttctccagccccagagccccactgtggagagaaaaggggctgctctctgcctcagaatccaagaactcctgagaaaacagctacatcgacatctggtattaacatttgattgtttaaccacactataagggagaaggggacatggacactggcttctaaatacagaagtttccagctcccagctggttactctgagaagatgcccctagtgtgtcacctacagagaagggaggatgcccacctaccctgcctggcctgcaccacccactagaaataaacaacaggccccaaatgcaaacaggaccaagagaagggccatacggcagcagcaccccagtgcctccaagatgccactcacccatggtgcaccctacacacactcacctcctcaagacactatggattctgtgtgtctgggggtgaactgcaatttttttaatgttttccaagtaaatctaatttaaaaaaaaatcactgatctagcccttcctcacccaaactcccagtcatacagttgtcgaaataatgaccataaagcaattcttctctaacttgagaattctcatactcttcttctccacgcaagtcggaaagacctagtctgagaaagaaagccataaaaatgagagaatccagcgaagtcgctgcagccaggaggagcagcaccgcgcagtcctgtgcctcacccctgcccaggccacctgagccccacctgtcacagtaaggctgcagaagcatgcggctggtcagcagctaatcagcagaaggaaagctggcccgacaatccatgcctataaattccacaacagatgtctcctgaggtccaaaatctgctcttattaaagagtggcgtgtgggatgggcagagactcacacagccacaccacacacacaaggtctcaggactctagccaaggtcttctagtttgtagtggcctcatgtttgatgagcatctaataacaaagacaggaaagcactggatggagacgcggcgaggacactggctgtctggggcagccttgccctgaggaagttatgctctaactggtgagactgcaccaaggcacaagaaaacccacgacaaactgaagtgtccatgcggatggctaggtgaagcagggcgcaggcccaggtgtgaacactcaactgctgggagcccaagaccaactgatacacccacagccaccagctcttcatgagaggtgaagccagctgggcttctgggtcgggtggggacttggaaaactcttctgtctagctaaaggtctgtaaatgcaccaatcagcactctgtacaaatgcatcaatcagcgctgtctagctaaaggtttctaaactcaccaatcagcactctgtaaaaacgcaccaatcagcactctgtgtctagctaaaggtttataaactaaccaatcagcattctgtaaaaatggaccaatcagcactctgtaaaatggcccaatcagcgctctgtaaatggaccaatcagcagtacgtgggcagggccgaataagggaataaaagctggccacatgagccagcagcagcaacccactggggtccccttccatgctgtgggagctgtgttctttcactcttcacaataaatcttgctgctgctcactctttgggtctgtactacctttatgagctgtaaccctcagcgcgaaggtctgcagcttcactcctgaagtcagcgagaccacgaacccaccagaaggaaaacactccagacacatctgaaaatctgaaggaacaaactccggacacaccatctttaagaactgtgacactcaccgcgagggtccacagcttcattcttgaagtcagcgagaccgagaacccaccggaaggaaccaattccagacacattcacacgcagacgtactttcgttctgtcctgctgggagtccaagaccaactgactgtccactcaaggaacagaccaactgacgcacccacagccaccagctcttcacacacacacacacacacacacacacacacacacacacgctttcggtctgttcgctcaaggaacaggaagcctttttcacttcaacttctgcattcagttcaatgtgctggtgccgcccatcacctctaaatcaccgcaagtttcaagaacagccagttgtgtcctggagctgtgctgagcacgcccaccagcccagcaggtgctgctgagagcagagggttttgcagggtcacacattcttccaacaatatgactgcagaccccccagcaaaaggaaagattccccatttgggaaagtagactaaaattttcttctattaaaacatgataattcggccgggcacagtggctcatgcctgtaatcccagcactttaggagacggagatgggtggatcacctgaggtcaggagttcgagaccagcctggccaactcggtgaaacctatctgtactaacaatacaaaaatgagctgggcgtgatggctcagaacctgtagtcccagctacgtgggaggctgaggcacgagaattgcttaaacccaggagatggaggttacagtgagccaagatcatgccactgcactccagcctgggcaacagagtgagactcggtctcaaaaaaaaaaagataatccaagtttctcctgacagatgacattcatcaacaagagattcaagcagaaaagaccactgtctctaacagcaagtattatacaagagcctcaagcgacgtctgccttgggtgttgggacatagcaaacaggacggctgttccgcaagagcaggactgaagcaggcggaaatgaagacgcaggggcatcagccatcagagctcttcttcctggaataactattcctctaagctgctccttcagatacaaaataaaaagtaactctcaacactgacaagtcaacggaggacacgcgaaaaaccaaaaaacttttactatatttttgttttaataaagttattctaatcccctgaggtaactgtgagggaattaataactagagaactgttagagacccctgaaggttggacaatggtattgccgaagctttgtgttttgctcttcaataaacttatctactttcttaagctaactgaataaaatttaatatacatttatcaaccacatcttttaaaaagagagaaaagtaggaaactcaaagtagtttcctttaaacaaaagatggtcaaagttgatgaatttagaacatttgtccccaatatcctaaaaagtgacatacgaggaaggagatgtcacagaagaaaacgacaacacacacccaaacggcatcagcctgtgtgtgaccattttcacaacagggaagggaacgaagcgaacagatccatcactgaaagcgcagcacacaccttctaacctggaaatggagaaggaacgtccacttatgaagagggccaacaacagtggcctctcattccatgaaccaagcatgatgctaatatgctaatatgacagagaattttttaaaaagccaccaaaaaaataccaaaaagtgaaagactgtattgtttgccccaacatctgttttcttcactctaatgttcccaaaccagtgcagcaaacaggctggctcttcccgcctcccactgactcctccacacccctacttcctctctcctcattcacctcttcttctttctgctcttctgtgcctcccactctctcactgagcagcccctcacttcccagcatgccaccatctcccctgagcaaacagtcctccagagacagtcctccagagctctctccaacctgacatctctcccaagagcccactcaccagatgtccaaggggtttatgaaagccatggattcaaggctagagacgctgtccctcagaccagctctctccggctcttcctgtctggtagggaggctgtggtgccctggccactctcatttctcactggcctctgcacctcccatgcatccgctcctccgccatgcctctccactactcctaatgccactcccagctccagcaacccaccctccagggcacctcgacgctatgcccagttcaatctcctatgggtcagtgcagggcaatgcataatgcaaactaggcccgggggctgtggagttgggcagccatggttaaaatcattcttagtttcctcatctgtagaaagaaaaattcctggatacaaaatataagatgaatatacacaagtccattgtatttctagacaccaacaccaggcagagtccaccatgaaggcaagtggcagtgtcccaaggagagcccgctggccaggagggcaccgcaagcttggacacagcaggggcactggagatgggtccacgaaccgcgtgcgcagcccaggaggctggcacaactggtgtctgcatgaagactaggaacagctggcttcttatctcacaccatacacaaacatcaatttaggatacattaaaggtataaatgcaaagggcaaaagtacaaaatgtgcagaaggcgtaggaagctatctttatggccttgggatagggaacattttttttttttcaacacagagtctcactctgttgcccaggctggagtgcagtggtgcgatctcagctcactgcagcctccgcctcctgggttcaagcaattctcctgtctcacccacccgagtagctgggactactggcgtgtgctaccacatccagctaatttgtgtgtgtgtgtgcgtatttttagtagatacagggtttcactaggttgggccaggctggtcttgaacttatgacttcaggtgatccacccacctgggcctcccaaagtgctgggattacaggtatgagccaccgtgcccatccaagaaaattttctaaaaaaagacatactgggtcatgatggacagtttggaaggcattgcccccaagaaccaagcacagtcccttcgaagctaaagtattcaaatctcaagtcatcaaatgttactgcatttaggaggccgaggtgggaggactgcttgatcccagaagttcaaggccaaccagagcaacatgtgagaccgcatctctataaaaaattttaaaataaactagccaggtgtggggttgcatgcctgtgatcccagctgctggagaggctgagatgggagactgcttgagccaatgagttcgtgatcataccactgcactccagcctgaacgacagagcaagaccctgcctcaaacaaaaacagaaacaaaaacaaacaaaaattttaacctttctcttaaaaaaaacaaaaccaaaaaaaaaaaagaactgtattcttccattcatatagaagataaacatcacaatgggaaactccctctgtgtggcacgttgttcaaatccacatgcatgcacagtcccagagtcttctttcctacccgcagcactgaaggttcaaggaagtcccactgttttcagtaaactgaaaacttttttggaaaatgctgttttccagtatagacaactgaatcctaagcacaaatatataggacctctgaatatgtaaaaatttaaaagcagacaacactaaattaatgattttacttttaaggagataaaatgttccttgacttgcaatggggttacctcccaataaacccagtgtaaagtcaaaaatcctaagtcgaaccatcattaagtcagggactatctgtatacactttcagtgctaaaaactacaccaaagaaaaaacaagtgtcaaagttctccatgtaaaacagtgatccagggatatgggtgagaaaacccatctaaaatgcaatgtgatatttaggataaagctgaaacacaccacagcgcctcagcaattgaggctgtgaatacaaccacacaatcagcaaagaaaagcttgttctattcttcatctacaccactcacacacaacaccaaaggtgttctcagcacacctccatccacctcagatctattcttcatctacaccactgacacacaacaccaaaggtgttctcaacacaactccgtccccctcagaactctgtggaacgttttcattcccaatgatcaccaacagagccagctgtaagctcaactctaacactacccacagtgcagctgacctagactgatgggcggcctccggagaagtcaaagactccagctctactgcacacacccacagcaggagaggcctgtgtctctcacaggtgtggggtctgagccgcagcccactaccttaactccataatctgtgacttggctcttatgaggaagctgacaaagaatcagagactcagaggagatcacagcctttcaggactgaggtctaaaacacagaacctctagcccagtgctcacccgcaaccatttccctgcctcttcctacttctccagtcctcaaggggacaatggcagggttcacaggattcttcctccggaagaattcagtgtgctgtaattagaaatgaacattttatcaatatgttcacgtaaaatgtacatgttcccctggggggagggataaataacagtggaactaggaaaagcagaccaccagaaaatgtctcggtccagcgtggtggctcaggcctgtaatcccagaactctggaaggctgaggggggaggatcacatgaggccagaagttcagaccagcctgagcaacacactgaaacctcaactttgtaacaataaaaacagaataaaaacttagctgggcatggaggtgtgcacctgtagtcccaggcactcaggaggctgaggtgggagaattgcttgagaccaggaggtcaacactacagtgagctgtgagtaccaatgcactccaacctggatgacacgacaaaactctgtctcaaaaggagggggaggaggaggtaagagggaaaggaagaaagcataagaaaatatcaagcacaaactaagggccccaaaaaatccaactcacagcaacgtgggcagagccctggagaagccagaggacatccaggcaccacccagcaaggggctacagaaagggggccacctgcctccaagcctgccgggactgaaaataaatccatgtggcatcaacaggaacatctgtggctgtgtggcaatgcgtgtgagtgcgcatgaatcctggtgtggctggtgtgtgtcacagtcaaaacggaaagagagagcgcatcgtggtttataaaaaataagtttccttgcggccagacacagtggctcacgcctgtaatcccagcactttgggaggccgaggcgggcagatcatgaggtcaggagatcgagaccatcctggctaacaccgtgaaaccctgtctctactaaaaatacaaaaattagccgggcgtggtggtgggcgcctgtagtcccagctactcgggaggctgaggcaggaaaatggcgtgaacctgagaggcagagatcgcagtgagccaggatcgagccactgcactccagcctgggccacaaagtgagactccgtctcaaaaaaaaaaaagtttcctcgctatgcatgcgctaaaaccctctggagtgaagtcctaaaatatttaaatgaattttcattctgaagagactacagaacttctcaacacaggctctcttacacagactctattacacagacttttttaagatcttgcacatccaatgtcagaatatattccatcacccagcaacaaaagcagtcaggaaaaaaacttcagaaaaagaattattaaaaaatacgcaaacctggccgggcgcggtggctcacgcctgtaatcccagcactttgggaggccaaggcgggcggatcacgaggtcagcagatggagaccatcctggctaacatggtaaaaccccacctctactaaaaatacaaaaaattagctgggtgtggtggtgggcacctgcagtcccagctactcgggaggctgaggcaggagaatggcatgaacccaggaggcggactatgcagtgagccaagatcgtgccactgcactccagcctgggcaacagagcgagactccgcctacaaaaaaaaaaaaaaaaaaaaaaaaaacgcaaacctgactcttaaaaaattaaacataccctgcataactgaacagtgtccacaagcaggaatctctctggatggcaaggtggcagccgactatggcactcaccaaaaaggcaccttcccccatcatccatgcaaagacctttcccaaagccaccagacctccgttcaaacaactcaaatccggtctagaaattaaaaatccttgtactgaaagcaaaatcagggttagctgtgactaagatccaagaaataaactttttaaaaagtaataaacatgaattcatcagtatgaaaaaggtctgtgcacagtgagcagttggcacaccgatgcagtgcaccgagggccaaggcgaaggccgcagggggaggaggctcagcagagggaggacaccccagctgacaacgcacgcccactggtgccagtgctttggagaacatgccaggtcatgtctacgctttcctcactaaggatttaatttcagtattctacaatctaactctacactctcaaaacataattagaaacaatgttttgaatgtgatggagggatgcagtagagcttctctagaaaatgcttttgaatctgtctcagaaaaccacctgttttgtagagaccaagactcttcctccattttggctcaagctggatcctgagtaaaagacaatcccacaaacgcccctttatgcacagcttcccccacacgctgtttgtctctgtttctctctctctcaatacccctagattttaggtcaaaacaaacctgtttccaccagctggacagtatcattcaggaacggttttacgcatcaaagactcatttccagataaagctgaagctccagggaggaggcctgtgtcccacaaaggccaggtgctgacacggttagtcctttcctccccaccacccaccaggaatgttgctggaacccagacacgcacagcaaggttctgctgtttaccctgctccccggtggcaggaaggtgtgtgccctattctcactccaaccccatcacggcctggtgagcctccggcgctcctgccccttacagcacaagccggccaccacctcccacgggccctgacactgtcactcaacacctcaccacagcacccagcctctgcctctttcattagacataagcaaggatttttcctctagccaggaagtttttcaaatgtgaagtatttcatttttttcttcttatttttttgaaacagaatctcgctctgtcatccagactggagtgcaatggtgcaatcttggctcactgcgacctctgcctcccaggcccaagcaattctcctgcctcagcccccgtgtagctcggattacaggcatgcatcaccacgcccagctaatttttatattttcagtagagacagggtttcaccctgacctcaagtgatctgcccgccctggcctccaaagtgctgggattacaggtgtgagccacctcacccggcctcaaatgtgaagtatttcaaatcgaacttgttcacagtcaaggcaagcatggcatgcttgctttggccagcacatgtactaaaaattcgaacaacagagacgattaccatagcccctgtgcaatgatgacatgcaaatttgtgaagcattccatactttaaaaaaaacacacacagattgggacctgctctgcaaggcatcagatgccttccagtcagtaagagacaagagatacacagggtgctcccattcccacagcaagcaccaccctgcaccactagtattagcaccacccacatggaagggtgccagacacatacctactagctgcctgccacgcatggaaaattctttaggcaataccctccgcacccagaaggctaccagacctgttaagccttttcaaccagtttttgcaagcaagagaaatgcaattcttaagagcgggaacacccctttattacatgtaaagatacacaagctggatgaattgaataggggtgaacagtgatgacccatgaccaagatgcattaagaaacagatctgcacaggaaggtggaacaaggcccgtgagtgcagagcaagcctgctgggagggcaggggcttgtcttggaggaaagtgccaacaaagcctgtgccaactacagctgccgtgccgggccggcgtcaacaccgaaggagaggtgtgcagagacaaagcggcctgtcaggctgaacagggaggcagaaactccgcagaccaagaatacagtttccatagtaccctgtaactcaccaaggctgggacaaaggttaatgaaaagttcaaatctgaaataaataacaactcacttcggtattttacaaaaaaggtagttaagtattttttttgtgttcctgcataaaatactagtaagactcaaaacaggtagatactgatatgcaagttttaaaatcacaagcagaagaaacaacactctgtatgcccttccaggtggaaatgcagtcagcagaaaactgtctccatgagataaatgctcctgcccaaagcccactctagcaatgcttcctccctgaaccacaactctgaacaggctgccactcactgcaactccttgcacatgacagacttgctgggaagagcaggtgcgtactaaacattttctttgggctccagaaagcactaacggcctacttttgcaacggggcggtcgggggggtggagtggagggaggggggttgtgtagggtttgccatcagcgttaccctggagctagtccagccctggacttcgatatcacctgaaatccaatcatcaaactttgcccactgtttcttctccaaaagcaaggaaaagaaaagctatcatgagccccttcagggtctagcagcatacaagactgcttttagaaattctactccaggcatagtggctcacgcttgtaatcccagcactttggaaaacaggaaggaggatggcatgagcccatgagctcaagaccaggctggataacacagccagatcccgtctctgttataaataaataaataaaatgtaaaaaaaagagaaattctaccaaataaagatcaactatgatgtaacaaccaagtaaccctacagtgtgagaaatgcatgaggggcttaagctcagggaaccaccacctaaagagagaggcagagacctcagaggacatcaccacaggagcaggcaggctcccacccagacagtggcacactgccacccttgcaaacctaccacacagacccgttcagcacctgcccttgcaccacccacctggaggctcagcatccaggtgtgctggccccttgggtgagggtgcccaggcactcaccaactgaagtccccatctctccacggcaggcccacctcagaggaggcaaatgttaacggctgatttcttcccataaagctaagcccttatccatgtggcttgtttacaaaagtaaaacaggctgtttggacatggcattaaccaatgtattagtaagggaaggggagcaagctgttttctttaactaatatatataggtccaaccctagttcaaccactgctcagccgtttcgaaccactggctgagcaaattcagcctctctgaggttcaggtaaactaagaggtcatctccttggggcgtaagatgctacccctgaagcaacatcacacctctcatggacgtcactatcatcctccaccccaacctgcaaacatacctaggaccagtgccccagccccaaggagccacagaggctgaggatgatccgtcctccaaatgctcaggctactctgaagcaggaaacaaagacagcaataaccacaagcacagggacaatgtcctgcctgacacctgaattcttactctgatatctcaacatcctcttcaataaaatcaggaaataactgtatttttttaaaaaaacgattttgagcccgggcactgtggctcacgcctatagtcccagcactttgggaggctgaggcaggcagatcacctgaggtcaggagttcgagaccagcctgacccacatggagaaaccccgtctctactaaaaatacaaaattagccaggtggtgcatgcctgtaatcccagctactcaggaggctgaggcaggagaatcacttgaacccaagaggcagacattgtggtgagcggagatcgtgccattgcactctggcctgggcaacaagagcgaaactccgtctcaaaaacaaaaacaaaaaaaaaaattttttgttaaaaaaaaaaaaaaaaaaaccagcctagtatatgttcctgcctaagagaatatgaagctttgttttgttcttcagatggatccacacttagaaccaccatctttaaaaaaaaaaaactgtttaaaaaggacttccaattgcatttcatgaaggcagtgggtagaaaatccttgatcagtccctaattgggtgtgttttccatgaatgagctattgggatacagagtgtcgagaacaagaaaacagcttctaatatgaaaacagatgaggttctcctaaagcttctgtgacagctgcatctaaacagtttaacactgaggtggacgggcgcagtggctcacgcccctaatcccagcactttgggaggcccagacaggcagatcgcttgagccctggagttcgagaccagcctggtcaacatagcaaaaccccatctctacaaaaaacacaaaacttatccgggtgtggtggcaagcatctgtactcccagctgacagggaggctaagaaggaaaggtcacttaagctcaacaggcagaggtggcagtgagctgtgatcatgccactgcactccagcctgggtgacagagcgagcccccgtctcaaacaaaaacaaaaaccaaaaaaaacccacagactcaattctggctgccaggccatcaagggctgtgaagtgaagccctgagatccttgtggcaggaccctggacacacaatgacagtgccaccagccacagccatgcccagcaagcagcttcctgtccagtgagcaccaaggggcccttctcacacacagcctcccactcaaacctcgagcatccgcttctctcctcctccactctggggcacagaggctctcgccagcccccacagctgcttctccgcttgtcaccctgccacacaccctctgtccctgcagttccagggacagccgaggtgttctcactctgcaccaagtgcctcacgggccaggtcctgcttaaagcctgaatgaagcaaagcttggaaaggacccaacacaacctgccaccaactgaatgcctgccatccctccccaccctacgaagacactgcatgaaagccaccgagcacgtgactgcatgacccccacacaaagggcacgtccatcgttccaactacaaagctccacgtccaacaccagtggcctcctcacccccaatgcatatttgcaacccattagtaccaaaagtttaatcactattgctgccctgtctcctactaccccattccttgccctcattaaactcctaaagacagtggtccctagatgcctccctctcttccctatccagcgacttatcacaaacaccccaacaccctttcctctccatcagatatcactgaacctcaacaagggggcctgaggtgccaaagaaacatcacatagcacgatctagagtgtagcaaccacacagctaacacccaaatcagagggtcctcatgatcccatccatgcacccacatcccggctgtcgtccacaatcctacgaatcagagggtcctcgtgatccccatccgtgcactcacactccctgctgtggtccacaatcctacaacaatgctccactcttggcctcgtaccctaagtgtccacattccacctgttctcactcctcctacacagccacctttggccctaagaacactgcatccggacacgcaggccctcggcctcccaaagtgctgggattacaggcgtgagccaccgcgcctggcccaacatcatgtatttattacatgtaccagcatttatctaatattttcctaaaatacaataactttttctttttttttttttttttggagacaaagtctcactctgtcacccaagctggagtgcactggcacaatctcagctcactgcaacctccacttcccaggttcaagcaattgtcctgtctcagcctcccaggtagctgggactacaggcgcccaccaccacgcctggctcatttttgtatttttagtagagacagggtttcaccatattggtcaggctggtctccaactcctgacctcaggtgatccgcccaccttggcctcccaaagtgctgggattacaggcatggagagttgggccatctattctctcactgaagcagggatgactttgtcacatgcacccttgcagacactgggcaccttgcagacagtgggcaccctgcagacagtgggcaccttgcagacactgggcacaggaattcagtaagactgataggtgatgtttttagttagggagaatatatgtgcaaattatttccatgtaatataaaaagaaaaagtctcaactgtaaaatgagcataaacagtccaatggtgaaaccttttctcaaaaatctgaattgaaaggacaagttatattagtgctcaagaaaaacttctccctgatctgtcagaattcacaccatgagttccaaatcacacgaaagtactcaaagtcttggccaaagcaaacctactacagcacctaaacacaaatctccattttcttttttcttaaattagccttactactatattattaaaactctcaaaccaaaagttgaaactaaaaattgaagtattttataaaggacataagcacaaaaataccttccaaataatcttcaaatacgcctaattaaaagcaggcatttaattgcacaaatttaatgaatttaacatttaaaagtaaagttaaactgcttctgaggccttacagtaccctaaaatcattttcaaagtccaagacgagacggtgctggactagcagtcctagaaaaaccctcaccagcaccgccccgtccaccggagcgcacgtgagtcccggcatgcgggcagggcaggagagctctttctatccccacccacctctggctcactccatgagcacaagcaaagcagtgccccggacctggcatctgttcatgttttacttgcccatatcaccattgtatttagttcttggtagcagccatcaaccatcataaagcagcttcttttattctttgctacttcaaatcacacatgaaaaagaaaatgcaagaatagaaacacagaaatggaaatgggccaggtgtggtggctcacacctgtaatcccagcatgttgggaggctgaggccggaggattgcttgagcccaggaatttaagacctgcctaaccaacacagtgaaacccagtctctacaaaaaaaaaaaaaaaaagaaaaatttgcaggcatgaggaatgttggtgcatgcctgtagtcccaactacttggaggctgaggtgggaggatcactcgaggtggggtggtcgaggctacagtgagccgtgatcccaccactgcattccatcctgggtgacagaatgagaccctgtctcagaaaaaaagaaacacagacatggagagagaaggcagctatcatggggcaaatttaaaccaggatctctggaaatgcgttattttttttttaaattatacccacacaccccttccacattcttctatacttagaaagggggtgtgcaggccgggcgtggtggctcatgcctgtaatccgagcactttgggaggccgaggcaggcagatcacctgaggtcgagagttcgagaccagcctgaccaacatggagaaaccccgtctctactaaaaatacaaaattaccagggcgtggtggtacatgcctgtaatcccagctactcgggaggctgaggcaggagaatcacttgaacctgggaggtggaggttgcagtgagccgagattgtgtcactgcactccagcctgggcaacaaaagcgaaactccatctcaaaaaaaagaaaagtgtgcataccaacctggtgagctaggtaaggtgctcacatactggcaacagaaagcaggtgacatgatcaaagtcatagacaggcagagccacactgaagaatgcagtcctggctacaggtcccagctcctgcttcactgagcaccctgagggagcccttcctaagcaaggggagccctgcctaagcactggggagcactttatctcacaacaggaaaaggcattctttcccctcagtttctcagagacccagtgacttcaggatttgcaaacaattgtgttactgaatgtgtcacactctgctccagctgcagggaagaacctgagtgatgagagtacatgattctgactctgaccctgacttcctcttaacctccatacccaaatcaagacctgtgcatggagctggctcagaccggggagccagatgctgtctgaaaatatgccatcaattctttctactcacttaaaattcaagtacctaagacattcaccccccattttgtaaaaaagcaaacaaaaacataagactcagagacagaatgtaagaatacaacgaagtatacctggctggaagaacagcttttacagtgacagcaacaccctaatgggccctcaagacaaacttgtgcctccctccgacggtgtacaaggagttaggactttcctgtgaccctcaacaaatacttgcaagtataaagttcgttttaacttctagacccgctttgttttagtactgattgcagaagagggctgacaatcccaagctctaagcctttcttgtgattatcattcccaaattctctttcgctatgcatacattcctaaactcctactttctccaaattctcaaaacattctattttacagagagagacagggtctcactatggtgtccaggctggtctctaactcctcgcctcaagcaatcctcctaccccagcctccaaaactggcgggattacaggcgtgagccaccatgcctggcctgtcaagacattctaaattctattttgttcaatttaatatcacacagaaactaaatatgccttccatcagccatgaaaatgactaatgaaaatgtaaatgaccacgtggcccaatcctggtttccatgggaagaccagctggctcaccacccagctaagagttatggcctaaatcagaggtgatcggggtgatcagaggtgagcaaagcactgtttctgtaaagttttagttttattggaacacagccatacacagccatgcttttgcttcaatggcaaagttaagtagtttcaacagagaaacctatggctggcaaagttctttaccacttggtcctctgtagaaaaagtttgccaatgcctggcctatgtcagaattctaactacatctctacagactagcctaacaagtgggtcaagtgctaatagttttaagggtgtttcgggtttttgttttaaaagttaattatctgtaaagacaaatcaatggagacagatagtagattagtggctgcctggggtgtgaacagattaactgtgaattgacaggagggatcttactgaagtgccaaaaattttctaaaattggattatggtgatgatttcacaaattacttttttttttttttttttgagacgaagcctcactctgaggcccaggcaggagtgcagttgtgtgatctcagctcactgcagactccgcctcccgagttttcaagcaatcctcacacctcagcctcccaagtagctaagattactaaaggcacatgccatcaagactggttaatttttgtatttttagtagagacagaatttcgcagtgttggccaggctggtctcaaactcctgacctcaggtgatctgcaagcctcggcctcccaaagtgctgggattacaggctagagccaccgcacctggcccatttcacaaattacttttagtaagcaaacttaactaaaaatcactgaacggcatacttacaatgcatcaatttatgacggaaaaagtatttcagtgaatcttaaaaactgaaaaagaaaagtcaactatctgtataattgtactttggtaatctaagacctaaagtttagggtacaagctgaaataaaatcctaaaaaatctttaaaacatgtgtctagacgttcaaaatttaacctctggtatcaaatagctcatttgcgccgggtgcagtgtctcacgtctataatcccagaactttgggaggccgaggcaggtggatcacctgacctcaggagttcaagaccagcctggacaacacggtgaaaccccatctctactaaaatacaaaaattaaccaggcatggtggcacacgcctataatcccagctactcgggaggctgcagcaggagaatcgcttgaacctgggaggtggaggttgcagtaagccgagatcacaccactgcactccagcctgggcaacagagtgagactctgtctcaaaataaaacaaaaaaaactcatttgcaatttagagacaggaattacagccaagtgcaccccttaccccactcccctggagccacaagccaagagggcaaggtagggaggaccaaccatgcctggtgtcctgccaccaatggctccaggaaccccaagttctctcccacaccctgggcgtgattaaaactagtaacacctttctgttagaaaccacagcgggtgaggacacagctgtttactttttttttaatcaagaatgctgctctcagcactctgggaggctgaggcgggtggatcacctgaggtcaagagattgagaccagcctggccaacatggtgaaacctcatctctactaaaaatacaaaaattagccgagtgtggtggcgggagcctgtaatctcagctcaggaggctgaggcaggaggcaggaaaatctccagacctgggaggcagaggttgcagtgagcagagatcatgccattgcactccagcctaggcaacagagagagactctatctcaaaaaaaaaaaaaaaaaaaaaagaatactttgatggtatctttgaaagttaagaggtcctattcccctcactacttttagattcttgttttcacatggtcttcttgaaagaaactgcacacgcccgctttttcatacaatcacacatgcgtggataaacacataccatcttttattttattttctaaatagagacagggcctccttatgttgcccaggctggtgtcaaactcctgggctcaaacaatcctcctgactcggcctcccaaagtgctgggatgacagatgtaagccaccacgcccggctgcacagaacatctgaagcacatttcttttttgttgttgttgttgccgttttcataatagtatttaacaagataaatatcttggctcctttttgtttttattgccctgcccttcagggattaagtgcatttcttagatactcactacttctctgacattaaattttgtttcagttgcttacatcaacgtttcaaaacccagaaataagaaaattattgttcgaggtcaataaccatgtttataacaacttccaacttaaaatggaagaggaatcccttggagaacacacatttccttatggaagtttcctcaaaatttctaataggaatttcaactaagttaaagtactaatttaagtaggacaagacagaattctcttccttcccagacactattacaagccaaaccacgtttcacaggaacacgtcctgcctgctaaggtgtcccctaggacaaagctgcttgccagctgaccatcacttgtattgcatactttaaaaagtgtggctaacagaaaggaggcaagacagatgttatttaaataaaagcacaaagcatctgttcaagcacgaaaaaacatatgggaaaatacaagcacaggacactcaggacaatgtgatgtgctgaagacacagcggcaaacaaaagagaccggatgccactgacctgtccaagaagaagaacaggaagtattacatgaaggagaacaggaagtaaaacatgactggagacagaacttgtgaattcgaggcaggactctggagccagcctgcccagggtccagtgctggcgtccactcccaacttctaacttccctgggcaagtggcccaacttccttgtgcctcaactgacttatctctgccacaaggggcagaggagcacccgcacctcgggagttcccaagactgtctgagtggacctacatggagcacacagaagagcacccggcaggtagtacatgtttcacaataatccttccacaatgcaaatgacatacactctaaactcatcatgggggagtgcttcacaacaccccctggcacaccacagccaacacaaccacagccaacacaacgacagccgcgccacaaccaagagagcctgaagagctgctctcagtcactgcccagcaagtgtgggcagctgtagcttacagaccaaggccacagaccacaacttctgcaggcttgcctgggacacaggggcagataaggagagcacctgaggcctacgctgagtcccacagcaaggatccgacccacatgggcacagaagacttctactgcaggttgcaaatcttacatccttgacctagtgggtaaaaaaaccctaagaaaaggcaactttctaaaacaatcatactacactcatataagcaattaatttttaataagcactgctcatatattaatgccaattttctccttcacaaattataactctgtcttaaaccaagccactatgaaagcggctctaggccagactctcagcagctaccactgctacggttcctcaagctgctcccctgggtgcttccagggttcctcaagctgctcccctgggtgcttccagggttcctcaagctgctcccctgggtgcttccagggttcctcaagctgctcccctgggtgcttccagggttcctcaagctgctcccctgggtgcttctagggttcctcaagctgctcccctgggtgcttctagggttcctcaagctgctcccctgggtgcttccagggttcctcaagctgctcccctgggtgtttctagggttcctcaagctgctcccctgggtgcttctagggttcctcaagctgctcccctgggtgctgttagggttcctcaagctgctcccctgagtgtttctagggttcctcaagctgctcccctgggtgcttctagggttcctcaagctgctcccctgggtgctgttagggttcctcaagctgctcccctgggtgcttctagcgttcctcaagctgctcccctgggtgcttctagggttcctcaagctgctcccctgggtgcttctagggttcctcaagctgctcccctgggtgctgttagggttcctcaagctgctcccctgggtgcttctagcattcctcaagctgcttccctgggtgcttctagggttcctcaagctgctcccctgggtgctgttaggcttcctcaagctgctcccctgggtgcttctagcgttcctcaagctgcttccctgggtgcttctagggttcctcaagctgctcccatgggtgctgttagggttcctcatgctatctccccttaagtgctgtggcagcagtgcagagcccacatagctatataagctactcagtaagaaaaaccacacaggagctacacgcaccacatcatggacaaacctcaaaacacaccaggtggggatgtcactgaaaacagccccaaaactcactccttccaacactgcatgagtaagctgcaaaaactgtcagaatcaactcttcagaactgtggagtctaataaaaaacttctaacaagcagagaacgcctaatgaaaaagctgctcgatttgggcaggagagagctgtggagaggaacttacctgctcacacacctcatccttggagacagcagcccccattgctggtacaaaagagtgccgcagactcaattctcaaagaattggggctgtacattttgacctatctggtaggaatgtaaaatggtgcagctgttgttgaaatactttggcaattcctcaaaaggtaaacacagaactatgatataacacagcaattccactccttggtatatgcccaaaaagtgttcaaatggaaacctgtgcacacatgctcacagcactattgaaaacagaaaggtggaaacaggtagggcgtggtggctcacacctctaatcccagcacttttgagaggctgaagctggccaatcacctgaggtcaggagtttgagaccagcctggccaacatgctgaaatcctgtctctactgaaaaatacaaaaagtagtctggtgtggtggcgtgcacctgtagtcccagctacccgggaggctaaggcaggagaatcatttgaacccaggaggcggatgttgcagtgaaccgagattgtgccactatactccagcctgggcaacagaacaagattcggtcccaaaaaaaaaagggggggtggaaacgggggccaggcaagctggctcatgcctgtaatcccagcacttcgggagggcaagacaggcagaccacttgaggtcaggagttcgagaccagcctaaccaacatggaaaaaccctgtctctactaaaaatagaaaattagccgagcgtggtggcatgtgccagtaatgccagctactcgggaggctgaggcaggagaatcacttgaacccgggaggcggaggttgcagcaagccgagatcacgccactccaggctgggtgacagagcaagactccgtttcaaaaaaaaaaaaaaaagatggaaacaagccaagtgtcaatcaagacaggatgggtaaacaccctgcctacacccagacaatgcagcattattcacaagtaaacaggaatacagttccaagacatacaacatagatggactccaaaaacacgttatgtgaaagaagccggacactaaaggccatatattatatgaactcattcctaggaagtctccaaaatagacagatccacagtggcacagagtcaacagtggctgaagagctgcggagaagtggagcgcttccttcggggggaacagaaatatcctggaatagacataatggtgctagttgcacaaagttgtaaatgtgctacaggccatggaattgtacacattcaaatggtcagagtggtggggtgttcgttatgtgagtcttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagtcttacctcaataaaattaaagtagtatgtcagactcaaaagactacaaattccaggccaggcgcagtggctcacgcctgtaatctcagcactttgggaggatgaggtgggcagatcatgcggtcaggagttcaagaccagcccagtcaatatggtaaaaccctgtctctacttgaaaatacaaaaattagccaggcgtggtggtgggcacccgtaatcccagctactcgggaggctagggcagaagaatcacttgaacccgggaggcggaggctgcagtgagctgagatcgcgccactgcactccagcaaggctccgtctcaagaaaaaaaaaaaaaaagactacaaattccattcatatgaaattctaaaataagcaaaactaatccacaataacagaaagtgggctggcagtgcttggggcagtggagggttctggttacaaatgggcattctgcggtgatggaaatgtctgtgtcaagctggtgcttaatacctggggtatcaaaactgtcaaactcatcctactgtaccttctaaaatggctgcttttattatataaagtatacaggtataaacatcactgaagaaatccaggtacatgtgaaacacacaagtgtggagctgaatggagccacgcgaaccaatacacaatcgtcagattcagacccagaccccagctgagacggcacctcgcaatgacttgctcccaaagaaagatgttctggccagagccctggagaccccacacctggggactggagaccgcagccatccacctgcaactctgttctcagacacctctgctgtgcggtggccccaggaaagcagtgacacaaaaagaaaaaaaaaagctttctgaaacggtgctttagaggtttaaccaaaataaaactcaaccaattttcttcaaaacataaactcctgttcttgttgtactttagcacttgctttacgtaatttcatttcttttttttttttgagacggaatctcactgtgtcacccaggttggagtgcagtggcgcgatctccgctcactgcaagctccgcctcccgggttcaggccattctcctgcctcagcctcctgagtagctgggactacaggcgcccgccaccacgcccggctaattttttgtatttttagtagagacggggtttcaccatgttagccaggatggtctcgatctcctgacctcgtgatccgcccatctcggcctcccaaagtgctgggattacaggcgtgagccaccgtgcccggccacgtaatttcatttcttaggaataacattttacattaaagaaaatactttgccacgctttcactcatgattttgcagttccactggaaggctgaacatcactctggcaagttcagacatgttccattaatcatctccaaggctgcttgctacaaagaagctgtttcattcaacagcatctccttaaacaaaatccaagcctgctttgcctttggtaaccaaaacttgatttaacctcccaaagagggagccagcctgctgctggccactgcgtgccctaggcctcagcttcctgctgctgactggctgcctgcatctcctctgcggccccggcctcatgaagctgcccactggtcctgtggttcctcaggggtcctggcactggcaaggggacgcagcaaacccacaccgtcgtgaccctggtcacatacacctgtcttcaggaaaacttctctgtgatgaaagaacccagattcacagtggtgaactcttcaaaaactatactaaacaagggaagactgtgctagatgaaataaccatacatgcatttattcacatgggaaatggatcagacaatggctgccaatgctaagaataaattcttgatgagtttctaagaaatcaagacaaccttcaaggttgggccaagagcatggatgggaaaggcagatgtgcatctggttctgttttctgaccataataatgagatctacatgaaaggatgtcttgagaggagggaacagtggtaagagtgaagccagcagagagagcttggaaaagagaattcagacccatcttcaagttaacaaaaacaattactgactcatacgaagaaatcgggaaagtcaataaaacggatgcttctaaacctgttgatgaagtttttctgaagttgtgaaaatttccaacaaaaaagactaactctaagcctgaaagtatcctttcctttctttttgagccacgacacccggcctcttacaagttttttatttccaaccttaagtgaatttgtggaccaaatttcaaaacaactttttgtgaattcagttcctgcataatatgtttggtaaacaactaaaaaactgattcctagtactgtttcagtatttatcaaacaactgatcgtgttctataaaaaggtttaaaaaaataaaattcaggaacagtggcccatgcttgtaatcccagcacactgggaagcctaggcaagaggatttcttgaggcgtctgagaccagccccatgtctacaaacaataaaaaagtagctgggcatggtggtcgtgcctgcagtcccagctattcaggaggctgagcctggaggatcgcttgagcccaggaagtcgagattgcagtgagccaatttcgtgtcactgcactccatcctgggtgaccaagcaagaccctgtatccaaaaaaaaagaaaaaaaaaaggccaggtgcggtggctcacacctgtaatcccagcactttgagaggctgaggtaggtggatcatttgaggtccggagtttgagaccagcctacccaacatggtgaaactccgtctctactaaaaatacaaaagaattagctgggcgtggtggtgtgcgcctgtaatcccagctactcgggaggctgaggcaggagaatcatttgaacctgggaggccgagattgcagtgagctgagattgcgccactgcactccagcctgggcaacagactaagacaccgtctcaaaaacaacaagaacaaaaaacattaaaaaataaaattaaaattaaaaaataaaaatcacatgctttggtcataaaaataataagtgtatcctataaatgtcctgaggtcaggagttcaagaccagcctggccaatatggcaaaaccccgtctccactaaaaatacaaaaaattagccgggcgtggtgccaggtgcctgtaatcccagctactcaggaggctgaagcaggaaaattgcttgaacttgggaggtgggggatgcagtgagccaagatagtgccattgcactccagccttggtgacagagcgagattctgtctcaaaaacaaaacaaaacaaaaattaaatttgacactgggcacagcagctcacgcatgtaatctcagcactatggaaggttgaagcaggcgggttgtttgagcccaggaggtcgaggctatagtgatccacgatcacaccactgcactccagcccgagcaagacagcaagactctgtctcaaaaataagtaaacaaaaattgaatttgacctgcagggggtagtcacaattgaggaatctgagctgtggggcaaactgttcaaatgaagattctgacccacaggaacaaactgatccaaaagggaaatatgccagtcacgaaaggacaaatattgtatgaccccccaccccttacaggagaggtgccttggacagtgacattcataagagaagaaaggacaaatatcgtatgacccccccccccaacaggagacgcaccttgagtggtgacattcataacagaagaaaggacaaatatcgtatgaccacccccccgcaggagacgcaccttgagtggtgacattcataagagaagaaaggacaaatatcgtatgaccccctcccataggagacgcaccttgagtggtgacattcataagagaagaaaggacaaatatcgtatgaccccccccccccccttataggagaggtgccttgagtggtgacattcataagagaaagcagattggtggtcaggggttatggggagagtcgaggttatggggagagggatgaagagttagtgttaatgggtagccggtgtcgtctgggaagaccaagttctggagagggatggtggtgatggctttgcaccgtgtgaatctaataccagagaactgcacactcaaaaatggtacaaatggtcaattttatactgctgggctcagggaatccttcccctcagcctcctgaggagctgggaccacaggcacctgccaccacgcctggctaacttttgtattttttgtagaaacagggtatcttcatttgcccaggctggtctcaaacgcctgtgctcacgttatctgcttccctcggcctccgaaagtgctgagactacaggcgtgagccaccacaccccacttaataattccattttaataccgatttactaaacaaggaaaagctcatagaattactaactatgccatcttatttaggctacctaaattctctgaacttcatcttctaaataaataagaagaaatgtatcttttaacactaataactatggtcattcccattaaaacattaagttttgaaaactagggttctcatttaagcctgtctcacagcagctcagctctcagaatgttcagaagactctgacactgccctctcccctcctctggcactcattttggaaacctgcagagcatctattgaaaaagcccatcccagcatcttcttaatcactggtatacttccgtctgtcacgagcttcatttaaaaaaagcgtcacgctccctctccctccccctctccctctccccctctccctctccctctctccctctccctctccccatggtctccctctccctctctttccacggtctccctctcatgctgagtcgaagctggactgtactgctgccatctcggctcactgcaacccccctgcctgattctcctgactcagcctgccgagtgcctgcgattgcaggctcacgccgccacgcctgactggttttggtggagacggggtttcgctgtgttggccaggccggtctccagcccctaaccgcaagtgatccgccagcctcggcctcccgaggtgccgggattgcagacggagtctcgttcactcagtgctcaatggtgcccaggctggagtgcagtggcatgatctcggctcgctacaacctccacctcccagccgcctgccttggcctcccaaagtgccgagactgcaacctctgcccggccgccaccccgtctgggaagtgaggagcgtctctgcctggccgcccatcatctgggatgtgaggagcccctctgcctggctgcccagtctggaaagtgaggagcgtctccgcccagccgccatcccacttaggaagtgaggagcacctcttcccggccgccatcacatctaggaagtgaggagcgtctctgcccggccgcccatcgtctgagatgtggggagcgcctctgccccgccgccccgtctgggatgtgaggagcacctctgcccggccaccccgtctgacaagtgagaagaccctctgcccggcaaccaccccgtctgagaagtgaggagcccctccgcccggcagccaccccgtctgggaagtgaggagcgtctccgcccagcagccgccccatccgggagggaggtgagggggtcagccccccgcccagctgccccgtccgggagggaggtggaggtggggggggtcagcccccccgccaggccagccgccccgtccgggagggaggtgggggggtcagccccccgccaggccagccgccccatccgggagggaggtgggggggtcagcccccccgcccggccagccgccccgcccgggaggtgaggggcgcctctgcccggccgcccctactgggaagtgaggagcccctctgcccggccaccaccccgtctgggaggtgtgcccaacagctcattgagaacgggccatgatgacagtggcggttttgtggaatagaaagcggggaaaggtggggaaaagattgagaaatcggatggttgccgtgtctgtgtagaaagaagtagacatgggagacttttcattttgttctgtactaagaaaacttctgccttgggatcctgttgatctgtgaccttgcccccaaccctgtgctctctgaaacatgtgctgtgtccactcagggttaaatggattaagggcggtgcaagatgtgctttgttaaacagacggttgaaggcagcatactcgttaagagtcatcaccactccctaatctcaagtacccagggacacaaacactgcggaaggccgcagggtcctctgcctaggaaaaccagagacctttgttcacttgtttatttgctgaccttccctccactattgtcctatgaccctgccaaatccccctctatgagaaacacccaagaattatcaataaaaaataaataaattaaaaaaaaaaaaagcctcacactggataagtgtttttcaataatttcaacgtagtattccacagcaaattgtctagttcacatttaattcaaaattaattccctacgttaccacacaagcaatagactgttaagtttaatgctcccatggctttctacttatgcaaaaaattaacttcttcaaaacacctatggtggaagttcttcctgttcagactgcaattctatttacaaaaaacaatagtactgtagtactattagaccacaacgctaacgccaggcacagtggttcacacctgtaatcccaacattttgggagggtgaggtgggcggatcacttgaggtcaggagttaaagaccagcctggccaacatggtgaaaccccgtctctactaaaaatacaaaaattaatcaggcatggtggcgggcgcctgtagtcccagctactcgggaggctgagacacgagaatcacttgaacctgggaggtggaggctgtagcgagcgaagatcgcaccactgcactccagcctgggtgacagaacgagactccatctcaaaagaaaaaaaaagatcacaatggtggaatctaaccctcttatctaaaatttcttaaagtaacaaacattttgaaaagaataaatctggcagagcgtggtggctcacgcctgtaatcccagcactttgggaggccgaggcaggcagatcacgaggtcaggagttcaagaccagccaggccaacatggtgaaacctcatctctactaaaaatacaaaaaattagctgggcgtggggtcagacacctgtaatcccagctactcaggaggctgaggcacgagaatcgcttgaacctgggaggtggaggctgtagtgagccaagatcgcaacactgcactccagcctgggcgacagagtgagactccatcttaaaaaaaaaaaaaaaagaaaagaaaagaaaaagaaaaaaagaaaagaataaatctgtaacagcactggaaaacagaagaatgacatgtcaatagttgaccagaattaagcacctaaattaacagaaagtaaatgaaatcagacaaataacttaagtttagagaaaacagagaccaaactctacagaaggaagaagccgcagagatcaaactctacagaaagtcaggaccactgcagaggaaaagcaagcttcaaggatgaaaaaccaataaagctacacagttccaagttcatctactatgattactatgatggggaaaccacctgggggtcaggggccgaatctggcccaatgtcttttttagacagtccacaggctaagaatgaggtttatatttatacctggttgaaaaagaaaataacattttgtggtaagtgaaaattatatgaaattctaatttcagtgttagtaatagttgtaactggaaaacagccaggctcgttttaagtgtggccccggttccttccatgatacaacagcagagctgaagagctgtcagagaacatgcggccacaaggtctaactggcccttgacagaaaaactgagatggagttaaaaagacaagtctgcatattaaaagagcttcaagatgctaaccaatataaaaaagtcacaatctaaaccctaaaaatagcaaaatgtcagactcccacatatcaacagaaaatcctacaagtttccacaaaatcctaaaaagcttaactaaaaaagaatcatgaattagactggcgttggacttctctcatctttacagcagaggccacgacagagaacaggggcagcacactcttgccgtgaagagcagacagtccatcgaggcctttctgtgccacaccgcccgcccgcacacatccgcggaaagcctgctttcagctgctcagcaggtgggaacacttgctcctccagcattccaccatgagacaaaggaaaaagtcgcttctgtgtgtccaccagcacacgactcccatgtactcctgcacgtcacgtggacgagctaaagaagactcctctgctccacagccaccatcacactttcttgtttttgttattttttgagacggagtcggagtctcgctctgtcgcccaggctggagtgcagtgacacgatctcagctaactgcaagctccacctcctgagttcacgccattctcctgcctcagcctcccgagtagctgggactgcaggcgcccgccaccatgcccggctaattttttgtatttttagtagagatggggtttcaccgtgttagccaggatggtcttgatctcctgacctcatgatctgcccgcctcggcctcccaaagtgctggaattacaggcgtgagccaccgcgcctggccaccatcacactttctaaaaggtcagggtgccaatcacaacagggaccagtaaaaggagattgtgtcataaactcaacaagctgcccagaaaaagatgctggcagaacctgctgcactggccgtgggctcaggcacaccaggtaaacaccagagcgcatgcagcccaccccctacaagcaacgagcccccacctgctgacagttcaattctctgaagaagaaatgatgatcttatttatctaaaacccaaaagacttaattctcatttatgggaaacattcacaataggcaaatccagagagatagaaaagagagtaccagttgtcagggaaagggggaagggggacaaggactgatgacacaggggaccgcatgaggatggaaacttgctggaatgtgacagtggtgatgggtgcacaatataatgaatatactaaaaatcactaaactgtgagctgtaaatggtaaattttgtattctgtgaaccagatctcgttcatttttcaaaagaaagtcatcacccaacggggtaaaattcctaatgcctggcatccaacaaaatcactaggcaaagaaggaaaaaatacaagcctcagaaaacgacgattagtgctcaaaaaaacacaaatacaaaccataatgaggttaaaagaaataaaccaacatagaattgaaacaggtgttaaaattagtagacaaagacattaaaagctgttgaactgtattccacatgttcgacatggaaaatataaaaaagacaactcggtagcagcaaacaaaagatgcaaagagccaagtgtgggcggcaggggccctcccgcaactcgggcatgttcgagagtttttagagctccatcttcagctcctgctcccttccctggaggtcagtggccggagatgaaagccctagccctctaataatcatctggtcttcctggtgaccacccctaccctgtcagttcattagcttaaactctggtgtgatctgaaaggagctagttatgaataacaaatgacatcctatcatataagaaattccaatggttgcaggaactctgtgccaggagtgagaaggcgcagggagaaaaagaccacataatcttttattgaccaaagttgccaaacccacaagctgcaatcaggccaggagcggcggctcatgtctataatcccagaacctggggaggccacagcaggtggatcgcttgagcccaggagtttgagatgggccagggcaacatggctaaaccccatctctacaaaaaaaaaaaacagaaagattagctggctgggtatggtggcacgcacctgtagtctcagctatttgagaggctgaggtgggaaaactgcctgagcccaggaagttgaggctgcagtgagctgtgatggcaacactgcactccagcctggaccacagagtaagaccttgtctctaaaaagaaaccctgggctcaagtggccatccagcctcagcctcccaagtagctgggactacaggcacatgctatcacacccagctaagttttatttttatttttgtagagacggggtcttgctatgctgcccaggctggtcttgagctcctggtctcaagtgatcccccgccttggcctctcaaagtgctgagactacaggcgttgcatctgaccctgtatcactcttcaacacgcaggatgcactgcacagctgatcccaaatgctgttgtgaatctaatcaagataccgtaagacatactgcatatgtttttaaaaatcagataagacgactgggtgacttgctacccacagtgttttgttttgtttgtttgttgagacaatgtctcgctctgttgcccgggctcaagtggagtggcgtgatctcagctcactgcaacctctgcctcccgggttcaagtgtttctcttgcctcagcctcccgagtagctgggactacagatgcgcaccaccatacccaggtaagtttttttgtatttttagtagagacggggtttggttatgttggccaggctggtcttgaactcctggcctcaagtgatctgcccacctcggcctcccaaagtgctgggattacaggtgtgagccaccacgcccagactgcagtctttatcactttatgacactgtaatcatgaacttggaaagaagggtctattaacttagtgttaacttgaaaaggaaaaccaaagcagaaatctaaacaattatttggatgactacagcaaaactaagaggatttgggtttaagttgttgtagtagctatgccacatggcacagactctatcaccttctcacccacacctgcaacgtgagtgcagctcctccaatcatgaggtcggggggaaagtctattttgcaccccttgaacccagtctcactcaccgatttgctgttaccaacagaatgaagcaaaagttggccaggtgcaatggctcacacttgtaatcccaggactttgggaggctgagacaggtggatcacttgaggccagaagtttaagactggcctggccaacatgtcgaaatcctgtctctactaaaaatacaaaaattagccgagcgcggtggcacaggcctgtaatgttagctactcaggaggctgaggctggagaattgcttgggaacctgggaggcagaggttgcagtgagccgagatcgcgccactgcactccagcctgggcaacagagtaagacgctatctcaaaaaaaaagaaggacgaagcaaaagtgaagccatgtggcccctgcttctgctgccctactgttcttggcagccccaatggccagcctgctggatgttgaaacgtacagggctcagctgacaccctgccagccaatgtatcctacaggaagaatgatacactgtcaccaagtgggtttaacccaggaatacatgattggttaaacgttcaaaaaacaaaaccaaatgataaataaatgtaaaagaaaactataaaattcaatgtccattcctgatacttagcaaacttgtaatagaagggaacttcctcaacctcataaagtgcctttatgaaatcccacagcaaacatcatggttaatggtgaaaaagtggacacttttcaattaccatcagaaataagcctgtgtcagagcctgcagtgagccaccactgcactgcacttcagcttgggccacagggcgaggctctgtttcaaaaaaaaaaagaggaaaaaaaagaaataagcctgtgatatccactcttttttttcttttgagatggagtctcactctgtcgcccaggctagagtgctgtagcgcaatcttggctcactgcaacctctgcctcccaggttcaagagattctccagcctctgcctcctgagcagctgggaatagaggcaaacactgccacgtccagctaatttttttgcatttcagtaaagatagggtttcactgtgttgcccaggatggtgtcaaactcctaacctcaggtgatccacccaccttggcctcccgaagtgctagaattacaggcgtgagccaccgcacctggttgatctccactcatcacttcttttgaacaccgtactggagattctagtccaagagaaaggagataaaacgtacgcaaataagaaaggaaaaagtaggccaggcgcggtggctcacacctgtaattccagcactttgggaggctgaggcgggcggatcacgaggtcaggagatggagaccatcctggctaacacggtgaaaccccgtctctactaaaaatgcaaaaaaaatagctgggcgtggtggcgggcgcctgtagtcccagctactcgggaggctgaggcaggagaatggcgtgaacccgggagcggcagttgcagggagccaagatcgcgcccggagacagagtgaggctccgtttcagaaaaacaaagtcagttgtactttttccttttcttttgtttttgacggagctcactctgtcgctcaggctggagcgcagtggtgcgatctcggctcattgcaacctccacttcccgggttcacgccactctcctacctcagcctctcgagtagctgggactacaggcgcccgccaccacgcccggctaatttttttgtatttttagtagagacggggtttcaccgtgttagccaggatggtctccgtgtcctgaacttgtgatctgcctgccccggcctcccaaagcgctgggattacaggcgtgagtcaccatgcctataatgtcaccggcctataatcccaattcttacaagaaaaccaaaagcgaggaaaaatgaagtaacttactcatggtcatagcttatcactaagattcaaaccctttctacaaatcctgccctgtagaaaaagcgctgaaatgggatgcactattaggacaggcacacaaggggaaacacacccctcagatgacagtgaggagcttatccaggtccaggtcaacgcaggtcagtctgaggagaggcagccatgggtgttttgtgtacagactaaacgtaggtagggaatactggttaacaccatagactgagaaaggagggtaaatactaaagtattagtctctaagaaatctcatgaaagcagccaggtgcgatggctcacgcctctaatcccagcactttgggaggcaaaggcaggtagatcacaaggtcaggagatcgagaccatcctggctaacatggcgaaacccagtctctactaaaaatacaaaaaattagccgggcgtggccgggcgcggtggctcatgcctgtaatcccagcactttggtagtaccaggcgggtggatcacaaggtcaggagatcaagactatcctggctaacacggtgaaaccccgtctctactaaaaaatacaaaaaaaaattagctgggcacggtggcggacatttgtagtcccagttactcgggaggctgaggcaggagagtggtgtgaacctgggaggcggagcttgcagtgagctgagatcatgccactgcactccagcctgggcgacagagcgagactctgtctcagaaaaaaaaggaaatctcatgaaagcatgggagccaaagccttccttcctacatcctcaatttaaaagcatgactgaggctgggcgcagtggctcactcctgtaatcccagcactctgggaggccaaggcaggaggatcatttgagctcagaagctggagatcagcctgacagcagagtgagaccccacctctgttttaaaagtaaaaaaaaataaataaataaaactaaagcactattgaccctccaaactagttactatctggaaattctagcgatttccaaatcacagctttcgaggaactgtgtgcaaaacctaaaagcctgctgccccgaagtcctgtgtggagtggtgctctcaccactcaggaattcacgagacggcaagaactcatcaagttaccctgcagccctgaaggagtccacaggaagtgattctctttgctagaggctgctctgagaaaaagcttcaggtaacaaattaggccaccatggagacacttaagatatgatttcatgaccaggtgtggtgcctcacgcctataatcccagcactctgggaggtagaggtgggcagatcacctgaggtcaggaccagcttggcccacatgatgaaacctcctctctactaaaaatacaaaaattatccgggcgtggtggcggacacctgtaatcccagctacttgggaggatgaggaaggagagttgcttgaactcaggaggcagaggttgcagtgagctgagatgatgccactgcactccagcctgggcgacagtgagactctgtctcaaaaaaaaaaaaaaaaaaaaaaaaaagatatgatttcatttaccacccaaatcaactcacatacaactcacagcaaagaggaaacaggaaaacatgtaccttaagtccttactcccccagttaccaggtcctgaacatcagggacaatggctatgaccctcgaggcatgcagccctgccaaacatcacatgctcattttatctccagacacatctcctagaataaaatgggaagctgttgtacccatccttgaccctcaggtgactacttttaaaggtgctctccaccgggcagaaagagcatcaggatcagggcagaaacctaattccgaccaagctttagggttccgagtctgagagcaacttcccatcctttttctgagactgaagctgctgtcaacactgcccaataaacactcgcaggacacagctaaggaagacagaaaagtgagaggcaaatggggatgctgactttgcatcttcatgttccaacctgagtatcacctgtgcttttgtgtttgtgtggatctgtagggacggtaccaagatctctaagtcaggtgcaatatcaggagatctgcacatttactaaggggaaggggaagggagaaaaaaaaccgtctcagactcaacaataaacctaggaatgaaaagatccaaagcaaaggagcagcaaggctggaaaagctccggcggcagagcaggacccgagtcaccagcacatcacactcctctgacccatttattgatttatttgagatgagctcttgctctgtcccccaggctggagggcagtggcacattcatgtgtcactgcaacatcaacctcccattccactgcgcccagcttattccattctaatggctgtgcacaccgtttaaatactgaccacagaggtgttactgttttattaggtatctgccctaagtgtgccaagccttttatttgaggatccaatgaatatcacttagtggaaaggaagtaaaagataattacaacacaacaataaattattaccacagaggggagcagagagcaccgcaagaccaaaggtgagaatctaaccaatggcagaagtcacaagtgaaaaaagagctcaaccatgagatcaagaggctcactgggggccagacatagtggctcatgtctgtgatcccagcactgtgggaggctgaggcaggaggatcacttgagcccagaagttgggagaccagcctgggcaacacagtgagaccccgactctacaaaaagtacaaacattagccaggtgtggtggtacacacctgtggtcccagctacccaggacagcttggcttgagcccaggaggtcaaggctgcaataagtcaggatcacaccactgccctccagccgaggcaagaaagcaagaccctgcctcaaaaaaaaaaaaggatcattgggaacatggaggcctgaaggatgagtaggcatcagtcagggaaaggagagaagggaatttgaggcaggaagcaaagacctcaagaactctgatgagtccatacttactactgaaaataaccaatctctgcctagagaatagaggtggagaaagaggcagactggactagagtagaattccaccaggccctgaccagctgcttcactgaccacatccatcatctcatctcacctcatcctcaccataagcctgagaggcaggcaggacagtgggaaatgcaaggcatagggcaaacagcctgatagtaccagggcaagcccaagtgtcccatccacccaaactgtggccacgagtcttgattctacttccgttctacaagtgggtccgggaatgcatgcaaatggaggagagagaagagacgcaccgctctcccacagactgatacgtcatggaggagagagagatgcaaccaattcccagagactgacatgtcagtatccagggaatgagggttctgaagaacaccccaggccagcagacagaccctaggtgagcctggcaatctccccacccagtgtccatgcctccttgtagccaccttgcccggagtgcaaggcgggtgggacctgtgacgtgcttctaacccacagaatgtggtgaaaacaatggaatggctttcccttgactgggttgcattaggtggcaaagttgctgcgctgtcactcccatgactacattatgttacgtaagacttagtctactgaagcagaagactctttgctgttttgaagtgagctgccaagctgcaaggggccatgcgccaagcaagtacagggggcctctaagagtcaagaggagacctcaagggacagtcaacaagaaaacaaagacttgcgtcccacaatcagcaagagataacttctgccacaacctgaaagagctcaaaagcacaccatcccccactcgagcctctgataagatcacagtcccacccaacacctagattgcaaccggatgaaaccctgagcagaggatcccactaagctgtgcccagacttccaacccacagaaactgtgagataataaatgtgttgtgtgtcaatttgttacacagcagtagaaaataaatacactggcctggcatggtgactcatgcctgtaatcccagcactatgggaggccaaggtggaaggaatgactgagcccaggaccttgagaccagcctgggcaacatggtgagaccctgtctctaccttatgtaaaaaaaaaaaaaaaaatttaagaccagaaatatacccccacacatcatcccatttgaaagaaaagctttcatccatgctacttccttccatgcacaaataatgactggttgccagaaaggcagcacaggtcactcttcagaactccaaatgctctttccaacctaccaccaacacacatgatgccaaccccactgagaccaaggcagcctcccaagctcagagagactccgagaccaagttcttcataactgaactcacagcttcaattatttcatactcaatcactatattccaagttttttataattaacaaaatgctgccttcaaggttacatatgccaccaacgtcaatcctcagaacactgcataacatcccaaaacttacacatgtatcatccaaataaaaaaataaaatgtaagttaaatcttcaaacgcaaatttgtgctgatgatctagaaggaaagctgggccctgcctggccgggagctgcctcctttcttccccagctttgtgcagggccacccctgccctctcctcacccctgctggtgcagtgagatgaggacctcaagtaagggggtggcagccgggacttccacaattcagggcaatctctggcatctgttgttcagtcagtaattttccaacagaccctcttgactgtgacgggcagagaaaggctggggagctcttgggtcgtcagtgggttggagagatggactaactcacaggtaggaaaaaaggcaatgaccactccactggagaacaaagcccacagcatttaagctggagggacaagaaaatccaatcattctgatgatgcagctcctgaggctccgtggccaagctgggatgtgaaagaagacaattccattcccctccctcatcaccaggtgactgctgcctcccagagagctccctcatgaaagccccgtaacccaccacgctgcactgtttctatagcaaccagaaagaaaatataaagcaagcagtttcacatgaaaattattctctattaaaatgaaatattgcagtcaggaaaagaattttgataaagaactaggtagaagacatcggtaacattaatgctaattatttattcactacccacacaaaagataatttttcctaaaattttaagataatcttttatcgttcacactggaagtctgaaaacagtactacagcaagtcaacaacaaacaattacaatcaaaattctgttctatgctgtgatatctccacgaaacacaaaatgctctcccaagtttaaagagggataaggaacacgaaaacaactgaccccggccaggtgcgggggctcacacctggaatcccagcattttgggaagccaaggtgggtggatcaattgaggtgaggagttcaagaccagcctggccaacatggtgaaaccctgtctctactaaaaaaatttaaaaattaaccaggcgtggtggtgggcacctgtagtcccagctacttgggaggctgaggcagatgaagtgcttgaaaccgggaggtggaggttgcagggagccaagatcacgccactgcactccagcctgagtgatagagcgagactgtgtctcaaaaaaaaaaaaaaagaaaaagaaaacaactgagccaaacaatggagaaaacacagaaaatatgcaaattatgagaacaaaaaaaattcagccaatgccttctcacatcaaaataccaaaactacaaagccaatttcaggtataccaacccattctcaaaagatgaaatcaaattcaaatgaacctatctttgcctatctttgacatccctaaagccacctgtgacttgtcacagccttaataacccaccacaatcgggatggtcatatgtcccctgaagtcacagaaacagaactctcaactagcagactgttaacgtgtcctattatcctcaggttcttgggttattcgtagaatagcaaagcaaactacctgctttgtaacgatatcatttacacatcaacatcaggaataaatacaaaccaaaacctggccaaaccaggagaggtgcctggaccaggacaggcagacccaacgcctacgcttgcttctaaccagcctgggcaggtgggcaggttacaacacactcctgactcagccaggtggggctctgcagcctggcagttacagacactgagacctcaagccgcaggcactagcctgccaaaaaagacttctcctccttggtctcacagccaacagtttggacacatatcctagaggtatactacacttccagcaaagagatgggggcccaaggcccaccccaaaccacttcatcctcccctcaccacactctgaatctggttctctcagaggcatgatgagagctggggtggagaggtgtggaaaagacacagtcctgacttcagagtccctctgggcagactcatctcacagtatcgcgtaacacacaacacacgtttatacacgggcacagactggaacacatgatatggtaacaatctataatacgaggagctcgttaagctcagagatgaaaggggaagtgagtggaagaccacaccgtgagcatctattaataaaagcagacggagtaagaaacagagaaaaaggttctcctttggtcttgtctttctttgtctactatttaaaacacgagagaattagctagttaaatttatatctcagaaaacaggcacaatagaagtataaaagccatcacctttaagtcatttcccctttttttttttttttggagacagagtctcactctggtgcccaagctggagtgcagtggcgccatctcggctcactgcaacctccacctcccatgttcaagcgattctcctgcctcagcctcctcagtagctgggatgacaggcatgggccaccacgcgtaatttcttttttttctctctgagatggcgtctcactctgtcacccaggctggagtgcagtggtgcgattctggctcactgcaacctccacctcctgggttcaaccgattctcctgcctcaccctcccgagtagctgagattacaggcgcctgccaccacgcccagctaattttttgtatttttagaagagacagggtttcaccatgtggcccaggctggtcgcgaactcctgacctcaggtgatccacccgcttcagcctcccaaagtgctgggattacaggtgtgagccactgggcccggcagtatttagcattttaataataaaaatattggagaggccgggcgcggtggctcatgcctgtaatcccagcactttgggaggctgagcaggtacatcacctgaggtcaggagttcaagaccagcctggccaacatggtgaaaccccaactctactaaaaattcaaaaatcagccaggtgtggtggcaggcaggagaactgcttgaatgcaggagaactgcttgaacgcaggaggcgaaggtttcagtgagccaagatcacgccactgcactccagtctggggacagagcaagactccatctcaaaaataataacaaaaaattaaaaaatcagacctaatatttgtttcttggtatgtattctttctattccaatttattatggcttcaaaagaagcccaaaaaatcaaaaaagaaaaataaaacaatggcttaatgagaggagcgcttaataaactgaaattttgtttaacactttcaggaacagttcccaacgttgttgtcagggcacagtgacagtggcccagctgcctcgccagcagcacacacaggcctctggggccagcagagaaacactcccagtgccttcaagaaccccattttcacatccagggtccaggaaacagacatgcacgtcggactatcaccctagtgagaaagaaggaaagccacattggggttggttttttttttaacgtccttcaaatctatggaagacatcctcttctacacaactcataggaaaaaagatccctctgaggttaagcaacccgacgcctccacaccacaactgaacatcctcctacagcccccacccggtaactcattactttccaaagagaatgggtctcaaggtctcaaggacccactgccctccaaaaaagcaacctggacatcctgctgacaactgagcatcatacaaatgtgtccctttcgtccccgctgccctccaacagtcaccccccagagcgaagctgcctgtacaggccacgtcctctcctccagcagccggctacgcgcagctctccggcacagccatcacctgcaccactaaagcgggtggcagtttctgcccgtgacatttctcattaggactttccacaattcttgaggcttaatgcaaattccttattcccatgactaacatcaaagaaccacacctccaaagactgacactgggattattcctaaatttctcaaggatgaggtaatctggaggttaaacatgcctgaactgagctgtcctcacttgggccctccagacctttcacttgttgggtgtgtaaataatgacccaacactttttcttttcttttttgagatgttctcactctgtcaccggggctagagaccagtggcatgatctcagctcactgcaacctcaaccttcgggcctcaagacccacacctttggcagctgtgtaactagtgggtcctcctgttcctgtggacagcagtcccatcaacagcaagtcacgccaccacctaccccacaacccaacccagtccctgaagattcaggtgacagttaactgacgtcaagagagtgcaacatcactagaaaaacattaatgacggccagacgcagtggcgagactccactcaaacaaaaacaaaaaaaggaaaaaaaaaacactaattacaaggaaagtttgcctcctagataaaacacatgtgacctgatataaaaaatatctaggcctggcgcagtggctcacacctgcaatcccagcacttaaggaggccgaggcaggcggatcatctgaggtcgggagtttgagaccagcctgaccaacacggagaaaccccatgtctactaaaaatacaaaaaaattagctgggcttggtagcacatgcctgtaatcccagctattctggaggctgaggcaagagaatcatttgaacccaggaggcggaggttgcagtgagctgagatcacaccactgcactccagcctgggcaacagagcgaaactccgcccccaaaaaaaattaaattaaattttaaaaaggccagacgcagtggctcacacctgtaatcccagcactttgggaggccgagggggcggatcacgagttcaggagattgagaccatcctggctaacacggtgagaccccatctccactaaaaatacaaaaaattagccgggggtggtggcaggtgcctgtagtcccaaccactcgggaggctgaggcaggagaatggcatgaacctgggagtcggagcttgcagtgagccgagattgtgccactgcactccagcctgggtgacagagcgagactccatctcaaaaaaaaaaaaaaaaaaactagccgggcgtgatggcacacacctctaatcccagctactcgggaggctgaggcaggagaaatgcttgaacccgagaggcagaggttgcagtgagctgagatcgtgtcattgcactccagcctgggcaacagagcaagactcagtctcaaaaaaaaaaaattaagtctttcctgccaagtattattgccttccttctcagaccacaagcctttttaaaaatcctaacttttaggccaggcgtgatggctgacgcctgtaatcccagcactttgagaggccaaggcgggtggatcacaaggtcaggagattgagaccattctggctaacatggcgaaaccctgactctattaaaaatacaaaaaaattagccgagcctggtggtgggtgcctgtagtcccagctactcgggaggctgaggcaggagaatcgcgtgaacccaggaggcggaggttgcagtgagccgagatcacaccactgcactccagcctgggcgacagagtgagactccatctcaaaaaaaaagaaaaaaaaaatcctaacttttaagatttccaaccaaatattaattaggtatctattaatatgtgcatagaagtaacagaagatataaaacaaaaacaagtccaagatgagcctaaccatgtatttgggcaaacagaatccccgttcttctttctatactccttctagcagcaggcttcaacctccaaaatctctaacccccttctgtttggacccaaaaccactatcttggcccacattttacactgtcctgacaaaatatctgagggcaaataccagtctgccttggccattaaagtcatttaggcaacacatctgccgagctgagcagagccagcaggtacccatctaacacaaggctccgtcctgggctgtgcccctcaagaattccccagatagccatttcctttcctcaactgagatgcccacttctccctccagaatgtgggcaaatcacaccagtgacgtccacatctgtcaaatgtccccagggcagagaatggagagtgacacacagtaggcacaaaataaacagcacccagcttctgccccaccaccccgttccccattcctgctttcttttctgtctcctttgctctatcgtttcacaaagccactctcctaactaatgtttgccccattccctccactgggaatcaattcatcttctctttttccaagtctttttaatgaataccagttaacaccatgaagtcttcacaattcacctacacagtgtgctttcgagtccccttccctatttcaagtttctccaggttctcttgtagggatcttcttaaggctgcatgtgatgtcttgtgcctgtcatcccagcactttgggaggctgaggcaggaggactacttgaggccaggagttcaacatcagcctaagaaacatagcgaaaccccatttctacaaagaatttttaaaaattagcgcacgtctgtagttctagccactcatgacgttgacgcaggaggctcacttgagcccagaagctcaaggatgcagtgagatatggtcacgccactgcactccaccctgagtgacagagcaagaccttgtctcaaaaaaagaaccatttaggcaccatggtgttgcaaagccagtgctttcatctaggcatccaccgcctgcaaactctgacacatcatcttctgcctcaaaacaagtaagcaaatgaaattcaggtctatcattgcaaaccctacacaacccaactccagtcatgcttccaggttaatctgctgtcatcttccatcttcttggatgggctttcgtgttcagacacgtctggctgacattctcacgttacatgcggccttcccagcctttgtccccagccttcccgaagtcgaagatgcccttactctgatttctgcagtgacattctactgattctttttttaaaacagaaacatagcttacagttaaaaaaaaaaaaaatagcacttcttcccttaaatctcccaggtcacagagcctttccctcctctgatctatgatctctcttttcataagaaccaatatttaatgcaagctttagtcaactaaatgcatctttctcccagatctcagaacaggaggccacagcactgcacccagtgagcagccaatgaacatctgtgaaggaaatcagtgaaacatcagaaaaagcagagtttgtctagtttcagaagtcccttctataaaacatgtagctccttccagctaaaagaagacacaaagctgttctcccactgtagagcacactgcaccccatttggaaaagcagtcaggtgagccacacgtcagccacaccgtgctttacaaacatgccaatgtgtgaacggtcagtcacaaagacataaaaaaagatgactgccctcatcaaaactgccaaggtcatgaaaaacagggaaacgctgagaaatggttgcagacgagattaaggagacatgacaactaaatgcaatgtgggatcccggatggcatctgaggacagcaagggaacattactggaaaaacctccagcttgctcacccctggaacctgtgaatgccttaggttacgtggaaaagggaactgaggttactaatcagcagagagggagatgacctcgcagtgctcgggtgggcccaatttgtaaccacaaggatccaaaagtgaaacaagggccaggcacagtggctccatgcctgtaattccagcactgctggggggctgaggcgggaggattgattgagcccaggaggtcgacgctgcagtgagccttgattgtgccactgcactccagcctgggcaacagagccgagactctccaaaaaagcgggtgggcagcaggagtcagagagatgccatgaggctggctttgaagactgaggaaagcactacaggccgaatgcaggcagcctctggaacacggaaaagacaagaacacagattctcccctggagcctccagaaggaaccagccctacctacccagattttagcccaggcagatcatgttaggcttctaatcaacagaactataaaacaataaatctaaggttatggtggttagttacagcagcgctggaaaaccaacacgggcagcactgacacaagtcccagcacttctccaacgcccaagagctgttctctgtctcccttccacaccctccatttgccttcactcatccccctgaaccaatatatttatgggcttagaagaaagctattaaggaaaaggcacagattaagttctaagacagattttctcctcaactctctaaaacttcaccgtaccattagcttctactaaatgtccttttttacaagagtcagtttcaacatcatcttcttttaaaagccagtcatctggtgagaacccaagtttagcagaatcagatctaaagactttgccaaagaaaaatcaagcatgaatgtaaatctcattgaatatgcttaacattttacctgaactgtaagtgcaagcgtgcatcacttttctgagtttcacactaaaagataaaggatacaattcaaagatacctctcgcatgtgtcaggggaaaaatgcctgtgagaaaatgtttaggccgggcatggtggctcacgcctgtaatcccagccctttgggaggccaaggcaggcagatcacctgaggtcgggagtttgagaccagcctgaccaacacggagaaaccccgtctctacgaaaaatacaaaattagccaggagtggtggcgcgtgcctgtaatcccagctactcgggaagatgaggtaggagaatcgcctgaacccgggaggcggaggttgcggtgagccaagatcatgcctgggcaacaagagggaaactccatctcaaaaaaaaaaaaaaagaaagaaaatgttttgagtgttagcatatttaatatattaagctctaaagaacttcaaatttcagatagactattctcaaagtaacaaaaatatctatgtatgtaatttaaataaattaggagccaaacatacaattatagtgaagaaaaaatccacaaagtctaaaaattccttgaaatccgaatcaactgtggggctgtggaatactaacactacaagctctcgagacgctcttcggctgcctgaaagctggatttcttctttgtcaccatcagaaaaggcaaaggttattcagtgctctgcacatcctttaatcagccagacatcttagtcaaaatcatttttaaaaacttaatcctttcaagagtggtgctctggggtttttttggttttttacttttatttcctgttttgcaagatgtaaaaccacatctagaaacatggtggatactaacaaagcttgatttcttaagagaaaaataaggtccttcactgcgtcttaccttctctattttagataagtttaaacagtacagccataatgatttcaagtttacatcatcatccagaattaaaccaaagtcttctttgattgtgtcagatatgaatgcagcagtaagctaatcctaactctagtaaaacctcaggaaccaagcagcctacgcaatcttccctttacttggaaatactgcattccaaaatttattctaagccattagcatcctaagtctgaaaagagccatagggagtcgaggaagggcaacttactatcaatgcaccaagaaaagaggtttatttgctaattttacataaaaaataacctctgatatcataaagttattaggcatttacaaataacatttcaatttcagccattcttaaaagtcacattttttagagttaagtaatgaaggggaaagtcttctgaattttaccatgacaaaagaaattttcatatggtataaaaatggtttgttgagaaaaagccaacattttcaaataatgaacaggtacacattggttgctttacacgtggaaaaaagagccctacagatttccaggataataaataattcactgcacagatgcgaaggacaggcctggaaacaggtctcaccctccaccagccacaaggacgctgtaactgagacagcagcaccctgacagctgtctcaaccttgacctccaagaggaagagagaaagcgggtgtggggaagcccagaagactggattttcactcaacaggattcggtcctctaggcccctgaaaaatctcagccatacagacaggacggcttacttttattttcacactgaaaaccctcttaaccctttattcacagagccagctttagcactgtggggtttctggctaggcgcggtagttcacacctgtaatcccagcactttgggaggccaagacggctggatcacctgaggtcaggggttccagaccagcctgaccaacatggggaaaccccatctctactttaaaaaaaaaaaaaaaaaaacactaactgggagtggtggtatgggcctgtagtcccagctactcgggaggctgaggcagaagaatcacttgaatccgggaggcagaggttgctatgacccaagatcgtgccactgcactccagcctaggtgacagagactctgtctcaaaacaaaacaaaactgtgaggtttcttagagctagaatagtatctgaatgttttcaaccacaatcaaccagttcccctccaccaaataccctagccccttactgtaaacccaaaaatctaaaacaagtcgcaatctcccaaatatacccacaattagtctttaaaaagcaaacttttgccaattacataacagtttcatttacaaagaaactttgaaaacctaaacatacagaaaaaaatcaatagggcacacctccatttcgttgtctttccctccaaagagatcattttttcttcattaaaatgctaaaactttcatatcactccacctgctcagctacatgtgaccagaggggcctccggacaaacgagacacttaatcctcataagcagcagcagcaaaccacacttagtccagactgatttcaacccatcctttacagtcactgagaccttgatggaaacgatgaggaaatctgaataaaaactgcttctggcccttctactctggcctgaaaacagcagtcctgctaaaagtgctttcacagaaagcactttcttcccacaaagacaactctccctttatgtttctttatctcttgttctgccttaattgtgaaaactgtcttcccacctttatctaagttataaaagcaaacttgtaatgaaaacaaaagggggctgagcacagtggctcatgcctataatcccaacactttaggagactgaggtaagccaaccccagaaggctgaggcctacacaacacaggaagaccctgtttctacaaaaagtaaaataaattagctgggcacggcggcacatgcctgtggtcccagctactcaggagtctgaggtgggaggatcgcttcagctcagggagtcgagactgaagagagccacgttcacgcaactggccgctgccctccagcctgagcaacacaccgagaccctgcctcaaaaaaaaaaaaaaaagacttactaaaggaagtgatattacactaagacgcaaaggctgagtaggagttatcttggagtttggggggatctgcatgagatggcagcgaggtatgtcgaggccatgccacaaactatggcacatggcccaactgaggaaaggcaaggccaacgcagccagaatgactggaagcttggggcagggtcaagaatggggcatggtatcagagttaggccacagtcaccatttgggacgttatcataaaaataacatttgaggccaggcatggtggctcacgtctataatcccagcactttgggaggccgaggcaggtggatcacttgaggtcaggagtttgaaaccagcctggccaacatggtgaaactccagtctctactaacaataaaaaaaaattagccgtgtttggtaggaggtgtctgtaatcccagctacttgggaggctgaggcaggagaattgcttaaacccaggaggtggaggttgcagtgagtcgagatcatgccactgcactccagcctgggcaacaaagcgagactccgtctcaaaaaaaaaaaaaagaaaaaaacaatttcaaattaagagaacacacactgaaaacatttcaaaatttcaagacaataacttttatttgaattcattccatttttctataaagtttatcaaacgggccacactgaattcccacagagcactgactacacaagagtcacaaactgacgcagccaccagacaagggatgcaccatcattttcaccgattaactacaaataccttgctattaagagacactcacccattacacttacgatttgaggatgaagggagttacacagagtaatggacagatcaaaacacttattttggcaacaaaatgcagattattttctgagccagcatttactgatactctctaattatgttatttaattgatgatgggctctctgcccatatgcaaaataagactcctcttatatttgatgaagcataacctttctatgtcaaatctacttaaaaaggcacaaaaagaggccgggcgcggtggctcacgcctgtaatcccagcactttgggaggccaaggcaggtggatcacaaggttaggagttcaagaccagcgtggccaacatggtgaaaccccatctctactaaaaatacaaaaattagccaggcgtggcggtgggcgcctgtaatcccagctactcgggaggctgaggcagagaactgcttgaaccccaggagacggaggttgcaatgagccaagattgcgccactgcactccagcctgggcgacagagcgagactccaaaaaaataaaaataaaataaaataaaaaggggcacaaaaacttcttggaaaaatactgtccaacacaaacagcatagtttccttcactctatttgtagggagttctacttgccaccgtatcaacactgtaattaccgctaacatggcagccgctcgtcatcaacagcccatctgggagggtgtgatggcactgctggtatggggtgcccagcatggccagtccggagaaaagcatctggcggtggcaatgcaagtcagaaggctgacgcaaatgagagctgcaaaagaggaactcaggttttaaaggtgacacctttaaaaacaaaattctggtaaattgtgttatgtatattttactacagcaaaaatagaacagaagaaaaaaactgctgaaagtttcaagtttaggtcaaatttagcactatcttgtggggaacttttcaacaaacttaagaggcatcacgaagaacagagaaaacgtcacagcaacttggtctttgttccctcccatccagttccattcagatggccagcctatcgaaggagatcctgctcttcggggagaaactacagaaagaggagaacaacagctgaatggagggtaggggaggccacaccaactatacgagatccaatgcaagggtcacaatgaaggctgagcaagacatccgcccccccccctttttttctagtttaactacagttgcagagtaaaatcagaggacttctgtaatcattctctaacagaactcgaagtcttccagggcagccaatacttactaagagaaatcaaggtctcagagaaaccaaagaaacagcctcagggtctccgattttgaacgttatgccatagactaggtctgcacacaacaaaaacagtaactgtttcgatggcactttttccacaggtaatatcatcttatatgtttggctaagtctcaacatcccaaaaaggatcaaaagattctctaagttttgcagttcaacaactgtgcacacttttatttctcatttcaagtgttaaggatattgctctaatgactgcataaaactctctcctcatgtaagaaagcctgaaatctaatttctctaccataaaaccctgttcttgcaaaaggatacaaaactactcataatctacaaaaacgatgaatcctaagcatgttacatagaaggaaaacagtttcaaagcatagggagctgttagaccagcttcatcttcccaagcctcttccaaaacttcttggaagctgatatataacactaaccttccaaaaacacaacagaagcagaaaatcttaatggggcaccaggaaaagagcaagcctcgagaaaaatcaagactccccccgaccaaccttcccaaataacacaaacacaagagttaacagtacaatccctctttgagaggggactgaatcaatgtggcagggccaaccctacacacacacacacacgcgcgcgcgcgcgcgcgcgcacacacatacaccacacacacagctaccgccctgccaggggatgatgaaatgaggaacggaaattaacatttcaggcaacgtctcacattgttccttgaggccaagggctgctgttgcagccgccaccgccaccgctttcctcccagccaccccccacacccgcccgcctaccctccccctaacaccccccacacggctgcccgcattcctgcccctcctcggcctacgcgcgcctcctgcaaccccgacgcccccaggtccccagttcgccctccccctccggctcggagcccgagagccgcctgctctcatttcaaaacagcgataataatagggacgctgagaataacaactacgaccagcacggcgaaggcgcccctctcgcgggtcagaggtcggcgccccagctccgcagaacccggcgcccggccagcgccccctggcagcccctcccggcagcctcaggtccccaagacctgcaggcccgccccgaagccccccgtccgcccctcacggccgctccgagcccccgaggcccgccccggagccccctgtccgcctctcacggccgccccgggcccccacggcccccaggcccgccccggagcccccaatcggcccctcagagccgccgcgggcccccggccacccaggcccgcccggagcccccgtccgccccttacggccgacccaagctccgccgacctcccaggccccccccggagccccctatgggcccctcacggccaccccgggcccccaaagacccccggctgccccgaacccggacccgtaggcccgctccgggacccattattggtccctcacgatcgccccgggcccccaaagacccccgcccacccggccccgaccccccaggcccgcccggaggcccgcggcgcagctccgtcgccggggaaggcctgcaggccgcaaggccgcgcgaatgccccgtgcccgccccgaccaccgcccccagaccagcggcgcctctcaccgtgctccgagggctgcgcggctccgcgacggctcagcggcggggcgcgggcgctgcccatgcagcccgcggccgcgtttcccgggccgcgcggcccgagcggcaaggcggcggcggcggcggcgcgggctcgggcccggcagagctgcgagggacggcgggaggcgagcccgcccctcgggcgcgcccacggctcgggcgagagccgcggctcccggtgcggacgctactgatggggcgtctggccgcgggctcggcggcggcgcctccccggctggggccctcggtccatcgcgcaccgtctcagggcggcctct

SEQ ID NO: 232 - DNA, 197408 bp, Homo sapiens
ttaaaaaatgcagcttgttttatttttatataaactaaaacaccagagttcatcgattcctatattaaatacataaattataaaataaccattcataaaactttacatacagtaagttgattccaatctctacggtaatacatacagtacatgtacatattcggtgtacttcagaggatcattctggtgaaactcagtcaatttttatttttctttcattaataaacaagcactgaagtgatatatggagtcatgctaatgagatggaaagaaagaaccccaattgaggcagttgattgaatgaaagctctgtgaaattggacccttggctacattaacacagtaaacacctggggaattatgtattcaaacacattagctctatacttgagtccccaaagtattggatcttgaaggctaaaacatgcatgaaccctgttgagatggaatttttagctaataaagatatgggacttttggctaattttaatactgtagattgtgctgaactttctgttgctctttcaaaaaaaagaaacatcaaccaaccaaccaaacaaataaaaaaaacctatttgctggtttatgggcctggataattgaaaaaccgagtggtctctgcctcagtcaacaattggaaataatagtagtgaacagaaggtggggtaagggagagaagaggtagtcaaggatgggaagagttcaaacactaaatgctcgacaaaaacatgagttcccagcagaagcagcagcagcgcagaaaaaacctttcttgaagtcctgcatcctagaacagaagtacacgtttagtaagcgctcacaccatcatactatgtacagaatatatctgtgcatatatttacatcacatatttataaaaatgtttggattttgatctgcctcattgtgggaagttgctatggttaatggctggtataggcacagtctgtgagatgtcagtcaaatagaagtgttgttactaacagatgctggggatctgttttagttggaaaattgcatcatccactctttagtaagttcgtgggatcttgattgtgggcaaaattgggctcaaagttgtttaactttaccattctcaccctacagaactttgcatataacaaggatgaaaatataagcatgggtacaaagaccgtaatgcagaaaaaaacaaaaacaggaaccctcaccaaatcaaccacgtgtatctctgccacattaatttgaatataggaaattataatcctatttttgctacattgcccctataagtatatctttagtagtttttttcctctctccctcttttctttctttcttttttttttttttttttgagatgaggtctcaccatgttgcccaggccgttatgaaactcctgggcccaagctatcctgccaccttagccttctgagtagctatctttaggaattttgattaagcattggacttggactcccagcaagagatttatttaggaagaactaaaccgccaaactaatgacagcaaaggattgtgaatctgccctgccccattctgaaatggaataatagaatttggcacttgaagaggccttacagggattagctccaactttccattatgtctgtatcttcttgccaatatgcctgaaattagatctcaagatactacattatatagaaatgacaaggcagtagaacacaatgacatctttcctcacttaagacctagaagtctgcttaaagaggggcttgggtccatattggaagcataaactcatgacataaacagtcatctaagatttgctttgaatgtttatcattcaaaagttatattgaattttttcaatgtaatagataaatctaaattagtaaaatgatagaattaaactgccaaaagctgtcattaattaccaaaacactgttatgaaaatttcacaaaaggcaacaagcaatgcaactcccaaattacagagcaaatttctattgctctgtgtgtgtgtgtgtgtgtgtgtgtgtttgtgtgtgtattctgtgccactctttgacagattgaaataatgcaattaaatattttaaaaataaaatttctatgctgtccatctatcttgatgtaatataacacagatgatccaattatttaaacatcaacacaaaaccaatgaatattctttttacagtttctacaaaaacctaggcaggttaaaaagacgtgcttcattttgaaacaatgaacttgtgaattatgttaaagcaaacataagaattacacaatgggtttacaggaaaatttgacagtcaatgggcaaaaaggaacaagtttgccagagatttatttaaaattgaaagcaaagttgaaacaaaatactgcagcaaaatttatttggcaaactttatttctcctattactagtggagaacacatttgctctctacctaagtgataacccaggccttctatatcagctctaccttatggacttgggaagacacatacaacctgtatgagcagttatttgtgggccaaaaaaaaaaaaaaaaattaaatcaagatctattcttccacccctaaaacctaactgttggtaataatttaatttatatagcataagtcagaagggttgtaatttttttcagcaaattctatttcctaaaagtagggtggcattaaagaaaagtttgacattcaatttagtaatagatgctttttaagtatgatagtcaaagatagtctctctatgtttttcccctctttcatgaaatttttctatcctgaataactatttaaattgggtcttttatttatctcaaattatctttagtagtcagttatgtttattttccagggtatgaatattttattgagaaaaattaagttaatgaacccggaagaatgctgttctgactgctacaaactcagtagccaaatgcatctcggtagtacagatgcagaagtggggccacaggaaatctcagttattgataacttttttttttttttttttgctattgctgaacatcccatccaagggaagcattcatttaaacacggtccatttccatggatccatgagtgactggaacacatatccacaattttgctgatgcttttataattgtgaaaatggataatagagagatgtatctattgaaatatttatactttattcaaggatatattcattttgaggctcatgagcaagagttggtaaaaattacagttcagtctatagtcttgagaaatttgctaatctcccagatcttaagcaaaaagaaaaaacaagcaaaccttttgcctggccctaaacacatctaaagctgcttggacaatcatcctagctgttgttctcatatgacttatagcagataagcagattaggtatataaaccataccactttttcaaaaattttcaatcatttagaaatagttactcatggaaataaattttgacttacaaatttcttggtgggtgggaaagcaaaattaagagaaggaaggtgtgtgttggagcagacggaatatagatttactcatatgggccctgcaacagaaagtgaagaaaaatggaaaagtcttagatatgtgagagtaatttatcctcttccatattttctgactcaagttggctagtgttgggtcaccaacactgtagaggcaccctctttcacatttcttgcctaatgagcatatggctcatatttaatctggaacctacctagttgaataaagaatccagcaggaggccgggcacagtggcttacacctgtaatcctagcactttgggaggctgaggcaggcagatcacttgaggtcaggagttcgagaccagcctgaccagcatagtgaaaccctgtctctactaaaaatacaaaaattagccaggtgtggtggtgtgcacctgtaatcccagctactagggaggttgaggcaggagaatcacttgaatccaggaggtggagcttgccatgagccgagattgtgccaatgcactccagcatgggcaacagagcaagactccatctcaaaaaaaaaaaaaaaaaagaatacagcaggatagtctgttttgtatcttcccagtagggcataccacctggctttcctccagaataaaagataatcaagctaattatgtgatactgtcagtttgctccaagcctttgtttaatgactggctctcctgtggtaaaagtggggttctgtatgatggcatgcatatgcaatcaagagagctgggagatgcttatcatagaaatgacacactcttctatcttgttcaatagcatgagatgatctatttcctatagattattaaagatcctggttttgaatctctcaatttttattgctaataatgtcccaagtagcttgataagcaagcttcagtgctatagtgcttaaatttaaccaaactgaagcactattttattacatgagggaatctttttgtcaacaacacaagaaagtcaaataatacagcacttgtaataattacaaagcacattgtgctactttaagcacctcttgttctaaaattgcaaataaaactttatgaaaaagcattttaaccccattttgcagatgaggaaactgaggcacagagaggttaagtgactgggccaaagatacctgggtcagcagtaaatgtaagaacaaaaagtgggaccccagcattctagtttttattgtacattcttcagttattgttctggctttgcaaatgccagtgctaaaactgaaggatgatagtgaacccacatatggaaagatttgtatagcatttcatagaaagagtttctggctccctacacatattctctatgcatgggaattctagccccataaataaaacttcaaaaatttgaaaaattgaggttgttctgttatctacagtaaatgaggtgtaaaattagcttttcaggaacatacatttgctctcagagatgactccaagactcagtaatacacaacttaggaaaagtaccagtcctctaattgtctctggtagaaaatgaccttgtcagtaacataatgttatttccatataaaaaagtagagctatcttgttgctgtcatctgtctgggaaaaaatgttatcactctaaacaagaagaggtcagaatgctctaggcatgtgaggattctttaaaaaataatagtttagtttaatattcacatctctgtggcaaacccgactcttggtagaaatttactcattgattctgctgtgtttttgcccaaatcatatagcatattcatttgcaggcaattttaagcagccatttgaaaaacagtattttggaaatgaaagattcagagatgctctctggcccatgttccctatagatgttggcgttctaaacagaactaagtcagggagcatgtgatttacagtatcatcttcttagttttcaatatgaatgagatcagtccattgttgatagaggaatgcagatgtgagagtaggacaaggaagcatcgaatctgcttttatttcacatgtcacattcgctcgggtcctttgacttcgttaccagttttgttgtggtcactgtgatccacttctcatctgtcgtctgtggaatgaattccacaagctccaccttttgcagaaaaacaaaacagagagtgtttttcttcccatttacgatgcggatgtctctgttcctgagtttaaaacaatcataaagacagaaaagcaaatccctgtagtaagaaaccagacttttcaaatgaaacattttattgtaaatagctcttcataggtattcctcgtgcttcactccccacccacccttgttttttttgtttgtttgttttgatcttttaaaatgatgtttattatcaggactagtgtttccatggggtgtggtgttacattaaaatgacccccctgcacagcaggggttgaatatttcattgtaactttggttccatgcccaagacacatctttgcttgatctgcagaaactagttccattgctgaactttttctttacacaatatatgtttatagttcttctcttctgatttgacatatacatgtttcattaaatgcagcatatattgtagattttcaacagggttgtgtaggaactgtcaagtaagaaaccttgaataatggctttaaaatacacagttgtagtcctggctacagggtagttcttagcttttgatctccctctcactggtgtaaacaattttgccatctttgaaggtttagaagcacttgtcttcctgggatcttatccatgttttcggttactctgcaaaacagaggaaaaaaattatttatatatcaattttgttaatagctgaatcataaaaaacaaactttaaaaaaagacacaaattttttattctttaccactgctttgatgtgtatgatcttatgcaagttacatctctaagcttagttactttaattttaagggagaaaatagaagtctctatgtcaaaggttgttgcaacacaatgcatataaaacaattaatggttcttgtctcaaagtaagttgcctgaaatattattatcattactgctttttcctctgaggccttccaaggtgatagctaagaagttaaattgaataatcatgccccaacatatccatttaagatgttattttatttttgaaacttattttagattcagaaggtaaatgtgcaggttggttacatggatatatttcatgatgcagaagtctgggcttctattgaacccatcacacaaaagtgaaaatagtacccaataggtagtttttcaaacactgccacttctctacctccccacttttgaagtctccagtatctactgtttctgcaagatgttattttaatagcagacctgtctattcccttcagtgacttaattctatgtcacatttcctccccaacaaaattgtaaccattggcaaattgtctccacctaaagtcctgattgaagaactccctgggaattctgccacacaggtttcttggttggcccagagatgtccctgaaaaggtgctaccctggggatgtgccagtcaggactcctagccctgttcctctgtaagtccatatgtctgagttttcacttgtgtagaagtctaggtcgtaatgctgtcttccaatgaaagccagaaatagcacagaagatgtgctatgaggttgtgctatcatgtcctacttaagggaatggcctttagggtctgaacaacatggatagagaaaatgggatttctattttcttgctgtatgcccaaagctaatttatttaacttctctaagcctcaatctcctcatctataaaataaggatactgattctgtagaaagactttactattattccagaaatgttaaatccaaagttaaatgttaaaaccacaatctaaagtggaggaaaaggaggcacttagtaccccaaggatacttctagtctaccaaccaggggcaacttaaagatccaaaggcatatttgcagagccattttgctcccaagacaaggttagactgggatggaagagtgacagagtcacagaggagaacctgtgggaaggaagtacagtggtcggggagagatcacactgagggaatgaggaggaggtacgaagaggcgtaaagatattgatggtggattcacagaggcatacttgcctcctattgctcagacatagactttctcatcttcccttgcttatatgtgagcagagaactgaagagtgatgacagggcagagacaggcgctacagcgtagttgtctccttgctccacactccatcaaaaagctacctccttagcaaaaagctgtgggttgcaccaccaacgaagggagccagtgaggcagtggaagagtctgggccttggccagactgggaatagggcagtgggcatcccctgcacacccttctgaagaattcacacatatgttgcccagaatggccagcctttggtcacctctcatagaaaagatatcaagtgttggtcaacagtagccaaagaaacatctgcaatcactgtcaaaggagctgagagggagaatccttttccctcttcttcctccctgctctccagaacggctgagccttgaagaggaagagaagaggaagagttctcgtagagtcagaccctgaactacagctccatgggggtacttggctcatgcctaagggaggataagggaagaaatgagaataaaacagagtctgaaattgaacttttaaactggcttaagacttttgaggattgaaagtgactgagaagttgggggaccaacctaatatttaattaaaagatgagagagggaaataagacagagcctgagtgaagaaagctatgatttgagaaaatagattgagtacatatttacattccactgggatgagagccccaaataactagttacaaacacaacattctcctattccatggtaaataagagagttgatctgaatgtatataaaaaattcttcagggatgtatttttgtttgtgtgtttttaaatatagaataaatatacaaacacaaaaagtcttttacttgcaaactttcaatgtatagcatatcaaagattaaatcctatatattgtgtcaaagcatgtatgcatcatttccacctatcacaaccgaggtaaaacccctcatttgagtaaacacatgttggttttaaaaaccaatggacttacaggcagtccaggcagtctcctggaatgttaagtttctatgaattgagaagtacttgtaaaaggaactattatttctatagtgaagccagatttattcaaattagcattctgagttattgcagttacccagtgggtaacaggagttctttttaacaggttgcataacagtgctacaatttagtttcctcatctgtggaaaacagcaattgccactatcatttttgagactttactgcatgctacaaattctttttttttctttttgatacagggtcttgctttgttgctcaggatggagtacagtggtgcaatcttgtctcactgcagcatcgacctctggggcttaagccatccttgcacttcagcctcccaagtagctggtactacaggtatgtgcccccatacccagctagtttttgtacttttgtagagatgggatttcaccatgtttcccaggctggtcttaaactcctgggctcaagtgatccacctgcctcagcctctcaaaatgctgtgattacagagccactgtgcccagctaatgccacaaactccaagtcttgagtacggtgatgtggcttctgacttgtggttgtagcatctgtaagggcaccaccgtttaaccagttacaccatctaggaacacaagggccatctctgacaccttccactcctcaccctttatatgcaatttgtcataaagtattcaataaatggtagctattaatattacctccacaatacagatgagtacactgagactgaagattattaaataattggtccataaaaatcctggtagggaagacataataatattgtatgaaatgtaactgaagctggaggatcagggaaagcttccctgattttccactgagacgggaaggatgaatgggtatcaaccatttaatggtgatgtgggaaatgtggtcccagaagatggaagcacatcttgaaaggcatgattcaagacagaatgcttggtatgtctacagacttgacctttaatgagcctttctatgtgccaactactaaactagttgctttacctgtataatattactcaatcctcagaaaaataatgggtgctattacttgctaattttttatattagaaaattaacgtttggagagtgctatattttgaatgtttttgtcccctccaaaattcatgctgaaagttaatccccagtgcaagagtattaacaggtgaggcttttaggaggttattaggccatgagtgcagaatggatgagggattagtgccttatgaaagagctggagagaactaacttaggctcttttgcccctctgttccttctgtcctgtgacacagctttgccccctccaggggatgcaacaacaaggcgccatcttggaagtagacaccaggccctcaccagacaccaaacctgctggtgcctcgatcttcaatttccagcctccagagtggtgagcaatacattactattactcataaattacctagtctcaggtattttgttataatagcacaaatggactaagacagagagttataatggtctccattatgcagaattgttgtaagtattacataaaataataaatataaatgtaccttttgaactgtaaagcaagttgtactctccttccttattgaaatatcattaatattattttaaaagtatttattgattgttgactatgtgctagacactgttggttatgtgctaggtatttggtatacaaggttgaacaaaattatatggtcattatctgcatcaagcttatttacaatgagaaagagtgacattaattaaaaaaatgtgtatttatatatatatttccccaatgtatgtaaaatttgttcagaaaggaagtcaagaaagatgcccttgtgggaatcacaactgaactgagatccgaaggataggtgagtagtaggtgtttactagttaaagcagaagggaagcattctgtgcaccaagtcagcttgggcaaaccctgtggaaggcaggaaggcacatggttcattaagggaaactggagcaacaggaagcctgagagattgcccgtgtggttagaccatgcagggctttgttggccaagttaaaaaattcaaatttgatctttttttttttttaacttgttatcaatagattggttgaaggaacttgatcctaacacagtgatattttcctaggatgggggtcaaggtaaggtttgcctttctaaaactcactctaactgctgtgtggagaatgagttataagaatgtctatagtggaagcactgagcccagttagtgggctacttcagctgtggaggaggggataatatatttgtttatgtcctctttcctttgtcaatgcattctttaaggtagtcttcaaatggtatataaaaaaacaaattgaatatgagttatctttgaaagatacgacaactctattcatggttctgatctaacatatcccaaatctgctttcatattcattttcccagctattcattcatccatctgcctctcagttcatctgtcaatctgaaatttattctgcacctaggatagataaggcactgttatagacactaaagatacaaagatgaataaaacataactcctaccctatgctttattagtacaatttgtgagacaaatagggaaacaatttatatatgactggataaagctaatggatatatttacacaaaaaggaattactaactggcataaactgattcatcttagactttccttatccatgtaaaaactaaggagtaaaattttcctactaatactttatttttttggtggggggatggagtcttactctgtcacccaggctggagtgtagtggtacaatcttggctcactgcagcctctgcctcctgggttctaagtgattctcctgccttagcctcccaagtagctgggattataggcacggaccaccatgcctggctaatttttgtattttttttttttttttagtagaatggggtttcatcatgttggccaggctggtctcgaactcctgacctcaggtgatccgcctgcctcagcctcccaaagtgctgggattacaggagtgagccaccgcgcctggccgatcgtactaatactctaaatgacgaatataatagagactggtcatgtggccatttgttttccccaggctacctgagtaaatatttgcacgttttaacaaataatacagtacttaatttttcttaagtttttttccattagaacaataacatagtattatgtgccttttaaaatttttcatgttattagacaggaagtaaaaatattgggctgtcaagttcaaaaatttatggttaacactggagaaatatcattaaaatttatatacatatatctccaaatgcatgtaaaatttgtccagtgggggacagtaaaaatgagctaggccagtgtatgtggataaataatcatgatcacctgttctgtggtcctcccaacttcataatgagcaaaactggtgctgtcatgttcttcattatttcatccttgctcagaaaaggaggattttcaatgggtcattgcaacctgggtatagcagctaatctggtgatagctatttttgtattcctctaatttttttctttcctttgtctccctgtgtaaccatgtaatgtgacacaatgagtcgttgctatggcttaaatgtgtctcccacaaagcgtgtgttagaaacttaatccctagtgcaacagtgttgggagttggaacctgatgagaggccatgaaggtggagtgaatgcctagtaactccaggtccttcagcctttggactctgggacttgcaccagcagcctcctggggctctcaagcctttggcctttgactgagagttacacctctggcttccttggttcttgggtcttcttattccttttttttttttctttattttttgagatggggtctcattttgtcgcccaggctggaatgcaatggtgcgatctcagctcactgcaacctccacctcccaggttcaagcaattctcctccctcagcctcccaaaagtagctgggactacaggcgcccgccaccacgcctggctaatttttgtatttttattagagacgcggtttcaccatattggccaggctggttttgaactcctgaccttgtgatctgccagcctcagcctcccaaagtgctgggattacaggcgtgagccatcagcggttcttgggtttctgatttgaacagagccatgttgcttctctggttctccagcgtgcagatggcttaccatgggacttctccacccccataaccaggtgagcgaattctcttaataaagccgctctcattttcatctatctatctatctatctatctatctatctatcatctatctatgtatcatctatctatctatctatgctattggttacctctctggagaacctgactaatacattgatatgccattcgtttggaaaaccagaatgcatagccagataatatcttctggaactacttggagtccccttgtttaaagtaaaagtcctgatataatccatgcagttatttagtcaatgccagcactgagtccagtaagggtgccttctagggagcgttcgatggcttctatatcattactgacaataatgacttaggcaattactaaaagaaaaaaagtaggagtctctccattttaaggaggactttgtcatttaagctagtcttgggtttatgaacacaatacaaatcattaatttagtatggaaaaaaatttatcgtaatttgcagtaagctttcactacctaccaataaagaagcactttttcccttacttcttcctatttctatcttgccaactttggagacataagtagcattgatcagttttcagtgatgttttattccctaatattatttaaagccagattattccctgagaagaggagatgaaaaagcaactatttgtttgggtttaggctgaaaactacttggcagtactagaggttataattttgaatttagtataattttgtatactagaatactagtataatttagtgtaattttgaattcagtaaatgtggtagctaatttttaaatctaataatagctaagagttactgattaatgattttccaggcactgttatgcctttgacatgcataacctcgtctcattctctcaacacaacaccctgctgtaggtaacatgattataaccattttgtggaataggaaacctaatcttgggtggattaaataaactgcctatcatcacacaactagtaaatggcaggactcaagctttaaattatatctgacttgtaagctgtgcactctaacctctcagccattttactgcatatgcaatatatttattgcccagattcactgtcacattcatcggctatattattaattatcattatagtcattcacttaacagacaattactaagtgtcatttatgtgctactttggaggaaaaacatcaaatcttgtacatccctcaaggagttacacaaaatgggaaaaggtacagagacgagcacactgtaatttcaaaagccagtagctaagtagtactatacaaatagatgacgcttctgatgaggatacatatgaacgccaatgttgcttgaaacatgggagaaaggcccttttttacttgtgaggcagtttggtggttagaagtggattctgggctgaggctgcctgggtacaaattggtagctggatggtcttgggaaagtcacatgctgtagtttctccaactacaaattagggataaaagcaatacctatcccacaggggatttcatgaggattaaatgtatctattacttagaacagctcccaggacataatcagctttggccagcattgatgttaatgctgaagcctatccattttctacctagtacttacaaggtttgatatttcttctgtaaaccaccatgtattacttgtctcttactgaaatttattttccctacttttaaaatttatttactgttttttttttttttttttttttttggtggggggaggctgtttgtttcctgatactctggtcattttgatcctttactagtgaatctccctccacttcaatttggatattcccattcaatttaagagacttagtcctcttctttccatcctacaaggctgtcatctttcttgacagacaaaggatagtggtcaatctgaaaagaaaatattttggaagaaagaatatagccagagagtgagttatgagttcatatattttctgagcatatctacttaactctttgcttgtatcaggttattctaaagcacttttacttgtctgttccatatccaggtaacagatctcatacctatggagggagaaagtgcctctcttctgttttccaacttgctgtagaaaatgttaaatcacctgaggtccaggaaagatctcaggctaatataatttaataggataatcagagttgacatgaaccatgataaatggatttagaatagccgctggcccttcttctttttgaacagtggtattgagatttgtggtttccctatttggccggccatcagaatcacatagcgtgcttgttaaatacagaccagtccttgctctcatctctcccaccctctctctatctccctctatctccagtgatctgactcagcaagtctgaggtggggcttaaaaatctatatttttaagcactgggaatcactaagattatttatgcatgtattcatgagacatggacttaataatagtaattataagactctcctttttgttttctatattgacattgaaaagtaacttatttgaaaacaagatccacttagcctgctttcttgagttttaatgaactccctagtctctactggggaaaaggggtgaaaaaaacagcagtcattactagcttgttagattagcagaatcagaattttcaagctgaacgcaacactaaagataacgtcattatttattcactttgcagatacagatgcaactttctgcataatgggagactatgatgagaatgctaacaaccacagacattgtgacttcccaaagtaatacagttaactggaacagattcttgattcccagaatatttggtttcttcacttttctaataatcacccaaatagactggatctatttctcaatttatggcatttatgctaaccaaagcaagtgtgtttgtattttaaaaatatagcatagttaaaatatatagaccaggcctgatggcttggtcaacactttgggaggctaaggcaggaggattgcttgagctctgaagttcaagactaccctgggcaacaaagtgagaccttgtctctactaaaaataataataaaaaaaaattagctgagcatggtgacacatgcctgtagtcccagctactcaggaggctgaggttggaggatcgctttgagcctgggagattgaggctgccagtgaatgatctgattgtgccactgtattccagcctgggtgacagaacaagactctgtctcaaaacaaaacaaaacaaaacaaaacaaaacaaaacaaaacaaaacaaaaaactaaagaaaggcatagtaactataggtaacatcctttttatcaaatacctcttagaaccacattttgagaattaaatggaatcttacctttaagaggcaccttgacatcaaggccatagaataaaggcaagagagaagaacaagaatagaaacagaaactgcagaagaaaaagaagaagattatgtaaatctgaatttctgtagtgccattcaggtagtacaaaacctcagcttttccatattgctcaagtctaatcacttcacacatgaacatcaagcacctttttgtttaaaaaaatccacaccttttatgtagctactgacagagtatcagtgttcaactaacattgattcatacattttagaatcatgaggtggtcttacgaacaattggtctaagctcctaattttacagataagaaaaataagcacagagcagtaaatcaatagtttaatttcatacaattttatggcacagtgagggctaaagcttagctagcctgaatcctactttattatatatcactgtctctttcatgcacaagagggtatttcaaaaacacaaaatacgatcagaacatacacttaatcatgcagtactatcttttttggttactatgataggttttaggattaaggcacagctgggagaatattaatctgtaggctaaatatatacttaattactcacagtggaacatttcagagagagaaatggacactgttaataattacattgggttgatgggtaaaaactgggtctgtcctaggcaagtggggacatctggtcatgctattggtataaaacctgcttctgcatcaatgggcatttcacataataaatgcgtgatgttgttccacctccaagatagacttcttcttatttgagtcatggaagttaaatggagtctgatttgtttctcttcaccaaatttttcacttgagaaacagataattggatggacaaacagtgcttgagtagcacaggtatataactaaccgtatactaactataaaaagtcatgggtcaggtcagttttaaaaaaaataattgatttccttggtggttttattttacagagtaagtcttttacttgattatcacactccaggaacataccgttggacacatctgtgaataagggttatgtctggcattctcatattgtgaatgttattagcatatttcctttaatgctactgcttataaggttcttgcttcactatggctaaattctataaacaagttatgagtatggctctaagaggcatgtattggtggctagtctattattctgaaaagcaaaaactgttgcttttcttcattccttgaaggtagacttatagcaggagaagttcgagaatgagagtaatggacgaattcccattcctgctatttctatgagaagatcagatatcagagctacctctttgggcatgaggagatgcccatcacttaatctgtaatgagagtcttaatccctgccgtgtggtgggcagatcatgccatttggagtcagacaccctgacctctggttttgacttgccataaattggttatataattttgggcaagttgtttaatttctttgagccattgttttattatttgtataaaaggggatcataacatctgtagtgtctgtctcatagagtaattatgagaatcagatgaaatgatggcagtggaagtgctctagatatggtgcatacagatattatgctctagataagtgctgcacacagctgaagcaattttgctaggtttgttgttaccaactgattcactgaaataaacaataaagaggggatattacatgtaccctgagtgggtgttcacgtaccacaagggaagaatgaagagtatctctggcatacaggatctttagcctttttactagacttaagggtgaggagaactgaagtccaatgagtagaaggtgaatcataaacctcatctctagtcaaatatctaatcagaagtcaactggattgtttttgaagtggttgaatttgctaccatatgtgaaatatgcaaggttgataattagatccttattttctttgaagtaagattattaccccattatcataaaagttcaggaagttcagacccgtaaagtgtactgagcaaaagaattgtgaaaaagtttacattgaattccaacaatgaacatgatcttaatctcccttcttccaaaatttttgagggttttatttagagaatggctagggtgatgacgttgatagattttgttttctcccctttttgttttttttaaacctcagctggatggggactgaatgggtatcatcgagttttgggggaagaatagccttaactttgacttcttccttgagccagccctagggtagcttatgaattagcagagagagagagctaagagctggccattcacaagtgtggaaaatggaagatattaagtgtggtctttgacaaacagggaagctgaaagcaatccctgccttctgtggggcttcctgccaatcactgggaaatttattgtatgttattgttgcctcactcaatcctgcaaaactaaatagccccttctgaaatgtgagaaattcaaatttaaaattttgcagagaatgtatactttgggtcagaaattttaaaaattacacttttagaatttgacttacacatttttagtgtttcctttttcacataagtgacctcatttgttcctcatggaacccatgggaagaagaagggacaagtgttatcatccctgttttagagatatggcttagacagaggaggtgaagttatttacttaaggtcaaatgagtacctgaagacccaccctatataaaaatctggatgcctggtggtctagctacttgagcccaccaactccctttaacctcacatatatggataattatagaagcaatctgggattaaccaaattttaaccattattgcaggaagggcagatagtttgctactttcttcttgtgtgcctatggaagctattataaaacagccataacattttaccatacagggattcaggtagctactttcagtcaatctgattggaattccagagaaaaacctctttggcatccttgctatttccctcagcagaatattcctggtgtcttgggccagacattttattattattattattattattattattattattattattatactttaagttctgggatatatgcgcagaacgtgcaggtttgttacataagtatacatgtgccatggtggtttgctgcacccatcaacccgtcatctacattaggtatttctcctaatgctatccctccccttgctccccaccccccgacaggccctggtgtgtgatgttccccaacctgtgcccgtatgttctcattgttcaactcccacttatgagtgagaacatgcagtgtttggttttctattcctctgttagtttgctgagaatgactgtttccaacttcatccatgtccctgcaaaggatacaaactcatcgttttttatggttgcatagtattccatggtgtatatgtgccacattttttttttttttttttttttttgagacggagtcttgctctgtcgcccaggctggagtgcagtggcatgatcttggctcactgcaagctccgcctcccaggttcatgccattctcctgcctcagcctctccagtagctgggactacaggctcccaccacctcacccggctaattttttgtatttttagtagagacagggtttcaccgtgttaactaggatggtctcgatctcctgacctggtgatccgcccacctcggcctcccaaagtgctgggattacaggtgtgagccaccgggcctgggcctgtgccacattttctttttccaatctaacaatcatgggcatttgggttggttccaagtctttgttattgtgaatagtgctgcaataaacatacgtgtgcataggtctttatagtagaatgattcataatcctttgggttatatatccagtaatgggtttataatttataatcctttgggttataaatccagtaatgagattgctgggtcaaatggtatttctagttctagatccttgaggaatcaccacactgtcttccacaatggttgaactaatttacactcccgccaatcatgtaaaatcattcctatttctccacatcctctccagcatctattgtttcctgactttttaatgatagccattctaactggtgtgagatggtatctcattgtggttttaatttgcatttctctaatgaccagtgatgatgagctttttttcatgtttgttggctgcattatgtcttattttgaaaagcgtctgttcacatcctttgcccactttttgatggggttgtttgcttttttccttgtaaatttgtttaagttccctgtagattctggataacagccctttttcagatggatagattgcaaaaattccctcccattctgtaggttatctgttcactctgatgatagttttttttgctgtgcagatgctctttagcttaattagatcctatttgtcaattttggattttgttgccattgcttttggtgttttagtcatgaagtctttgcccatgcttatgtcctgaatggtattgcctagattttcttctaaggtttttatggttttaggtcttacgtttaaatctttaatccatcttgagttaattttcgtataaggtgtaaggaaggggtccagtttgagttttctgaatgtggctagctggttttctgaacaccttttattaaatagggaatcctttccccattgcttgtttttggcaggtttgtcaaagatccgatggttgtagatgtgtggtgttatttctgaggcctctgttctgttccattggtctatatatctgttttgttaccagtactatgctgttttgtttactgtagacttgtagtatggtctgaagtcaggtagcatgatgcctccagctttgttctttttgctaggattgtcttggctatatgggctcatctttggttccatatgaaatttaaaacagttttttctaattctgtgaagaaagtaaatggtagcttgatgggaatagcattgaatctataaattactttgggcagtatggccattttcatgatactgattctttctatccatgagcatggaatgtttttccatttgtttgtgttctctcttattgccttgagtagtggattttagttcttcttgaagtggtccttcccacgtaagttgtattcctaggtattttattctccttgtagcaattgtgaatgggagttcactcatgatttggctctctgtctattattggtgtataggaatgcttgtgatttttgcacattgattttgtatcttgagagtttgctgaagttgcttatcagcttaaggagtttttgggctgagacaatggggttttctaaatatacaatcatgtcatctgcaaacagagacaatttgacttcctctcttcctatctgaatacactttatttctttctcttgtctgattatactggccaaaacttccaatactatgttgaataggagtggtaagagacagcatccttgttttgtgccggttttcaaagggaatgcttccagcttttgcccattcagtatgatattggctgtgggtctgtcataaacagctcttattattttgagatatgttccatcaatacctagtttattgagtgtttttagcatgaatgggtgttgaattttatcaaaggccttttctgcatctattgagataatcatgtggtttttgtcattggttctgtttatgtgatggattacgtttattgatttatgtatgttgaaccaggcttgcatcccagggatgaagccaatgcgatcgtggtggataaggtttttaatgtgctgctggatttggtttgccagtattttattgaggattgtcacaacgatgctcatcagggatactggcctgaaattttgttgttgttgttgtgtctctgccaggttttatatcagaatgatgctggcctcataaaatgagttagggagaagtccctttttttctattgtttggaatagtttcagaatgaatggtaccaactcctctttgtacctctggtagaattcagctgtgaatccgcctggtcctgggctttttttggttggtaggcaattaattactgcctctatttcagaacttcttattggtctattcagggatttgacttcttcttggtttagccttgggagggtgtatgtgtccaggaatttatcaatttcttctagattttctatttatttgcatagaggtgtttatagtattctctgatcgtagtttgtatttctgtgggatcagtggtgatcccccctttatcattttttattgtgtctatttgattcttctctcttttcttgtttattagtctggctagcggtctatgtattttgttgattttttcaaaaaaccagctcctggattcattgattttttgaagggtttttcgtgtctctatctccttcagttttgctctgatcttagttatttcttgtattctgctaacttttgaatttgtttgctcttgattctctagttcttttcattgtgatgttagggtggtgattttagatctttcccactttctcctgtggggatttagtgctataaatttccctctaaacactgttttagctgtgtcccagagattctgttatgttgtgtctttgttctcattggtttcaaatagcttatttgtttctgccttaatttcgttatttacccattagtcattcaggaacagattgttcggtttccatgtagttgtgtggttttaagtgagtttcttaatcctgagttctaatttgattgcactgtggtctgagagactgtttgttatgatttctgttcttttgcatttgctgaggagtgttttactttcaattatatggtcgattttagaataagagctatgtggtgctgagcagaatgtatgttctgttgatttggggtggagagttctgtagatgtctattaggtctgcttggtccagagctgagttcaagtcctgaatttccttgttagttttctgccttgttgattagtctaatattgacagtggggtgttaaagtttcccactattaacgtgtgtgagtctaagtctctttgtaggtctctaagaacttgctttatgaatctgggtgttcctatattggatgcatatatatttaggatagttcgctcttcttgttgcatcgatctctttaccattatgtaatgccctgctttgtcttttttgatttttgttggtttaaagtcggttttatcagagactagaattgcaaccccagctttttttttgctttccatttgcttggtaaatctttctccattcctttattttgagtctatgtgtgtctttgcacatgagatgggtctcctgaatacagtacactaatgggttttgactttttatccaatttgccagtctgtgccttttaattggggcatttagcccatttacatttaaggctaatattgttatgtgtgaatttgatcctgtcattgtgatgctagctggttgttttgcccattagttgatgcagtttcttcatagcgttgacggtctttgcattttgggttgtttttgcagtggctggtaccagatttcctttccatatttagtgcttccttcaggaactcttgtaaggcaggcctgatggtgacaaaatcccttagcatttgcttgtctgtaaaggattttatttctccttcacttatgaagcttagtttggctggatatgaaattctgggttgaaaattcttttctttaagaatgttgaatattggcccctactctcttctggcttgtagggtttctgctgagagatccactgttagtctgatgggcttccctttgtgggtaacccgccctttctctctggctgtgcttaacatttttttccttcatttcaaccttgcttaatctgatgattatgtgtcttagggctgctcttctcgaggagtatctttgtggtgttctctgtatttcctgaatttgaatgttggcctgtcttgctagattggggaagttctcccggataatttcctgaagtgtgttttcaaacttagttccattctctccatcactttcaggtacaccaatcaaacataggtttggtctttacacatagtctcatagtctcatatttcttagaagctttgttcatttcttttcattcttttttctctaatcttgtcttcacactttatttcattaagttgatcaatctctgttatcctttcttccacttgattgatccagctatggatactgcatgcttcacgaagttcttgtgctgtgtttttcagctccatcaggtcctttatgttcttttctaaactggttattctagttagcaattcctctaaccttttattaaggttcttagcttccttacattgggttataacatgctcctttagctcagaggaatttgttattacccaccttctgaagcctacttctgtcaattcgtcaaactaattctccatccatccagttttgttcccttgtttgcaaggagttttgatcctttggaggagaagaggcattctggtttttggaattttcagcctttttgtgctggtttttcctcatcttcatggatttatccacctttggcctttgctgttggtgaccttcggatacagtttttgcatggttgtccttttcattgatgttgatgctattgctttctgttagttttccttctaacagtcaggcccctctgctgcaagtctgctggagtttgctgggggtccactccagactctgtttgccggttatcaccagcagaggctgcagaatagcaaagattgctgcctgctccttcctatggaagcttcgtccctgaagggcacacgtcagatgccagccagagttctccagtaggaggtgtctgtcgaaccctcctgggaggtatctcccagtcaggaggcacgggggtcagggacccacttgaggaggcagtctgtcccttcacagagcttgagcgctatgctgggagatccactgctctcttcagagccagcaggcaggaatgtttaagtctgctgaagctgcacccacagctgccccttcccctaggtgctgtgtcccaggaagatgggagttttatccataagcccctgaatggggctgctgcctttccttcagagatgctctgcccagagaggaggaatctagacaggcagtctggctacagcagctttgtggccctgtggtgggctccacctagtctgaactttcccatggctttgtttacactgtgaggggaaagcagcctactcaagcttcagtaatagagaatgcccctccccccaccaagatcgggcaccccaggttgacttcagactgctgtgctggcaggtagaatttcaacccagtgggtcttagcttgctgggatccatgggggtgggatccgctgagcaagaccacttggctccctggcttcaggcccctttccaggggagtgaacggttgtgtcttgatggcattccaggtgccactggggtatgaaataaaaactcatgcagctagctcagtgtctgcccaaacagcctcctagttttgtgcttgaaacccagggcccttgtggtgtaggcacctgagggaatcttctggtctgtgggttgtgaagaccatgagaaaagtgtagtatctgggccggagtgcaccatccctcatggtgcagtccctcatggcttcccttggctaggggagggatttccccgaccccttgcgcttcttgggtgaggcaacaccccaccctgctttggcttgccctccgtgggctgcacccattgtctaaccagtcccaatgagatgaaccaggtacctcagttagaaatgcagaaatcacctgccttctgtgttggtctggctgggagctgcagatgggagctgttcctattcagccatcttgctcgggaattccaggctttggctttttttgttgtgcaagcctgtgtagctcgctgctgcttgttcagcatcccagcctgagctctgtctgttctcccaccccacacgcatttccaagtgccctctgtaagagccatgttgttatatccctcaaaaacactggctgacttggaagaagcagccactctttgagatcactggggaagtgacaggacaacatgattatcatatatcaacccaagtttctgaatttactgttaaggtgaaactgcagcacaaggatgaaaggtctttttatgaatgataatgggaaaggtaaaacaaaggtgctaaaagatttttttaaaaaaagagcaaagtagggtaacaaaacttgaagaaacttttggaaaggaaatgaagataaggaaggggaaactaaggaaagaaaacacagaaaaaataggaaagcaacacaaaagacaaatatgtgaaggctgggttactgatggcagacgctttgctggcattctgtttgactgaaggtgaaagctaggtttactgtaactatacctgcctctgcaagacacacaataactgagaagccaggaagaaaatacagtgagcaaaatcaatattgctttctgattaaacaaataataagatagttattgaatttgacacctaccttttcttctaagtcttttatttgtcttttctggatgtctgttttatcttctaagtcacgaattctctgaagaaagaaaagaaaagaaagaaagcatcagtaggtggtaagttgtgcggaaaaataatttaccaaatgaaaacacgaaacttcctatacaaacctgaatatttgtacaagcagctggaaacatcgcatgtatgttttccccacccaaaaacatgttgcatgtttcagaaattatctatgtttgtggtagaaaatcattgctactgattaacttttcaaaaaatatttgccaccttttctactgagcctatccctgtagaccccttcctagtgaggtgtagattccacaccactgacattgagtttggcaaagagacttgttttggcctgtggaatgcaagttggaataagatttgggaatatcaaatccttgtagagggtgtagtatatctcagaagtagacagcaagaaacaagctttgttatgaaccatttggattgagattttgattgtttgttaccacattaaagatggttgaggctgactcatatagatgtaaacaatccaattgttctttcttaacctttttatcttaaccccatttcaaccctgtttcaggatagaattttctcacaaaatagaattggtaaattcacaaaacaaagtagagattacacatcaacaaacattcccaggagggaactggtaaattaggaaaacaccagaatataacaaacataacacaagtaatcctaaagatgaaaagttccaagactgtctttgaacttacctctcaattatgtaacaaaattccactaatttaaacaccgaatatttgaaatcaacattacataacaactatttacaagtaaaataaagtcttcacatttatatctggcaatctgaaggtttttttgtgttcatgtacatggttatataatgcaggcttcttatttaatacctctgtagggaataattagaaaatagagaaatggagtctatggagaaaacactagaagccaaatgggatgataatatagaaagagaggtttttataatgcaatggtaggagaaaaaaagggaagctagaacaaggggtacttgaacttggaaagcatatctccttctctttaaaagagtagatctcaactgtttgtctctccctgccccagccagggacatttggcagttctgcacatttttttaaagttagttaatatgtttatttattttaagttgtgtaattcagtggttttagtatattcataaaattgtgcaaccatcaccactatctaaatgtcttgacatttttgtactgtcacaactgggagtatgtgcatctagcatctactgagtagaagccaggaatgctactaaacattcgataaggcacagaacagccacccctccccctaaaaaagaataaagaattatctgcttcaaaatttcagtagtgctgaaattgagaaactcttctttaaagtaagggggctaaggtttgtgcaacaagagatggtgtgttttggtcagagtgagaccataaaggttaaccttgaaattataccataatgaatgccggagaaagggatggaactggaatgttgatggtgtgtttatacgtgtatgatttgtgtgctggtgtatatttccatagtgctgtcagtgctccatagctacacagtaaaagaataaatttgctagatatttccaccttgagtgttcacgtaattccttggcatgtctgctggatatggaggcaagtactatatggacaaaatcatgaatatgtaaaattactgcagtatccattcagccatcacatctatgcttgttgggcacctccttacatgctcatgactctgctgaatgtaatggacaatacagataaggcaccagttagttcccagtttcaaagaactatcagatccagatggaatagcaaaactaaatagaaaaggtaaacaatggaaaaaaactgaataactttgtcacccatctccaattcctagtgcagtgttaagcatggagaaggtgtccacacatatttttttgtcaaataaatgtgttatgctacatcatatgacgtatacttgatttctttttgcttcccatccctttgccatccacccaacagaaaaccttgctggatctaaaacattccttttctacctacttctttttatctctactgataccaagttcaccaagtcattgtcttcccttgtcagggctggtgtggcagcttctacctgctcttcctgccttttattttgaccatcttactccatcaatagcagccattgtgaactctcagaatgtaaaaatgatctccatggtcccctgagtttaagcgggtggggaagaaaagaaggaagagttagttgagttgtactcagaataaaactcaaactcctgcaaagccctgtgtgatgtggccctttcttagctctgcaacgtctcctcctatcaacctcactctggctctgcgtgctcctgacattctagcctttgctctgttccttgactattccaaacttattcccatgatagggacttagcccttgctgtccctgtcttctgggacacttggccaagatctttgtgtggctcatttcttggatcgtaggtatcttcagagaggcctcctctgaccagccaacctaaagtggccaatcctactcccaaactcacatacacattgtatacgtttctgcatagcacttattgccactctcagaaattgcctcagtcattgttcatttgttctgtggctctgcccctgtccctctgtgagatagatgagagtagtgatctgtatgtctttgcttaccattatactcccagcacctggtacacagcaggccctcaataaatggttgtgaatgagtgcataacagaatatagaatgtagatatcttgagcagtatgtggttcatttttaaaattttcatcagggagaggatcctgaatgggttggatcttaaactgggactggaaaaatgagaacacttggatcaatgcaatggaaactaatggacactttaggatgagcaattatgcaacaagggcttagaggtggaaaatcacagcacaagtgggaccaggatgttttgcatgagtggagagggaagtatgctctggggttgggtcaaatctggttttggagggcggggtagtcagctactgaaggacctgaagagacctgcgtaagactctactcaactggaaattggatcatggaggctttgaggcaagaatgtaccatgaggaaaaatgagaagaatctgtgatgagatgtgtgttggattgaaaaggggagagctagaactaggtcctcatggcacctgcatgtacttttaaaaatgctatttattatgatatatcataattatttttctttgtgttgatcattttataaccatctatgggtccttcgttttgtgaaggcagggtccacggtgaattctctgtctagcacagtacttagcacctaggaaaaacatttaaaagtttgactgaataaatgcatagatgatggagtcagattcacacagagaacatttggcagtacctggaagctggtggaataatgaaaggtcctgcacgtgcctggggtgacaaaaatgaacaaaatggaccagtatcaaaaacatttcaggggaaatgccagttggatgtggtgctgtattaatgcttacagggaaagaacagagaagactccagtgtttctagccggagtgatttgagatatggtaattctactgactaagacaggcagatggggagagagaagagaagtaaggataagaacgcatcagttcactcttaaacattcaagcagaacggtgtaatacatggttagtgatatactttagaagttagagtgtattacatagttatatataaaaaatcctggccaatatcttctggaataattctatgaaactcagctattaattaaaagggaagaagaagagtaagaaataactgggaaaggcatattctaatgaacatttgtttagaagatggatggaaaatgtcaatgaaactccctgaggttcagaaatgtactatcagcactactggataacttaaacaaaaccaactctttcagaggtgaagtatcttagctaaatggttaaagaaatactcaaatggaatacagtttttatcataaataaatttagataactatgagtccatcttaaaagtaaacacttcagtgtttccatgacataactcccaatttgttgaaagtaattacatgctattgcagcacaagaaatttgtgcagagtacatttttatcccctgctagaagaaaagaatgcatgaagcaatgcaatgatggcatagagtctattattaaagactttaagaagtctttccatgggtcaaaactcaaacttttgtgatggaatctgaaggggcattaataggaacatgtaggtatttatcatttctgggacacgtggcttcagaattctccacctacttgggtaatctattagcctataaaatccacaaagctcctgcctgcatctgaagtgtgctaagtgtcatgtcccccatgaattgtttttatttgcctcataaaagaacccctgcctcttttccacttaccttgattgctgatgaccacacgattcttaccgcctattcataccatctgaattttgtaccagttgtttcttatagcttctgaggattgaatactataacctgacactttcaatgctggaatccttattgaatctgtattttgaccaggacctcagccctcaactgtcaggctatggcatgaataaagagttacaattaaaaatttttgctggaaattagtagtgggtgcctattttggaccttgctgatgaatcacataagtcatggatgacggtacaatacagtggttagacacactgaccttggagttcagcagacctaggctgtcatcctgactgttgcttaccatctgtgttatcttgggcaaatcacttaagcattcttatctacagtattgttatctccaaaattgagataataaaaatacttacctcatagggctattatgaagattaaatgaaatgatgtaagtagagtccttagtttagttactgacataaagcaaatgtcagtaagtaaacagcagctgccaggctttgttggtggtgatgtttgtaatgtgaacggtccttgctctcttttacactattcggattattatcaggcttgtttacggactggagtgagcaatacatgggaagcactatttttgccctggagagtgtcctgcttccctgcataaggcagataatcagacaccatgaaattcaaagggtatttcatgaaaacgtagttctaaaaatagtagcagtattcagtccttctgaaatgccaattttctcaagattgaattattataaaactgtcatttttgtatgtgcatgaaggtagaaaacaatggttatttattttactctctgaaaataacttgtatctcctgggcttctccgtacccatactcaataccgtgtacctagtactaagttccatttgctagtactaaccctacgcagaggcagtgactcagtcctcacctgatgggcttgctgtaagagctccattctctcctgaagaatctgacagtcatactctctgctcttcctcagcatttgccgccgtaacttttctactgccgtcctcagctcctcttgctgtttttcacttaataattcaccaaacttgataacagtttcttgctgtagagcattgtacaaagtagcttctagttcctggattctctggcaaatagaattagaaaagtctaactttggaacttggcattgatatctggtgtgggagtgtatgctatgtatgtatatgtatatggctgccaactttaggcttataggatcttagcaagaaaataattttaaaacttctctagcctaattacacttctgaaaatctccttttatgagattccataagggtcatctagccaattcatgaacttctctagtgagggaacatttgttctttcttgggaccctgtccattttatatacttttcctaactgtagttcctatcctaaagtgtagctgagaataagtgtgttctcacttctacttgacagctctggccaggcacggtggctcacacctgtaatcccagcactttgggagcccgaggcaggcggatcatctgaggtcaggagttcgagaccagcctggccaatgtggtgaaaccccatttctactaaaaatataaaaaattaggtgggcgtggtggtgcgcacctgtaatcccagctactctggaggctgagacagaagaatcactggaacccgagaggcggaagttgcagtgagccgagatcacgcattgcactctggtctgtgcaacaagagtgaaactccatctcaaaacaacagcaacaaaaaacaaacaaacaaaaaacaacaagacagctcttcatacatttaaagacatctaccacggtggccatacttctggaaataaatagtctaagttagaacaaaatactgcccccgttttattaatacatgacaaacctctggtacttgaagatggctttatggtcgccatattttttcttgaaataaaattgagaaataaaatccaaaaaatgacctaaagttttggaattggtctgtttttaagttctctgagatttatggctgctctcattataatatttctctgagtctttcttttgtagatgaaggatgcactgccttcatctttttctttctttttttgatatgcttcagataacagttgctaaaatctacaatcttatcccttctaagtttgacagaagtgaccagacatgctttggtgagaaatattttcctagctcttgtcctgggctaagcaggtctcatctttttaaggataaatatggttttctgaatgagtactcagtagtctcgggacccacataaacacacaacttaatttcgtataggtagaagaggcaagggtgaaaggtagaagtgaagcaaaactcacttccttctctgtctctaattagcatcaaatacccattctcttctttccccatcaaacaagctcagaatctcttactcattttggaatgcaaagacaagttcatctttgttacaagcagggactaagtgcttcactctttccccaaaagtgactcaagctgcttccaggaaagcattataaaaacctctgctaggaattctttgaaatgttcctttaacttgctctttttcttttgattcataattgtgaattaatggagggtggagcataaggagagaagaaatgtgagctgtagttcattatgaagaagcatgcaataggaatttggtagaggggaatggatcacatgtgctccttaatcagcataatcttctgtgggagacaaaaaggcacagcccatttaccatggaagcctcagttactgtggctggattatagtaggccacaggatctggagtcagatctacacactacctatttatcaacttgggcaaagttcttatattctctaaatcttactatcctcgtatgtaagatatgaataataatcttacctatacctcacagagttgttgtaagagataaatgaattaaaaatatgcataacaaacattaaacacattattccaccactagatcagactcccaaatgactggatttggtttaataaaatttctctttaatctacactgccatccaaactgttcttcatttaatattatccaacaacatatatttaattgtttttgttttattttgttttgagacaggatcttgctctgctgcccaggctggagtacagtggcacgatcacaactcactgaagccttgacctcccaggctcaatgaatcctccctcctcagcctccttagtggctagtactacaaagtgcatgtcaccatgattggctaatttttgtattttgtatttttatttttattttttggagatacaaggtttcaccatgttgctcacgctggtcttgaattcctgggctcaagggatctgcccaccttggtttcccaaaagtgctgggattacatgcatgaggcaccacgtctggccttttaattgttaaaaaatgaagtataattaaatatttattaggtattataagaatatcttataagaatcttagaataagtaaagagctaggaatgtatttgttataaaattagatctgaaaaccagtaaatgaatgaactgcatgtcgtgatctattcaagtacatagcatggaaaattaaaaaggatacttaattccacagtgcataactgtaaatactgcgggtgtctctatcacttgttgtacctaccatatatgcttggtcaagagcttgttttctgtagtctagttcttcctccagatagccttttattttgcagaactgttcctataacaaagggccatattgatagagtcagcttagttaactagaaagtgacgtacaaatggtattgattaatgtttcctctaattctaccataagacaaatcactagtatttgtagagtcataaattttgtctgttagggaaatagttcaactctcatagtctcacacaggaatgtgaaaatcaatggaaagcagcataaaagatataatgaaaaatccacatagaatgctctaaaagatttttaatctgagagcacgtgattaagtatagattttgactagtgtttaataataataagcctatctatgtaaaagtattatgataatatatttttgtaagaatgtgataaaatgtaacatagctgggttgcataatcaacaagtttaactgattcaaattcatctgtgtacaactagcaaacataaggacaaaaatagcaacttaaagagtgggagtgattccacccacactgctgcttaatgagtgggtgtctgcttttgccacaaagccagtgtgagctgggaaaagtcaatctgatgttccctctcttgttctcagtttctgtgtgcttctcatattatcagcatcttgccattagcacttaaaactatattttgggtacaacatagtcccaagcacaagtcaattgtttctttgggtgtttaactgaaggaacaaagacttcttccaactctgaagaaaaactcaatggtgttgacttttgagagatcgtgtatctgtatggagtaattttgctgttgactttgctggtgactgctgaattccagtacctagaacagtgcctgatacagactaattgcttaattaatatttgtgtttttaaagagctttcaagggtaattttgaagagaaattgttcatttggaaagctttcttggccaaatataaaaataaaataaaataacaaactgttctttttacatgctttgacattggagcctaacctcttagtaaaatgtgagcactgtataaaatataagcaaattataagctataatgtgccacacaaatgcaagttgtttttataggattccctcatccaataggaatccacgacgttttctagttataatgataacattaatcataatcttgttataaatttctgttttttttttgagacagagcttcgctcttgttgcccaggctggagtgcaatggcgcgatctcggctcactgcaaactccgcctcctgggttcaagcgattctgctgcctcagcttcccgagtagctgggattacaggcatgtgccaccgcgcccggctaattttgtagttttagtagagatggggtttctccatgttggtcaggctggtctcgaactcctgacctcaggtaatctgcctgcctcggcctcccaaagttctgggattataggcatgagccactgtgcccagacgaatcttgttataaatttctatgcattgctgtaagttaataataaccaatttttagacttggtgagtaaaaagaaacttttaaaattgtggtaaaatgcacataacatttacaaccttactcatttttaattcatttttgagtgtatagttcagtagtacaaagtatattcacattgttatcaaccaatgtacagaatttttcatgctgcaaaactgaaactatacccattatacaacagctctatgtttccccttctcaccttctggcaaccacagtctactgtctgtttctaagttggattactctagcacctcacatgagtggattcatatagtatttacaattctgtgaatagcttatttcacttaacgtagtgtcctgaaagtacatccatattgtaacttgtatcagaacttccttccttttgaaggctaaataatattccatgatatgtatacaccaccttttgtttatctgttcatccattgatggacatttgggttacttctaccttttggctattgtgaataatgctgctatgaacatgggtgtataaatatctcttccagactctggtttcaattcttttggatacacacccagaagtggtattgctgaatcacatagtaattctattttgatttttttgagcaaccaccatactttttttcatagtggctgtaccagttttacattcccatcaatagtaaagaagggtttcaatttccccttatctttgccaacacttgttttatctttttggttgtgggaacacagggtcttgctctgttgcccaggctggaatgcagtggtacaaaaatagctcactgtagcctccacctcctgggctcaaatgatcctcttgcctcagccccctgagtagctgggaccacaggcacgtaccactatgcccactaattattttttgtagagatgggttctcactatgttgtccaggctggtctccaactcttgcgctcaagcacacttcctgccttaacttcccaaattgctaggacaggtgtgagccactgcactaggtcttttgttctactctttttttttttttttgataagagttattctaatggatgtaaggtggcttagggatttttaaaatcagagttacaccctccatttctgtaatttttccttgctaattaaataaagtggaaaaattatttagcctaagaaagaaaacataagaaaactcaattttcttcggcattagttttggatattttccaaaaactaacattttttggggggagaatatagcctgaaattgtttggtacttctggtaattttttttccatcttctgtacataaaataataatggaaagatgacaaactttcatcagtgccagataaaactggtagaggcaactttaattttccatttgccttgtaagtttttcttaatttttacaatatctcatcttgtacttaccatgtcactttccaattccatcattttctggtgtagggcagcctcagctccttcaatctgctggatccactaaggggttaacaagacaaaagtgtttgacatggctgcttgatatggtgtatatctgtgtgcccccatgaggtgctccgtctcctccccttatatctcaggaagaagactgagaactgaagcaaaaacaacacctttttttgcttgtttgtttgttttgtttttgaaacggaatctcgctccgttgcccaggctggagtgcagtgacgttatctcggctcctgcaacctccgcctcctgctttcaagcaattctctgcctcagcctcccgagtagctgggattacaggcgcctgccaccacgcctggctaatttttgtatttttagtagagacggggtttcaccatcttggccaggctggtcttgaactcttgacctcatgatccacctgcctcagcctcccaaagtgctgtgattataggtgcgagccaccgtgcctgacccacatttttatctcatagttcagaaacaagactacagtcttccttgtattcattcattcacccattcagcaaatgcatttatggatgactagcaagtgtcaggtgctgtaccaggtcctagggctgcagtggtgaaccagatcaacaagactcctgcccttattggagaacaccataggaggctttcttgtgagtgataattgcactggggtccaaagaatgggtgagagatgactgggaaaaaatgaagaggaagttccaagtggaagggacaacatgtccaatagctctattgttggaggaagcaggatgagagaaagaaggccaggtacactggagaattgggacaacggtaatttttcagtatataaaactgattacagcaaagtggggaagaattatttttgtgaagtggaggtgttctaaatcacataaaaacttatctttcccagtactcagaatatatgatatttatgttagcattgataaacactctgaatgcagactttgaataatgtgaccctaccatatacaggtttttatagaacaaattattataatgaatctctagcaagttaaatgtcagcttatattttagggaagcaattgggcataataattaagtgggttctgaagacagactaccttggccgtaatttcaattccagcttttcatgggtgggtggcatggaaaggttacctgatttctctaagtctcaagtttcttgtctgtcaaatgggattaacaataagtaaagattaaggaagtaaaaaacatgaggcagtatccattgtgtattggatgtactagtggtatctcactacaaggtactatttatttatttatttatttattattattttttgagacaaagtttcactctgtcacccaggctggagtgcaatggcacgatcttggctcactgcaacctccgcctccaggttcaagcgattctccagcctcagcctcccaagtagctgggattataggtgcacgcctccatgcctggctaagtttttgtatttttagtagagacggggtttcaccgtgttccccaggctggtcttgaactcctgagctcaggcaatccagccacctcgacctcccaaagtgctaggattacaggcgtgagccactgcgcccagccccagatagttctttctaggttacctgtgataaattatgcagcacagcgagacttttatacacaacagccttgatacttacaaggggataccatgttcaaccactccttggctgtggggaacatggtgaaagaaaagaggcatgccgagactggagaggtgctaagttctttgcacatacacatggtttccccttgaaacaaatttctgtcaatcatgggttttgtgtaaatagactcatattgcaattgtacccatccaaaacctaaaatccttcatcttgcttgctgtccatttgttatcaagaaacatattttttaaaatcatgtttttaagagtactgtgaactaaagtcattatatcatgagcattagatatagatttgtgtgttggttgctgttccttcctacttgtgtaatccaggacaagttactgaatatcccaagcctcagtttcctcatgtataaaataaaaacaatggtaccccaatgtacattatttgggcggtggatacactaacagccaagacttcaccactacaccatgtatccatgtaataaaagtatacctgtactccgtaaatttatacaaattaaaaaatagtgacagctgtagaatggttgtaaggaacagtacataagtacataatgtacttatggcattgagtgcagtatccagcccctaatatgttctcactcaaggtcactgccattatttttaatacaaagtgacaactgggtttgcttgttggaattttgtctaggctcaaattctggctaaagatcatactcccatataacagagtgctattcaaattggtagtctcaagacattcattgttgttgtttagaattacttggatgtagaaacttttatctgtgaatcccacagacaagagataaatttaatctgtgctttgcaaaagtctgcacaaaaggcagctgaacagaccatgagcactttagggaaggcttgtgtcttgttcatctggttcctagctttctaccacagtgctaagcacagagtcatcaccctgtatttgttcaactggtccctatacctttcttgcaaaaaaagtaagcagaggcatgggctaatttgcctcagctccgacagcccagctcccatggggtctgcaaagcctatttcccacaggaggaggagtttggtgcaagacgtaagatcatgggctttagaaccagactccttgggtgtgaatcctgactccatcaacttcaggctgtgtgaccttaggcagttatctaccttttttgtgcttcagattccttgtgtgaaataaaggtcacactagtacctagtctccagcagttagaaagtgcctatctcaaaaggagcactgcgcaagtcttggttctgataagcacagttgttggttctgataagtacagttgtactgcacccacacagggcagggagcagaagatatttctcccatcagtctcagtaaatgtgagacacacaaggctgtatttcctttctttcacctcctcaatcctcatcttccatagaatcagcccatgttttgtttgtagccctaaacccaggcgattttttcttgcagtaaagaattgcagcccttcatgattccagctgaataaggctctcttgctatcattgccagatgatagcagcactggaggcacagactgtgtttttttcatctttgtgttgtcactgaaatggtgtcttatgagcattcacaaattcacacctttgctccttcagttaacatttattcatgacttactacatgtgctggactagtgtgaaaagctagggcaaaaaacagggggtggggagtggagagacacaactatttgtcctcatgggccttagagtctagtggtagttagatggggccatatgacaaatgcaaatggacagtgtaatgcaattgtcaaaagccatgggagcagtagcacaggccactgtgggaacatagagcaggaacacctaagggggcttggatgaacaggcaggcctcctcattatggggaagtctgatgctcaagatttagccaggcagaggtagaaaggcaagatgggactatcttccaggtaaaaagatcagtgtaaaggaccaagagtggagaatggagagagaaagagagagagaatggagggagagaagggagaggagacactagagaaataggtagataagactcaaatcccagagggtctgtatgccaaattctaaatttggaccttctgttagagataatgaggcatttgctggggagggatcagagaaagtgattaggtctgtaattaaactgtgtaggaagtaagtttttttaaaagaaaaaattccagctttcattttatttcacatgtaaatacttcaatgtgtatctctaacagataaagcctttctgtaaaaaaaaaaaaaaaaaaaaaaaaaacccacaaggttattggtacactttacaaaattaacattaattacttttgtcatctgatacccagtccacattaaatttctccagttgtcaacaaaatgtcctttttaaaaaacacctggttaagtgtctttttatttcatagctatagttctttgttctccctgttttttatttcattcttttgtttgagtaacttaactgttatttggcccgtagaattccctcatttcagattggagagagctgattgcttgctctcattttatccaaccatgtgcacatgactctcaagtatttactggtactttttttttttttttaaaggagatggagtctcactatgttgcctaggctgaagtacagtggttactcacaggcatgatcatagtacactatagccccaaattcttgggctcaagtgagcctcctccctcagcctccaaagtagctaggactataggtacataccatccagccaggctttatgcattgattcatgaggtactctgaatacaccaatttatctggccatttaccaggtttagacacaaggtggagccagagctcagtcagtgttgattttctcctgacagtctctatgtcggactttctgaatgagaaggcaatgagcccctactaagccacaggatcagttgggagcaatggtaggtacacaccccaggataagtctatgataagagcaatgctccagtttatcatcgccccgcagaattcttctttgtggtttcccagcttggtagggattgtgtaaataatgtaatctagaaggttttctgtttttaaaaaattatatatatttttaaggaacttcaaagcaaaaattagccacccatcccaaatcagtgtatagacttttcgtttgggtgttctcattctatctgggttgtactacccttaaaaataaaatgtgtattaggtattcacacacagtcatgtgcagagggaatgtccttcacaccctagtctgctcgttcagtattaagccagacaccgagatgatttgaaatgtttgtacggctcattaccttctctgccagggacagcacagtgctggcctgaattatggccacttgttcttcatttcttaaattctgtaaaaaataagaaaggccgtcagctgaacatactgacattatttaccccaaagaaaatactgtctgactgactgctacagagcattctgtataagcctgtatagaaacttaacaaattcctattctgtttagtaataattctgaacaaagagttaatcaaaacccggaagaagtatattaaacgtgattttttaaatatctccttaacaccgatttgattttgtgtcactggaggcatactttattaatagtcatgttatgagaaaaacagaaaccaaaatggaataaaaaacagtctcttcatagaagttttgatgtaattttactaattctgttctctcctttgataatttttcaagggaaaaacggtgattctttcaacctacaagcaccaatcacatagtatcacaataaatggtcctcccactgaattaatgtgccttgaccctgtctggaagatgttttcggaaagaaaatgcattatagcctcctggtccatttttatggcactgccaacaaccctagtatttagcagcctttgcaaatgcgtgactgattaatttcacactggatgcctttgagctagagtcagacaataattagctttacttattggagatgtggtcgacattcaaacctgaaacctgcccgcaaaaagcactttaccaggtctcatttctgctactaccttccagagatccttacaaccccttagccaagttgtttgataaattgtatattcttcccaaggagcaacatccttaagtgaaatggcatctcacttgctcttactttacacatgatgcattgttaagtatctcttgcctctgtttaggcaaattcatatctatactaaatcaattctttacttaccccattatcacccaagatatcaagctgctttatgagatcagggatgttcacatcctgcaaaatcaagcagaaactcatgtcaaagacaaatgtggcctcctattccatcagtgcctgaacatgaagttagaggaagacattttagggcctgaacttccttgggatgttttcaatctggcacacctagttttaagtttcaattttgcttcttacatgctgtgtgaacttgggtcaggtacttaacagatcattcttaattttgctagttgcaaaatggagataataaattcctacttcataggctgagctgatcttcaggataaacagactgtgtatgaaagagtctagcatgtagtaaaagacttggaatattctcattaactttcttctcatgactgccaaatcttttttttttcaattgtgataggctttcaggtataaaaaagtaataggtaataaatataaagaatcaaccaattttattctaattagcaaaattctgacctgattgaattttgactgccatgtagaaaactatagtgcagtaccatttttttaaaggtggttagcattaatttcatctatcttatttttaccctgttccttgagtcagtttgaagcagctgaactccattcgaaagagttcattggattaggttgtttgtgatttatctgagaaaaaatgcatcgaaggaaaaggcaaagtaaattcttttcatttaattacagtgaaatccaaaaattgctttggttgacaaattaccatgccacccaggaaggccagaagtttaaacaccaggacaatggtttaagatggaaggcaaggaaacacaatattaccaccaaagttttctccactttttaccgtattagtactatgttctcctctttctcatgttcaaacagcagtatagtagagccctaccaccaggaaagggaaagtctagctcaatctcataagtacagagaaggcaactgaagcaagtatatttggcagctcagagtgggagcaggaagggccatgcagaaggtaaggagagaccaggaatagcaggcagcatcccagctttaccccaggaacagatattcacaatgtgatttcactgaaggacaatatatttccccgggggaagagctacctcaattcaactctaatacttaaaatatatccagtagcactaaaaagataattatattctatttaatatgcaacctgttataaaccctaagcccttccaaaagaggaatcctccctaaattaaacacatcaaaagagatgttggactagatgacttcaaaccttttctaactctgcaattccataattatgaattccatagcacctagaatggctcaacaaagggactcaaacttttctatctggcagacttgaaatatatttcttgaagtattaaatcgaattcacatttctcccaggtaattaaggctaattttgatgcagcgtctttcttcatatgactctgttctaaataatcatggatgcctctgtttcttctgttatcatttgtatatctgtcacacattaaaaaacattctgttaattttctagtagaagtgactattttcaattcctacatagtttgtatcaaaatgatgacatccagtgactgaaagacaaaatagtcgtaagtaacctccccttttccaattcccagtttttctaatttctacaaacataaaaaatgaaatatctgcctaccttaacaccttctttcatacagtagatctgtagagcactcacaccatctgagaatgggtgaatttggagattaaatggaggggatcgtctctctctctccttgaaacacagtgaagaatatatggaaattaaaaacaaaactgattaattaaacactaaaccagtggtctctttatgctatttcagcagtttattactgtcatttggcaaaaagaaaaaaattcaatctcaagatgttcatgattaaatgtgacggaaaaagctgactagtcaactaagagattgagaagaagaatttatagatggtgtcatccattcttccaaattttttgatcagggaaatgcaggaagtggagctccagtttaaactgtatgaatatttagagctttcaaatatctcagcgtggtcttgccatgaagttttatggccgctaacagccttttgcatattcaatctattcaagcattatgagaaagatatgtgggctacaaaagaatgactcttcttcactgaagcctactaacacctaactttttatccagacctaattcaaaatagcctaaagaagaactaactggcaaaataacagaaatcaaatgggaatttttcttatactttatatatcaacatacactgaaccagatcctaagtcagattctgcaggatacaatcaaaatctgatgtttccatgttttacttgcaaaataaaaaacaaacacctgaaatttggtcagattaatcaaggtattttctaagacaagttaccttgcttcttagtcttttttttcataaatgcattagggactaaaacgtttacttataaattcacatttacctaaaaaatattttttatatagcacattttgaaatataagtattgaagtaacatgttttaatgagtcaaaatttaattaaggatggacatgagtatttaaaaacaacgaatgttgaggatggttgaaatctattatttaacttatttaaaaattatttattagtcttgctcataaaagatagtaatgttgaaaagcacagtatctaagtagacagttttgagttgcatcagagctttaccacttactagtcacaggacttaggcaagttagttaatctcagttgcctccactatataattttgagggtgattgtgaggtccaaatgagagtatgaatctgaaatgcttaatacagcgcctagctcctcaatgtgctctgtgcatgttaatcattacgattatttttattattatcatcatcatttccttacttctagctctaggtttcgaaactccagcagctcattctggtctctggcgtcctgtagttcttgttgtaaccggtgattttctgcctcctgtttttctatctaataaagtaaatcctgaagttaggtaagcattgagaaaagcacctacaactttgcaaagcatgaatagtgttcagtttactcagtgaataagtcttccagaccatgaaaaaaaatccccaaatagatgtgaataaaataagtatttggctttggctttccttctagttatccttcggttgagttttttgagtcacagagaaaaatgccagaagacatctctgttccttggaattaaaatctaggaattctgtgaatagtgaatctgagaatactcactttgcccttgtgatgggtcagagacagtctactagaaccaaatttaatggtatacataagagggactgatacttctcatttctcgagttatatttgttacagaaattttttttaacagctatcatcatacacaaaactttgctgaatttcaattactacagaagaaaccagctctttaacactgaattcaaaaaccttaataatctgattaccacctagctttccagttttaaatattatcactgtcatctctgcacaaacacacccacacatgatcatgcaaacactagaatctaggaactgtggcctacccaatgaactgactactccaggaactctgtagctactcagctctgcctgaaaatggctcactttatctcctttgctatgtgagcaaattctacacttctttaaacaccttaaagctaagctcttaagcattagcacttaaataagctctaatgtccataagagccttccctagtcaatccattcagaagtgacacctctccttttgttttcctctagactttcttataggacctctagtataacttgaggaagcatggatttcagttagctgtgtacaaatgcaccttcccctgtagacagggttcatgtctgagttatctttggattttttttttttttttttgagatgaagtcttgctcttgtccccgaggctggagtgcatgatctcagttcactgcaacctctgtctcctgggttcaagcaattcccttgcctcagcctctctagtagctgggactacaggtgcctgccaccaggcctggctaatttttgtatttttagtagagacagggtttcaccacgttggccaggctggtcttgaactcctgacttcaggtgatccacccgcctcggcctcccaatgtgctaggattacaggcgtgagccattgtgcccggctgtcatctttggcttttaagggatcagaaaatctttatgaagtacaatggatgttgagcttcccttgatattagctgtataggtgggcattacatacagtaactatttaaaatcttgaatttagaaatacaaaccagggcctttttaccatagcacgaatcttactttcccaagtatttacatttgaagttacctatttaggttcattgtcagttctgccatccctttattttgtttatttattcttagaagcctgagcataaaaattcctcctttagcccaaaaagattaagactaacggaaatcagatagaagacgtaatgggattttttttatgataaagaaatataataacacttattactgggcatctctgaaactaataggaaaagaaagatagggaaatagtgagaaattatgtgacattaataaatgtagtcgagttttctaccctagatatttgtggcctagtaaactttcaaaagtttgtagaagttaacttaacattataaaggagattctacttcctagaatcttctactgaatcaatggtggaatatttcgagagattgctggttctagtggttaacgaaacaattagatcagtggttcacagactgtaattcattcaatgccaacaaagtttctttatagggtcgcttaaccttcctgaaagcaccagttctcgatttttgaatacctgcccactctgtatataacatatacatcatctatacatctatgtgatgaacacatcagctctgtctcacagcatgcaaagcatgagatagaatgtcttcactttgccagactagaggggaggtaggacaagcatctttttcctccttctcatgcttaccagccaggatgttgtggttaatttttattacttgtcagggataagaaatattcataaaaacaattctaaaataatttctgcataactttggattgacctacacaattgtttcccttacacaattgggctttcaaattctgtttttgtcaaacataatatgagattattttgtaatttaaattagtcagatgtggtggcacatgcctgtaatcccagctacttgggaggctgaggcaggagaatcgcttcaacctgggaggcagaggttgccgtgagctgagactgtgccattgcactccaccctgggcaacaagagtaaaactccgtctcaaaaaaaaaaattattttgaaatctttcactagatttgtagaaggtaaatatcaaaggaaaagccacctttgaactgaaaatgtgttatgtttaattgactctatgttcagataaccaaaattaattatatctattcaagcctaagccatgtttttgtttcttaatttgttgagtaatttccaggaatactgttttatgttttaaaaacagtattcatctaaaaaaaatctttcattaaaaaaaaaagaaagactcaagcttaataaaaagactaaaagtgggaatctaagcctatgctaggtttcggcatggtcttggagtcatactctgtcacttcttctcacaaaataacaagttctattcatagaggtttctttgttttgttttgttttgttttttggagatggggttttgctcttgttgcccgggctggagtgcaattgcgcaatctcagctcactgcaacctccgcctcttgggttcagatgattctcctgtctcagcctcctaagtatctgggattacaggcatgtgccaccacatctgcctaattttttgtatttagcagagacagggtttcaccatgttggccaggctggtctcaaactcctgacctcaggtgatccacccacctcggcctcccaaattactgggattacaggcttgagccactgtgcctggccctcatagaggttttgttgtagataaacaactacacaggatgtgcacgtgtgtgtgtgcgtgtatgtatatatatatgtacagtatatatacagtgtatatggttagcaaatcaggaggtttcagggatcacatcctttcaagtctgcacaatgcccagcgcagagccatgcacacgtgccacttcactgatggtgatggcggtgacagggatgcggttgagcacgcagccgaggacagagcagtgccggaaaagcctccccttcccctggcccctgtgccactcctgagagcaccccctgctgctcctggatctctcatgattttctcctctgccccgctagggtgttgtgcccaacataccttttctaaaagctcctggtttctcttaatgaaaagttgtttatcttctacccagtgtgaatcctgtttgacaaagaatatcgcgcagtcagcatttcagagtggcacgaaagagcctgtgttgtcaaaccactttgccagagctgccttctccccaccctgtttgtttgcctgccaaagactggtaagtagcacccacccctgccagctccttcaaagaaattggggccaaagttgccgggaaaatttaacccccttttcatcatcactccctatttctaccttttccagtttgaataatccaggaccagccttctggggactcagaagtgaccacacaggcaaaaagtgaaaagggtcagaatgcacacaggctagatacatatggatggaaaacattaaaatgcagaaccataaatgtagcatagaggcaaagaacgcagctggaggggtgggtcttggtcttagcagcttatgacaactctaggctatttgtacagggttcctcttcctctggcattctctctcttgcccaagctcattcactgttgtggctgggttcatactctggccagaaaaacaccagagacagaagtacagagttgaacattctaacgcagttcgagaaagatcactgtggagagccaagctgtgtcctgggtgcggcccatgcacaggtgagctacaggaaggtcagattgaattgtctgcatctgcagaagagctagcaaccaaatgcctacctgccctttctgagccagagtcgcttccaggtcttcaattttggctttataccttagcacctctgcttggagctgttcttgagcctggtgaaaccaaaattccagaactcagcaagtaaaatggttattcaatacctttcttgactagaactcaacaagtaagagagagagagaggaaaaaaagaagaattttctatgacaaaagaatctttctgatctaaattcttgtttaaaactccctgtagcattctttattttcaggttagtattcaaactcgttagcttggcattcgagaactcccattatatttccaatcttttcctactactcatcagcctagagccaaaccctcacctgctggcataattcttgtttcctaaatatgccttgtaactctccactcttctctttatttgaatgatttctctttcatgaaagccttgttccattttgcctccccaaattcttttgattttttttttttttttttttgagacagagtctcactctgttgcccaggctggaatgcagtggcacaatctcagcttactgcaacctccgcctcctgggttcaagcaattctcccgcttcagcctcccaaatagcttggattacaggcaccggccaccacgcccagctaatttttgtatttttagtagagatggggtttcaccgtgttggcctggctggtctcgaactcctgacctcagatgatccacccgtctccgcctcccaaagtgcacccggcctttccattctttcagagcaaactttgtgcctaaatttaagtccctaaatcaatttctctctgtctttctctttatatatcatattttgtgtgtctgtgtgtgtaagtagttttgaatactaatcttgtatggagcaactttgttgtcctatgtgatttagcttagtaatttgtttcctgcctgtaaacccatttttttgttgttgttttacaatctggataggttttttagtacaaagttgaataaaaacagcgatgaaagatatccttattcattgtgaggagaataattcttttgattgttaaatattacatttacctctatcaggtccaaaaaataattaattttgctaagatttattttaactgtgaattgatgttgactgtaacctattttttcttgtacctaattttatcttttgttttcaacgatgctttcatctgtattattttttaatttctagtctctttaaatttactctgttgttctttttctaacatctttatttcttgtagattatttttctaagaatggtaagttttcctgactttaatggtcagagagaacgctaaacctttatttaggtagaagaattaaatgacacagggaggaatctccaaaaagtaaaagaagtctcctttttttggaggaatctccaaaaaataaaaataaaataatatgctattattttaattccccaatccatgttggtaagaacacttaaccacaaatattatagcactggggcatatatatgacagcctacaggcacattcctttgtaatgattgcttgcctgttctaaattggtgttttttaaaaacctgcttatttacttatatatgtgtgtgtgcatgctactgttgaaaaatgtataactgcgttacatctaccctttcccactgaacaatagtagttctacaaaactcctcagtgcattgtagaccctccagaaagaaagtaggatgaaatcactgggtggtctcggtggtcatgctgccttttggctcatgtaaatttacctaggaggcaattatagcctggtgattatgactgtgaagtcacaaggctaggaaacctaggtaaacctaggtaaataatttaacttcactaaactacatttaacttctactaagctattatttcctcttctatagaaagaagataataatcatatctagctcctagggttgttttaggattatatagataatgtgtgtaaaatgttcaacacaatgcctggaacacagcaagcactcaataaatattaagaattagtatagtacatgtctatcttttctttttgttgaaataggctcatgagaggcagttatgatataaaggaaagaacatttgacccagtaagacttaagttgtaatatcagctttgccatttactatttgtgctatttggggcaattcaattaacctctctgagtgtcaaatttctcttttataaaatatctgccttaggggactgtctcaagggttaaatgagatagtgtctgtgaaaattctggtaagttgtcatacgtaaacgctgggcacttattaacgaagagaagacactggctcactattgcttttgaaagataaaaaagttctttttctaagcaagaaactaaaaaatggcttaacaaaatccaatattgtctagctttgaaaatgtatgttttcaaacagcaagaacaagaactatgtactcaactatctttaaaagaacaaaagcattgatctaagctggttctaatgtttctagagtcaaggtttgttgacataaaagctataacaattcaaaagctgcagaggagagaagaatacagggaaagctgtcttattgatatttttatgtccacagtgcttttatgctgtgactgctgcacgctaattcagagcactctcacagatacacactaaccttggcttctcgttcagcgtcgatgatgcctcccgtctgctcctgtaggagggcatatgctctttggagggcctgatattcttttgttaattgtcgaaatcttagttcagattcttcagctgctaaactcttgaggttaagaaaaaaagccccaaaacaattgtgttatgttcaggtcctgttttcaatgtgaaatattaacatttgcccactttttacaagaagtaaaaggttgtttaacagtctatttgattttatttttagctctgaagtgtatatacgggcacaaatactgtaatactttcaagatggacactgcagaaatacataaatatttattttagtaaaagaagcatttagcatttgatacatttctcattgttaatcatttgagcttagaatgtagtcaattttggatccaaataagaaaaagtcatatccagattttggacctaaatttgaggaaatgataccctagaattttcttatttcttttcagtatgttcatctccagcaacttgttttttcccccagataaatcataaaatctgttttattgcattacatcttaaacttcaggacataacataatcagcagggaattttgggaaacaatgcagactggggtgtttcactcctaagatcctgagtcaggagttgcatggtagagtccaggacttttcattgtaactgagccctctagatcattctgatgaggatggtccacagaacacacttcactcaacagtgtcagaccacatccaaaagcctgctaaggcctcttgggttcctaccttccctagataaagaatattggaaagtaacttttattttgaaagaagtcttcaaattagagagttgaactggagagaaatttctaaaaggtttacctgctataagtgaagctatttttcaagagataataaagtgcagcctcaaaattgtttactattatgagatcactttgtgctgtttatataaaggagatgaaaagtgaaatcctttttcttcccccttaaatcaaagatttggtgacaatatcaccctaggctagagaagtagaaaagcttacttcatccaagtcatcatcaggagtagctggtgttctgtctgttctaaatgaggccatggatgatgtctctgaatccatagagtcctcatcatagccaataaacgggtccaaaacaggcctctaaatggagggaaagtacctatttactgacatagctaacagtagggaaagttgaacgttaaaatactgtcaactggcatacgtgtaagtgaatatagaagacatggatcctctatgcttctttgttgaaataaaaacattaggcatgagcataattccaataagtgtttctctcatattatttcacttctgacatcttaagaaaaattcataatatgtagcttttttcatagaaacactgaaacctctttcatattacattttatatcatgatgagctagtgtggtttactctttcctgtatttaaactatgaccaaaggattttgaaaactcaggtatctatgtgatggagatgatcaaatcttaagccttgtcatccaagtccacattaaaaaccaatggtatacttggtaaaaaccaaaataaaaatcaaatagacaaactgaataacaaaactttgtggattataagaggctatacagatattgatggattgggagcattgctatcaataagattgtctgaatgaataatgaaaatgtattaattgtcataagtgggagacatcaaatcatgtgcatttcttgaatatgactctccaacttgtcaggtaatcctttctacatcaaacctaggggcatctccatttagagaaagttatattaaagcaaacccctttcaggttaaaatttacaacataatcatttttagacttcgaagaaatgtcaacagaaaatattttcttctagcaaataatgcccatggtttgctgcaacagttctggaacacctgattcatcacatctttgtaggaagattccatgccaagcctcatctctctggctgtttgtggcaaatgcctgataactttgatttcttattaccttaattggcttggaacttcttctatgctttcttctacggatgagcttttctcggtcctggaaaacagatgaaagattttcagatccagaattggtagatgtttctttatagttttttgcaaagacagagtgttctttcccataaggcattatatttggaatagaataagactttgttttttaaattttggcaacttttgggattgatacttaaatatattcaaaacaagaatcttctacaactattcctgatgagttatgtggatcaaggagcctcatgatcagaaagtgtactgtgttcctaatcagaatcctgttttatacttgaacatcaagtagctatgaaaatagttacttatattcccccaaagcacagtactttagttctcctagatccaaaattactttaaatttgtgttaaaaatacaatttcacaataaagtaaaaccgtattcttttcatttagtcatttgaaatgcatagaaagctgtctttggcctatttttgcatccttgttctcacctgcagtccctgaaaataggacagggaacagagtagctagcgggttggagccatttagtgtttctgttttgtcttcagtttttaaaaaattttctgggaatctcaaagaatgcctagaaatattgatcaatttcatgatttattgttgctgtgaatagagatatcatgggaatttggggtttattcactaagcactccatgtatttactgtaaaaatttaaactagatagaatgtcttttgaaaagtccgatgagtgtgcctaaatagcccaaaattctataaaaaatttacagcttaatctcaggatactcaaagccaggcaaattcctgggctcatgaatttgtaaaatgtatgagttattaggatgtgaaaatgaaatgaggaaaacagggagtaatgagtaatcttgtttaagccagtggtgttcgggctttttttttttcacctttataagtaaaaatgcagcctctatatatgagacttttacaatttacacattattgtgatggttaatattgagtgtcaatttgattggattgaaggatacaaagtattgttcctgggtgtgtctacgtgggtgttgccaaaggaggtttaacgtttgagtcagtggactgggaaaggtagactcaccctcaatctgggtgagcacaatctaaacagctgccatcacagccagaataaaaacaggcagaagcacgtgaagagactagactggttgagtctcccagcctacatctttctcctgattcttcctgccctggaacatcagactccaagttcttcagctttgggacttggactggcttccttgctcttcagcttgcagatgacctattgtgggacctcaccttgcgatcgtgtgtgccaatactccttaataaactccccattatatatacatctatcctattacttctgtccctctagagagccctaatacaattatatatttaaattaccttcctaatctaatgtattcattgtaacatatagtcaacatagaaattttaaaaaggatgaatcataagtaattataaacagaagctataacctttctctgtctcagtggcagtgaatcacttttctcacctcactctggagactattgcctaactccctccttgcaattcaagtctttaggccttgacttggtcctgaagtgagagcaaccaacgatgtcattcacagaacacagatggagaggcaaagaagaaaacccaaaggcacctagaggtcttagtgcatccttactagcaacacaaacctcagccaaactctgatggaagtaataactgctctacccactcagtaggtactgaagtaatgatcagaaaatctgggctgaaattttagctctgttatgtaattatattgttgctgttcatccaacaaatatttgttgaactgtaactatgtgctagacactgaattgagacctgggaaacaaggtatatatgtgatgttgttagcatagacaacatattaaatctctgagcctcgggatcctgctactggaaggcagttacaagacacacccaacctacctacaaacttatacaacgaggcatttaaaagttcttttaatgtgctttgctgttattatttgtgctaccaaattagttaacaaagggttataatttaaaaggtgtaaagcagttgaacaatataaaatattggaatacagtctctagaacaaaattacatatttaacatatgaacttgggcctctggggttaaactaaaattaactgctttcagtgtatattttgttggctacttgtccttgggaacaacttagggtttacagattgattgacacgtacccttgtgagctcatcaataatgttctgttgctcaatgacctgaagttttagaaactctgtttcttgttcttcattagcttggtcgaggtcattcagagattttaatttcttcaggggtggatgggatgttattttttctctctggattggaaaagaagaaagtacaggtggagactttaaaaacctcaaactttggttgttaacataaaatatctgtagaaagtttatgaggctccagctaaatttggaaattgcccagcctgaatacacatacaccaactaaatcctcaagcacattttatctgccataataagtcattatcattggggattgtcaaagatctctatagatgtattgaaagtctattaaggagtacattatcatttcacttgtccgcatataacacaagtaatggtatctatttcccaaatatcatgcacgatcttagaagacaaggtgtgcctggggtataggtctgtaaatagcatgttagtgaagtcatggatggtttctgtggctaagttatgtcaaagctttccttctccatttccaagctttggaaagtgtgcaaattcctggaagcactcctacagttttgcaaatatagaaacctcataaaattcagagccagcaaccttctcttgctttcttcattaaggcttccttgcttacataaggaaaaatccaaatagcactgtatttttaaaataagctgagaaatggcaataagtcaggttattaaggtaatataatcaaggaagctgcagttttgcagagtctgtgatacacaccatttctgaattttccttggtaacggcttttagtttttcttccatgcgctgcaaggacaccatcagttcatcgtttctcttggcgaggcacttgttcctttccaggagaggtttacattgcttttcggtttcccgcacacgttttaactgggaagaaataagtgaagatttgtgtcttgcgtttgggggacgtgggggcaggggagtaaagtggtgggagtgaaagcacctctggagacagccttgtctctgcttcactatgtggctgaggactgaccactgacatttcaatccttcatttaacagactgtttgctttcttttcagttttctctaacggtttttcatcacagccttcatagccttatatcaatccattgtcttaaggaaagtactccagagactggttttggaaatgctcgggaggacgcgctctccttgctttctttcgcttccccgacttgttactccaccgtgctcagctgcaatccctgcacctggaatgacctgcattagctcagagataaaggagctcacccagaccacacggccactaagtaatgcgaccaggagctgaatccaagcctggttatgtccaaaggtcattctttcagagaccttgtggaaatctcctgactcgcactacagttgttattttaaaagaaattttatcgaggggaaaaaaaccacacgtaagtttgaaactctgtggatgtttgtgtaaggatatcaaattctccccaagcttagtaaagtatgattgtattgttatccacccataattaagagtgagcatactctcatttgcttggttagtctaaagcagggtttctcagtctcggcgtctgtgacattttgagccggatgtttttttgatgtaaggtgtcctgtgcagtggaggatgtttagcggcatccttggcctctgctggctagatgccagtaacactctgctaattgcgaccatcaaaaacatcagatattgccaaaatcgcctgtagttgggaaccactggtctaagtttatgaaaattgtcttgaggggattgtcaatagtcctcccctttacttttaaaacactcctttttgtatatttcatgatcatcctatacattatagattttcattttcagcttctcatgattagcttattcttttcttactaatgattctgaatgtgagtatgtattgggagaagagcaaggaaaaaggagggctgtattcgaaatatttgagaagactttttaaagtgcgcactactgttcttgagattctaagattttgggaagtgctgaggtggaagacttagctaattatgaatatttgtaaaatctcatcttacgattcttaaacagcacttctgcaaatccatctcaatctcaatttcgtattaaagaaataactccatttcatattaaaggccaaaactgggtttatttttacaaataatctgacttagtcctgaagcattaatgccttagtccttagtgcctgaagcattaatattaaatattgcatacatataaggacaataagttattcttattttttaatctgtctcttctgaaggtcaatgatgtgagttttaaatatttaaatttacttattaatacaattcacagaaaatgcagatatacataaagaaaatatctataattctatcacatcatacatcaataaccatagtcccacaatacccaacaaaatgttccttttaagatacaccttaaataaaacacagaaaggttggaaaaaagtgtgtttgtgtgtgtatatatgtatgtgtaaatatgtatgtatatatgtatgtctatatagttataaatacatatatatatacacatacacatgtatatgcacactaacactaaaacaaaaatctgatgtagttcaactaataacaacgactttaagccaagaagtattaccagaggaaaaaaaaagcataatgattaaagggtcaatacacacaaaaaatataacaaatattaatttatattcatctagtaacataatttctaatatattataaatacatattattgttctacatataaagttaaatttaaagaactaagaaggatatagacaaatcttttgggagaacaagcagacaaaaatatcagtaagaattgaaaaattttaaacaagattattaacaaacttcaatcaaactgcaactaataattacagagtatgcctccttttcatgtaaacatgtaacattgctaaaattgactgtatgctgaggtcataaagcaaatctcaacaaattttgaaggaatgaaatatacaaagtacattctctgactatagtagaattaaggtagaaattgataccagaaagataactaaaaaaatctctaaatgttttgaaattaagccatctacttctaagtgacccatatatcaaagaaaaattacatgatattagaaaaatttttgaatgaaataacaatatattaaactaaagcaaggcttagagggtcaattacagcctaaaatgcatatatttgaaaaaaggaaaggctgaaaataactcttatatgaatagctctattaaaaacaaaaacgtaagccatagagcaagatattttaaatgcaaatgtaccacaagtgatgataaaaaaaatcctaatagtaactgaaacagtaaaggcagcataacagaaaatgggcaaaaggctaaggacaaattatatctgaaagactagtaaatatttgaaaagttaccctaccttcttaataatgaggaaaattaaaaccataatgtaaggtgtaagagtatgccctacatccaccaacatgactaacaattatttttgtatgttggaaaagatatggagaaactaccactttcattcattattggtgggaattgtgacaactcactgtttggtaataactattgatgctgactacatccatactctaacatccagtaattctactcctctgcatattccaccagaaatgggcatattttttcagaaacgacatgtagaagcactgttcttctcaaaacagctcagaagttttaagaaacaacataaatgtccattaacaataacatggatcagtatattgtgatatattatttgaatactatagagaaatgaaaatgaatgaattctacatgcaacacaatggataaatctcacaaacaaagctgagtgaaagaagcagaagaagtcagacaaaaaagagaaaatattgtatgatttcatttacaaaaaaatgtttaatggtgatagacatctatggcgattgaagtcagaatagtggttaagtttaacaggatgctaattgggaggggtcacaagaagcgggggtgtgagatgctggtaatcttccatttattcatctggatggtggttttttgagtgtgccactttgtgaatatctattgaatggtatctttattatttgtacacttttctctattatggtacgtatctataacatagtatgtaattctgtaacataatgcttaacaacaacatcaacaaaaatttttagtatatctcaccagttcatttcgttcatctccaagcaaggtattcctgtcttctaattttcttatagtggcattcaattcagctattctcttttgatttcttcgcaaatcctacaaagaaaaattaaaatgggtatttcttcaacaacacttttcacaaagtttgggaatatcacttattattcataaaagtaataggctcagttctcttatctggctcctgaagtgagaataaaatattcttttatccaaagagtaaatatttacccttttataactctcaatattcaccacttgggttgaagaccacgccaggttgtaattgcaaatgaattccatgtggcagatactccctggatccaggactcagggcagggagagtgcagagggttggatcaacttatcagagctgtgtgctgtgggaccaaggtcatgatgtgattacataaggttcaaagggcatcccttgtgtcatggccacacattgcttcccacagcttagacagctgtcctggtattaccattagccacagaggggagagagtaggaggtagggattaatattgtcaattccttcatactcctgaagaaaaaggtcaaggtgagaaaatgttgatgtattaccttcatgtataaaggtcagtagtttataggataggcctgactagtatattctgcccaatgcaactggcttctccactggcagaatggctgtgaatcaccttacacagggcattcatggcttaatttcatgttgtagagttatataagactgttattatcatatgctaacaattatattatcatcttacattttgataatgctgtactgttgacaaagtagtttcaaatacattatatcccagcattcataatatcctaaaggattcagtagaacaggtaaaattcagataggtaataactcctttaaggtcttgtggctaatgtcaaaagataagtaactaatatgtattaaatgctatgtgccagacaccatgctcaacattttacatattatctcttctaatctttagaccagccatatgaggtactactatagcttctattttacacatgaggaaactgaatggtgaagtggtttgcctaaggacacacagtaaatggcagatttgggatttgaaccaaagagtctgactctagagcccattctcttgacaactatgctatattgcgggtacctgtcagtgtcagaactaaaacttacagaaactgctaaatcctagataagtactccttccaccacctactaagattatatacatatatatatatatttattctgaatatcaattcataaattattcattacttagttctaagtagtactttggaacccatctctgttcctaaataatacatttccattattatagcagcaaaataattggaaaggtataagagttatagccaactgcatataagcccatttctattgcgcacttccgaaaataatttctcatataaaatgatgaaaattcatggaaataagtggtaagttcaatcagacaataagtcttcagatgaagattaaaaatggttttgtcttttatgcagttatacattttgacccctgtagatgacaaccatctttatcaatttccaacccaattgttcacaaaagggaaaattaccagtgtaggcaagaggcaaaatattttcatctaatttatgtttcttataatagacttaagtttggataggtattgcctggctagaaaaattctaggaaggatttaaagaaatctatctcatgtgatctgctaatgtagtgcagaccacttagttgtctatgagtttagaaaaccctgttctcaagatactagctgattttatagtagaaggtagattgatttctttgtagtaaacaagaaaagagcttaagtaaaaggtaaaacttgggagctaaataaaagatgacttgtgcattcttaacttcaactagaatggacttacaggactgctgcagtgttcggaaccatcacctgcccttcctggaatttctcgttttgggctgctcatgttgcactcagcctccttgaccagaaagagttgttcgtccaaagcctccttctgaagttggagtttctgtacatagcctgtctgggtctccagttccttttccagggaaaagatgatcctgtccttggctttgatttcatccatctgaattaaatgagacccaggacattttatttaacaatgctgtaaagaaatacatttttacaatggtgtaggtttaacttcttttatctgattgatacagaaaaaaaatcacggatttgataagtgtattggtttcatgagtaagatgaggcaacattgtgtaatgaagaagtatcctgggttaattaggtgtcaaggagagtaattttttttctctctagtatatcctgtgaagatgttttgactcaatatattgtttgaaatagtctgggttgattagatatgcaaaggacagtctaactttaaaatagccattaattttaataaagatgaacattaaatattccactctaatgtttcctaggacattttttgatgtcacttcttctttgggcaaatgggtattcagattcaatcaaaatagctgttgctcctgttagtagctggtcatttgtaactgaagaaacttcagacttcccagtggcctagtcatttttccaagactaacatgcttgcattcaggtgatggatttggagggaggtccttccacggttcatgtgttatatctctttctgttctcacttgtatttcagagcagccagttcttagcaaccattttatcattactataagaaaatcatggttgggattaacaggaatagaaaatatctggcaatattaaccactattttccctcccacatgtgtgagatatatttattgatccaaatatgcatttctgctaagcctgggcatggcctcagaagaatttctcaactaaaggccacaggcattcaataccagttgatttgagttcccttggaatgaaacctttttgccatcctaggatgagggctaatgaagtgaatgtctataaacaatttttaaagagagcatagccattgggtgaaacctttcttatcgtttcactatattctatgtgtacattcaaaatggagataaggaaaagacatttaatacaaacaacattacgctgttttgctttttctaaaagtgtctccttatacaaaacaatacttttgtataaatttttctttgctgtgtgctcttagaccagaaaaaaaaaacctgcaacagaaatggtgttacatagtcacgtattttccacatataaatatctgtgagctactgcctgtgagtcacatgcttaaattttaggtcaattctgagagagctttgggctaaattctgcatgatcttgtaatatcatctgataacttggtaagaattcaatattgtcccgttaattgggaataatagcattgtctttggtttccgtctccttgtagaagacttgagacctgtgtttttcttaactgagcagcatgttcatttgtcagacttgtcaactggagcattacttttatttgcaggttaacatagctctagttacttttcatgagttgacatagctctagttgttttttatgtactcaccttgttaaacttgtcgagaaatcattctattactgcccacattcagcctcattatcaccatcatcacagctgaaatttattgatctttcactatattcagggtactatactcagagcttaatatgccttattttataacaatcctattcagtaggttcagtcgtcatcattttacaggtgatgactgaggacctgaaagcttaaaaacttggtcatagtcatatgtctagtaagttgtgaagccgtatttttaatggaatcttctaactatagagcccattctgttaggtactatgctatactggctttaagattattcatatactttaagcatttcccaaagtggtttcctgtgggatatatagtaattagcattgagaaagctttattgcgtagcagttatgagcatggactctgatctcaaaatactgaaaatcaaccaaagccctacttagatgggaaagggtataaaccagaattctctggggaaattttctagacagaacaactcccatttctctccctttcagttccaaaaatggagcttggggtaggggtaggcacagagtaaaaagaaggaaaaaatgaagatgagtatatctgcgctatcaaaaaagtttcctatgttattctgtgttcatgcagtttgtgaactactcataaggtggctcagatttactttttaaaattttaatgtttattttactttaagttctgggatacatgtacagaatgtgcaggtttgttacataggtatacatgtgccatcgtggcttgctgtacctatcaaccggtcctctaggttttaagccccgcatgcattaggtgtttgtcctaatgctctccctccccttgcccccaccacctgacaggccccagtgtgtgatgttcccctcccttgtccatgtgttctcattgttcaactcccacttatgagcgggaacatgcagtgtttggttttctgttcctgtgttagtttgctgaggatgatggcttccagcttcattcatgtccctacaaaggacatgaactcattctttttttatggctgcatagtattccatggtgcacatgtactgcattttccttattcagtctatataattgatgggcatttgggttggttccatgtctttgctattgtaaataatgctgcaataaacatacgtgtgaatgtgccttttagtagaatgatttatattcctttggatgtataaccagtaatgggattgctaggtcaaaacgtatttctggttctagatccctgaggaataaccaccctgtcctcaacaatggttggaccaatctacattcccaccaacagtgcaaaaagtgttcctatttctccacagactcaccagcacctactgttgcttgactttttaataattgccattctgactagtgtgggatggtatctaattgtggttttgatttgcatttctcaaataatcagagatgatgagcttttttttttcatgtttgttggccgcataaatgtcttcttttgagaaatgtctgtttatataccttgcccactttttggtggagttgtttgctttttcttgtaaatttgtttaagttccttatagattctggatattacacctttgtcagaagggtagattgcaaaattttctcccattctgtaggttgtctgttcactctgatgcgagtttcttttgctgtgcagaagccctttagtttaattggatcccatttgtcaattttggcaattgttgcaattacttttggcgttttcatcatgaagtctttgcccatgcctatgtcctgaatggtactgcctaggtttacttttaaggtttgtatggttttgggttttacatttaagtctttaatccatcttgagttaatttttgtataaggtgtaaggaagggatccagtttcagttttctgcatatgcctagccagttttcccagcaccatgtattaagtagggaatcctttcctcattgcttgtttttgtcaggtttgtcgaagatcaggtggttgtagatgtgtggtgttatttctgaggcctctgttctgttccattggtctatatatctgttttggtaccagtactatgctgttttggttactgtagccttgtagtagagtttgaagtcaggtagtgtgatgcctccagctctgctctttttgcttaggactgtgttggctatatgggctctttttggttccatatgaaatttaaagtagttttttttttttaattctgtgaagaatgtcaatggtagtttgatgggaatagtgttgatctataaattacttttgtcagtatggacattttcatgatgatgattcttcctatccatgaggatggaatgtttttccacttgtttatgtcctctcttatttccttgagcagtggtttgtagctccccttgaagaggtccctaatgtcccttgtaagctgtattcctaggtattttattctctttgtagcaattgtgaatgggagtttattcatgatttggctctctgcttgtctattgttggtgtataggaaagtttgtgatttttgcacattgcttttgtatcctgagactttgctgaagttgcttatcagcttaaggagttttgggctgagatcatggggaattctaaatacagaatcacgtcatctgcaaacagagataatttgacttcctctcttcctatctgaatacgcttgatttctttctcttgcctgattaccctggccagagcttccaatgctatgttgactaggagtggtgagagagggcatccttgtcttgtgctggttttcaaagggaattcttccagttttttccattcagtatgatattggctatgggtttgtcataaataactcttattattttgaggtttgttccaccaatactgagaatttttaacctgaagggatgttgaattttattgaaggccttttctgcatctattgagataatcatgtggttttggtcattggttctgtttatgtgatggattacatttattgatttgcatacattgaaccatccttgcatcccagggatgaagctgacttgatcatggtggataagctttttgatgtgctgctggatttggtttgtcagtattttattgagaattttcacatcgatgttcatcagggatattggcctgaagttttctttttttgttgtctctcctaggttttggtatcaggatgatgctggccccataaaatgagttagggaggagtccctccttttaaattgtttggaatagtttcagaaggaatggtaccagctcctcttcgtacctctggtagaattcagctatgaatctgtctggtcctgggctttttttgttggtaggctattaattactgcctctatttcagaacttgtcattggtctattcagggatttgacttcttcctggtttagtcttgggagggtgtaagtgtccaggaattcatccatttcttctagattttctagtttatttgtgtagaggcatttatagtattctctgatggtagtttgtactgctatggagttagtggtgatagctcttttatcattttttattgtgtctatttggtgtgctctttttttctttattagtctagttagtggtctgttttgttaattttttaaaaaatccagctcctggattcattgattttttgaagggtgttttgtgtttttatctgcttcagttctgctctgatcttagctatttcttgtcttctgctagcttttggatttgtttgctctttcttctctagttcttttaattgtgatgttagggtgttgattttagatttttccatctttctgatgtgggcatttagtgctataaatttccctctaaacattgctttatctgtatcccagagattctggtacattgtctctctgttctcattgttttcaaagaacttcttgatttctgccttaattttgttatttacccagtagtcattcaggagcaggttgtttgatttccatgtagttgtgtggttttgaataagtttcttaatcctgagttctaatttcattgcactgtggtctgagagactgtgtgttgtgatttcagttcttttgcatttgctgaggagtgttttacttccaattatgtggttgattttagaataagtgccatgtggcatgagaataatgtgtattatgttgatctggaatagagagttctgttctattaggtacacttgatccagagctgagttgaagtcctgaatacccttgttatttttctatcacattgatctgtctaatgttgacagtggggtgttagcctcccactattactctgtaggagtctaagtctctttgtaggtctctaagaacttgttttatgaatctgggtgctcctatattgggtgcatatatttttaggttagttagctcttcttgttgaattgatccctttaccattatgtaatgcccttctttgtctttttgatctttgttggtttaaagtctgttttatcagagactaggattgcaacctctgcttttttttgctttccatttgcttggcaaattttcctctgtccctttattttgagcttacatgtgtctttgcatgtgagatgggtctcctgaatacagcacgctgatgggtcttcactttttatccaatttgctagtctgtgtcttttaactgggacatttagcccatttacatttaaggttaatattgttatatgtgaatttgatcctgtcatcatgatgctagctggttattttgcacactaattgatgcagtttcttcatagtgtcattggtctttatattttggtgtgtttttgcagtggcaagtactggttttttctttctatatttagtgcttccttcaggagctcttgcaaagcaggcctggtggtgataaaatatttgcttgtctggaaaggatttcatttctccttcacttatgaggcttagtttggctggatatgaaattctgggttgaaaattattttctttaagaatgttgatggctgggcactgtggctcacacctgtaatcccagcactttgggaggccgaggcgggtggatcacaaggtcaggagatcgagaccatcctggctaacatggtgaaacctcatctctactaaaaatacaaaaaaattggccgggcatggtggcgggcgcctgtagtcccggctattcgggaggctgaggcaggggaatggcatgaacccgggaggcggagcttgcagtgagccgagatcgcgccactgcactccagcctgggtgacagagcgagactccgtctcaaacaaaacaaaacaaaacaaacaaacaaaaagaatgttgactattggcccctactctcttctggcttgtagggtttctgttgagagatccgctggtagtctgatgggcttccctttttaggtgacctggcctttctctctggttacccttaacattttttctttcattttgaccttggaaaatctaatgattatgtgtcttggggttgatcttctaatggagtatcttagtggtgttctctgtatttcctggatttgaacgttggcctgtcttgctaggttggagaagttctcctgcataatatcctcaagtgtattttccaacttgattccattctccccatctctttcaggtattccagtcaattgtaggttcggtgttttaacatagtcccatatttcttggaggctctgttcattccttttcattcttttttctctaatcttgtctgcatgccttatttcagcaagatggttttcaaattctgatctcctttcttctgcttggtcgatttggctatcgatacttgtgtatgcttcacgaagttctcgtgcagtgttcttcacctctatcaggtcatttatgttcctctctaaactggttattctagttagcggttcctgtaaccttttatcaaggttcttagcttccttgcattgggttagaacatgctcctttagctcacaggtgtttgttatttactgaccttctgaagcctacttctgtcaacttgtccatctcatcctccatccagttctgtgcccttgctggacagttgttgtgaacgtttggaggagaagaggcattctggcttttgcgattttcggtgttttttcctcatctttgtggatttctctacctttgatctttgaggctgatgacctttggatggggtttttgtgggagggtcttttgttgatgttgttgttgctgcttttttagttttgtttgttgttgtttgctagtttttcttcaaacagtcaggcctttcttctgcaggtctgctggagtttgctggaggtctattccagacccttattgcctagatatcaccagtggagactgcagaacagcaaagattgctgcctgctctttcctctggaagcttcatcttagaggggcactggcctgatgccagccagagctctcctgtatgaggtgtctgttggcccctgctgggaggtctctcccagtcaggaggcacagcggtcaggaacccacttgaggaggcagtctgtcccttagcagagctggtgcgctgtgctgggagaatctcccttgtcaggatcagccagtatcttcagagccagcaggcaggaaagattaaatccgctgaagctgctaccacagccgcccctcccctcaagtgctgtgtcccagggagatgagagttctgtctgtaagcccctgaatggagctgctggatttcctgcagagagaccttgcctagtgaggaggactctagagaagcagtctgaccacagccgctttgctgtgctgtggtgaattcggcccagtccaaaaatctcccagtcgccttagcacagtcaggggaaaaccaccaactaaagccacagtaatgacggtcactcctccccccaccaaactcaatcatctcaggctgactctagactgctgtgctggcagtgagaatttcaagcaagtgtttcttatcttgctgggttccatgggagcatgggagtgggactgggacccgcttgtgagactgcttggatccctggcttcagccccctttccaggagattggacggtggtcctgactcattggagttccaggcatcgctggagtatgaaaaaaaaaaaaaatcctgcagctcagtgcctgctcaaacagctgcccagatttgtgcttgaaacccagggccctggtggtgtaggctcatgagggaatgtgctgatccgtggattgcaagtgtccatgggaaaagcgtagtaccttgggcaggtagcacagtctgtcactgcttccctttgctggaggaaggaggtcacctggctgcgtgcacttcccacatgaagcgacgccccaccctgcttctgctggttctctgtgggtcacacccactgccaaaccagtcccagtgagatgaactggatacctcgattggaaaagcagaaatcacctgccttctgcgttggtctcgctgggagctgcagacctgagctgtttccattcggccatcttggcccctccccttcacgttgttattaaaagggatttcatgcctacttcagcaatatgccggtgaaaggaagtcgtgcaaaaattagcagatcaagtggatatacttatagattttatattgaaaaccatcaacaaatgaaaatatttaatgcaaagctgccttttcattgaatatttacctgccagctccagagttcgaagtcctgattctttcttcatcagtcactgtcgtttcaaaaaccaaaggcagggcagagaccgatatttctgcactgtgtttggtctttattgtcaaacagtgcaatagaatgagttgacataaagaattcagaaaatgtggcaatggcaatattttacagttacactctattgcagtataaagaaaaataaacattaacttttaaaaatgctctatggtaaccaccttgaacttaaaattaaaagcctagagatatcacccgaggaacataattagaattctcagaaagtaattgcttagaactagaagacaaaaaaggaaaagtgtagtttttcctaaaaaaagccttatttccggagaagcataaagtacattctaacaggcgatagttgatgtgataacattaaagtaagatgtaacagatgctaaacatccgaatgcagatgaatataaaattttttggtctaaaataattaaacaaggtcaacctaggacattctaattttcagatgataattatatttgtattatatttaagcatagtgagaggcctacctggtttttggtcaaacatgttagaaggaaagaccaactctgtaggggctgaggtaagtcttggaaactataaatagcaaacaacctacttagggatgacatccaatttaaaaattataatggctcctgttttaaatgactcctgtatactttgggaaaaatatctatgtttaaaatgactagggattttatcattttgtatcttttttcagtcatggtttctggaagaaaagactcaagatgttctcagtagctgctgttttcagacatcatgaaagtcttctcctaccctctataaaaacaaacaataaaactctacaaaggaaaagcccacaaaaacatgctgactttagaagaatccatgatttagaatatttttataaatatctaagaaaacaggagtcctttccatatatatggtccttggagatactttccatatatatggtccttggagaatccagtttttatgagaaaggtgatttccaaaatctcttacactttacaatttcaattttggcctgagcatatctctcgattgatctacctacctacatactgatctatcttggatagagcactggacaaaaggtaggcactgtttacaatccactgacaagaaaacacatgaagaagcaaaccccacagcgctctgaaacctggaagagatgggttctacatgggtctgatgggattactgtactaaccagcctccgaatatcccgctccgactcccacttgatcttcgagatggcttcttggtgggactgatgctcactccgaaggtccccagccttgattttatctgcttggatcatattgctcagagcctcgtccacctgcttcttggccgttttcaggtccgcaatttcctgtaagagcttaaggcgctctgtgtcaaacagtttccgggcctcctcccgggcctcaatggtgagcgctgtccttactttgtcactgctgccgtcgcggagagcacagagagcagacttgagcctctggatctctccatcacgtaccttcaccgtccttgacatttcctgctcgtgctgcttgataaggttctccctcacagcctgcagctccttcatcttctcctcatggagcttggctttgagttctgtcaccagcaccgtgtgcttgcgctgctccagctcacgaatcctcttcgcttcttgagtcttctctctttcaagctttgatacctaaaaacagagaggcgaaatgatgaagagaaatgagcctcaaaggacgggtgtgctcctaggcaggatttgcagctcaggccgctgtgatctcttaattcctcatctcttttccaattccaggccctctgagaaaaaagaactacaggccttgaagctgggaatacagtgtgtaagaggaggaaatacctgaggatatttatattactttgttcagatgaatatttgatgttctggggccttactatgcaatgtgtggtctgcagacaagcagcctcggtatcacccaggaagcatgttagaagcacagaatccctggcttagccccagatctatgactcagaatttgcatcttaacaaatccccatgtgattggtatacgccttaaaattagaaagtatcgctatcatggtttttccctttacggggaggactgcaaaacagatcgcctggagagctttttagactacacaaccctagctagatccaaactgataaatgtgtgtcttagaatagctcacagtttgatattgtgataaggctaataaattagtgcctcaagtgatattattgagcatccgtctccctcttttcttttctttttttttttttgaagagatgctgctgctgccaaggaggtgaaaaatgaagacagttgataatagcctcaaccttacctttcttagtatggcaggttagtttcatccccaagttttacacacacacacacacacacacacaaacaaaaaaccaccaccaacaacaaaactgcagatcattgggtcctctctctgatgaaggactttagtgaccattgttatttctgaatgtgccatgaatgtctctttgagtcccttttcactctcactcctccttctcccttcctgccccacaagccaacactccaagtagtttgataaaatatttcgaataagctttttacctctcaggaattccggtttaaaactattctatgttttgctaaatttcctgtgataatataggcctccttgtagattagcaatggcactacctattgatctaatctggctgtgagtctctgattcagtagatcaggtggggcccagacatttgtgtctcgaaaaagcctctccgtgatcctgttatgctgtcctcctcccccacttcatctctgctgcttggctctgtctctgtcttctctctctgtctctctctgtgatacacacaacccccgcatgcacacacacacatacacagagtaacctagaaaaagggggccgggtgcagtgcctcatgtctgtaatcccagcactttgggaggccgaggcggatggatcacctgaggtcaggagatcgagactagcctggccaacatggtgaaaccccgtctctattaaaaatacaaaaattggctgggcgtggtggcaggcacctgtagtcccagatacttgggaaggctgaggcaggagaatctcttgaacccaggaggcagaggttgcagtgagccaagattgcaccattgcactccagcctgggagacagagtgagattctgtctcaaaaaagaagaaaaaaaaaagaagagaaaaggaagaaaattggggagtcccaggagtaatagctagttgagtgatatcgagtctccaccatctgtaaaattggaaggttttacaaaataatagttaagaacctttccagttgaaaaatcttaagattgagactccatattttaaccactgtaatataaagtgtctgtgatggctaatactgagtgtcaacttgattggattgaaagatgaaaagtattgtttctgagtgtgtttgtgagggtgttgctaaaggagattaacatttgagtcagtggactgggaaaggcagacccaccatcagtctaggtgggcacattctaatcagctgccagggaagccagaataaaggcagggagaagaaggtgaaaagactagactcacttagcctctcagcctacatctttctcttgtgctggatgcctcctgcccttggatatcagactccaagttcttcagctttgggacttgaactggcttccttgctcctcagcttgcagacagcctattgtgggaccttatgattgtgtgagtcaatactcgttaataaacctccttttatagatacatctatcctattagttctgtccctctagagaaccctaatatacagtgtctgagattttactcaccttaatagttaacctacctttagctagaacagtattttctaagtttgcatagtattttgtgaacagtttatttttaaaggcgcagcaattattcccatgatggttattctaaaagagcttggggcacaaggggatttggtgaaataagcagccagatatcctcaaataaccatcctctgatctcacctccagcttacacctacggtcccttcctggaggcctcttctttcttaggctctagacttgtgcttgtcctatgtggcatccgctagttaccatactgcaaatttgaagtgagattttctctccatgtaaaatatactctggatttcgaagacttagtgcgaggtaaagaatgtaaaatatctcctttatcgtttttatattgcttacatattgaaactataatgttttggataaattattctaaacgatattattacaactgattctgtttctttttactgtttaaaattgcagctagcaagaaattttaaattcacagatatggcttgcatttgggattcacattatatttctcttggacagtgttgctctggagttcttaaaggttcatttggtgaacctagcttttcccacactcctggtgatattctcttagtaaagctcagttctggttttccttacgtatctgctcaaaaccacccaggctcttttatgttgtggaataaaatctcaacagcccagcttcacctttcaggctctcaggaaggtttggttggatttccagctcctgcttctccctctctgtctcctcacctgtcccgtgctctaggtgggggggattatgctattttctgcacatgcctgcatctcgtacccagatgccacagtttcttcttcctgacttattcttccatcagctccttttgggatcctcacattcctcatggcctggctagaggtcatcctctcctgtcatgccaccctactcacccaggacaaagctcatttctcctacctttgtcttctcagtatacttttgaaacacctccttagtagcggttttcacagttttctttgcatttttttgcccacttgtctgtcctcatcacctcctcttctaccctaccgcaggctggtaacttttagaaagttgccaatgagccatcctcatctctgtgtacccagtggctcccagaacaatatataagaaaccaggtggcatgtgtagaactaaggatgtatgctgttatatctctctggctaggcccctagccagaggcaagaataatattttctgtcatacagtttagagaatacaggcttgcagggttaccagatcagcccctcctcaaccccttcccagtataaaatgacaacaaaacaaaaccctaacatataagaattcacttccctctgctaggtgtttctcttggtgcttcaataaggacaatctagatcttactctccatctttctagagtgaatggaagtgggcatcttctagattggggtgggcaaactaccacccatgagccaaatccatcctgctcctgtttttataaataaagtttattgggacacagccatgcccattcatttacatattgcttaaggctgctttcatgctacaatggagttgagtagtttcacagagactgtctagtccacaaagcctaaaatattcactatcttgcccttcacagaaagagtttgctgattcttattctagataatgcattttttgaaaggaaaagccttgttttctattgatttagaaactacgacaatttaccttccatataagaccttgggaaagttacttcagctcaagtgataggaatttagtcatcttcaatttctgcaggatgcacttacactaggcatctggaacagtatcatgactgcaatggctggtgggtaacaagggaaacttttagccattcttctgagaacagtgaaaaactgtactaaaagtggacaaagggtaagaaattctgggtttttattcctgtttcactatttgctatctctaagaaagttgctttatccttctgaggatttttgattacacttaaaaatgtctgtaactgggttatttttagggttaaactagattgtgtacggaaaagtaccttgaactgtaaagtactatgaagtgtaaggtaatattattactggatataataggagatactccttgatctaaaattatttatgtcaaattctctggaggtgcatcaaattgtatcttcctatgattctgtcatttaccccaaattatcaactcaaagcttttgcctgagaactgaagaggagatgaaggaaattatttttaaaaaagtaaaaatacaggtgcatgaaacatgtattccagcctgaagacaaaaacaaaaacaaacactgtctatcccttaaaataatccatgaaaactagagaaaattcaaaggaactgagtaacatttgacatgtttttatgtttacttattttggttgtcatgaaaactgacatttttttgcaggatttctagttatggcttctttttaagtctggaagaagtgttttattctgaagaaaagccaaacaatgtgactgaaatttttggggaaaaaggccaataaaaattttctgaaaattatttgcagtgcagatggcaccactaaggatatagatttaaatcttaatataaatcttaaaatgaatatacaaaattataaactattcctgagtaacaatgaaaatataaagatgataatactttgaaatgaagaaaattatttagtagaagaaagaaaccaattttgatacatggagatgttttacggagaaaaatttcagctcaaccatataatagctagcatttattgagggtttaatatgagttaggcaactttctaaacaggctttacacacatcagtccatttaacctcccgggcggctctatgatgtaggaagtctttgtttcatcacaagttgtgataagaaaagtgagaaacagtctttacataagaacaatgtaaagaagactcactaaagtacattgtgggccaggagctggctccaggtaagttcctacacctccttgtttgctctgaaaccttggacacctcgtatttgcacctgaaaccttgcttcacctctgtcagcctcagttttctcatctgaaaactgggattgtcgatatcattctcttacggctattgtgatgattgatataggcaatggatcaaaagctctttagaaaagctggaacacattagagattaataactattaatacatggtggatattataatataattttaataaatactgtgtatatattaatattatacactattacattaataccaacaacataaatataaaagtacccatatcatcctgataagactaacattactatattacattattaagatggtaactgtttttccaacagaaagagatgttcaaagataaagctgagtttcttcagtacgtattgtgttctctggcattggcagcatctaatcttgacgtggaagacacttggggtgcgtatgggcctaaagagtggtgcggggtggggcagggtgaaggggagagcactcggtagggctttgaatgatgggtttccaaatcctttctaccctagaggttctatgggaaaaaagatcattagaaaagtttaatcctaccaaggaaaggttacactatgacagggaaaaaagaatttatgactatcttgcacagacctcatgttgtatttttctattctgtcctacttctggtctagcctttgcaaaatgccaatgtaaattctgccaagagaaagatagtgatgatttgagcttcaaaagtgatcttagaaatgtaggattaaaaattggacagctcagtcaaaggtaaggaaaaggttgagaggttatcaaggcaagctaagctaacataaactttggcctggattatctgcattggatgttcctggaggaacacagtaaactggcagggattttcatgggcacaaagcaactctcagagaagaggtgtgaaggagtcgctctaggaagattgcttacaagggaagtcctatacaaccttacacaatccagtgcaaaggatcctatttttaaaatttcttgttttcagctacttatgcttcctgaaaatagaactaaaggagtagataggaaaatataccccatcccaaatttggtacctgtatctggaggctgtggggacagtcactcgaggatagaaaatgttggttgattttctgagaatgccctagaggcaatagatgccttgaatcagacagtgagcattaccttgatcaccaccatcttacagaagacaggaattcccatcgcggctcctccaccagctgtgtctcttggagcaaatgagttaaacagtttgaacctcattttcttcctcagtgaaggcagaatagtaattgcaccctgtctttgtcacgggcttgctctgatggttgtgaggctcgatgtgaaaatgctttgcagtttgaagggctgtgccaatgggacagctcctgtctggagctgattattctcagtcttgcaacccaggcctgttgcccttctgcctctgccctgagaaccctgttccctgctcctgtccattcattccctctgtcactgtgcccatgctgttcacgaaaccatagtttatctctgagggagagtaaaaagccctggggcagcccgtggcatgttcatacacactaaccaatggatcatgcactcatggtgtccatagaagagacaaatggggcaaataccgcaacttagtggctcagggtgctgctccaagaagcagacagatctgggtggaaatcctttctctacccaagcctggagttctcacctaagtgagtactgtaacggtacttatgccacagggtttgggggaaagctgttaaagagaatcatgtgatttcattcaacaagtaattttgagcacctcctacaggccaggaagtttcctcatctgtaaagtagggatgacaatgcccacctcagcaggtggaaatgaggatggaatgagataatggcatgaaagcacttaacatgcttgacacaaactaattgctcaaaaattagcactcacacatacacccttgtgaggcagatactattattgtcccatttgacagatgaagaaggaaaaacacagaggggttttataaccttctccaggccagtcaggtgctagtgaagcagctgggactctggcaggatgaaatgtgcttatcagcccatgacagatagtaaacattcaataagttgtagctatttatattatcagcccaaaggtcttaaaatttggctctatacacaatggctgttctgtaaatatcagtgggattatttgtcttgctggataaatgaatactgccccattaccccaaaggtttccactttttaacttatccattccctagtagctgaactgtcattttgtcatcagagcctcagagccaacctgagagtataaattcacaccttggcattgttcatattctctctcttaaagcctggccctttgaaaatacaatcctatttatttataataaaagtgctttatgacttgtttgccctctaaattccctttgctctttggcgaaggatgctgacaggcaatgagacttccctttagctcctgagctgggaccgtaattaactgccaaggagagggagccaggcaggggcagccagcagagaaaaggacgaggctgtgtgctctcatttaagaggctggctgccagtcaattgttagaggaaggggagattatgcttggcctgcgggcttagacaacggtgccaggcccaagataaacaggcagcctggttcaaacttgagagttacccattttaaaaggcttgaatatgtggagtattggcagtgttgaagtcctcagagcctctgtttctgagaatctcatcagtttgttctctggaaagcagtagcagtttagggttcccagtctcgagattgacaagcttcttcctaggaatgtagattgtcatcctgtcataactgcaattaaaggagtctgcctcccttgaagtgtgatgttgctgcagggagagttaaggccaatgaaatgttcagagattgtcagacctggatggaatcttacagcgagtgtttgtcaacacgaaggctggaagtcatctgcatctgtagtccatcagaattgccagggctgctttaccgaattacaagtcctggttctcacctcactactttatcagaattcttggattgtggcctcaggaatctcgatatttaatcaggtcccccaggttataccattgcacagtgatgcttgacaagcacaaatatggagaagcagattcagtcatctgaattacagatagagacactgtgacatttaaattcatctccaaggagagataaagacaaataatgccccgtgtcttctgactcccaaacaaatgctgttctaaaatgacatcatgttccctttggcttcaaggaaactaaaaaattttcttcacaaactttacattacagtctctttatctaaggtcaaggcttagctaaggcagggagcaagaggctttggcagatccaaaggccacttattattgttaaaatgaagagaaatagattttgggagaaataacaaattaaaatttaataatgatgtcaaggaagaagaggtagacaaaaatggaataaatatatttgttggcttgtgactattgcttattgatcaagaatgttttcttactgtataattatctaaataaggcaactttatgctgtcatggtggtctctggtttgcaaggagcgaaaacatcttatgaatgctggagatttcaaaatgctttcctagacatgaccctctctgatattcataccaccttggtgagatgtgtgtttgcttgtgcatttaggcgatgggattgagagaagtaaagagacttctaagtctagttagcaactgacttaaatctatgaatattaaaaagaatactaatattataatgttttgcaagtttattatgtgtcaggcagctctctgagcacctgacgtaaatttttttgttcaatcctcataagcacataatatacttatctaattcatacctcagtacagctgtgatgtgatgaagaaactgaggtataaggaatgcatcatctttaaattattcctctattcattcaacaaatacatattgagattttaagttctggatattatttaggctctagggacactaagtaaactgaatttctgcttttgtagagattgaggagtgacagcactaaacaagtaaaaagcaaatgtatgaattactatgaaataagctaagaataggctatggggagtacctgacaatggggaagtgttctgttttagagactgtggtcagatgcttgatggttgagcagacatctgaaagaggtgagtgaaggagcatggagctgtccaggaagaacaagtgcaaaggccctaaatgtgattggggtctctctcttgatccagcaaaaataggaaacagaatgatcgagagagagaagtgggagatgagtcaaagagggggatggagctaatatcctgtagtggtagagaaagtcctttgagtctaagagagataggaagcccttggaaggtattgggcagtggagtaacgtgatgtgctacatttcagaaggacttctctgaatgctctgggagttaataacctatagagggcaagagtggaacttgcccaaggtcatgcaactattaagtgtttggcggtggtaagggacactgtctgaattttcatatctggcttcctgaaccgggcttccagaggaggctaagatctgtctagtgagtatgctattttcactttctgtgtgtcctgtgctcagttccctcctgccacatgcaataagctctccatgtttacaggggacgttgccctctctggcaaagggcaggagtccactggggtaggccagcaggcagagctgtgctcgctgcatgtggacacagccagagctgctcttaatgccacgacctcaggtagccctcgctcaccttggacttctcttgatgcagctctatctgaatgtctgtgagcttggtcctgaggtcttcattggcagcttgaagggcaacaatgagtgcctcgggcttctcgcccttatttcgccctttcttggacattgttcctttctaaatggagtctgttggtttttaatttctttcaagcaggtgctgccatgttactgtttcttatcctggagtacgatgtctcagcatctactgtgtggtgctccttggtaaggtctcctcaatcgctgccctggaagccctgagaagaggcagagatagtagttattgttttggcaaagacctggtctaagtgccagtcagtctactctcagcctgagttacctgtaagagcctcctcctgaggctctcctatcctcagtatctcctgtccacttgtacgtgagtttagagtgatttttttttcaaatagctaatttaattatatcaatatcttgcttaaaatccttcacctgaagcataaatccttcatccttcactctttcatgtcttggagtgttctttttacctgaaactgctcgctcttctatcctcatctcctccatgtcactcactgatactccaaacataaggaacatggtcgttaaaggaagtcacctatgtgatgacctcaaaaggcagagagacccaactttaagaaaagccaatgtatagagacaggattacatgtaatagctaaactgtgagaagtggggaataactataaatgaatcaccggattaactgagtcactcatatattcattcattcattcaatcagtcaatattgttagagctctttccatatgctgtgctaggtatagaatttggaaatagaaaaataagtcagccttccaatgggaaaaaatttatctatctatctatctatctatcaacgatctatctatctacgtcaccatccataatctgataagagttttttaaaaaataggcatgaattgtttcagaagtataaacagtaaactgtctttccacctgggttgaataagaaaggctcgctgaagaagacaccgttggcttggaacttgaggagtgggtaagatgataacagatggagaaacaggtgaagcatcctgggcaaagaaaaaagcaggtgccgagacacaacagagagaaatcacagtgactatttgtgggaagaaatagggcctgattaattacacccctaaatgtggttgatgggcactaatattggaaaggtttcctggaaaggatagatggcggggaggcctagaattccaagcttagaatgttggaatcttttttcagcaagcaatgggaaagctattgaagttcttggcaggtgtgtgccctaacagagcagtactttggtgtggttattctggtggcagaatggagagagaatgaatgcaagaagaccacatagaaggcaactgaatttgtccaggtaaagaatgatgaaagcctaatcagaattgtggcaagaggagagaaaaggggtgggggaaggcagatgtgtcttgatttacaaattcttgaatacttcataggaacaaggggcccagaaaaataggaatactaaatcattaaagtcaatgggaaaaacatgacaagatcctagagaaagcttctcttgcaacctttcagaaaattgggcattgtgtatgttgaggagcttcagtccagagctaaggggaactcctgctgaccacccatatgttccggcagctgctgctctcttaagacccttgtatctagcactgacaagcatgctgggatcctgggctttgtgccatctgctcatgagcactgaagctatgctctttggagtgtgtccctgggggaagggggcagggagaggttaggagacaggaaggatgagactgtcggcagcagtcatagaactgtccaccacattccatcctgtgctagatgctggagttgtccttcacgcttcctttgcaaatctggccaaattattaaagtgcagggctgcgaggtctctgagaggccatctttttttgcttttagtcttggaatgaattcagcaagcacatattgaacatttgtgtgaccagcaccaataggcaaaaggataaataagatagtacttaaactcaagtaggtagtgagtgagtaaattcacatatatatatatatatctatctaacaggtttctctctatatatttgatttctaaatgttgttgttgttctgggcttttccagaggacctccaccagcctcctacgtagttatgacccacagttctatatccacagccccgaccattatgcaaacactagacttgtatatacatacaacaccccattatgcaaacaccagacttgtatatacatacaacactttacttatcaaatccacttgaatagatctgattggcatctcaaaactagcataactaatgcagatgtctttgttacattagtccccccaaaccttattccccccaggttttcctagatcattaaatggcaaaaccacatgtccaattgtcccagatataagcctagaaattatattttcttctattttattccttgtttctcttattcagttcactaagaagttctgcttgctttgtatataaaatctgatccgctttggccaatttccctcaaatccctaaagtgctgctggaacacagagtaaaaaaggagcttgggaatagcttcatagtcccttcattgttgtcttcttgaatgaagaataggcttttctaaatgcagatatgaaatggtagaggaaagagcttaagcaaaaacctgaagccacaaatttgcctggtgtatttagaaaaggttgtgaaatggaagaagagagacgaggtgagatttcgaaggttgttgcatgataggctagggagtttggagtggattttacaggcatgaggaaacatggcagcatttgaacatatgtgtaataacaataacagctgctagagactgactgctcacaacgagcccatcattggacgaagggcttaacatactgttcttacttaattctcacaaagtttagggaaatatgattaactgaaagattagataacttaactaaattgaccaaggtcattggtggtaatgctcagattcaaatctaagcaatctgagaccgggaaccaagctctttttctctggactgcactgccttgtatttgcattttaggaaggtaactgtcagtattatggaagatggtggaagaaagtcagttaggctgatttaatggtccatgtgaggggtaatacagccctcaacagataaaaagaaagtggcaactttgacacatggagtcactgatggaatcgtgcccaatttttaaacgttactattgttttgaacattcttctctcccattgtaaataatgactatgagttctacagaattgcttgtagcaaaaatgtgcaaagggacagatacaatagatacattttacatcttaatttataattctacttcaaaatataatattatgtgccggactttatatatttttagcctgggaattattgtgaacttagtcccacaaagggtgaggaaaaggaaaaggtgaaaaaaaaatagatgcacattcagaagagaaaaaagcatcacaggaagttattgatagcatcagcctatgggtgccttaaggtgagcaacttcatatccatggtcctatacacccctctggtggaggagaactttccaaactcttctccagttgtaatgggtgcctggcaatctcatgattctcatactctaattttactgcatctcttttgtctccttgtgctgcttttttttttttattttcacagcttctttgagatataagtcacataccgtaacattcacatttttaaaatgtacaattcagtggtttttagtatattcacaaggttgcataaacagcatcacaatcaattttagaacattttcgtcactcccaaaagaaactctatacctgttagccataattcactattccccacgcagctctctcagccctaggcaaccactaagtctatttagtgttttgtctctacttagttttgtctctggatttgtctgttctggacattttgtataagtggaatcatatgacattttttttttttttttttttttgtgactggcttcttccactttagcataatgttttccaggttcatccatgttgtagcatggattgatacttcatttctattgctgaataatattctattgtagggataaactgcatcttatttattcattcattgcctgatggattctcttgctgcctttgtgtaagtggcttaaggtcaggcttctacagaagctgccagccatcacaagggacatcactcttgagtgcaaaaaagagagtgcctggaccgggtgcggtggctcacgcctgcaatcccagcactttgggaggccgaggtgggcggatcacgaggtcaggagatcaagaccatgctggctaacgcggtgaaaccccgtctctactataaaaatacaaaaaaattagccggacgtggcggccggcgcctgtagtcccagctgctggggaggctgaggcaggagaatggcgtgaacccgggaggcggagcttgcagtgagccaagatcacgccactgcgctccagcctgggcgacagagcgagactccgtctcaaaaaataaaataaaataaaagagcgtgcctgaaggtatcactgcacacaggtggaatgtttccggacactccgagagtccttgccactgatgatgtctgacccagcagattatccggaggaaggataggagccttgttccatccactaagggccaatctctacaggagctttacaacataaaaaacttgaaggaactttaagtgaaccctagatttctagctcctagctgcatggtcaggcagcagtagccccaggcaacattgtgaggcatcaaatatgtgaattttagcttactcttcaggccttccactatccctaatcaggcacctcctacagcctctgaggctgagtttctctgtaatggtttctatctctgataaagatattagagaagttagagacagcctcttagaaagttttgcattttgaagatcattgcttaagagcacacctttgtggaggaatggatcattagtgaaagaattacaggcatcattccttcatttatcagacatttattgagaaggaaatatagtgtagtattttagaggagggcttcctgaatctttggtctagttacatcaaaatctacttgagagctctagtgataagaagctccacttctggagattctgatgtagtaattggcacatgattctgatacacaggcatctctgagaacatttgattaaaagtatgggctacggagttagacaaacctgtttaaattccacctctgcctttagtagctgtatgatcttaaatcacttaattctctaggcctcaatattcctcatctttcaaatggggtttggagggacggggatatgtagtacctatgacactggattgcttggcaattaaacaaacggatgtaagtgatgctcttgcacagctcacgacgcaagaactaaccatttattgagtgctttctatctctactgttagccacagtggaggaaataaaataccctataagcgctgtcttcaagatgcttaaattgaataagaatgacaggggatgtgtaaaattattgataactcaagttctacacttacagaagactttatatattaaaagagccctttatttaggaactggcacaaaactcttgagggagagaagccactgagagaagaggagtgacatcagcagaggcaaatgcagcctctgtcccttctcaccaaggttcctcctggcagggtacttctggagaccaggagtgggatgccccatctgaaatcatcttgaatcatctactcccaatatagtccttttacatcttttagtgtttaggcagcttccaaatccattcttgataaacaaattttcaggtctaaaaattcccattcagcattcttcttttttaattgacaaaaagtatgtatttatggtgtacaatatgatgttttgaaatatgtataattgtggaatgtctaaatcaagcaaattatcatatgcattaactcacatactttttttgtggtgagaacacttaaaatctactttcctagcaacttttaagtatacaacacatttctattaactatactcaccatgttatacaacagatctccatccagacttactcctcctaactcactgaaattttgtatcttttgaccaacatctctctattcttccctccccacctgctcctcaccttttttttgttcgtttgtttgagacggagtcttgctctgttgcccaggctggagtgcagtggtgcgaacttggcttactgcaacctttgccccccggattcaagcattctcctgcctcagcctcctgagtagctgggattacaggcatgcgccaccactctcggctaatttttgtatttttagtaaagatggggtttcaccatgttgttcaggctggtctcgaacttctaacctcatgaactgcccacctcagcctcccaaagtgctgggattgcaggtgtgagccaccacgcctggctaccccctggcccgcttaatcaccattccactctctgctactgtatgagtatgaccttttcagattttccatataaatgaaatcatgcactattagtctttctgtacttggcttattttacttaatataatgtcctctgggtccatccatgtcacaaatgaaaattttctttgtttttaaaagctgaatagtactttataccacattctctttatccatttatttggtgatggatactgaggttgatttcatatcttggttattctgaataatagcattattctttttgaatgacaaacactgcaatattaaaatcaagaaattggaaacatcaaatcaatttataagtatttacaaataatgattctaggagtgtaactgagttgcaactcagaggagaaatgcttgaggggatagatatcccattctccatgatgtacttatttcacattgcatgcctgtatcaaaacatcttatgtacttcatttatgtatatacctactacatacccataaaaattgaaaattaaaaaaaaacttttcagaagaaaaaaatgtgatgaattcatgctatcaatcttaggttataatcctggttgtatactctgtgcaggaaagtaaaaatatcctagaaatactgttttgatgtccaactacatttttatttatttatttatttatttatttatttatttatttagtatggagtctccctctgtcactcaggctggagtgcagtggcacaatcttggatcactgcaacctcggcctcccaggttcaaataattctcacgcctcagcctcccgagtagctggcatcacaggcatgcaccaacatgcccggctaatttttgtatttttagtagagatggggtttctgtatgttgtccaggctggttttgaactcctgtgctcaagagatctgcccaccttggcctcccaaagtcctggaattacaggcgtgagccaccatccccagcctccaactacattttctactgactctcacatcataaaataccacacaattctttgtcagaaatgtagccacgtggtcaagaaaatatggccactatttactgagtactcttcttagcttttggtagatgttaaaaagtgtaccattcctacctttaggtggcttccaacctagagaggagacaaacacctgcaaaaagaaaactaattctagaaagcagggaatagtaaatgctatgaatgtagctcagagtggagtgataaagcatgaagacttcataaaaaggatggcattgagctgagcctgaatgatattacctaccttaatgaagctcctactctgtgccaggcaatggcattaactcattgaactattccaattaaactttgcagacatttacttttattagtttttagatagggaaattgaggctcaaagaggttaattaacttgcaaaaagttacacagttaagaaatggcagagctgcaactcaaatacacatgtcagtctccaaagcggcttagctataataacactttcctaaagagagggcaggattcagctctggttgccgacaggctacagaggtggcaaaggtgtcagctgggatgtgataaagagagcgatttcatacactaggagagtgtatgaaatagaatggtacaaaatagaatggtgattagtaacagttaagagtttggaatttgaaatcagaaactggttttgaataaaatttcctagctgtatattcttgagaagttgcttaaactctctaagcttctgtttcctcactgtaaaataggaaaagtgctgtatttacctcattgagctgtttcaaggaataaatgagttaaagtatataagataactagcaaattatttttatcattgttatatttccttttttatgacctaactatccactaaacatcatcttaaatttagagggaataggaaactgatttatcacctatttgtgttaaaaggacagggtagagaaagcacagagatccctgaagagactaaagaaatccatgcttctgcttctggggaaatacgacctacattgacagggtcagtattcccaggggtcttggctttgtagctggttctgccccaagctataagctgaataaagtcattattaatctcaaggtttccaatatggctgttgccactgcaatgtgatgtgaaagcaactgttatataaaatagttgcgttcacatgtatgaagctaaatgcttcaacccttctctataattaatatttggatatgtcaattctaacaaagccttcttagttcttctaagcctcccttcttttccaaagatgatgcttttcaatgagatgctattagtgtttaaaatgaatgaagtaaacttgcatactttattcctggtcacctgcagtgacatcctgtcacttgttaaacccttctccatgcaggaaaaatgtcacactgtgtattcataaatttgacccaaaaatttaatgtaaaggagagagggctgctatttaagccagtccaacattgaagttctaccttctcttaataaagggaatgtggtggcatggctatagagtcaaaaagttttaatccattacatgtcagttagagaaaaatgaatgtgaaatattcacattcagcatagtagcaattttgcatcttttggattgtaaatttccaggtttgtatgacttttggtttgttttctttctcctagtgtatgaaatcgctgtctttatcacatcatcataatagtagttgttacaaattatttaatgtcaatacactgtttcacatgaaaagaatgctatataaatataaccaaaaagttattactcatgataaataaataatttggatctcaggtttaaaacttcacatttgaaatatgcttcataaagtatggagagaaagcactcagcacacatacaagagacatccagcctctttaagggggactgccaggaaggcttggtagaagtaatgtctaagttgagatccaaagcaagtagtattcatccagaactgatctactaagcaaacccttgactttgctcatgcaattctttgtttgatttcccttttcctccctcaactccctggtgaactccatcctactcatcttttagggccagatcaaatatcatgtcataccacttttcttcatacctcttcaccataccccgggtggaataaattattccttcatccgggttttcattttcactttgaagatatttcttacagcattcatcactgattcttcaatttattaactcactaaaatacaaatattcatgaagtgcctggtggaggacatgtgtgtgctaagcaagagagacagcatacttgcccaccctaggggaggaatcagcaatttaatacagtgtgataatcatacagaggacaggagatgggcatcataggaatctcagtgagtcaggaaagattccttaggaaaagtgacatactggccaggtgtggaggctcacaccggtaatcccagcactttgggaggccgaggcaggtggatcgcttgagtccaggagctccagaccagcctgggcaacatggagaaatctcatctccacaaaaaatacaaaaaattagcccggcatagtggcaaatgcctgtagtcccagctacttgggaggctgaggtgagatcacttgaacctgggaggtcaaggttgcagtgagctgaggtcgtgccactgcactccagcctgagtgacagaatgaaactctgtttcaaaaaaaaaaaaaagaaagaaaaataaaagtgacatatgtaactaagatctgtaaaataagaaggaaggaaccagtaagcaaagggttatggtgggaaagaagaatattctaggcagaaggaatgctaagcatgaagacctagaggtaaaagagaataagaatgatgctctggagagacatactggcaaaagttttgtgagtgaatagaaaaatggcaagaggtcagcttggagaggtaagcagtggcagatggtagagggtagtctaaaccatgtcaaagttatggacttcatccacaaatcaatgtgtagtcactggaggatttcacataggggagtgacttgatgaaatgttggttttagtaatattcctctggcagtagaaggtagaatgaactaagaaggtgaacacaggtatacaaagaacagttaggagaatgtggccataatccagtatatatacagaatgataactattcaataattattattcaggtgactgagtcccagttaagagtaaaactgtgtgttattcatctttgtgctcattgtacctgtcaacaatgactaccatgaagttcaatctaattaacattgatccagatccaaggaaaacactgagattgaatgacatattttgtaatttctacagagaccatttataataagctttattatgggaaatttcttttattttgcaggagcccttgaatggctgtttcaggtaaaagttaaagcttgatgtaacactagaataaacaataaaattaaatgtatttttctttaagccacttgctgacatttcttaatccttgcctccatccatcatagtaacaagcttaatttcactcctcagcactgggtaagtcatcttgtattgtactcttttgtctggatttagaaggcttttgctaggatgaatttaacaaagtaagtctttaagtgtcatatagtcttattttattgtattttttctctggattcaaagtgttttacagctgttgcagagtaagaagtgtcaacttcattggacatgaaggagaaatctcaaacagagcgggaagcaattatgtattcaaggtcaggcagagcaagaaacatgcatcagagcccccacctgaggcaggtaattgctgtatatgtgcacagttactaaaaacaatctggcgaccaggtgtgatggctcatgcctgtaatcccagcactttgggaggccaaggcaggcagatcacttgaggtcagatcactttgagaccagcctggccaacatagtgaaaccccatctgtactaaaaatacaaaaattagcggggcgtggtggcacctgcctgtaatctcagctattcggaaggttgaggcacgagaatcacttgaacccgggaggcggatgctgcagtgagccaagatcatgccactgcactccagcctgggaaacagagcaagactctgtcttaaaaacaaaacaaaaccaaacaacaacaacaacaaaaatccctagcatgtaaagttaaaaaaaatgcccaaattattggagggagtggctttcatagaacatatttataactgacagcaagattttctattttaggcataagtgaaacatatataacctattctgttgtttccttggtgactgttttcaaaggtcttgaatttttttaaaaagctatcataaagccaccttttcaaggtgtcagacatgagcagaaatgtctatatataggagaataatgtgtgcctgctacttaaaaaaggcagaacaatttcaatataaagatgtatacagattaatattacttaagtaaaagtacatgaaggttggataaaatagctttcggatatattacatagttctattataaagaattgcatttaattttccatactttacataagagaaactggctattagtattttccctatgttatactatggtatctataatataggaataaattacagagcaatacagatctgtttttaacactgaggattcttttttgagttttgtcccaggggtcagtgctcacctacattttctgtccagttgatgggatcttaaaagcaagaccgttaggttgactaatggaaggtagtcaacgtatccacataggccaaattccacaggaaaatcacttcaggaatcagaccatcaactaacttttagaccataattatgtgcaaggcattgtggtagagttaaagataatacaatatgtatctaccaaaaaagcctgcatattctaagtgccagagaacacacacacacacacacacacacacacacacacacactgagaacaagaggaattgtatcatgaggccaagactatatctggctccctgttaaatcccagtgtctaatataatattgggcataggtaaattctgaaaaaatacttctgaataaatagatgacttcaccaaaacagaagattttatgattaaggctgggaaatgaagggtgaataggagggattgaggaaagttaaaaaggtaggacaagtggagataagtgtgaggaataaattgtagatcactgtgtttggtatggaaagtttaatctgagaaaccaataggtgtgcagttagaaaaataaactggaggcaaactatgtatgtcttgcctgcctaggtagtgaatttttacttggtttaataattactgggaatgtgataaatatttttaagagaagaggcacgctctattttttttctaagaagggctaatcttgaagttatatgcagagcagaagggaagagaaagaaattagaggctgtaggtcctgatagaaatctattgcaaatgatcagagataaaaaatgaagcttggattatgatggaggggtagaagagcttttctctttcctaagctaaaggaacttactcatctcaccattatcattttcttcatcattccacatcttctctttagagagcacttagtgtgtgctgaccactgtacaatgcagcaatttttgtgcatccttccatttcatacttaaaacaagattatgagatacatggagttattatttccctataacttgagttaataggaggtcaatcccttacgcaaagtcacagtgctagcaaaagacataattagaatgtgtttgagcctgaagcttcttagtgcttctctcaagctagtatgtaatgcagaaaaagtctgtataatgtgctcattactaggcaatagtcaaagagagaaggaaaggttgaagatgatacccaactctcagtaagggacattggaagaatgtaggtaacatcaatgaactcagtaagatcaaagaagtcacccatgtgtttcaaaataagaaaagctaatattttcagggggcttagtataagctaggcactacagtaaatgatctatattaactattatattaaggaaaaagaagctcaaagaagaaatatagattgtgcaaaattgtaggtggtaaatagcaaaggcagtgcataataacatggctagccttactccggagcctataagcccaactgtaccagaaatactgtactagaaatacttcagtttgtttttacagaaatcatatttgagggaaagcagtaccatcttcttactatttattgatttacctacttaaaaaatttattccacaacttatttgaaagcaatttctaagcactttatagaaataaacttcaacataatgtgatgtaaggcatttaaaatgaagtagatagcatatatgtttatatatataaagataggtgttcaaatagcagtaattttttttgaatggcagatgatcagagatcttaatttaaaataattgaggcttttcttttccttaaggtttctataattgtatagcttctataatcagaataaaataatgtttctggcatagcgcagggtggcggatatggtgggaagcaaaacacagaattcagtgaggacaagtggagcaaagggaaaataaggtagacaaccagctgaagctaggagtgaggctggaacacaatggccatgcttttggcataacatcatgaaaagctggaattaatgcaaacatagggaccttgttcctaatctgaaatgctttgggctctaaagtgcctctcctcttcattgaacagagaaccagccattagtcacagcgagtcacagcacaattgtccacgctgcaaaacctgacttaattggaatcaacaaggccagaacaaacttctgaatgtatgccagtctcttttcatgaagggactgtgcagtcagttagattggaacttgaataaatcgtttttttggaaatcagtgttggtgggggggcactgttttccatcaaatctacctttcttggggaagccagcctctctcacgcatatcttaccaaactcacgggtacaaatcactcaaggaaataaattggataccctataatgttcacttttttcccttcaatgtctctatcacatatttgctctatagaagcagggatttccctgggcctgttcaccactgtatccgcagtgcttagcacagtgcctcatagtagaaactctaaaatgtttgctgaaggggtacctgaatggagccaaaatgaacttatcattggcaagagtaaagaattccttaaacccgcaaaattttaatgttgttcttccaaagcacagatgactacagcatgaagtgtcacttaccattgagtaaacctaatgatgttttatccacattaaactctgtagtatattaattgtatttatatacttaaaaattgagcaatatatttccaaatgtaagaaatttatatttgagaaacacattttcctcccagcattttctttattacctggcacatgaaactaggaattataatttctcattttaagttttaagctatttctatagacaacttattaggaaaaacaaatctccagggctcataattttttcttatatatcttaaaatctcagaagattctgggagccattgttttctttttgtatagtaagcaatctttgatattccaaagccctggagtcctggcctataatattctagatcatcatagcacttgtaaagataattactgttcttcatccacttactcacctcctactgtgacagatgaatactactactactactgctaatcatcatcataattgtcattattgaccatttactactgctggtcactgtgcaaatctatttacatgcattatctttttaatgctctgaggtgagtgttaaaagtcatcttccagccttgaacgtatgatttatgaatcctctctacaactcttccccactgggagagaccaacatgtaaataatgaactgcaggcctgaagatgtaatgagtgctgaaacagagaagcaaacgaggcactactggtactcagaggaggagctccaactccctgggaaagacagagagtgtgtctaacagaagggatggctaaactgagtcttgaaagatgagagaggatttgccctgtggtcctggcaataaagaagaattgagtaaatattatgtaagaaaatttggtaagaattatggatgtatcaagactattgattagcttggagttgcaggtaacatgcagaaggaggagagaatttagaaagggctcatttttatatctgatattaaaactggtctattcttacccttcacacgacaggtaaaacatttaatttgggagaagacaattctattttctcaactgcagaatggaaataagctatttaataataactctattgcaatctttctacatgccaagcacagtatttaccactgtacatgtattaactcattaaaacaaattcatgaagtaggtatcattttgcagttacataaaacacaaaatgaagacttttaaatttgcccaatgtcatgcaacttgtatgcgtaggacccattcattgactcagttaatgttttttgagagcctttgatgtgtctgacaaaatttaaaatcacttcagcctgattccaaaacatttgttttaaccgctgcatggtccttgtctttctcttaggaccagaaacacaacactctttttcatatctattattgcctttagaactctcagatgacttacaaagaagtcctgttctatagaagtcaaagtgtaaggccactaaacacatttgctgtccagagcattatgaagatttaacacaaggctatgtatcattcattgtcataatgttctgagcactgattgaattaatcgcttagggcttttcacttagaaatcccattttttagggtggttataaactagcagttaatatttttcctatgtgaaatagggttcaggcaagggagtgctttaatcctgcaaaaccgtatgcacaacatagctattgcattgtaaaatgatcacatgagatagataattaaataaaaggggatttggtgcctagatctagggttgtggttgaaaaacttcttatgatgttgcactggttgcttcatagagtctgattaaatgcaactaataataataaataatagtcattaatatttcccttttaatcattcacataacagagacttagtgaagataaataattgaccttctgctcagtgttggtaagcaatggagataggatttaatctaagctgttagactctagggcccattctctcaaccgcatcactatagtcccacccttaaaggatggtggcaaaagatacatggaataaggccggtaaagcgtttcacatggtatgtgtcaaataagtgctctgttctaaaatcagcttcttcaacaaatatgtattgaatgctgcatagctgccaagcactgtacttggtatggaagatacagcagtgaataaataaaacagacatacatcgttggctcatggagctgctatgttagttggagacccacataataagcatgctaagtaaatatactgtgctagattataataataatgtgttatgggaaaaaataatacagaacagaggtcgacaggaaggatccaggtggtgttgtgattttagatctgagaaagcctaagtagttgctatttgattaaaggctgatgcctgggggggaaagcgtgccagggtagtgaggaaatagtacaagagctccacagtgagcacagacgtccaagttccaggaacttcagggagccggggaggctggaggaatgagtgagctaggacagcagccaaagagagggcagacagtaatgggagggcagtgtgtgcagaccatgctgtgctttttaggccattttgcattgatttaagcttttactcagagtgggtaggaagccacaggaggagttgagaggggcagtgccctgatctgacttagcttttaacattttactctgactgctctagtaaaaggagaagactgagcataagggtggaattaagcggactggtttggaggtcactgcaaaaatccagcttggagatggtagcggcttagagagtggaagcaagggaggtggtgataggactagatgcaagctgatggtaatcctttttgggtggatgtttcatcagaatcatgggatcagtaagttgagctgagatgcagagccacgttgatctgatgatgtattaaacagtacacgttactgtttgttcctaaaatgtataaagctctcactctaagcagggcattgtgccaggcactgcagctaaaacactctgagggtgtccatgccctcagagagctgtcctcctattaagaggataatagttacaccataactatatgtggctgcagaatatggctatagcacatttgttcaatgaatattcactgcatacacagttttaggggctggagatagagctgaggatagaataaacaaacatccttgctttcctggagtttatactctagcagagtgaaacaaaaatcagcaagataactatgtaagttacatagtatgttaaaaggtaataatgagagacttcatgacgatctagcccacacctgtgcaacactgtcatagtgaaaaattagaaacaatgcactgtccatgtaaaggggaacagcttgggctggacacagtggctcacaccagtaatcccagcatttttggaggctgaggcgaggggatcgcttgagaccacaggtttgagaccagcctaggcaacattgtgaaaccctgtttccacaaacaaacaaacaaacaaaaattgttaggcatggtgtttgggaggctaaggtggtagaatcacttgagcccagaaggttgagggtgcagtgagctattatggcaccactgcactccagcctgggtgacagattgagaccctgtccctaaaaaaagcttaaaaaacaaaaataaaaaagggaccagcataataaagtggtatgtccagtctataaattactatgcaatagtttaaaaacacataggaagatctacatgaaccaatgaggctagttgcacctcaaaacatttaaagagcaagatgacgaatgaagtccaaagtataatgtcattcatgtaaaaaactaaagagattatatatatatatatatatatatatatatatatatatatatatatgcacatatgcacacacatctatgtggacctataggtacatacatgcataaaaacattttggaaagatatatgaggtaacagggtccatctcactgagggatcaaaaagtcttcctggatgcctcacatggttcattgcaaaccctctggggaatgtgtctcaggtgagtgtgtagctccttctccagtgcttcgtggctattgcatgacgcatactgtgtggccctctgctggataaacctaaccttgaccacaactctgacaaattatatacctggatctgttgctggaaatgctgagaccctttgggtacacaggatgggtcctgggagaaaatgggatttctcctctctcccttgtctccaacaccttcctgggggtaggtgcctgaagctctattctggtctccttttcctcatgggttatctcacccactcattcagccttctcaagattggttaatgtgacggactactccagtcaaagtgctagcagatagggaggttggtattttaaaactctctcatcccccagatacatgagttttattttaaaagtgggataggagacacaagcattgcataagattgtatatgagaaaacactgttacccataaaccactgtaaacatattccattattaaaatgattaatatttgttctcccaccctctccattgtgcacagatgaaatgttattgttactattaaccttctcacctcctccacggtacacagactggggaatgctattaatagtttccccccatcccccacccagctccttctgttactgtgaagtaatttggatgaactatgctaggcttaaaaggccaaggatttttcatcttccctattccaagtagcattctttctccttattgttgaaatttacaaagtacttgaatacgatgcagacgctatactcacctcaccttttatatgaaaaaactggggctcagaatcatgcacttacccaaggctgcacaaagctgggatttaacccaagccttctcccgaaccttgtgttcatatagcacaacccaagctttggccctgaaggattctttaccacatagactttctctcctaaagtctagcccagaagagaggagtgtttgcttctcttttgactcaagggcacatgagggtgctggctggtcagtggaggtagacctggagcaaaggcgatgtgatgtccacgcctcatgggaggggagtctgtgcatgggagcggttaagcagcgccgtgggtgactccttgagactttttgctcctgtgtttccctgtgcatgtgtttgtctctgtgtccttctctcaagtctttaaacaggatggtccttcctgtttcggagactttacctgtcccattccctttgcaaagtcctgtcttccatagattctaatcatctcagctccagtgtcattgactcaaggaagctgttgttggttgagtcacgtccctcaaaagatatgtttaagtcctaactcccagtaccaaggaatgtcaccttacttggaaatagagtctctgcaaatgtaatcaagatgactgatgtccttttaaaaaggaaaatttagacacaaacatacagatatatccaggggagaatgtcatgtaaaaatgaaggcagagattggggcattgtgtctacaaatcaaaaaacatcaaggaatgccagtgactaccagaagctagaagagaggacggaatagtcttcttagagctccggaaagaaccaagcttgctgacacccagtttcagacttctggcctccagaactgtgagaggatacatttctgttgttttaagccaccagtttgtggtaatttgttacagcagctctagaaaataaatacagatcttcctgagattttcagatcaggccaggttcttctagtgcatgttttcacaatatcagctatttttctaaataacatgtatcacagcttgtggttataaatttgattttttaaatcaatatttatctctcccactaaaatgaaagacttgtgaaagtagggagggtgtttgctcatatgactaatataaaaacagtatgataaacattttttaaatgaaagagagtaaatgaatgaatggattgatgaatgacaagaagagagtgcagcacttgtaattttgacctggggacatgcggaaacggtccatttgaaagcataataaagctcgctctctctttctccatctagatttgaacgatggtctttttaaaagtctatgggtaataataagattgacaaagcagttcctaatatcagggaaaactgtcaacactaacactgatgataattactgtaaaactgtgaaaaatgagaacaaatcatttctgttagagaaaatgaatgctttttatcttatatcttattatcaaccagcacaatcataattatgtgtgccaccaattttgtatatgacctaaaattgtaaacaatttttatttgagggaaacagtaaaattatacattttttcctatctttaaagttagctctttataaatataatatgatattcacatatcataaaaattactggaagaatgatgttgctttatgcttaaggacaagaactctggagtcagaccctaggcttaaaggccagctcttatctcttactaactgtgtgaccttgggcatgttacttaacatctctctgcccagcttttaatttctccctcacagagtagttgtttggatgcatctaataaactaatactgttcatgtaaatacataccaaagtaataagcacattgtaaacctccatacattttcaccattaatattatcagacatgtgacatttgatgagatcatggtgagtagtcattcagcttttctcacctacttacatcagaactacacattgcaaatcactttcccttttcatctttaagaatcagacagcaatgaacaaaataggtgagtgatgtgtgggattacgggtggcaaagagatatcacaaacacattttttaataaaaaaaggggctgaaaacataaatgttttaatttgtggcaagagagtaagaggcacaaaataaaatgttacaataaaaaaaaaattggaattaaaactccctgctttcattcttttgaaagcattaatttattttatagtagatttttaagttcaagtttttgcactttcgtttcagtcctgtcaagtcaaaatttcaaacgactgttaaaatcttatgttaactgaatggtttaaatccttagaattacaattaatttgggggttatacttctgatcaaataaatagaatttcataaaatcaaagtaattaagcatatctgctgtggtggccccttctcaaataaatcctttctactaacaacattttcaagaacttggttgttgaagttccagataggtgaagtttacgatggacactggattaatagcttctcttagtctgcagctgggctacatcaattcccacatctcctctcctaagagagccaattaatatttttaaattggtatcagaatagccaggctagaacctagctcttgtcctggtgtcaaatgtgatcactctcattcaacctcagatttaatgttgacttgtctgctggaaatctctactgcctacactgggaagattccaagtttttttagaaaaaacccctttaatgatccattttggctagagaggataaagttgattttccagggagatgtcagcagcttgcgctctttttgggtgtctctcatcttgtctttgtggttaattgtggagtcacagtcatatcatgggcagctaaaataggaacaggactccttgatgggctgtctacaccacaagcagtcattaccccgggtcaggacttcctgagaaataaagagggtatacaggaaaatgaacaaggcaacaagattcctacagatcctataattgtctagtgaaattgataggctatgcttgtcaaagctgctgtttggcattctcccttcctgtctctccctccctcctggtgactggcaatgtccatctgcagcttttacaatttgatgtgtaatttggcctctcatgtctccctgaatgtgccttcatgtcacttctacttttgagactgcatctttcttaaacttatctcttggtatttttcagattcactcttctttgctgttgaatagccagaattcatctttgaaaaatttactgtgaaaataaaaacaactgtcaaatgaagaaaataaaacacagagtactcaactgttttgtcaggcatagaaattaaattttaagtctgttgtacttttgatgaaagtatgcacatatgggctcagagcttatcaaattgtgacaaattttgtgtttgtttaaggttccacactggaggctgagtaacttggaggcacaggataataaaagcacatgcaagcgagccaatttgttttatatgtaaccatttcagatgcaggatcagaaggattttctcccttcattctcaaatttctgctaggcatgagtatttatgatcaagctagactcaaaacaaactaacaatgcgttaaatattaacacccaggactcttatggaatgattttttttgtactaagtttggcagtttagggacagttgccaatgatccaactaaattaaagtgctgttgaatacacgcttaaataaagaaaagcctatttagtagttgagaggctaaaaaagaaaagaaaattggcaccaattgcccggcttccttccacaactacctctaaggtagaagactctcaaggatccagacttccttttcatagactccagatagatgaggtttatgatggacactggattaatggcttctgttagtctgcagcttggctatatcagttcccacatatcctgtctcgagagagccagatgaataggattcctccttagggcattattgaatggcaatggcacttctccaatagtagcatccctagcatgggcatcaggcccagatatttattatatgttcttccatagcttctgaccagcaagtaaggtttgcatttctcatttcttcctctattgttacggaagtgaaaggtctgtgtgtgtgtgtgtgtgtgtgtgtgtgagagagagagacagagacagagacagagaaagagagagagaacaagtgagcaaattcagaaacttttccccctcatttatactaatttttaggtactgattgatagaaattgagatttaactcttgatgtaactgcttgacttagactgagacctaagttatatataatagaaactttttttctggcaaaattacatagaataacacatagttctattatattatacattttaaagcccacaaagatgaagtgtttaaagtctgaacataatattctaatatttgctttcactttaaaggagagacaaaaatacaacaatattttatggagatctttccaattacaggcttctaccagccttaactttccttatctcaataaaggttaggacatcatatcccttatggaggttggacaaaatttagtaaacatatactgagtgccaaccatatttaagatattgctctatataaggtttactgagaccgacatgttgcaaaacttcaggagatgccattcatgtatacttctgatatggtttggctgtgtccccagccaaaactcgaattgtagttcccataatccccatgtgtcatgggagaggcccagtggaaagtgattggatcatgggacagtttccctcatgctgttctcatgatagtgagtgcattctcacaagatctgatggttttataaggggcttccccatttgctcggcatttctctctgtgccgccatgcaaagaaggatgtgttttcttctccttctgccataattttaagattcctgaggcctcctcagtcatgcagaactgtgagtcaattaaatctctttcctttataaattacccagtcttgggtatttctttacagcagtgtgagaacagactaatacagtaaattggtactgcagagagtgccatgctggtataaggatacctgaaaatgtggaagcaactttggaactgtgtaacagacagaagttggaacagtttggagggctcagacaagacaggaaaatatgggaaagtctggaccttcctagagacttgctgaatggctttgaccaaaatgctgatagtgatgtggacaatgaaatccaggctgaggtggtctcagatggagatgaggaacttgtagggaactggaataaaggtgattcttgctatgctttagcaaagagactggcaacattttgcccctgccctagagatctgaggaactttgaacttgggagagatgatttagggtatctggcagaagaaatttctaagcagcagagtgttcaagaggaagcagagcataaaagtttggaaaatttgcaggctgatgatgcaatagaaaagaaaaacccattttctcggggagaaatctaagcctgctgtagaaatttgcataagtaacaaggagcctgtattagttcgttttcacactgctaataaaaacatacctgagactgggaagaaaaagaggcttaattggacttacagtttcacatgactgaagagcctttagaatcatggcaggaggtgaaaggcacttcttacatggtggcagcaagagaaaaatgaggaagaagcaaaagtggaaacccctgataaactcagcagatctcatgagacttattcactatcatgagaacagcacaggaaagaccagcccccatgattcaattatctccccatgggtccctcccacaacatgtgggaattctgggagataaaactgaagttgagatttgaatggggacacagccaaatcatataaaagccaaatgttaatcaccaaaacaatggagaatatgtctccagggcatgacagaggccttcacagcagcctctcccatcacaggcctggaggcctagaaggaaaaaatggttacataggttgggtctagggccaccctgctgtgtgcagcctggggacttggagccctgcatccaagctgctccagctgtggctaaaagaggccaaggtacagctcaggccatgccttccaaggatgcagatcctaaaccttggcagcttccacataatgatgagcctgctggtgcataaaagtcaagaattgaggtttgggaacctctgcctagatttcagaggatgtacaaaaatgcctggatgtccaggcagaaatttgctgcaggggcggagtcctcatggagaatctttgctagggcagtgcagaagggaaatgtggggttggagacttgacacagagtcaccactggggcactgcctagtggagctgtgagaagaggaccactgtcctccagaccccagaatggtagagccaccaacagcttgcactgtgtgcttggaaaagccgcagacactcaacagcagctgtgaaagcagctgggaggggggctgtatcctgcaaagtcacaggagcggagcttcccaaggccatgagcccacctcttgcattagtgtgacctgaatgtgagatatggagtccaaagagatcatttggaaactttagggtttaatgactgctctattggattttggacttgcatgaccccatagcctctttgttctggccaatttgtcccattttgaacaggtgtatttacccaatgcctgcaccccattgtatctaggaactaacttacttttgattttataggatcataggcagaagagacttgccttgtctcagatgagactttggacttggacttttgggttaatgctggaatgagttaagactttggggtactgttggaaaggcatgattgtgttttgaaatgtgaggacacaagatttggagggatgggggtagaatgatatggtttggctgtgtccccacccaaatctcatcttgaactgtagttcccataatccccatgtgttgtgggacggacccagtgggaagtgattggatgatgaagatggttttcctcatgctgttctcatgatagtgagtgagttctcacaagatctgatggtcttattagggcttcccccttcactcaacacttctctctcctgctgccttgtgaggaaggacgtgtttgcttccccttctgccatgattgtacgtttcctgaggcctccctagccatgtggaaccatgagtcaattaaacctctttctttcataaactacccagtctcaggtatttcttcatagcagcatgagaatggactaatatagcttcctagagttgctcaaagtggaaagtggttgtacaaaaataatctggattttcactggtactctgtgggccatagaaaaatgccacctcctcagctctgaaaggctcttcacagtctggcttgaacctcatttatcacaatctacgttatctaagatttggccatataagatctattcactgcctaccttttcctgtaatttgtctatgctcttctatcccccaggcctttgctcatgctatgatctaatcaataaaagagaaaatatacacccatctattattacatacagtaggaaaaacactaaagcatatcacatttgaaatgtagggtaaagaaaatttaaagaaaataacggcagttaaagttctgatttggtaggttgaaagaattgctgctggcttgagtatgtgttgacatgagcacagttgtgttcaagtaagtcaagatgggttacagtaagaaaatgtgtacaattgttaaataagacagaatcaggctctagcctgggtggaaatggtgaagaacagatgtagagagaattccagggcaagaaaaagtaattgaaagatctagggaagttgtttacattggtgaaaaaaaaacaattagagagggactctttaaataacagcaagacctcaagaaaagagggtaggcagagaggcaagtgaggtgggatgaaggctgagtggcttggggaatagagaggaattaagaaacattttttaccccagccataaatgaactagttttcttgaacatcttactcataaaaaaaaccctaaaatttctggattaacaacaatagcaaaagccaatcgcagaacaaaaatagaattccagaaatacaaacaccacagatggctctatccttacagcatcagctaaaatgtgatgcctattgtacactggggataggcaacaaatgctagtgtttcaagagtaggactttctttgtatgaaggagtttgcataaaattgggtttccaaagagaactaaaagcaacctgcccttcctgaagaacaccaaggaaaactgtctattcaaacttggtgctgtgtgaagcagaaaattattctctggcatgaagcctcacgtcatccttcatggtggtgtgtgacctaaatgtacgctatctatgttggttgaaagcatattggctgaaaggccagtgctcccaatgatcaaagagaagcaaattcaaaacctctttggagaaacacccttttaacacagacctcaaaacatttccccagataaagttctcaagtagaaaagttcatggagtggagggaaacagaaataaaatcagaccattagagattcaaatattgaaattattagtcatagagtacaaactatactaaaaatagttaaaaatatgaaaaatattaaaaataaaataagggatataaacaaagaactagtggctataaaaataaatcaaacctttaggatggagaaaaataattataattgaaaattaaatggatggtaaacattaggttagatacagataaagagacatttagtgaactagcaaatagatctaaagaaattattcaatagtaggaacaaaaagacagatatttaaaatatatatacacggttaagataaatggaaatcagagtgagaaaggctaatatatgtctcatgcagtttctaggagaagaaaataggcaaacctgggacaagtatactaatatttgaggagatataacagcagctttagaatttagctgtctttaagtgtctcatgggagaaattcagctgtgtatttgtttccccattttgtcactactaaaagctttgatcagaaccaagtctagattctcagcccctagccatagccaggaattagcaatctctgagggaaaaagcaactgctgatcttcagatcacctctggaagtttattgcctttctggaattttagtccccctaaacttgctttcttttgtagctctcagatgcctttaatatagaatttttgtaacatatctggctttttaaattgttttcagtggaagcatggacctgtcatgggctacttcattctagcagaaagtggaaactaagggtggtgtctttgatatttgagcatattcatttggttggcatatgtatgtggttggaggaaggtataataataaagaaaagtatgggagctgggagtgagattatgtagagtcctgtaggctatggtaagaatttgttttgtaaaaaaagctgtaaggtcaaaatatgctgaagaccaatgccataaaggaaaaagtctcaaaggagagaaacaagataaataaaaggaatatgattctggaaagggaagagggtatcctgggattagactcaagaaggatggatccagaggcagtgaaagaagttaaattactttgtgatcagatactggtttgtggttgattagtggagacagaatattttaaagataaaaggagtgctgattccttttccttaccctcatagttagtgcaagtaagatgaaaagcagcctctacttgaaaaggaaggaaggaatcttcttgtgagcaaaagttacttgttatggtctgaatgcttttatccccctaaaattcatacgttgaaatctaacccctacagttacagtattaagaggaggggcctttgggaggtgagtaggtcacaaaggcttgaccctcatcaatctttgatcattgggagcactggcctttcagccaatatgtttcaactaacatagatggcatacatttaggtcacacaccagcatgaaggatgacttgtggctccatgccagaaaataattttgtccttcacacagcaccaaatttgaataggcaatgcaacaagtgccattatgaaagaggcccaaggaggcttgtttgccccttctgccatgtgaggatgcagcaagtaggtgccatttatgagaaatgagccctcacaagacaccaaatgtgctggtgccttgatcctggacttatcagcctcaaaactgtgagcaataaattccatcatttataaattacccagtgtaaggtattttcttatagcagctagaatggactaagccactagtgaccactcattttgcttgcacattatctctccattcttctgataacagaactgcctttggggaaacatcccttctcattctgagtccatatgattttagtagagtcagctgcatttttccttctgcctctttctaattgcctgacacaaaagtcgaaacatgatccagagcaactgcttacagcaaacacacttttgtctagtgaaacccaattctagaacttttgatggaactattttactggggttgatggaatattaatctgaacctgctagtggctaccttgctaacacaagggaagaaccaaaacagaagaaacagctaagctatgaggatgcaagggcataagaatgatacaatggactttgaggactagggggaaagggtggaagggggggtgacggataaaagacattgagtacaatgtacattgcttgggtgatgggtgcaccaacatctcagaaatcaacactaaagaacttatgtaccaagaaagaaagaggaaggaaggaaggtaggaaggaaggaaggaaggaaggaagggagggagggaaggaagagaaaagaggaaaggaaaggaagacaggaaggaaggaaaggagggagggagagagagagagacaaagaaagaagaaagaaagaaagaaagaaagaaggaaagaaagaaagaaagaaagaaggaaagaaagaaagaaagaaagaaagaaagaaagaaagaaagaaagaaagaaagaaagaaagagagagaaagaaagagaaagaaagaaaagaaaagaaaagaaaaaaaaagagcagaagccaagggggaaagagactgacaggcagcaagacagaagctgatgatccaaacatggttgagtatggctctatttctatactttccatttatatgagataaattatctttcctgcttatgtcaatttgagttgtgttttggcaaactgcaaaagaaagactcctcataaatatacttgggaaactctgcaataaatgggatttgtttccaataggagtttaacaagacattaaaaatcctataatttcaaagaagtaaagaatctcagagataaagaagatacccagggaaatgttttgacttgccccaagtcccatagtgagtgagtggtggatctagtgctaaaatccaggtctcctatacttttcttctctcaagaagagataatgatatacagtcatgtgtaatttaataagggagatatattctgaggaatgtatcttttggtgattttgtcatcctgtgaacatcatagaatgtacttatacaaacctatatggtaaagcccactatacacccaggctatatgttatagcctattgatcctaggctacaaatgggtacagcatgcaactgtacttcatactgtaggcaattgttaagtcataagtatttatgtatctaaacatacttaaacatagaaaaggtacaataaaaatacaagatgaaaataaatggtacacctgtatggagggagtgcagcttgctggactggaagttgttctgggtgagcgaataagtgagtggtgagtgaacgtgaagacctagtcatcactgtatatcactgtagacattataaacacttaggctacactaaatttacataaaagttttatttcttcaataagaagttaaccttagcgtactgtaactttttttttttttttttagtgacaagacctcactatgtttcccaggctggtctcgtgctcctgaactcaaacaatcctcctacctcagcctcaaagtgctgggattacaagcatgagccactgtgcttggcctttactttaacttgtttacttcataaactttttttttacttcaacttttttacttcataaactttttaatttttaaacttctgactcttttgtaataacagcttaaaacactaatatttttgtactgctatacaatacattttcttttttatatcttattctgtatactttttctattaaatgtttgtttttacttcttaaatgttttgttaaaaactaagacacaaacaccaaccgcacattaccttaggcctgcacagggtcaggggtcaggatcactagtatctgtcttccatctccacagcctgtcccactagaaggtcttcaggggcaataacatgcatggaactgtcatctcctatattaacaatgccttttggaacacctcctgaggctgtcttacagttaacttttatatttaagtggaaggagtatactctaaaataacaaggaagtatagtatagcaaatacataagcaacatagtcttttattatcattatcaaatatatactgtgcatcattatatgtgatatacttttatagactggcaatgctgtagatttgtttacagcagtaataccacaaacacgtgagtgatgcattgtgctacaacattacgactgctacaacgtcactaagcaaaacgaacttttcagctccattataatcttatgggatggaccaccatggtagatgtggtccatctttgacagaaacatcatacagaaacatcattttgtgggacatggctgtatgttccatttctctcctggcctccttttactgggaagtttggtgttagggaagagaggaggaggctccaacattagaggcagagcaaggtaagaggaaagacaaccagggagtgaggaatgattcactctcccagaagattaaattagccattattagcttcttcatggaaagccaactggattccctctggtaatcaattgccccagtcattactcaaaagtcaagtcaagcagaggtttcacttccttaacttgtaaatatctttggctgtcaataatcatttctacttgatactgtggttattctgattttgcagaaaggctctatggtggagttaggaagaagcttctccaaagaagcactttatttgactgtgtttgaaggtaggtagtcataggcccactggagctgttttctcaaggatgcagcattttacaggaagagaaaatagcactaataatgtagcagagtatgaattacaaggtacaagcaaacatctgcacacaaatcagccaggataattttatctcatcagatgccacattcaggatacatgagtgaaatctctttggaatatgttcgttgttgctgcaaaacagaatgttcttcgctttaagaataattttcctctggtttcttaaaatgccttttacatcagttaaacccattataagtgtgtgaaaaacttgtgttgatcaagctgagtttgaaccctcaaattctaacaaagtcacttgtcttctgcatcataagcagtggattattggagccaggaagggaattccaggaaccccttcactcagagacagtgaatggtcagttgttaagtaaacaataaggccgggtatggtggcttatgcctataatcctagcaccttgggaggtcgaggtggatggattgcttgagcctaggagtttgagaccagcctgtgcaacatggagaaaccccttctctactaaaaatacaaaaattagccgagaatcatttgagccatgagaatcatttgagcctgagaggcagaggttgcagtgagccaacattacaccactgcactccagcctgggtgacagagtgagacctgtctcaaaaaaaaaaagtctgaggtcctgtgtgacttttggcaacaccccatcatctctaccttgggcgtcacctttccgatatgcaaagcaagtgaaatataaggttacttccagggcagaagtgctctgaccttctatccacaggataaagtgtatggctgggagactggttatgcagtttgtcataaaacattgaaagaaagcaaagccttcatattatgcataattaaggacttaccatttaaaactatagttctattttttatgtataagatgaataatgtgttttaaatggactgttttgatgtggatgtggggaaacactcctgtgttgtagtgggagtataaagtagcacaagctttctgcagagtaatctggcaacatatttaacaattgaaaatgtaagtagcctttgatttagacactctgctaggaatttatgttataggtatacttgaacatgtgtgaaatgatttttgtatatggcattatgcaattatagtattgcttcaggtagtgaaatgctggaaataacctaaatattagtatctatagtggaatagctctacagtggaatatcatgcagatatcggaaaataaaatttagatctgacaggaaaaccttaaaatatattaataaggaaagactcttacagaagtgaattccctcggttcactgattcaagagaggatcagaagggatactggttttttccatcttccccaagactggagaaccagcaactgcattctaacaacgtgttgaccagcaatgcttttcagtcaaggctggcaaggaagaggcatggggattctggctgaaatattgagatattcaaactcctggactcaagcaatctttctgccccagcctcccaaacagctgagactataggaacgtgccactgtgcccagctacaaattattttcttaacactttttatggtcatctggcttaacagatatctctttaaaaaagaaagcaaaaaataacaataatactgtaatattgagtacctactatgaagtagcactagaaatctttgtatattctaccatttatcctaaaaattatgatctacccaaatattactgatggagtatttctaatttgaaaatccaaaatctgaaatgatgctcaaaggacatgctcttcagagcattttggatttcggattttttggattagggatgctcaaccaatatactgcaaatacagtgttccaaaatctgaaaaaaatctacaatctgaaacacttcaggtcccaagcatttcaagtaagggatattcaacctgtatctccattggtcagatgagaaaactcagactcagggaagcttaatgatttgcccagagaatgacagtcagtaaagaattgaaattagtatttagttctttctgctgtcaaagctaatgtatttacctgtgtgttatactttctaggcctttttttgagggttatgaatcataaactttttaatacaggcagttaaacaggcactatgatgtaaatatatattaaataattctaggtactgtgttaagtcttcaccaagtgcagccaccatgttgagtcccagaagggacagaaatgaacacgtgctcttagtaatgcctggggtctgtgttagatgtgcaaccagtattaataagtgcagtgtttctgaaaccttaggcatgtttgtagcatcctcgcaatcttcaccatatccacatgccaacttaacgttacttaattcatttctatgtaaattaactcatttcttttccttaaagtccagctattttagcctcagcgtaagcaccatatctgttaaaagttgcggtatgtcagtaatattttctagtacatgctacaataagtatatcactatggggaaaaatccattcatgtgccatcaacaccacactctgggaaatactagattaataccacattatctcagagtgacgcagccccctcctaggccccatgagattttctttcataacttttatgatgttgttgctcccagaactgaaatatgtagctaccagtgtttccctagcattggtacactctccctggtaacatatcctgctccaaaattgatagatatattcattttccatcatgcaccacccttcctaaacatttgactgactgtggatgtaatgcacaacagtgggttttgatactaaatttacggtgagtcaatgactgatatgcaaatgagatcagcaatagtaagtacagagtcttcttagcaaaatgagttgaaataggagattagggaggagtcatgatttgaaccaaatgcttccacaggacagaatataagtgttttgaggcaggctacatcaacttgtctgaacaaagtcagttagaaaagaccttaagctggatgtgatgtctcagcattttgcccaaagattgtgagagaagagggcaatttaaattggtattttatatttatcaataaatatttgcctattttctaaaagatatccttaggagacattctgggaaatgtgcaactattgagtcaaagattatgaaattattttacacatttaaatacatatggtgaagactaagatttaagtgacaatggaaaaatagtgttgacttcaaaacaataaagctaacaaaaaatgaaaaacaaaatcaaatgtaaagaaatgtggaccgaagaaagattcatacttccctcagcattgagtctcagacattaactctcaaaacttgaagataacccatatcacctgaggagtttgtaaaccacacagcaattaggttctacccatataaatctgaactggaagctctgagatgaggactaggcatcttcatttttaggaggctcccaggtcattctgatgcacaccacattccaaaacactgacttaattaacagctagtcacgtagaaggagaaacaggttggaattataattaccaacacttacatgttaattatgattagtttaataatctacagaataaatagttctgtaaccttgttatttttcattcacagttttaacttctgtttattcaattctaatgttaactttctgctccccctaccacatttcaatgttcctgaaatcgagatgctttttaaaattgatgtatgtttttttcctgaaaagacggtagtaaatcaatgttgcaaaatgcaatgaattatgtcttaatcaaagaaattcgacagttatgagagacctcaaagattcacaacatgaagccctttgtaacattgtaggttcctgggttcaatttgtgaggactctgaagccagtatgcagctgagtttacctcctgggtgtgaacgcaggccattacacaccatggcaagttggccttactctttagagatgcagtgactctcctaaagtaaacaaccacctcaacagcacattttgtttccttgttaaaatcatcctctcaatgtatccagttgttagtgctggtgatggaagtgaaaatgtttaagcatgatagtttaatctaaaagcaagtattttgaataaatcaaggaattgaactgtggtaataaattttacttgctttgttcacgtttactaaataaatgacataaatagatttacggagctgtccagtgtttaagtgatattttataactgtattatgaaaaattaaattacattagcagaattgagacgatctcagtatccaatgagaatgttatggatttgtattatgagactcttatacatacttgcatgtatttgtgtgtgtaaatccagacacacttagaaatatttatgtggacatctatacttacattcatacatgccaactattacatataaaaatatttctatatataataacaaagatctataaaaacacctatataaatatgcacacgtatatatactgatgtatacagtatatgttttaagatatttaaaaaatggaattaagtattttgtatatcgatgacttactgtgaagtcagtataaagaaagaaagaggtaaaaatatcattctaggccgggtggggtggctcacgcctgtaatcccagcactttggaaggccgaggcgggtggatcataaggtcaggagttcaagaccagcttggccaagatggtgaaaccccgtctctactaaaaatacaaaaattgagacaggagtggtggcatgcatctgtaatcccagctactcaggaggctgaggcagagaactgcctaaatccgggaggcggaggttaaagtgagccaagatcatgacactggcactccagcctgggcaacagcgcaagattccatctcaaaaaaaacaaacaaaaaaacaatcgtcctagtctttcttcttttgttctcctaatcgtagtctttctttaaggtgccattgtcctctgtatttcattttatttatcaatgtgcatgcctcatgtctctattaggctggaaattatacaaaggcaatgatgttctacttgtctttgaaattcttcaatgcctaatagagtgatcagcctgtaataggggcttaaaatccgaaggagtattgatgaataaatgagtcaggaaatatgaacaacactatgagttcttttattaattaccttcttgaacacaggcaaaccattaatttacttggaatccagtttactcatccttacaattacagggtggatttagttattcttcaaggtatcatacagattttttgtttcacatattaaaattttttcatattataaatgctttataacattattgtgatatatggattctgctgaaacatacaattttatcactgcttccatcaaatatattagctatcaaaaaaagaaagttaaaaagactaaaatcaggaggtataaattttatatacagcaaaatgtcagggagaagaaaaagatttaaggagcacaggcttaaaatcagtagtcctagaatctagtctgggctttacgacttactagctgagtgatcttcacaaataagtcaattaactccttaggctccatttcctggtctgtaaaataaagattataatacttgctttatctccttctcagggttgttgtgaggtccattaagataatatatgtgaaagcagtttatatagtgctgcataaaggaatgttgtagttttacccctcaataccaatgttttaatggcattaaactatgtattgttatggcacaatgaattcaaaattcaccaaggctctgctaaagaaaaacataaaatgatagatgtgatgggaaacagttctgaaatcttaattacattatgcaaatgtgaggcaatattattttatatcttgatgcagatttctgaatcggttatagggatgcattccaagtagtaaagtgtctaggtaacaaatgaatgtttctcaacagacagaggaataaaaatctttctactatttcctatttaaaccaaaagtcttaggcttttaaatctttctaaacattatttactattgttgaacaggtaacatgttaagtgcagtagtctgcaatagtagagacatgaatagatctactttaaaaattaactttttaatttttactctcatgaaaactttgagaacaaggacttaatggcaaaagcaaatatgaccattactgccaagaaacagatgcttgtgtctagtataaggggaaacattcatctaacccagagccttaaagtcataatgaggttgttgtggcttcttagagtcataatgaggtagttggcaagtccacgggagtgatggtaaaatgccttactctattaatttactcatttattagttcattcaacaagtatttattttgcattgggtactttgcttggaagtgagacctcagtagtgaattacagggataggtttattttcttgccagacctttcaatcaggcagagaaaacaaatattaaagaaaaggaaggcaaagggggcatattggttaagagtatagacagcctaaagagagaggcacttatggatttgggggcaacctaattttattaagcctcagtttcctcatcgataaaaacagaatagtgtcatcactgatctcatgggtctttgaggagattaaatgaagcaacgagtgtaaatcatagtgtgtaacccatagtaattgttgttgttgttttttgagacagaatctcgctcttgttgccccagctggagtacagtggaggtatcttggctcactgcaacctccacctcctgggttgaagcgattctccggcctcagcctctccagtagcaaggattataggcgcacaccaccacacctggctaatttttctatttttggtagagacagggttttgccatgctggccaggctggtcttgaattcctgacctcaggtgatccacccgcctcggacaccgcgcccagcccatagtaaatttccaagaaatgtagacttcatggtgttgataaagatatctttatcaattatacaactttaaaccagttaaatagccttaatgccatgttagaacattctacaaggaatcttgctttattcatgtcttagaatctgaatatttatgccatgttgtactttgaactttgttttcagatccaaatatcccacattctcaccttggctttgccgcctgtcttctgttctggcctgcccttcttgtctacaacccacaatcactcacagaagtcatgttttccagccactccaggaaataactgcacaggccacctgatcaaggttcacatgggagttcgtcagcccagggaaaggattcagccaattttcttttttgtaacgaagcagtttaccctctctaaatctcagtttctgcattcactaaatgacaggatttaatgtgatagtgcctttttaaaatccattgttttataaattcttgtttctatttttgtaaaatttattttggtgtgaaaatgatgacattttacatacaggactcttctaaaatcatatgaaacccattgaaaaaataggagcaaataggccagggaacaaattttagagcccttccactaacaatattacggagggctgcattctcatctcttcgtgtggctttcacacattataaaattgctttgccaatattgcttagtggaggtgggggaggggatattttaaaactaggaattggatgtttcacttggttgctccctcatccatcttaattttgacatcgtaaccacacagcacccagcacccaccccttccactctgatggaaagaatagctatgcctacgaatgcttaaaagcaaaaatggaagggcatacattttactgcaaacacagacgtttctcttcctctttctcaagtaaaagcctaagtagtaaccttttagagaatgctaagaattgaaataaattctttgttgagttcataaatccaagtaattctagtaagtcagggttcctttaaggaatatggataacgatttaaaaatatgttaagggaagggagggaagcaaaagtaaaaggaactgttaaaaccagcaacctccataaataagccacatcctgaatattaataacgtattgtgtaaaattcattagatacattttatgtttcagacatctatagccagcaatgatacaatggagctagaccagatttttttttaacttcaaggatcacagaattagtataccttaattatattaatacaaaattgcttaacatttgtttaatttctttgacagtttatgaaccaggaagacttttttgtaagtgtgagcctttcactaacatcaaggttccatttttttacgtgagacattttttaacaaaaagtgacaatattagaaaaaacaataaaagctaaactttattgaacattcactatataccaggtactatacttggggctttaaatggatcagtttacttaaaacagcataatgaaacaggtaatccccttttcaatgagtaataaaactgtaggaaatgatacaattttaagtacatatgaaattctacttaattaatggcagactgggtaattctggacaatcgccaaccaataaagacaatttaaaaggctaggagaaaaactgcaaattttaaaaagcattaaagaacacatgagattataaagaattaccaggctgagatctgagggtaaataggagaccacagccaagaacatagagcactcagggacttttgctctggtgatatttgctgatccaggagaaatggctaagaggctgaacggaggttttggcagactaatgggggctagatggaaatagctggtgtctaggtaagcttgattattattcttgtttttgggctgggacttcagagtgccacattctaacggcaaaggcaaagcaaaagtaaatgagtactcatgacgactgcagcccgactgtaagtcatctgggtgacctagacaatctgaaaccctctatttagattaaagtaattccagattgctattttgcctacaagcctggaaaaagcaaaagacaactgacttgggacactcaaataacttctactagcaataattgaaacaccatacttcacacacaataaaaggtaaccaaacacatgaggagatgagacagcatgagtaagaaccagcagaaccaaaagacaacagaaacacacaaagacttcaaatactgtagccattacaaaggttctgtaaaacagccatgcctacttcaggggataaaagtcatgcatgaaaaatttgaaaggcaacctgaaaatataaaaagtgatattatataggaaatttgggaaagaacaaaatagaagttataaaacagaaaaatataacaacaaaaattaagaaatcaattgatgagttcattggaatttaggtgtaacagaagaatcagggaatgaaaaacaggtcgaaagcatggagagaccaaaagacggaaatgatgcaagaaacaaaagaaagtaaaaggcatagaaaacacagcatggaagtctgtcatatattcaatagagacttaaaagaatccaagagacagaatggggctgaggcaatgttggaagagctaaaggctaaattttttttagaattgatgaaacatatctatccgtggagtcaagaatcccagtgaataccagcaagaatcacagacaacgaggaaatcttaaatgctatccaagaaaaatagatgactggcctataaaaagataacagttacactgagagctgacttctcaacagcaacacaagaagcaggagacagtggaatatttttcataggttgaaagaaggtaactacccaaatttgaattccatacccactgaaaatgtccttcaagaatgaaggtaaaacaaagatgttttagatgcacactgaagaaaaatctaaaggatgttacttatacaaaagggaaatgatacagaaaaaaatgagtgagtaaaagtgatatctgggcaaatgtaaaagaacatggattattaacaatatgaaaatatacataattataatcataaagtgatagcatctaattctgtaattcaagaacagcagatatggttttaagggctagaagaaacataaatgtatgtattacaattattctttgataagagaagaatatgttacaattactagaattaacacaaagattagtctataacttctaagttaatagaagaaattgaatgattaaaaaatttcctgtcgattcaaaataaatcaataaaggaacgaggaagaaattaatgtagagccatttgggcagacaaaaaacataatgaggtagtagatttaaatctaaatatcagtaattgtattaaatttagataaatgaaatataccaattaaaagatagaaattggcataccaggaaaaaataaccaaacagaaatccaaaattctatgttccctaaagagtctttctattaatatacacatataaaataattaaatatatatgtattacatattcatgttactatattatatataacataaaaacaaaatttaaagcagcctgtgacggctgtattaatactagaaaaaaaagattttactagaacaaataggataattcataatgataaaattccatttctcctcggaagacatgccaattctaaatttgtatgtatatattaatacagcttcaaaaaacttaaaggaaaaattgaccaaattttaaagggaaatagacaagaccatagtcgtagtaggagttttttcctaaaacattcatctctgagtaaaacatatccctgcaagatataacatacatcatatcatctccaatgatattgttttaaaattatatttctttttttttttttggccaatttactttcttttttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattgttcaattcccacgtatgagtgagaatatgcagtgtttggttttttgttcttgtgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgctgtttcctgactttttaatgattgccattctaactggtgtgagatggtatctcattgcggttttgatttgcatttctctgatggccagcgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggtttccttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccagatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgctgttgtataagaatgcttgtgatttttgtacattgattttgtatcctgagactttgctgaagttgctgatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctagattacatttattgatttgcatatattgaaccagccttgcatcccagggatgaagcccacttgatcatggtggataagctttttgatgtgctgctggattcggtttgtcagtattttattgaggatttttgcatcaatgttcatcaaggatattggtctaaaattctcttttttggttgtgtctctgcctggctttggtatcagaatgatgctggcctcacaaaatgagttagggaggattccctctttttctattgattagaatagtttcagaaggaatggtaccagttcctccttgtacctctggtagaattcagctgtgaatccatctgctcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtcgtgatatcccctttagcattttttattgcgtctattagattcttctctctttttttctttattagtcttgctagcagtctatcaattttgttgatcctttcataaaaccagctcctggattcatttattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagatatagtttgttataatttgtgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtgttgggtgcatatatattcaggatagttagctcttcttgttgaattgatccctttaccattatgtaatggctgtctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaacacagcacactgatgggtcttgactctttatccaatttgccagtctgtgtcttttaattggagcatttagtccatttacatttaaagttaatattgttatgtgtgaatttgatcctgtcatgatgatgttagctggtgattttgctcattagttgatgcagtttcttctgagtcttgatggtctttacattttggcatgattttgcagcggctggtaccggttgttcctttccatgtttagcgcttccttcaggagctcttttagggcaggcctggtggtgacaaactctctcagcatttgcttgtctgtaaagtattttatttctcctttgcttatgaagcttagtttggctggatatgaaattctgggttgaaaattcttgtctttaagaatgttgaatattggcccccactctcttctggcttgtagggtttctgccgataaatctgctgttagtctgatgggcttccctttgagggtaacccgacctttctctctggctgcccttaacattttttccttcatttcaactttggtgaatctgaaaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccatcgctgatatcctttcttccagttgatggcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccgtccagctttgttccattgctggtgaggaactgcattcctttggaggaggagaggcgctctgctttttagagtttccagtttttctgttctgttttttccccatccttgtggttttatctacttttggtctttgatgatggtgatgtacagatgggtttttggtgtggatgtcctttctgtttgttagttttccttgtaacagacaggaccctcagctgcaggtctgttggagtaccctgccatgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaagcctccttgagctgtggtgggctccgcccagttggagcttcgaggctgctttgtttacctcagcaagcctgggcaatggcgggcgcccctcccccagcctcgctgccaccttgcagtttgatctcagactgctgtgctagcaatcagcgagactccgtgggcgtaggaccctccgagccaggtgcggggtataatctcgtggtgcgccgttttttaagcccgtcggaaaagcgcagtattcgggtgggagtgacccgattttccaggtgccgtcagtcacccctttctttgactcggaaagggaactccctgaccccttgcgcttcccaagtgaggcaatgcctctccctgcttcggctcgcgcacggtgcgcgcacccactgacctgcgcctgctgtctggcactccctagtgagatgaacccggtacctcagatggaaatgcagaaatcaccgtcttctgcgtcgctcatgctgggagctgtagaccggagccgttcctattcggccatcttggctcctccaggcccttaaaattatatttctttcatactaaagtgtgggaggaaatatgggtatcaccttcctggcgatttcccatggctgggacctcttaggaagcagtctccctagagtatttcaaaataattatgaaatacctacttcctgtcgaaaggtgtccctcctatttactctgagttttcataaataatttacaatacaaaagtatttgatggtgtgacattttaaagacaaggaacagaatgattcctaaaggctcctccatatctataacattttaaaaaatcaaccgattgctgtttgtaatctctccctgattttgctgcaaatgactaatcttagtattttccttcttgttgcagttctcaccttgatgattttataaatacctgtgcaatcatttaaggatgctgttataacttgctatcacaggattcaggtttgtctcttgctctttttagttattcctctccccgtcttttctccttttaactccccttccctactcttttcttctttgtttctgattacctgctttgcacgtgtgaggtaccttgtgtaagtagcagctttttcctaaaaattcctcttcatgatttcccaaatctctaaatcttggaggatttgcaccaatgagttccaaaatgtcacaggctataatttatttatattttgtctcattgagtgaagagtatttgacctgtggttttaaaatacatgactagccccagccaagtgtagctaacgaaagagttgcatgggacaatgtcagtcatagaaggaaggtgataatatttcggtattattagaaatgaaatgaagaaaaaactaaatcatctgatactgaagatgacaagtttggtgttttgttcgatgaaacaagactacctatcatttactgttctcttgatgccaaggtaattaatgttcttaaaaagttatctaacttaaaaaaattagagatagaaaagaaagttcatttccattccatcctctttttttttatccctctgcatccccatttcatgtggttattgcaggagagaatacattgcttttataaaactagtatagttacacaacatcagcaaagcatttttgggggatgaaaaataagaatattatgttattaattacattttgaatttcaaaaaatttaaccacgcatcatcaacactgtattgcaactaaaggaaatagtggaaaatttagaatactgtatatattttgcatttcactagtagggttggctttcctaagctacttggcctttatgtcctgttcatcttattttaatataagattagagagaataccatatatcctacgttatcagatacaaaaaaatctagatatacgtatatttttgtaaataggttgatttacctggcatttggtatcttagccctctcacatatgttaaatggaatacttttcaaactaacatgtaaagatcatgccaaataactcttccaaaaataagaaacatttgtatgattaaagacatttttcaaagagaatggggggaaagtttaacacaatgactttgtacattctcgatggtatgttctattacaattttttgtttgggctattaacatgaattttgtgcaatactatgaggggaagattggttacttttcaaagaaaccacttattttctctcaaaactgagtgtctaatcaaaggcaattttttagaacaggttatcattggtcaaatgtagtaaaaagttgatattcctcttcaatattcacaagatgactctcttactcttctgtgtctttcgacatagttatttttagcaattacagctctgcctttgtctcatttactatgcagtctgtataaccattattagacattacaggaaagaaagccacatggcttaaaaagtactcattctgtcttatccaccagccatggctgtctctttacagtagcctagggagagtaaccccagacacattaacactttacaaaatataatgaatgtgtaaaacccccaaagagagatgtataacgtacctgaaaatactgtggtgaaatgacctaataatttttcactgcccgtgggaaagtattctcacatctccagaggggctttaatacaatcaaattcaatattcagaagatgctatttattataaagagtaattcacttaaccagacacttcagtgaggacttattttgtgccactgaaagaggatagggctacacagataagaagaaaattacataattcttttattaataaatctacatttttgaatatttactatttgtcaagcactgagttaggtcctgtggatacaaggcacaagaccttaaatttgtttttattctagagtacttataatgcaaggtagttttcttctaccatctaaggtgccatatgcttacaaatgatgccctctgtaaacattccaaacatacattttctaccaccattatttttgttgtcttgctcttattaattgatcccacctgcagcttgatagaatatggcaaggtgttatatagaaatatcttcttacgtctttcttgctcttcttcaataacataataacaataaaaagacaaactgtaatgtgttatgtacttgttgtacccagcattggtctaagtgccttataggtattgtccctaaaatcctctaaaaattgatcaaataaaaaccattatcattttaatgtaatgagaagaaattctggttcaaagtgactcactaaatcccttgagttaaccaggctaataggaggctcagctcaaactcaaactcaaactcaaactcaggtatattaaatacaatggtgatatagaaggaagatcttactgtacccaccctatcttccttcacaaagtcttcctaaattgggtaagtttgaactggttttaaaagagttagatcaggagattgatgttttcttttcctttttaatcactgtcttcatagatagataaaaaacaaggaaggaaggaaggtgtcagaggcattcaaaccagaacaactccatcttgaataggagctgggtaaaataaggctgagacctactggactgcattcccaggaggttaggcattttaataacagatgaaataggaggtcagcacaagatacaggtcacaaagaccttgctgataaaacagattgtggtaaagaagctggcccaaacccaccaaaaccaagatggtgatgaaagtgacctctggttgtcctcattgctcattatacattaattataatgtattaggatgctaagggacactcccaccgtgccatgatagttcacaaatgtcatggaaacatcaagaagtcaccctatatggtccaaaaatgggataaactctcggttccgggaactgcccacccctttcctggaaaactcatgaataatccaccccttgtttagcatgtaattattaaagaagtaattttaagtataaacaggtgagcagcccacaccactactccgcccatggagtggccattctttattcttttacttccttaataagcttgctttcattttactctgtggactcatcccgaattctttctcgtgcaaggtccaagaaccctctcttaggatctgcactgggacctacccctttttggcaacatgttcttggcaaccacgaagggactatcctgaggagatccctgacccaaaggaaatagactgcagaaccaattggctgactttgggtaagtggtggggtaaaccttacccagttaaatgatggtattgggttagagtacctcctaagacagagaaggttaaaggcccctcttaataaaaggcaaggatgcttgaccaaacttgggttccagccccaacttaggaaggttagagtccttcctaagatttagaggtttaaaggcctctctcagtgaagtccctcttggttaaaaatggatttggcataatgggatgttaattgctattctctttggattaatctgccttgcactctttgctgacagctatgggtgacaggactaggcatgtacacgataactggacatggggagctttttttctctggaaagggagaaactcgagagctgatgggacagtagtgaagattccttcactattgacaagtggtgacctgaacttttgattcagtgttgctgcaataagtgggtctttctctgcctctcttagctccttgccttccccaccctgccacagacaatgcttttctccttttctctccttttatatcttttctgttactcagggcgaccatcttgcccagacaccacatgctgaaacacttggtcggaaggatcattccaccccactttgagtggatcaaagatgacaaggcccaagtaggggcaagtttgagcctggccagttcaatattgggtgctaactggagtggctaatgtctatgttttgtcacacgtattttgctctgctcagaatggaagaagatggttttcctttgtgttgcggtttggcccccagggctgtggtgtggcgagccaagtcactagggctgcccaaggaaagggaacacagaagcctggcgtgctggcaaaagggtgggaatttcttaccagtcaggctttgggcctccctgtgtgcataactggttgaataaatggcaaaaataactgttcatcccctctgtaaagttttgattaatgggaaaagaatttgtgaggtacgtctgaagctgtagcaaatctggtgtactttgtgctataaatttatcttcctgtattgtactgccataaagaggagtaccttaggatagaacatgggcttaggaccccataagcccactgttaaagccagcctggcaagttggtcagtaacaaactttgctgcaggtccctgaaacaaacaagcaaaaacaactgaatgaagtttccttctcgtcttgttttatgtccttggaagcttgagcttgtgaccatatggcagtactttcttttagtctctgcttatccagaggacaggaatttaggggttcatgttgtagttagccccaaaaattacctcaagcagttaaaagcctttgcaagctcaaaattggctgctctagactccctctgggaagagcaatggaaattgcccagtgctgtggcttagtagctaaggctttgtcttttcacaatgacggcctgggttcagggttcaattcccagcttagggaatgggtcctttctggcttaatatctgtgtgacctttaccatttgttgattctcttctcctccatgaactacttctggcttcatttcttgaatcttcctttctctgagctacctgtggagattctaaatcttgtaaaaactgctaaccacctctttgaaaagaacttgtccattcatggtcaaatcataaccttagttaagccttattggtttcacctgtgagtttatttttggtaaagtttaaaagccagaaatattggctgttttgcccagctaaagtagggtgtatttgtctggttttacactgatataaagaacttccctgagactgggtaatttataaaggaaagagctttaattgactcacagtttggcatggcttcagaggcctcaggaaacttacaatcatggcagaaggcaaaagggaagcaaggaaccttcttcacatggcagcaggagagaatgcaggaggaactgccaaacacttttaaagcatcagatcttgtgagaacttaccgtcatgagaacagcatgatccaatcacccaccactaggtccctcactcaacacatggggattaaaattcaagatgagaattgggtggcaacatagagccaaaacatctcataggatagtaataagagatttaaaaggattttattttttaaggagtactacggttaaaagtcagctcaattaaaagcagatattcaagctataggtatattttaaaggcctttatgttttattctcttcttggattgtgtttttctggaaaaaaggtttttttcttttcttctcagtagacttaattgtttttctccattttgtcttcttgctactcttgatgcacacatgagaggacctaagataatacaacctgggactccttgggaaaaacagaagaggggccacagactgcgttttgggaaaaacgtctattttcctcatgaaaccccagggattaaaagcagacagatccctcttaaaatctaaggctctgttctgttttgctttgctttatctgacgttttttgactttttaggggtatcagaaattacttcgcagtatgtgagaattttgatttataataactaggtaggaaatatacttttaggggtggctaatggcagtcatgagaggatacttggctctttgcacatttggattgggagaagcatgctcttggccatctggaaggtatggaaaagtctccacccctccactgagagataaggctcccatcagggtgggctaatcacaaaatgagttgattggttttgggttgccttgcaataaaatgcatggtaaaatctttgcattgtcttgttctgtagtgtccttttgggattcaagatgtaatataaaaatgggatccttaattttgggagatctgttttgtcttccagctgtgccacattattaggtcctagaaactgtgtgttttaaagagaaacattaaaaactggcaaatgaaaaaaacttacacgtactgaaactatttctgtctgtgtatttatatttgttgtgtgtgtgatgtttatatatgaaagagctctgattaactggctgaaaaataataagtgcttaaatcaaatattgtcagaaaaacaaaaactaatgccttttagttcacatgacttaaataatctttgggaaataaagacaattataagattattggtaaaatttggagatttgacctaaattaggcaggtcagatatttggtttgctaaatgctttaaggtcataaactgcttctctgacttttgaaaattgttcagcttacctgctttagagccattagatcctagatacggtatggggacatgtggaattagccattccccctagcaatgctggaaagtgtcagaccttatctgcacttctgtctggtgtcctaggtgccacacctggtacataattagaatcacttgcttaccaagtttttcaccaaaaataaaagtggctaagagttaacattgtaacatgtaattgagactactgaagaaacagttttacatgcaaggtgtgtaagggagaagggaaggaagaggagagaaggcaggaaagagggaagggagggaggaatttctctctcacatagtgttaggatgtccctgaattaagagttggctgacatcagtttttgtcacagatgcatgaccttggctaagaatttagccctttcatgactgttttctcatttataaagtcataatcccagccttgcctaggtcacctcctcacttcttgagaataaaatcagaggatgctcgagacagccctttgaaaactaaaagaagatgcttaggtgtcatcagtaaaccctgggtgtggggcaggggaggacagaaaaatcactaagccttatgtctctaaaccattataatttcaaaaggttaaagcaaggttagatgttgtcacataaaaagctttgttctggccaggagctgtggttcacgcctgtaatcccagcattttgggaggccgaggtgggcagatcatgaggtcaggagattgagaccatcctggctaacatggtgaaaccccgtctctactagaaatacaaaaaaattagccgggcgtggtggcgggcgcctgtagtcccagctactcgggaggctgaggcaggagaatggtgtgaacccaggaggcggagcttgcagtgagccgagatcgcgcctctgcactccagcctgggaaacagaatgagactctgtctcaaaaaaaaaaaaaaaaaactttgttctgtgaaatatttattccctgcaaaactttctgaacaaagcagaggaaacacaagagtcaaagaagatgcagctgagtgctatggttaaggaagcagacactgaagtcagctcagcctggtttgaaataagcttggccattcattatctacaagaccatagaggttgtttaacctttctaaacctcactttcctatctgtaaaataggaagaacagccatctgacaagatgattccaattattaaataaaaataatgtaagcaaagagcttggcattgttcctggcacatagaaaatgctcaataaatggtctctgcagagtctggcacactcggtgatttcctaccaatacacttacatttgtttaaccgtgggtgaagcctgagtcatttcaggccagttagaaggttgataaagaatgtaagcagattcaaggttttagaaactgacaaagattctttgcctggccaaactttcatcagggtcctaagtccatctgtgtatgtccttgtaaaattcaggtttagcaaagaagctgctaagtcagtttggcaaaaagcctccaccctcaacatctgatcaccctcaatatatgattaggttcctcatcctccactgcctcccatgtgatatcggatcatcttgccctattttttttttttgttattgtttttttgaggtggagtctcgctctgtcgccaggctggagtgcagtggtgcaatcttggctcactgcaacttccacctcccgggttcaagtgattctcctgcctcagcctccctagtagctgggactagaggcacacgccaccatgtctggctaatttttgtgtttttagtagagacagggtttcactatgttggccaggctggtcttgaactcctgacctcatgagccgccggcctcagcctcccaaagtgctgggattacaggtgtgagccaccacacccagcccatcctgccctatcttaagccagaatcctattagttcagtttagtcagaatttcccttaccgctgatgtttgctgttggtaattttccttccactgaccctcactctgcttcttggctatacattcccacttgctcatgctgtattaggaggtgagctcaatctctctcccccactgcaagactgtcacagtggtccctatatttatcatgatggtcctgaataaaggattttttttttaaccatgctttaacaaataacattgaataattttttctttaacagaagaattgaggccaagttgttagattggaacaaaatgaatgggcaggaaatgaaagtgagtgtccccggccagattcacagaggcaatgcaatgcagaaacaagggtcacgtcagttctattttggatggacaaggggagagatttcaatgagaccacgacgatctggtttgaccataaaaggcactgcttggaatttttagaaaaagaaatcatgaaagatgaaataaatcctttggggggttgcgaggtaatttacacttctgggtaaagcaatggtaatatttcaagtagctcacgaaagactaactttacacctgctgtcctggtacgactattagcagtgttctaaaagtgcccaggtctggacaataaattatacataatactcttacttctgaagccttgggaataaatgaggactgtttggaaggattctcaatgaggcttttgcagaagttgtgaaagtagcagtttctcaaataacatacttaagttcgtgatctcttaaattaatggtcatgtttttctaggaagaagacctttggatttacagtcccagcaagcacagcaatgccttattctttttatctagattattttcctttaaattaatcgtcatgtttacccaggaagacctttggatttagagtctctgcaagcacagcaatgcctccttcttccttttatccagattattttcttccaagacaactgcaacaaaagttttgaaaaataggtcacctagatttcaaaactattttgtttccagccatctggggctgaggatgattagctgttcttggtatcatggcagaaacccgacgcaacacatttatttgcacatctcccagtgttgcagcattgttctgggtatttgatattcagacgatgtatcaagaatttgagccttggagaagaaaaccactcagcatttcaattagaatcagtgtgttgtgcatacaaaacatcactacagaaaatcttggaacatgttgtattattacgtgggtttttaaaactaaatattgccaagtagttgcaaggtaaattctaatctgcatgggtgatctcttttccatccctgagttttcctcaaagaaaggtggtaaatacagactcccggtttgcacttccaaatttttacccctttaggtttccagtctatgtttagtgaattcttctcagcacacttaatagactctgtataaagctttgattaaatggcatctaagaaagcatcccatgtgaatccatgtatttcttacaatgcccaaaataactataaaaatgtttagtggcttcatttacaataattgccatttttgtgcccttcccccatcttgctggatagattcttaatgttcttctctttcaccatgcgtttgtggagctgccagcgttctattcacagctgctaattatcaacacagaaaacagagatggctctatctcttgtaagagtatgttagaatttaactgcagctatttctccttgtctgcctcaatggtggatataggagaaaacataaggctaattgtattcagatagtaataatgaggtaatactactattaaaataataatagcaactgtatattgaacatttactaggtgcaaagaactttatttgcatgatgtcattaatcctcacaaaaccccacaatgtaagtgctttcactatattatttcagtaaagaaactaagccttagaaaggttaactagcttgcccagtgtctcacagctgggatcacacgatttaaacccaggtttttctggcatttgattttattcttaatttcacgctgtgatgtttatcttttatggtattatgttctgaaatatctaacaccattctgccatttgatctcaaagcattgtattagaattcttctgtcttcctggcaccttcaaagaaatatccaaaattaagatccttataatgcttacagaattttaagttgatagagattggctgtgcaaaacaacttataattaactcatggtttaggtgaggattttttcaatccattaaactctgaaattcttaaggagagagatggtatcaatcgtttcatcctcattgatgagcacaatagttgacaggtagttgtcatcaggaatgcttattgagtaaatgtggacaaaaaatagacaaaaatgttactcatgataatataattcactttagatgtgagagcaactcagatacaaaagctgaaatggacaatttcagtccatgctgagctgtgctcaaaaagggatggaatgaacaaagaatgtctttatgtttatgctgttactgagctgcctcattcttgcctttcctaattattatccttttgtgctggcactttccactttgctccctatgccttctggtcaggcacttcactcaccctttggagaaagcaatttttaaaaatatttatctttttttattatactttaagttctgggatacatgtgcagaacatgcaggtttgttacacaggtatacatgtgccatgatggtttgctgcacccatcaacccatcatttacattaggtatttctcctaatgctgtccctcccctactctcccacccgctgacaggccccggtgcgtgatgtccccctccctgtgtccatgtgttctcattgttggactcccacttatgagtgagaacatgcagtgttcggttttctgctcctgtgtcagtttgctgagaatgatggtttccagtttcatccatgtccctacaaaggacacaaactcatccttttttatggctgcatagtattccatggtgtatatgtgccacattttctttaaccagtctatcattgatgggcacttgggttggttccaagtctttgctattgtgaacactgctgcagtaaacatatgtgtgcaggtgtctttatagtaagaatgatttataatcctttgggtatatactcagtaatgggattgctgggtcaaatggtatatctggctctagaaccttgaggaattgccacactgtcttccacaatggttgaactaaattaccctcccaccaacagtgggtgaaggatatgaacaaacacttctcaaaataagacatttatgtggccaataaacatatgaaaaaaagctcattatcactagtcattagagaaatgcaaatcaaaaccacaatgagataccatcgcatgtcagttagaatggtgatcattaaaaagtcaggaaacaacagatgctggagaggatgtggagaaataggatgtggcaaatatacaccatggaatgctatgcagccataaaaaataatgagttcatgtccttcccagggacatggatgaagctggaaaccatcattctcagcaaactaacacaggaacagaaaaccaaacaccacatgttctcactcataagtgggagctgaacaatgagaacatatggacagaggggggaacatcacacaacggggcctgttggagggtgggggggctaggggagggacagcattaggagaaatacctaatgttgatgacgggttgatgggtgcagcaaaccaccatggcacatgtatacctatgtaacaagcctgcacattctgcccatgtatcccagaacttatactataatacaaaaaaaaaaaaggaacgcctttttgtttttgtatttatttgtgataaactttccatcctttcatttaccattgctgtttcagcacttttgcatgtaaggttattgacaaaactgattgttttccaagaaggacaacaggaattgattttggggtaagatttacaaactacacgtagatcataacaaactgctaataaactgccttctgtttctagtgggttgtaaacaaagtctgatttatcctctgtgtaaagtggacagatggaggaggtatcccgaggcccttgtagacacctatttaagagtgaaatgctctactactgcaggaagcagagtaaatatcctttcagtagttttgcaagaatgcaaacagagggtcagacaggaaacacctgaaagtggtattcctgcgatctgcatatgctgggtcagatctctgctactgaggtgtctctatttctatttgtttctctcctgccagacttcagtttgagtgttagctttaccaacaataagaccttggccaaattacttaaactgtcttagttccctcatttaaagaaagtgcatcgtgtgaaattcaagtgagacaacttacagaatgtgaaagtgattgtcaaatggtaaagcgctcttcaaatgttgcttattgtattagtctgttctcaggctgctaataaagatatacccaagactgggtagtttataaaggaaagaggtttaattgactcacagttccacatggctggagaggcctcacaatcaaggtggaaggtaaatgaggagcaaagtcatgtcttaaatagtggcaggcaagagagcttgtgcagggcaactctggtttataaaatcatcagctctcgtaattcttattcactatcatgagaacactaaaggaactgcccccatgagtcaactattccacctggccctacccttgacacgtggggattattacaattcaaggtgagatttgggtggggacacagccaaaccctatcacttatcattattacaggcatcatctttcaaaagtttccactaattggatgatgaatgatttattgttaatgattagccttctttcataattggccagctcaaagttctatttattaggcatagtatttaatgttttttagctgttgtactttctagcaaacactgctattggtagctcagtgtaggttctatttttaagaaataaagtcagcacagtggactagaatgaatgctggtttgaagtgagtagtttcatagttctggtctcaggttggagtgcaacttgttaccactctgagaaagtcattcaacttgttaccactctgagcaagtcattctcctctctgaacctcaggacagattaaataaggcaatgcccataaatcaacactctttcctacccttcatttttcaactagctcaaaaaaatacagtgaactgtttttcacctataattctcaagagttggggttttctagtttatctatttcctgattaattaaaattaaaaatttgggggccgggcacagtggctcacacctgtaatcccagcactttgagaggccatggcaggtggatcacttgagatcaggaggtcaagaccagcctggccaacatactgaaaccccgtctctattaagaatacaaaaaaaaaaatagctgcatgtcggggcacacatctgtagtcccagctacttgagaggctgaggtaaaactgcttgaacctggggggtggaggttgcagtgagccaagattgcgccactgcactccagcctgggtgacagagaaagactctatctcaaaaaataaataattaaaaattaaaaaattaaacttttctttcaatcattgccagaagcattttaggaagactaatccatatcacttaaagaacattatctatttagggggtatcatagagtttatttaatcaaaaccctgtacttttatgaggttggatatttatatgttggatatttataaggggtatcatagagtttatttaatcaaaaccctgtacttttatgaggttggatatttatatgttggtttcaacatataaatattgaaaccctatattgtttcaatactgaagatattcaggtaacttatggcaatgtacggaatttagggtcaatcttcacatatatttgctaagtattactatttcccaactgagttcccaaattagggaagaagagagaggttttctacaatagacattgtgcctgatagggtaagatttgagttgtgcttagttagtagtcatgcatgagatatataatttataagatcacaagtgttcacatatgcttcttactgtagggctgactatctgatgtcaggcccagcaatctccgttcaagaacacaaatttagagaaaaaagccagaatatttccagaaatatttattgtaatagaaattttgaatgctgtaatattttaattcctgagacttaagtattgcctgatgtggcagaatgaaaatacttcccactttaatgtcaaaatgtctcttaataaaactaactatacagcagaagcatatgattatcacaaaattttctgtgccctgttctagtcttgttataactctgctcttgcagtgttataaatcaagactataaataaagatgtaactttttattttctcagttttagaccaagatattcaagtactttttcctatagacagaaatgaagaaagcacttactaataaatagcactgagatttttattttcctcaaccaaaatggtgatgatataaatttagaattgaaatcctcaaaggttggaaatgttacactgagtgggatcttcccaaaactctcctacttttgtaatctttaaggtatactttctgacaatgaaagcaatcaagctgtgacagacctccaggtttagctatttaaaataatattattggaaagtaacattctcactaaaggtggtcagaattctagattgattaagttgggtggtttaagtgtctgagttacaagtgtcttattgagtgcaatatatcgatatacttatttttcaaaatgttataatgggtttaagtatcaataccttgcagacaaaagaaatttgagatgtgtgctttataagaaaattcacagcatggaaatttaatatatagttcaggaaatttagttctgaacactaccttagaacttcctttacagaacgttagatttaagatggtaagtgtcttagtaaatataagttgatgattaagagcttgggctttggagtgataaaagcccagaatcagatattggtcctcccacgtaacaggtgtgtgagcttgaaccatttactttcacaagttttttttttccttaaaagaaacaatttatttagaataaaacaaaagcagctcaactgtgagcacacgtttgagagacagctactcttaagctgtatgagccataaaaagggtttttatttacttttccagaaatcttgtgtacacagcacgaagcaaagaggtcatttttttttcccacttaaaacaccagcattggaatcacaatagcagatacacaactttaagctgccattttagtaaaatgcacaaatactaaacatactagctttcttccatcagagccccatataaactccacataagccacaacttctcttcaaaaaggtccattagagctttgaattccatatcttcatccgctgttcaaccagttttgcttgtggcgtgggggagagaaaggttattcagtacaaatgtttacaatattaaaaatatatgtatttcccctatgtcattatagatgaacataacattaacaagaccttcctggatagttcacctcaacttcaaaaagcagcaatagtacccactggcataaatcttgaaatgaatttactgtatgaatagacatataacaagactgcaattgcagataataagactgaaaataccctttatactcgtgtaactgagtaagcatgccaaaaaattcagaaaaaaagtttcacaatcaatttataatttatcaatatattctaaatataacttaaaaagtgaaactacaaaaaggtgaagtttagtcaaacttttggcccatccatctactaagtttttatcttcccataagaaaaagagtgataaaggtggcagctacctcccatgattgtcactaggatttaatgagatcacgagataatcacagtctttactaagacccaagatataacagatgctgtaaatcaaagaaagaaactggattaaaatgttttgagaatcagtttcataacccttgggctcttcatccaaggatctttaaacaagatgtaggatacaaaatttttgcgggtgaaatggaggagggatttgtttaagtgatttggggcaagagggtttgaaggacggtaggtcacacctgctccttaagcctcaccaaggggaaggggctctgctcacagcagcctggtgaggggcttgaatgagcctgctggggaaagcttaatatgggtctcccagaactttagaggcaacagacttgagtcagactctcaccaagaaagatggagggcagcagagaaatgcacgagcggctttcctgggagggtggaggcgaggtgctgcggcatctgcagggtaactgcattctctctcatttctctagcgggtcaaagaatatgtgagattccccacacatttatgccacaggaggagaaaagcctgcctaggggtgttttaacttatgcccagaagtaccacctggaagaggcaacgagactttattcataagaatctaagtggagcattctcccagacaaccagcggcggagcaaggaggggctggccaaacagtgacgttgactggtgcatgagacgaacagaggctcacagaagagcctctgaagagcccacaaaaaatgtccataaggtaaaagagtcagctttgaacttatttttcagtaggcaacagaagcttcacagaagagagcttgaagctctcttgaagcagcatcatggttcaagcaataccttctcggtcacactgtgccccttccctttccagtgctccaacttcagtgagggagatagagggtgagaaaaaagacaagaagacatcctttcccgcttaaatcaagttctgagctctgatcatcctctgggactagacagcctaatttctgaagttagactgtctgtgatttaaagagattgcaggactttctagactgatcagagaagtcacagcccctgcccattttccacctagggtcatagaaagactatgtctagtatgcacattttaaagacagcaatggaaaatgaaaataaagggttttggttcatgttccatgagctgaatttattcaaagtacaactgattattggtataaacagctctttctcctttttaaatcaactggaacctcacttgctggacacaagacccttatttgtacaagcaaatggtttctttttttgagtcacacttctaacctgccatcctggctttagccagatgccaccaggagtgcttgttagacatacccagcccagttttatataaagccaaacaatatgaaaagtgggaatgtaggcagcaataagatgtaatgtctaattatagaatcagaatgcaagacatacactaatcacagatataaagaagaaattggggactgattgccattacatacctaacaaaaatctattgattatcagcacactgtgaagccagactgcacattgctggaggttagggagctgtgacaaaaggactggttatagccttgtttctaaaggacaacctgatttcatgcaatttcttttaacagttgattgagagccttgcccaggctggaacctggtagttgtgctgatgaacctaccctacaacccaagggccttccccattgctactcagcacacttgaatttccataaacttttggacaacttagaagcagtgtggaggggtcttagcaagcccgtcatctttgtcttgaatgctcttctctcatcttcctggaatcccctggcataatgaaaactaaacttgaagctccagtgtcaggctctgtcttcataaccagagcttagcatagtgattggcacttagtatgtgcttgataaatgatagcgtgggtgggggaaagggtcttattttcattactgcaatccatcttgaagggcaaacctcacacaaagggttggtgaagaggaatattgtctccaaaatgagctgtggctttcttttacatggggaggcatttttaatatgatcatagatcgctacagctggaaggtccaataagataatatatttcagcccttcacagtatcctagaccactatcgcctcatatcatattggcccagcttcttgggatgaagccgatcagtacagagatcatccctgtcccttcaggtctggaagtgtattacagacatatcctgctgcaaaaccctgatcaactaaaatataagctcgctaaggtaaattaggtgttaggataccacttgattaaaaaaatgttttaccttttacctaaatactaaaataatttcagtatttcttcaaatataaattaatagttgcacagagtacatttaaaataactccaatgataactgcattgcaaaagaaaatcagatatatacttttcaaaaaaagaaattttccaacttcagaatgtgatatatcaaaatgctctttctttgagagagtacaatcgtgtggtatttatttatatgtctattcctttgagttgcattacctttatatacatataaaatgaatatatataacttgtttaatatataagaaggtaaaaggtataagtatatactttttcctagaagcaagaaattttgcttacttttaaaattcaccagaatattaagaaatctttgttttactctgatttatccattgagcttggtagtaaatttgttactcaatgaaagaaactaattatacagaaaactggtaaagatgggtaatattcattctaggttttaactaagggaaaaattttccttcagcaaagcacaagaaagtgttttctttctagctctagggaaagcctgtaaactataattaagtattgaattaatgctactagtttagaatcaacggtcagtataatcaatacttgagccttcataaagtatggggacaagcatcagcaaaactgctggaaaaaaacagaactcaagaataactccatttgctgctctatgtcccaaccttaacaataaaggggacaatagtattaatgctggacaaatagaaggtccagcttaagattttatttaaacacacacacatgaactctatattaaacgacaaaagctttgccactataaaaccactctgctaactagtgtaatattatttatatactttatatataatagcgtactattatttgctactttgatattgctttatctgtgaccttctttctttgttccgcattagccctgtggatcattatatatatatatatattttttttactattgtattgtatctttcagtggattttttgtgggactttggctgggttgcaatatgctccttaagataacgagagacatcctgagctgtcacaaaatccctgatgcttgtttattcaatgcaactaaagtgcaagacagtcccctctcaatgcttgccttccaggattacgctaacattctgctctgtttataagtcaactcgttgggctcttctgtggcaaggagcaagttgttctcattcctaccttcctacataatcattcaagaaatatttgttaagcatttactatgtgccaggtctatgggaaacaactaacgaagtctagctcccatgaagtttgcaattttgtgagggaagacaggcaataatgacaaaaaataaattaaataaatttgaaggctagcaggtgacaagtgctaaaaagaaaaagtccagcaagataagggaatagagagatgggggttagtttatgtggtatgatgaagaaagtagattgttagtgctcaataaatgcttattatgtatgtgaatgaacagctgttcataatcctacgtttgttatgtcagctggtccttcaagaaatgatgctagtccttcctccaggcatttcttttttaacttactgagttgttaatgatccctacactatttcggtgttagaattgaagaaattactgaaatgtaagtactaatgacttaaaaaaaaagtctagcacaattcttggcacatagtagatattttacaagcctccttgatttacagcattggaaacctgaaatagaactgagttttgactcaccttagaattccatacattttcctaatctgcaatgttaggctttttccctgtgagaaactttccaaatagtacctgtaatcataatcaactttactgagtacttattatgagaaataaatgagtttgttccatgttagttctttaagtcatcatcttatgaatccttacactgacactgagagaagtactcatgtggatccttttttctttttttggattgcaggaggtgcgacaggcttcaagccaaggctgtctgacctgagacaaaccaatgatcactctcacacgcattatctaaataaaacttatccacttaatttgaagtgacttttttgtagaaggctggttaacctgctaaagatacaaaaattgctgatggtacttgaatagtagtatttgagtgggtgtttgtggaggagaaatcttttaattagaatctgtgcatccctcacaataaaatgcaggcattagactttgatctcaaaggaaacttatagccctgttatttttaaaatatctactgttcactaatgggattaggttgaggtttgacacacagaaacctggattagtaatttatccttattgtctctccattattcagaaaataattcacagataggctgcttgattggacagttcaatgctactttgagtttttatttgtgaatgctccacagtagtgaatatcctaatgagtataaggattctgccaaggagatttgtcttcctcctcttgtttttggtctagggtattatgttttgagttggctctggtttccttgtgaattctccagagctaccagaaggcccttgaagcccttaacctcttaatgatgttcttctccaaaaggctcagccctgaaaaacagaattgaaatatgctcctctgtggaggctggcatttttccaaggctaatcagaaggctgaatccagtaaccctcccctgcagcactcagctagctagccagctttctttcccctccctccctccctccttctccctcccttccttccttcctaacttctttccttccttccttccttccttccttccttccttccttccttccttccttccttccttcctctctctttctatttttctctctctctcattaaagcaagttgcttcatttgtttcttagggcaaaaaatatcaaataaatgaacgaacacagcaaattggcctgtttccaaagggcagctagagatattgaggagaggacccaggatggctcttgaattatttttccagctgtgcttaccaaaagaaaacaagtcttctctggccagctgtgtcatatttaatgatgacagggggcactatgtctataagaagccaccagcttccacatgaccctttatgtgacaccattaagatcacacccagactcttaaaagttcactgaacttctttgaggttaataaataaattgccaaagattctccaaggccaagtaaggcttaggccacttctattttggagcctccagttgcattaaagatgaataaaaatccaaaagaattctctgaaagttgttacatattttaaacctattaaacccattaatactgttttaaagcaaagatacagagcaatatcagtgtgctccttacaaaaataattacagcatttattatataaaattaatcatagtttactataagctgtttaatggtaaaaaaattaaagattggtacaaaaatataaacatttaaaatgggtgatggatgtctttcagtcctgttacagtatctctgtgagtgtacccagatccttgtgtggatatagtttaaaagttagggccaggcacagtggcttatgcctgtaatcccagcactttgggaggccaaggtgggcagatcatgaggtcaagagattgagaccatcctggccacgatggtgaaaccccttctttactaaaaatacaaaaattagctgggcatggtggtgcgtgcctgtagtctcagctagtcaggagaatgaggcaggagaatcgcttgaaccggggaggcagatgttgcagtgagcagagatcatgccactgcgctccaacctggcaacagagctagactctgtctcaaaaaaaaaaaaaaaaaaaggaaataaggtctggcctcagcacctattgtagattctgtaagatgccattgagtacttcttgaacactagaacctaagggaaaacatcaacaaaccgaccttggcggatgcaacttagatctacactaagaaacactttaccaatgatctgagaacagcatgtcagcaaaatattaaccagtgcaagaaaatcttattttaagactaagctgtcttcaaataatttggagaactcaagatctattattttaggtttccaaacctttgagttttgttggattctgcttgattaaccactccttgctttattaacagagaatgccaacagtaacaaaatcttgacttgctatctctgtatcatcactgtaagaactagtgattgtctttggtttcacttacctaggattgtcttaggattcatccaggaggacaaagatacccatcctgccctaatcactccagaccaccatggaggttttggttctgatatttgatttttatggccttttgtactctcctcttttgttgtcagcaattatatttatcacatctgccactgagcctgcaaagaatagactctcatctgctccgtactttcttatttcttgggagattaaagattaaagaactaactttgttgactgtgtcttagaaaaagacacagacatcattaggacaatgttattatgaatacatgatacatggcattaacttcaatgtttggactttagttaatttatttttgtacttttactttgtcagagactctctgagtctcagattcttcatccataaaattatacacagaattttggtgaagataagtgtatttatataatgtaatagaatagatgtcatggtttaataggagtacaatattatatataattacacttaactgatatacacaagtatttacaattattattgtttctgattattagtggtgttgaagatagaagtttccagacaactgaattctgggaagatgagatcaaagtttgtaattttgagagaataggatccaagttggaaaaatccaaaagtaaatatgcagttagaaagaactggacttttgcatgcatcagactcagccagaggaaataggtatatttaagattcttttgagcatccctgctatcctggcatagcagggctttaccatacttccagaaatgcttaaaggcctttcattcagacatgccaagtagaggtattccctcatcaaattctctcccagaaaaagctcgatgacctgggttgtactcatggacgaaagacgggaatagagttaacacaaagatagaacttcagaacaattttctgtggccaattgcccttctgggactttaggttcccttatgcattataaactagagtttatatataaacaaatgaatatatgtaaatataatatacaaaacataaatagcaaatatgtaaaataaaatatataatttataaaattttctatttatatatcatttatcatggagtctgaaacatggaaagtactccagaaacatagcttgttccattactgtagaattaaatactcaccaaaacatcaatcaattatacagctttgtgttttcctctatttttatacagtatcctcattcattcattagtattaaaatatacactttcatttttctaaaaatggttattactcagaaattctcatatatgtaacattggaaacattactactattcacatatttaactttataattggtgacctagtagtccactggtttcctttaacacagtttgtttaatgattcctataactttgaacattgttaagctatttattctgctaattaaaaaacgaagtcaccaaataagccagtgcccataagttagtgctttaaggcaggagagtgaatttttctcctaaattctgggaccaaccctccatgcagagaaagctgtttgtatgtccaatgcttactgatgatcaggtaagctcgaatgtctttcacccactctcccacataccatagtgctttattattattattatttttaacccaatgagtcatgaggagcttttttgaaaaaccaagattcctttaaactttggcagtgccacggtgcaaccagagaaggctgaccagtactaagccattccactgagcttggccaggcaatcaacccacagaaatgatctgctcttcatttctcagtgggggataaaggtggaaatcatcacacatataaacatccctacaagaaaaatgcttaaaacgtcacttctacctagccagcaagagtgtctgttctgagggtaaattaaaccagttaaagattaaaaattacaacacgggcacagctgggcctgaaaacatgaggattcaagcaataacaattggtaactgtcaaagatatagctaaatagaaagaagctgactctgatctgatgcagtctcagggccacttggtctacctcaggaccccattataagtcacataaacaaattccatagctggctactagtcttctccttcccaggctcttgtgtcccgcagaccatcttccaggtgccatcaaaactactacctgagagactgtccactcagaatcagtaagaatgtaaggaatcaccagattccatacattttatttaaactgccccagcatttcacctcagcctaccttttttaggcttattgttccagactacttccctcatgctatgctctagccaaattgaactcccactgttctctcctatatgccctgtgttttcctgcctttgtatctttgcataagctatctactttgtctagaatgtgtaaacacaaaaatcctctcaaaactttggttgcttaactattgacttgctggcatatattcttcaaggtgcatctcatctgctgcctgttctgaggggccatttttccatactttattattgataacaataattgggaacattgactgaatgactgaatgctgagactattccgagcactctgctaaaggtttcatagacttatctcacaaaatgataaaagtataacataatgttgtagagtacagaatgccagggttcaaatcctggctctacttcttgttggctgtatgagcttggatgtttattgacattctgtgtcttcacgtgtgaaatgtggataatgataatacagctaataccaaatagagttactatgaggaatatgtgaaataatatatatatataaatcccacagaacagtttctggccaattctaattataaatacctgatgctgttattatagtacctcacaatatgctacaaggtagatgtcatcattattcctgatacaggaggtagaaggaaattatttaggtagatagcgagggtaaaagaatcctcggcagaatttcccttttaacaaaaagcagccccaaatcatttcttttctaacaaagagcagcttgaaaaattgagctgcagacatagataagcaagctggaagtttgcacagatgaatactggcagctgtgccaatagaaaagggctacccgagggccaggtatgttcaacatggagatgctgtctttccttttctttgtcaccacatgtacaataaagaaacaggcaacctggcactggccaggtagagaacccatctgcaaaataaaagcttagggtgggggtggccatgcaaatggcacacctagccctaaccagtttttcataccttatgcaaatagcacacttggtctgaccaatcttttgtgccctatctaaatcagacaccacctccccaagctcatccataaaaccccttgcatttcactgtgaaccagaagacctgcttgggactcctctctctggaagacagaggttttctctttcttttgcctattaaacctccactcttaacctcactcttcgtgtgtctgcattgttggtttccttggcatgagacaacgaacctcggttattacctcagatgaatgatgccgcttcattcccacttaagagatgagaaaattgaagctcaaaaaggttgaaaacatgtcctaagttacatggctgataagtgacatctagaacacacatataaatttgtcaatttgaagcctcttattttctgcaatatagacaaactggttgtctttttgatctaggaattttccttagggctaaacaataacagcaaaaaaaaaaaattcactaacatttattgaatatttactatgtgccaggcatagtactcaacactactcatgcattatcctacttgattcttacagcagaatgagcaaaaggaaccctttttaatccttattttatagaggaagaaactttgctttagagaaacttgttcagtcacacagcttacatgtgacagagctagaagtcaaaccctggctcttacctaaaacaacatcctgcctagtggaagctattcccttactcttcttttcttccagttctcttagtggtagctacttctgtgtcacttgacactctgtgagttgtgcatatatcacacactcctgctaacctgccagtcacctgaagagtaggaccctgccctatacaccatcgcctacctagaaatgtcttccaagtagtggatgcctaataaatgttggactgaattcaatgtcacattggaagttggattataaagaatcaaatggtgcataaaaatattttgcatatatgctaacactttaaattataatggcaggaggcttgagtccagttcctttatggatgaacaatgaatgagaaaaaactgttgcaatagttaagaagctcagccctgaaattggattgagctgattatcttgccccatacttataaatgtttttgtttgttggtttgacttatccattccaaaccagtttccccatctataaatagaagataagaataatatttcccttttaggtttgttgataggattaaaagaatattcatgaaaactacttgggatcatgactcatacatggttagcactcagcaagtttgcttcataaataaaaactgatttttaaaaagtcaaataattacagaatagctccttatcatcccagcaattacacgtctagatctaatatcttcctcaggaaagatcacaaccattgcgaaataaacttaagtgaagatgagggaagagaaaataaaacactcacttgggaaaggtgctctgaaagggccaagcatgtgagaaatggcaggaaggaggccattttgtggtaaacagctgcgttcttaacccaagggacacaatcctcatatgacgcctttgtgttgttaagatgtgtgataaaggccccatggggagggttttcctttgttctccagtctcatggagagatcacatgttatactcacttatttagagactctcatctctaatttgttaagagctgcaagattaagactgatgtaaagtctgaaggccaataagaaaaaatgagtaagcacacccatttcccaaggaagatatcactcatggtgccagaaaatacacacacacacacacacacacacacacacacaaaagaaacctatattacatgaaattgcagcatttgaaggtttctattatgaactgcactgtgttttcccaaaatttatacgttgaagccttaaccccgatcccaacgtggctgtatttggagataagaaggtaatgaaggttaaggaaggtcttgagagtgggattctagtctgataatattggtatccttatcaagagaggaagaaacaccagagatctctctcctagtgcacagagaggaggccattggcaagccagcaagaaaggcctcaccagaaaccaaccctgtaattacctcgacatcggacttccaatctacagaactgttgagaaaaaaattctgctatttaagccacccagtctgtggttttctattgcggcagcccaagtagaatcatccactaacatttgtattaaattctttcccatccacctatacaagtgatggttatattttccctgttaaaagtcagaatgactttttttttttttttgagacggagtctcaccctgtcgcccaggctggagtgcagtggcatgatctccactcactacaagctccgcctaccggattcaagtgattctcctacctcagcctcccaagcagctgggattataggctcgtgccgccaggcccggctaagttgtttttttgttgttgtttttttttttttttgtatttttagtggagatggggtttcaccatgttagccaggatggtctccatctcctgacctcgtgatccgccctcctccgcctcccaacgtgctgggatttcaggcgtgagccagcatgcccgacatggatgacttttaagagaaaggacttttgtatctctttcaagtcaagtggtgtgtttgggagatgtagtttggctttcctactttaaacaaaaagaaaaattaattactccccctccccccacccccttcacataacccttgttttgtaaagtgtctttattaggagtctcttccataagtacctccctctagacattaagcaagggcacagggccacagggagacaaagaccagctacacagccaaaagcagtgtgcgctcagcaataacacaggctctttgttagaggaattttactctttttccttctgaaattctttctggtcgaaaaagtttttacaattccatctccttaggccagccacacttggcacatttgggcaaggagggtggcataaaggtgtggcctgccctgatggatgaggttctgtaggactgcaggcttaagtggtgctgtggcttacactgatagagagtactcatctgtttattctcccttccaaaaagtatttttgaggatctgggttagagcagtcaagcaatagccaaagtctgccgtcagcttataaactagtatgaaaatacagactaccatataaaagcaaccaaattaataaataagagactttctgatgatggggagtactacagaaaagaacataaaatagaggaatggatgactgtaagttgtcatttggaatgagtctgcattgggatcaggaaggcttctctcagggatgacatctgatacataaggaggaatcagtcatgctgagatggggaaggcgaattccaggcaattagtacagaggccctgtcaagggaattacctcgttttgtttaaaaatctggatgaagtatggagtgcctggggccaaaaggggtgctggatcaactaggccatgcagaccaaactgagtactgtaaacttagtgcctgagaaatcattgcaggggttagagttaagtgagtgacatgaccatatttcattttaacaaggatcaccctgactataatacaatgacccacaggccaaatccagcctgcagcctacttttgtaaatagtttgactgggacacagctatgtccagtcatttaaatattgtctatagctgcttttgtgctacaacaggagagttaagtggttgtgacagagacctaccttaaggcccacaaaacctaaaatacttgctactgggcctttggaggaaaagttggttgcatggcagcaggaggctgtgcagttatccttggtggaagtgatggtggtgatgatggcttggcccatggtgcggggtggcactatagatatggggagatggagagatctaggacatgatttgcaagaagagacaactaaatttgctggtgaattaaacatcaagggagatagaggagaggattgagaggactcaaaatatttctagctttttggctagaacaactgagtggataagaaggccatctgctgagatggggagttctgggggaggggcagctttgtgggaagagtgaaaatgaaggactgctggagaatgttcagtttaaaatgcctttttatagggcctctctgttgttattttctcagtccagcacaagaaattgcaaagcaacccaatgacttttatctcctcctcattctataacacaaacaaaagccatgtgaccaatggcattatagctggcacttccttggatgctaaaccacaaactctcaaggcagggaccatgcctctaattgctcaaaattagatttccgtctctaccccagcacctgactcatagtagaagctcaataaatattggttttgaagtgaagaaatagtaaccggttactgagaacttacaatggcatcaggaactgagtaaggcacttaatacaagttacattacttaatcttttcaagagttcctcaagctagttgctgctatattaattctacatacagatttagaaactgaggcttagaggaaaggatgaaaagcacagatgcctttcctacagggttgagtcaggaaatatgaatgtgtgaaggggaccatgtactgaataatggtgactggcaaggcaatgaccttccttaagtgagcaatggctcctcagctgccaccgagcgttgctctgtgcaaatgcaaccacacgatatggtcaagtctgatttttcaagagaaattgaaaatccagtttatttgataaatatgaagtttctccattaaacataaaataaattctttaatgcctgctcattgttctagatcaggcattaaagaattcggtcttagcaactaccactcacacattcctcagtgtactaaccatcttccttgtggtagaaaagctaatctaccccttagtaaatattattggtgagtctggtgtaacacattgtgcctatgtgctcagcagaatgtattttttttttttttttgctaaagatgtttcttataatagctaaaggttccactaggcacttactttttggtctggaacactgtagccattttcagatgatgaccagagtgaaactccaaatcatattgtctgagtggctaatgaattcctgtagtcctcctaacgcaatgatgcaactacactgacatcactgacatcactgtgccaacaaaccatgtgattttagaattaaagatattaaatgcttctcctccccctttttaaagattcaattcttgttactacctttggtttatggtgacaggttactctactgatggttccaacttaaataatttcataaaagggagattaaaatgctatcgttggcttatcttttcaattttcagcacaacaacctctaatttgtaacaaggagaaacatttaaagcaagaggatgtttgaagtgtccaacaaattcaatctggtgaacaattaatgaatgactattatatgccaggatgtgtcctgggccccaggatacaaaacaaataagccattgcctctgcccaggagcactatctttccagtggaggaggaagacccataaaaataatatatcgagacacatgctataatagaaggattacaaaataccctgggaactaagataaaaggatgattaacaatgaggacatggtggcagagctgagagaagtctagcttaaggaaagctacagaggaaaggttacaactcagctctcactttaaggatgactagagtttcagaattcaagtcataagagttgcattttgggtgatacaagcaaacagctactaaaagtttaccgtgagtgaggtattattgcactcataactcattcctcacaacccaattaagattgggttttcagtctccacttttcatattaagaaagtgaggcccagaaaggtgaagtaatttatccagggcctcatagctaattattgtgaaaacttatattctattccaagtctatataacttgaaagcctgggcttttaaacagtaaatgctatcacaaggtagggtgagcaacatgtggacataaaatattgtggtttgaggactacagattaggccactatgagtggaagagagcttgcatcaaggagctttgggggtaggtgtgcacatgaagagcagctgtgaatatttcagtgtaaggcttgcaaagtaaactgggtacagattttatgactatagagttggagcgttattccataggtatcaaggacttttgggatgcttgtaagaatcagaataacaagatcaagaatgaactcattagacaaatccaagagttttgaacaaagctttggagaaattaaatgctggcaaatctactaggaggttattgaaacaatccagacaaaagacaacagtcttaaataaggatactggcagtgaggacaaagaagattaggatgtccccccttttgggactgaaccaatgtatatcttatacatattgattgatgtctcatgtctccctaaaatgtataaaatgatgtctcctgtctccctaaaatgaataaaaccaagccgtaccccaactactttgggcgcacttcatcaggacctcctgaggctgtgtcacgggctcatccttaatctcagcaaaataaactttctaaattgattgatgcctgtctcagatacttttgcgttcagacataatagcaacacccacaatagtgatacacggatgttaaaaataacgtttaatttgatgttaggcaccattcttccaagtacctctgtaatttgtatttgttaattggtgaaaactaaccaaggcagattaacttttatttttaattttttttagagataggatctcgttatgttgcctaggctggagtgcagttgctactcacaggagcaatcatagtgcatttcatagtgaactcctgacctcaagcaatcctcccacctcagccaccggcatagttgggactattggtccatgccaatgacccaagctcttttttgaaagtaactagtccatacacaaataatgaatgactaggggtttctgagcattccatgatactaggatataagtcaattaaacacacaccctttgaagagccacaatgaaaattgaaatcatttaatttattctgcatatatatgtatatcctgtattgctctaacaaaaagaaacacaggttatttgcaaatatccatgtgaaagcatgagaaataaatgagcatatcagtgcaaagggaagggaccaataggaatatttacattcttttcaaaaaggaatattctctttgattactaatagtttgactataatgaattaaatggaagtacaattatttgaaagaattattattcctttcaaagcaccttatagattcatgtcgtgactgaagcatcagagagaagaattctatcaaagacaacttgtatttgtgttgtctttacaggagaaatcatttaagtcagtaaaggtcagttttaaaaaaatgatagggaggcacctgccctcactccttactctggtacacacacaaattagagcattctaaccacccagccttagaattattgcagacgttaccttctgagctattcaaaaagcctttgttcatgaaaagttctcatggttataagacattaaaacaggaaagaccttgctcggcatgatgtgttgtatttatatttctttttgtttgaggaattcaaaaagctttacaaacaacatccagtaaatctctttaagactgttgctcatgggaattcttttccactcaatgcagactgggacaggtaaagggagaacaaacactgagagaagaaaaggagggtggatgggtagctgcagatctctaaagtcaccaagaaggtgcagggctactcacatttatcctcctacagggcctgccaatataaacagcctgtgctctacccttcccatgtggtagctgctgtttccagatttaccatctgttaacacaggtgcacaacagagaacaaaacagcagaagtgcagagtagggaggtaaagaacagaggacatgaaaaatcaacaattacaaagtactgtctgtgttctgtaaactgtgctagatgctgtcatattttatagtaggtgctcaataaatgcttattttcttccccttcacacaatttatgctatctgattaaaagaaactagtttttttggtagagaaaaggaagagagtccctgtgaattaatgttgctgatcatgaaataaatgaatgtatgcatgcatggaggcataaagggaaagggaggcatggtgtggggtcatgatctgtttacatggtccatacagtgattacacccaggtaggacccattccatttgtaggaaatatgactatgaaaaataacccaaaggatagaggtagccactgggaccaaaaatgcaaccttcctgtaaactttttttctagtaaagtggactatcaagggcgagggagaacccttcacaggtgaagtcactatcttagttcttgatgatggtagcagagctgagactgtgatgtggcattagggaaactcttcttactctctccatccacatgattaaatgtggtccttaaatttttataaatatctataaaaagaccttcgagaagtaatagctttcatgaaacaagagagctactcaaatcaactgagtcagggatgggatcccactggttctggagtctaatcgtccttggtgagaatccagcctctgttctttaacctgggcccagtgatgttatctctggaccctagtttccttatttctgaaaggagtgatcataatgatatgtagaataactgactttcagagccgctgtgataattattaaatgagataatgcgtgtggacatttagcacagtatcagacatggtaagaatttaacacatattaattgatgttggtagcaattttttaaaaatcctgaaatgataatgcagttgcacctgaggctccgcatcaatccacaaatttttaaagtattatgataatatttgatagaaatatgatgaaaaatttgacatatatggaatcaacttcaatccacaggttctgtttcttcttttttgtctcttcggaatgtgtcaagtactaatattgattaacctgattttgacttcaaaatatgagccatgacattttttaaactcatgcataagctgtatcatgtgctatttaacttacaaaggataaatttgtctattaaaagtttattcatcatggattttattttaggtaaaatagtcaaatgtagtaacacacggtttagtaaagattcagaaaaataatgaaggtctctgaggtttaattcctctaatgagaacatgtaaatactacagtaatcagaatattgtccactagtttcaaattttacaactttatgtaaacagttacagaaaagtctgtggcaatgttgcaactaaaaaatttaaataatttctgttggtaacgaaaaggcatagtgagcaatagctaaatgcaaatgaaggctaatttttaggagaggtaaaaataacttcttttaaaatacaaatcgaatgttacatagaacaaagaaaaataatttggaaaaacttacataatctgtagtttataccatataacaaaacaagcttcaggctgtttaatgagttaactatgaccttcaaatcatagaacaaaactaactgaaaatggactatcagatctttaaagaggcaataattccaaatgtttgaaaataaaacagtaaatcacaaagaaaaagttcaacataattgaatataaaagtgttttgttttgttttttgacatggagtttcactatattgcccactgtggccttgaactcctgggctccagggaacttcctgcttcagcttcctgagtggctgagactacaggtgtgcatatcatcatgaccagctaaaagagttttatacaatgaaatccccactagaacatacataaacgtatcatatatgcatgcaaaactaagtcagaaaacagcaaataaaaagtcccaagaatgcaatttattgaactatgtatagtgcaggtgcattgtttagggtgcactagtgcctctaccactgacccatacactaagggacattagtccctctattactggaaagtgtctgctcttactcttagaaacctctcttgtgaccttcttttatttttgatgataaagactttaagaggtggaaagagaggcaacaaattttaagggttatgtcttatcttttgatcctatttccatggctgggtaaattgtttccagaaaataattaagaggaagagtaaaaatacatgcccataccagaagatgttcttatcagtgttatctaataatgaaaacaaaagaaaataaacagaggcaggtagaagttggaaaacagaaaagaaaaaaaggagggaagaaaaagagaaaggagaaggggagcagagagaaaaaagaaaaaagaaaagaaaatgaactgaatgtctaaaaaatgagatggcatatcaattcgactaattatcattttttaaagatagttttgtggaccatgcagtcacaagaagaaatgtttatgtgaactctgatctagagcatttatgcacaaatttgagcatctactcttcaggcactgttctaggcttcagggatatgaaaatgaacaaagagagtgctagtggtggacaagaaacaaaccaacaactgaataaaataccaatcaatgataagtgtaatataggtcattaagatggtgtgaggtgctggagagcacctggtggctcctctagactggatggtgagagagcctcccttaaaacaggacacttaagctgcaatttgaatgacaagaagcagctaacctaataaggtaaggagaagtgcaagtcaagaaaagtgtgtctgattaacaggaagaggaagacatgaggaagagatcaggagaggagtctgcaaagtcaattcgtaggatttggtaattttgacaatatttaaaagggtcattgtgttctctgtgaggagaatttaccatacaggggagagaagcaggtagtcccagtcgtgggttactgaggtagttcaggcaggggaagatggcagccctacatgggaaggtggcaatagagatggaaaagtaaacagatttagggaatgttttgaggtaaaagcaacaggattgttaacagattgaatgagagttataaaggaaagaaagaaatcaaggacagctcttcaaattggctttaaaacctaatgccatttactaaaatggagagaaagaaggacacgtttgtgctggggtggagcatgcatatgagtaaagaagtctactttgcccctgtgaagatcgaaagacttgtaaacacattagtggaaatgttaagtcaacaactgagtgtgagcctggacttctgaggggaagtcaggactgcagactggtgttatcctagagatgcagatgcatgagattacctggggagaatgtagccagaaaacaaggaagtcaagcactgagccttggtaaacccaaatgtttagagatggaaagcagaagagggacaagagaagaggcagtcagtgaaaaaaaaaaaaaaaatcactcagtgtgtagttatcaaaaccatgaagggaaagccattaataagaaaagtgtggtcaacagttttatctgagaggtcaatataagaaaaagaaagagaaaaaaatgactttagaattaagcatcaagggacatagtttgttaaggatttgacagatgcagtatcattagaatgatgacaatggaagcccaactagggcagctgtggataaagtgtgtggtgagtaggtgtagacagctttgagagaagactttttcaacacacattgctgtaaagggtagaatataaatggaataatgattgaaagggatgttaagctcaaataatttcttttaagatgtgaggtatgacagcctatttatatgctgatgtgagtgatacagttgagaggaagaaatggatgattctggagaatgagcaaataattgcaggaggaaagaccttgagaggtgagaggggtgggatccatagcccctaggtttctcactggtctggaaaggtacagggacactctcccattgggaaaagtatgaggttcctataccaagacacattaattctatgacctcatatttgtattagatagactgggaagaaatgcaagtaattaaaaacagttaaataaagacacagggtgaatcttctttctttaatatctcttagtgtctgcttttatactaaatagagtttttgtaaagtaacggattctcaaaaatgcttctaaatcaaggtgttcccagcagttgtacaagaaaagcactgaaaatatacaaaacccctgagctattatattttgacaatgtagttcttctgatggtaatccagctcctgtattaattcttcatatagttaataaatatctacatagtcttcctatgtgccaaaattgttataagaattttataaataatgtatttaatactgaaaataatattgactatgtagggagcatcaccttttccattttacacatgaggagtctggggcacagagaggttaggtaccttaagtccacagccatacagcaagtcagttacctgagattcaaacccaggcactctaatggcagactccttgcccttaacctctccactgtgttttggatttattatctaactttatcttacaacaaacttacaagaaaatataattattctatatttaacagctgagaaaagtggcacttagaaaagttaggtgactttctcaaggtcatgctaagtggctgggcaaatattcaaatctggatctttctgtaagtgtgtattattggcacttaacactagactaagtgtcagaagcggagagtaaaaatgttacatgtttcatcactcaaaaatgctaaataaatatgacaaatggtataaaaatggaacttttagtcatgggaaagaaaatagttaaattatcataataataaaagtaattaaacatttaatgatattataagcatggatttataggatattggtagttactaagctcaagaattttacaatctgaataagtttattacatttgaaaggcacttttaaaacatgggataaaaatacatatgtcttatgaatatttccaaaaataactcatgttcattgggaaaaaataggcttcacagacaagtgaaaaaagaaaggaaggaaaggagggaaagtgagaagaaagaagaaaactatatttaggaaggatttgagggtttgtttgatgtaattctttgacacttacatatatgcacacatgcacagataaatatatttgtatacaaacaggatcattctagtatattttttagttacctccttttctaactaaaatcatattgagagcattttctatagcaataaacatgatgcaaacccttatttttttatagttacattatatactaatgttagattgtactcttattcgtgtaattttctcctattatttaatgattgggctgtgtattagtttgccagggctaccataacaaaataccatcaaccaggtggcttaagcgacataaatttatcttctcacagttctaggggcttgaagtgcaagccaaagtgttggaaggtttagattcccctgatgtctttctccttgcctttcagacagcagctaccttcttgctgtgtcctcacatggccttttctctgtggtgcacaatctgggtgtccctttctcttgttataaggacacatgtcgtattggattaggactcaacccttatgacctcatttaaccttaattagctccctaaagggcctatctccaaatgcagtcacattgaagattagggcttcaacatatgaatttgggggtaaagggacataatttagtccataacaggttgtttcccaatttctgttggtatagatcatttgatgataaattataaagtgatttttattcaattatttcccaatgatataatcctaacagtgtgatgtgattgctaggtcaaagggtgtgtcattttaaggcttttgatatgaattgacaagttcatatcaaaaatcttctggaaagttttttccctttaaacttctgccaggagagtttgagaatgaaaacacaagcattctaaggaacaatatacatgtggtgtagaattctctaacccggagctaaatctttggtcaagccatcacctcttgactgcctatgacaaagggtgagtagcctgagactactccagttccaaacaccagaccacaggcagccagtttgttcactcctgagttccatatgaattttgggggagtagaggagaaattggtaaggggtgaagagttagaatagcctggatagatgagttcagactgttcagacagtctttgttttctatattctaaattaccccctttcagttcttcacatggcattaatggatagataaaactcccagttcatcccattgacaaagagaaacacagacagaagacagggaacgttctggttcatttgggggcagctataggctgtctttttcttctggctacacgcacactgttgaaggagagccttttcctactcagcattcttttcataaataactctgttctgctgtctcttgttggggtcaggttactacaggctttcgaatatcctagatgcattgcaggaaattaaatatggaatcattgcttcttcttctttgcattttgtctctggagactggtacttccacaattgggtaaatattttaatttagaggtggagaggaatctgaaactgaaatatagagaaggtaggttctttcacccaggtaatggagagggcttaacaatagttcctggtaaacaggagtagtttaatgaattaggcactttgagctttaatgtagttttatcttcgggaagataccaagagaagaatgaaaacttggcatgaacagggaaggccatttaaaagcaaataatcaagagttggttatatttgatgtttgctaccacaaaaatttacctcaattatgttaaaccaagcaagaatagacaaaattaaataacgttgtaaatgagctgccacattaaagtcacctaaggatcacccagccagacaccatgggggaatggaaaatacttagagaccaagagacagatagctctgtgagtaaccagctgcatagcttcaggaaaatacacaatctctctgtttcattctcctctcatgatatatgaaggtattaataccaacttaacagagtaattgtcaggcttaaatgagagaatacacaaaacacctagcatagtacatggcacacagaatttgttcctcaaacagaggtgtccttgcacttctgggagcagaaggaggattgcagatatttcaagggcctttcaatcttgatgtggaatctcgatgttccaatgagaacatgtgaaacaaggagaacaattatgcactgaacagtaccatagtgaccacaagtatgacaggaattcagacaagggaggtctgaatgtgctgggctactctgccagtgaaagattcgtctaaatgttgggtcatagatactagggttccaggaaaagcaacattaaagaagcaaattgtgcaaagaggatattgaaaatgggcggggtggggtgggatgctggagcaaagacacaaaaaatggtagggatattgagttaagtaaaagagatttaaaaagcttttcaagtgatccataatctatagaaagagcaattcggctaggggcagtggctcacgaccctgtaatcccagcaatttgggaggccaaggcgagaggatcacaaggtcaacagatcaagaccatcctagccaacatggtgaaaccctgtctctactaaaactgcaaaaattagctgggcatggtggcacacacctgtagtctcagctattcaggaggctgaggcaggagaattgcttgaacccaggaggcagaggttgcagtgagccaagatcatgccactgcactccaggctggtgacagagtgagactctgtctaaaagggaaagaaagaaagaaagaaagaaagaaagaaagagagagagagagagagagagagagggagagagagagagagagagggggagagagagagagagagagagggagagagagagagagagagaaagggagacagagagagagagaaagaaagaaagagagaagagagaaggaaggaaggaaggaaagaaagaaagaaaaaagcaattcatgctcataatagatacattaaaaaaaataattggaatgaccaaggaggattacggtatgagcatgtactgaataaatactaatagatgaaaataatggtttatcacaattcattttggaaataagaaaaagatctgggaatataaaccaattggtcacacactttccaaaaaagaaatgaccccagtattaatttgtataatgattagtagataggacatgaagaaagctcttttttccaactgatggtgatgatgtaattactttggtccacttgacgtgacaccatggctttcccttcagtatcattacagttttaatcacagcaggacagccctgctggtcttcacttggcttgtctaaatcctagggttttcatttcctgcatatctttatagtgaattcctttaattcactcatattaaaataaaaaagaccaagagaacaaaggaatcacttgctttaaaggtggaaaaaatatgaggctcactttcccctacctaatatccatcagggacttcctaatgttcaggtaaagacaacttcttgaaattctttttggtttgtcccttttcacattaaccaagtagtatgtgttcattggcaaaatcttgggaaatgcaagtcaacaaaaagaaaaaaaaattcacctgtaattctaccacctgaacactttttatatttttatatttccttcaggtctttttttctatgcacatacaaacaaattttaatagacacagtgttttcaaatctacattttcattgaatatattctaaacatctttgagttcattgccattttttaatctgtgatacttgtttaaacatttataacatgtccatcttgtgatactctttatatcttcattacattccaaccagtcaaggcaattttatgcagttttatactttgtagctagatattaaaaacttagaggttaaatgactatgcatttttaaggcatctgctattccctcacccaaccttgggttatgatctactccttagggttgtgtttccccccatcttttctccttctccctctcggcctcacttccctcaaagagacactgtaggccaatgggagaataagtgaagtccataaataattgtaatcactaccactggcaaataaaaagactttggattcagaagaggatttcttcaatcagcttgcaaacatgcctacatatctgaaggcaaaggaattaagagacttttctgtagaatttttttttgcttgttttccttttgaaaggaggaaaaaaataagtgatgttttttatctctctcttttaacaattaacaaaacaaaaatccagaatggacaggatgcatgcttatgtcatacaatcagctggtagctgaacaaatattaaactctgacttctgattcccaaatttgtgcctttccactgtgtcacattgctttactctaaacaaatcagagctgggataagtgaacttggtaccaaaataacaactgtgggaaaagaacacttgtcaagtcaagggattctctgtttatgagatattcttctgactccatatacaacagcagtacatgccctgagagatgggagagaaggaaaaagataatcttttattttttttcatttgatttttccttctaaggagagctatattcatactttgattaaaatatcacacatatgggtaagctggcttccaacatggcctctaaaaagggaaagctagacagtggcttcctgaatgtgcaagtgcaaatattttgcagagcagagaatgctcttaccttgggggtccacttaacacagattcataatgctgagtggaaagtggccgtaatataaactgataaaagcccttaaataaaccaaaaacctctcaatgagatcggccagtcaatcactcattttctgcttgcacattggccttaaggatgcagtatctgggctgcagcagagaaaacagtagtcaattcctttatgcattggattgaatagttagcctggcagcataccacattatatgcactgtttgatgtacagcttgaatttaatgacctgttggctaaactgaatggcaacattgtgtgtgcacacgcgtgcacgcacacacacatatacacagagtgaaagagaaaaatgacaataagctgatattgccttattaccttgagaagcatttactatgacaaagaactgacggaaaatgtgatggacagtcacaaagtcataaacacattggcttatagctggatgagtccttgtagagaatccatctcaacacttccttttcacttaaaggaaaataaacagtttaagggatttgcaatagttgtacaggtttctggctcagtggcatttgactacacaccaagagagaatttacagattacttaataccaaggttggagtactgataatcatagctcaaagaagaaaaatccaaagtgaaggcaggcaaatcagaatcaatactctcattaagtactcagtgacctttttccctccaggtttatatttttctcactttctgggttgatttttatgtattaaatacagaaaaaataataatgaaagagtcccttgactgtaactgaaatcaatgtatctaatgtgttttccaatatttctcatgcatatgccctcattagattcacatgcaagaaacggttcaaattggaaaaaaatctttaaaaagccattcataattttcctcgtaggatttaatagtcatttcttacttcagtcttatactctgttttctaatagttactaagtgatgaagtttcaagcatgctgaaattgagcacagcaaaccattcagtctgcaaagtgatctgtttgtgttgttttgtttgctttattttaaaaatccattttcttgcattactccctgaatcatggccattcatggcttgattccatgtaactaacattcttttttaactttaaggcaagacaggttacaaaacccctacacacacacacactttcaggtttgtaaactcaattttcatgcatttactgtttttcttcattcatgtgccttgattgatgttcttaagttttcttgtatagatttttacatatttgatactcaatttgtaaatgttcttatgttctgataaaggcctctgggtctctcagcaaaattttagtgcctcaaggcttacagcttaccgtgcttttaggattaagttttattcatctttgtaggttccctactcactacttactcccctacacatacgcctaacttagaagaacccatcgtagctgttagaattatttctaaacttaattcttcattgtattacaatcaagaccacaaatttcacaaatacctttttgcattcagcttaaaatatatttttcagttctgttcccattcaaaatgttcaaatatgcctctagttcctaattgaacaggtttattaggtgacatcattttaaaaaacagatactctttggtagtaatttacataaaaataagtcatgtgagttattttaacattcattactgagatgggtttggtcagacagtattaaaatatactatctaatggacagcattacaatgcgtaataaacagcatcaggaagtaggcactataaaataattcacactctgcttttacttccccaataaagaacaaatatgatttcgcttaaataagactttatatctttatggcaaatgttaaagtattaaaattttgtttgaggcctggtccttttgtggctgaatgggagacacatactgtcacaatgtttgtaatgttttattgttaacttttttgtttatagacttgtcttcctacataagccttttgagaataggatcctgatctttatcccatacacctagtatgaaaacaagcatgaagaagccatttggctaaccatttattagctggttgaatttgggcatgttccttaacatttctctgtcttagtttcctcaaatacagaagttaaaggggagtagagtagttcctgcctcaatgatatcacggttgtcaaatgatcagaactccgcctggcacacagcaggtgctcattcagtactcctcctttgtacaactcagggaggtgccactcacacagtcctccccggagttgtgcccctctggaacccaccctcaaagtgtgagatgtcataatcatcttcctcatcatcatgattattaggcccaagaagagaaagatttcatttcatctaaactacggagagggcggcaaaagtgtaagcagatccttcatgataaggatgactgtgcctacctcctaaagggaaaaagctcagaattctgcagaatgtgtatggatttttgtcctgtcatgtaataatccttgttagagcttttcaataaaaatggattatgactgagccacatagtattaaacttggatttttgtcttattaccatgtattctaataattactatgaactaaacccactatagactaatgaaaataggatgctgaatatcccagtgacaattgaaatttttagtttttaaagaaattaggtatacagaatgtcaattgcattaattatatcattgggtttcaaactattttgagacaagatcttttttttttttttttcaaaatattaggacatcaatgggtattttgtgtagagcgcctggatcctatcctccttgccttttccttctgtctagggctcagcagaaacactgtgtttgtctctgtaaaccagatggaactgctgacccaggtggagcaaaactggatagtcaaatatttgggtttgtagatgatttaaacattttgatatcaacatctttccttaaaaatatttaccacattttgttaaagatgtaaaatgcattttagtaaatctggaaatcagagaactcaaagaaaaatttctcataaacttaccacctacaacgaattccttttaatattttcatttgcactattttggccctttaaaacgtatgtatatatgtttgtgtaattttcttttcacagaattgggattaaattctatcttttgatttttgactttttttttaacttagacaaatcttacatattttttctatatcactaaacatttttctacaacatactgtttaaagggcttcattgcattccacatttgggataggtcacaattaacttatcatatatatgtgatccatatatctgtatatttgactatctacagtgactccaaaggacttctgaaaaattgctccacctgggtcagaggttctaaatgggtttacatagacaaacacaatttctggtgagccatagcaaaaaggaaaagaaaggacaataggatccaggctgtctacacaaaatacccgttgggtgtacagacagacaaccaaatcaaaatttcagtctctcatccaaacctattcttgttataattcctatttactgtaaacaaaaaatttaaacaaaaaagcctcgagttgcgtgaatttacaccacgtaaatgataagaccacagaaactatattgttcatagcgttaaattctgaaatatgtactgcccagtctattttgcagttggggatttatccagaggtgaaattcctgtgaaactgctctctggatctggaggaaaagaaaatgtttacagtttaaagaactgtcaaaaatacagaacaaaatttttgtctttcttatttattgcttgaaaaaagtaggaaggaaaactagataattttctttttaaaaatatatttaatgcctatttacatttttgttttaaaaagtgaatcctggattacactgtagaaatacacagaactcacacaaaatctcttaatagttatttaaacacaaaatctctgaatggtttattttaggactgggattcattctccccttattttctttttttcactgaggaaagtgtgtttatgtgggctttgttcttgaatgtagatttaagcagagcgttgctgtcctttttagcaagaattgtgtcttgatgaatatgtaacaataacattcaaatatatttgcctttttcttcatttactttaattttcagaatcacaatcatgttttcattaaaaggggaaagtagtttagcttatttgttaagagcaactttgcagtcagacagaattaaggtcagaatctcgttccatcagtcattagttggatgatctagagtaagtattaagttgcttgacctcaatatgccttagtttaattatgaataaaataagaatagaatcacttttttcaaagtgtgatggtaaaaggtatgcaacaaatttagtgcaatgctagtatctagtaagagtagtaaagcaaaataaaaaccaacataaaacaaaaactagcattaatatcaaatatgttttgaaagaaacccttagatatattttaacctggatttagtccaaaaagtaaactgacacatctcaatagttcctatttgctaatataaacattattatatttgattcatcaaatgaaagatacctgttgagaagaaagggaggattaaatactgattcaaagcattctcatcaccgtatgcattcatagtttagggccattagttacaagccacagagatcagttcacacaaataaagacttggacagggaactgtagtgctacttatgtttctcctgtaattgttacatgcattaatattccatttatatttggccctttatccttttaaaaacaaaagttccttttggacagggaccagggctaacaattggaagcctataaatattttctattttgagggtcttcagtgaagcttttgtggtattgctgctgctgataataatatacttgcaggaactatctattcatattcttccccctaccaccaaaaagaaaaatctcttggtttattttgctgtttccacatacaggaaccatagatttgctggcacaaattacatgtgaatggaaagatctgatgaggataattaaatgacctaagatatacatattaatatataatatctgccctgtctttattcttgtgagaatgtgaagtattaaaagtttttttataacttgaaaaataaagtattaaacatatgtaaattgtgaaaaaaacgccttagtctactaattatgaaagacgtaaataattgctgggacataagggaaacatttgaagctgcaaatcatactgttgaaatgtcattgggattgcccacaaaccagatctaaagcattaaatttcatacagataattcatttttagcaaatgtttgtctgcaggattatttcctgtattcatgattttcagcttctatatgaatgaaaactgaatgtgtaactgaagaacaataaatatcaattatgagggggtggtggggggcaggctagggatttgaagtagcacaatacccatccagaatacccacagttcaactccagatgccatgaagaaaggtggccctggtgttgccagattttcttttttttttttcctaagaggagaagatattttaatatctcctgaaatgtcaaaattataaaatttggataaaagtgtgttttaaaaaatattgtgttaggagcatatattgctttgtactaacatttcactcaggtttacaaacacttttcttgagctgggtccagtccacaaggctccagtttgtaaccactgtgctacataatcagacagactttatttccatctcagttaaaaaaatcgctaattgaatggctttgggtataacatttaacctatcaaagcttcatctttattggcaaaatgggaagaaaaatgcctacttcaccagcctgctgtgagaactgcaaaaacaggcatggatgaaaatactcagcgtactagatgcataatagatgctcaaagaatttaggtctttttctcattttctggataactttaaaaaggaagttgttctgttttgttcctttcatacttgctatattcagagcatatcagatatccttgttattaggaaggtcagcgctaacgcattaactactggaataaatagttttacttgaattataaagaaaattctaaactatgggtctctccacatcttctaaagagtaaagatgagtcagcatcaactctgaaaaaattttcaaatttacctagggggaagtgcatctttggcaaaagtctgccttgaacgaaatgctcttccactgcttcatcggctactctctgtcataaggatcctttcgttggtcaaacagcacttaagcaccacaaggctatgattagtgatggcaccacgtgaactgagaactgatcaattctgcttagattacagttgactacacggccaaagatcaatgtttcaaagcaagaggattatacaaaataaatgtagacagttcatgttttcaaactacacatgttagtgaaagttcagcaagcaaatgaccagcgagtggctagaaatattaattcttgtctctttactacatttcaggggcctcgactaaaccatgtaggcttgatttcaataaccgtacgtaggatgaaaggagaaaaacataaagtcacataccatagttaaaagagattaaacagtatatatgtagtcaaatctgcccatgtaagagtgttagtatgaatcaggcatgtttaagtgtgcatttggatactggactcttaaacctgtagagagcaaaaacccaaaggtcacactcagatgcaacaatcgatttcccttgtcgtaggctaatattttcctttctcttgtttcagagtgtggcattgcaccctgtaggtcaaaaatgtggacaatctggctaagaagagagcaagacaggtaaagcattccttctatgtgaaattgattgggggaaggcattcctttctacttcatttttaaaaagctgagacttatttttcattattgctaaacattttaagcatctggctcaaaatactctgtattctaaattttatagatgattttatttaatgaagtcctttaaaaagaagtcaaaattcaaatgttttccataatatagctaaaaataatatattctctaaaatacaaaacctgttttatagttaattaactacaacttaaattactccttaaaagacaacaggaaacagagactgacccagtggtcaaaataattccttcctttgggtttaggaaactagaactgagaagatgatggagaaacccctgtaattccagagtacccattttcataatctgaattacctagcaaatccataagaaagcaagttgagggcctataatatcttcaaaacatctaagtccttctctctctgttgccaatgtcaattagcagaattagcagcttgtgaattctcagcatggattttttaatataaattctccaaattggttatcatcatataaaaatttgttgactgttttgctcttcatttaatggcttattggtagaatgagacaatagcctagattttacagaatggtacttatttaaaatattgtcaagttgttttcatgagtattcttgcacttaaaatacctaataatttcattttggaaaataggttcaaattaggtatgcttgacctatgagtaggttaagggccttaaatatacgtcagtgatgactacggagtaagagctcagtttatttttggaatgtacctctctccatgaagtgctacataagaaagagccaggtaagaaatgcgggtaaaaaacaattgcctggtttttactgtggttataagcatttttcaggggaacatttccagtttggaaaagatggcatgatgaaaatatcaccctcttctcctaagcacatgctcagaggcttttttagagtcataataatctcagcaaatttcccttcttgaaaataataccgagtggttttctggccacatagtgtcagctaaaatttgtcagatttagttttccatgcatattctaactgaaactggactccagaaattcaagaattgcagtaagtgccatgatcttgatttaggtgccaaacaaagaaaggcaacaaaggctttttcctcatacttaagttacagcgtatcagcaggttagacacccgtagaaatcactgtcctcagtggttcaaaggcatgtccgtgtgtctgtcaagctaaccctcttgtacaagtcactctttttatatttgatttcaaaactctcatgaaagcaggatgctgccttaatttatctttggagtgagatgcatttctgattcaacttaatttttgaatggagataggatggaatgatttgtttatgattagtgaatttggtagagtagctttctaaaatagcacaatagctgtgagtgtgtatcatataacttgctgcttataataattaaattactaacttattttaataaattagtgaattaaaaggtattcattaatgatgttactatttctgacttgcaattcaatttttaaaagaaaataaaaagatccacggaagtgttcataatctttcttacttatattgtagcatgtagtgagcagtctttaatgatggattgttaagtgttatgatatattacctttaagaatatgattttgccttatcaaaatcataacatcctgaggatgtgaatgcaattcattttgtttttacagtcaaattaaaagaatgagaatcacagttgaaagagctactagttgaagtcttctacagtcttaggccaggagccctttaggggactctcattctttcattcattcagccactcagtcaaacagtctttattgagtatgcattttgtaccaaggcattcgttacaattggtgaacaacacagtttcattttctgccctcatggagcttacattctagtgaagagtagggaaagcaaataaatagctctgtaattacaacttttgatacgtattatgaaggaaacacacaggttgcagagagtaaaacgggatatatacctagggaattttctccaaggtattatgtttaaagctcaaagtttaagaagagtcaaccattcatatttaaaaaagaggaaagagtcagatgactggggttttatttgaaaactatgatatacatgaattcattatgaaataatgaatatagtgaaaaaaatagcaaaactacatcttggtgatatggtttggctgtgttcccacccaaatctcatcctgaattgtagttcccataatccccacatgtcgtgggagggacccagagggaggtaattggaccttgggggtggctttccccattctattgtcatggtattgagtaagttctcacgagagctgatggttttataaggggcttcccccttcactcagctctcattcttttccctcctgccaccatgtgaagaaggacatgcttgctttctcttctgccatgattgtaagtttcctgaggcctccccagccctgcagaacagtaagtcaattaaacctctttcctttatacattacccggtcttgggtatgtccttatagtagtgtgagaacggactaatacacttggtttattctgagaagtcgtttaaatatcttcccataatggatttgagttgcttaaccaaggttaaaactacaggacaggctgggcatggtggctcatgcctgtaatcccagcactttgggaggtccaggcaggcagatcacttgaggtcaggagtttaagaccagccttaccaacatggtaaaacctcgtctctactaaaaatacaaaaatttgccaggcacggtggtgagcacctgtagttccagctactcaggagactaaggcacaagaatcacttgaatccagcagggggaggttgcagtgagccaagaccatgccactgcattccagccagggcaacagagtgagaccctatctcaaaaatcataataataataaattaaaaattaaaaaataaaactacacgacataccactacaacactggggaaaactaacatgaatctgaaacagatgtgtttttgtttttgttttctaattgttgctgatatatgcacctggtgaaactcctagtgactcaaacagggatttcactgccttggattcagacctcattcattatcagcagacaaagaatgaccaaggttaatttaatacccattgtaagatgcagtggcaggtcaggttaacagagttcatatttcctgaatataatgcctgactcacgactgctttaaatcaagcaggatctatctgtatcataagaagtatttaaaagtaaagtgtgaacactctcaagtgggggaaaaacagcttgaatcgtcaagaaaaatgcatgcggaaatttaaaattcagtagagacacatttgttgacacggatagatggccactatacataaagcagaagcaatataaaacaatgcatacagtatggtccatgtatgaaactgtgtctgcatgtgtctctatgtgcatatacaaaaagatctaaaaggaaatattccaaaatgctaacagtaatgatttcttgatggtaggcttatgagcggttctcatcttccttttacacatttctgtattatcatttttccataatgaggatgtgttatttttaaatataaaaaaaactttaagcaacaaaatttacttgtagtaatgaataatgatttaaagaataatttttttagtgtgacaggtcccatttttactgcaagctaattaattataaaggacactttttccaaatgtagaatacagttcagacgccatgattttctatttggccagggctgaattacccaatacttacaccagtatgtgcctagggcattaataaagaaaaagagacaccagaaaattagaatatttgaaaaacaaataaatatttttgatagttcagaaaaatgtaggagaatttgttcagagaaaatatcagaaagtcgttgaactgatgcacacttattttatgacaatatcatttttacttttaagaatgtgtaggtggagagataattaggacatataggtaggaggtggcataacttttttcaagattcaggacctacaggaattttaatcagatcctaaacacggaaaaaaatggtcacctcccaacctctatgtcattaaaaacaaaaacaatatttatctataaaataagtgcatattagcccaacaaagttctgattttcacccaaacaaatgcttctacgtttttctgatatatcaagaagcctagattttctctaaaatgctttttgtgtgtgtgagcctttttttgttttgttttgctttgtttttgttttttgtttttttgcctgataccctaagcacatagttagtgtatttggcaattaaatatggccaaagaacaaattttggtacctgaaatattcaaataaaatgagccacacaacacagattagtaaattgaattaaaattatcttaccaattaaaattcaaattggtaagataatttgctacctttctactgttgtagtttgtgctcatgagactagggatccagcctgttacaccactcaccaaacacaaatttggacaagtctaacctccctgaatctgtttccacttattttaaataattattacgacactagctttgctgataatgatagaattgaaatgatagaatataaactgaaattgatagaatataaaatgaaaaagaatggaaaaatgacagaatcataaaaacttgtaataatataaggtgaagtgatggtactaattacaactatattgttttcaacattaactgtttcatggatgtatatcttatattctccaaggaaattctttcttgctagcatacgcaaatgctgctagtcatataaaacctctacaaatagttgttagtcaatttattaatttatcctgcttgaaagcacattttcccttgatagaataatagtggaatgtgtaaacagggaattgcaacacacttcacagagtaacaaccaagtataaacctaatttatgtctttcagtaaaagaccatcattgcgttatttatgttaaaacttccacagtaagctccaaccatgagaaacaaagcattgacttttcatgaaccaaaaagaaatgtagaaaactgttagactctccaaatattgcctaagtcatcctgaagcggacttgtagcaggcacataaaatcaaaatatgttctgatgtcacttgaaataagaaacatcctattacaaagtgagaaattaattagtgtgtcttaattaaaacaagttttactaaagacttacataccaatcaaaatatttaactttaatattctaacatgaatgacatttttaagatagcatttgagtggaagattagtttgttaaacagcacatttaaacattaatttgtatatacctttcatataatttgtttttttaaaaaaaacaacttgatggcccttgaattactttgtacaaagaccccattaaataacacagtacatttttcaaaattaactatacaatatgaaataattttaatataggtatttgacatcatactccataaagctgctgagaaagaagggctcttatgaacaggtaaatgttcagtttcctgaattctggcaggattacatgtaaatttctctaagaagatgatcagctgatttctttacaaatacctagaacctgtaatttagaagtcaactacaaaatggagtcttactgttataacctagaagtgtcttatcttaaacaactaatgtactctctcaaataaatgactcactctagaaaaagcaagagaagttcttgagaaggaaatctagtacatcctagacaaatgcatatctaggtcatacttttggaggttttgatgagagaagaattcattgctttatctgattagccagttgactactcacacttactatgaggaacttctacatttgcatatttctcatcttcataattcctcataaagttgaagcccattgactacatttgaggttccaaaaaatagcaataagcaatgtcctgtgcttatgccccatgcttagcttatctgaaacaaacgattgccatatttcatttttctcttctctaaatgaaatgatcctagcttttaaaaatctttcctcagagagttcaacttctagtgcttgaaacacacttcacttttctatggccccttagcaaaggccatataattgtcttaaatagtggggtcaaaagctagacctgtatttctatcagggtaatagctgacacatagctgaaacaggctatctacaaggagttttaagcacatggcctaagggatttgcctctgttcaaactgtaccaactttgcctataaaaccacctccaaatgaaaactcaaaaaaaagaaacaaaaacaaagccccaggatatctgctttcattgcatgaaatggggtcaactagtacaaatcttaattttttaagtgtgctataggcatatctaacattttaatttttggaagtcaagtgttatcactaaaagattcaggatgcaatgtgttatacaatttgttataacatacaagcccagtacctctttccttgccctacttcatatagttgttaaaattaggcacaaagtagcatgagtttacaaagctatggatctataatatataacatgctatgagcacatgcacaattgagtcaccaagggcccttctcatgtataaaccaaatagaacaattattctcagcaaaattaaactataaacctggttcaaatacatgtgaaaattataaatgtggggggtgtatgtagaatcagatgcaagactaaagacccaaacaattgttattttacattgtaaaaaatgtctgtactgacaatgatattgttagagaagagaataatggataaaactataatagcccatgtggtaaatgtaatattactaatacactttacctacataattttttctggctttaattcaatgaaatccattatcctgggcgggaatggaacctcctcatctcacgcatctttagtctcctgaactgccttaaagccttgacataataaaaggtcaagcagatcccagtaagcatttgtaaattacaatagacccccatttcagctacaagccacacattctcctgctcgctttgctcactctctggtttcatttcattgtataagcagactaatttggaaacggctgggctagggtgcttgggaatacctagattttcaaaacaatcctactttcctacttaattatttacagaaggagacccttaatacaacatctgagagaactgtgaaatggttcctggatactgaaggaatgaacatcagatagcagcactattaaataaaatgaatacatttcaccttccagcttagctgtgcttcctgggacacaaggcacaaacatgaaaaggttggggtggcatttcaagaaaactgatttgcttcaacattgatttggtaagatgctagacacaaaataataccacaaaccgcctcccattcccatcattgtaaattcagagtcctcaatatcatcccccacaaacccaattaaaaataaagaggcaggctacaaatttgcatctagttctatgacacagatcaaacgataggcatctgttccaatcggtcacaatgaaactaagggacaataaccagagtaaatttcacattaatccaaataaagccaatgaataataatataaaccagaagcatagtttcaaaaacatgcaattacttccaggcatgcaaggacatatgtaacccataaaaatggttgcaaagcacaccctacatataaatatgcttcataaatgcaatataaatgctaagtgacatgtgtatatatgatctgtatatccataagatatacatgtgtaagttcacagtcaaatctacgtataaaataaaactgggtcttgcaaatgatttctcaacaagagtatattagaatataaaataaaatgtcaaattctggggccactttttctaagcaatcaataaaataagcaaaaccaccttataatgagtctggtaagcttatgagacaccaaatgtatttctgaagaaggcccaaccctgtatgtgagagctgcaaatgaaatgattcctttcaataacaccctcttcttgttgttagctctttttccaacccctgatgctgttgctaagcttaggaaaaaaggcaccaagtggctcagtctgcattctgagccagttagagataaaatcagaacaccattttttttttttaaacacaagaggttgtcttctcacttctctcttcctggcaagcttcctctccctccatcctcatctctgtctccacatctcccccttctagtctgaggcacgggagtcattgttcaagttcaggccagaaatgtatacacaggtcaaataagaacactctaaaccaagaagggagccctactgtttcctactcaccatgctgagacccggagaagctgtttaaaggagggagagatgcaaactgaatccattttccttgtgaccgagtcggatgcagcctccgaacccaacatcagcagtggctgccggttttttttttccctctgtctctggttggcgatggtgcgaataggaaccacccttccagccccactagagtatcagcaatagaggcggcggcggcggcagcagcagcagcagcagcatcaccagttgggcctcctccctctcggaggatggggtgagctcggaagcagccaggaacttgcagcagacacctcctctggctcctcctctctctctccccctcccccagtgccccacccctgctgcggtagaggctgctggcccggcagctgctggttgcca

SEQ ID NO: 233 - DNA, 197408 bp, Homo sapiens; identical to SEQ ID NO: 232

SEQ ID NO: 234 - DNA, 197408 bp, Homo sapiens; identical to SEQ ID NO: 232

SEQ ID NO: 235 - DNA, 197408 bp, Homo sapiens; identical to SEQ ID NO: 232

SEQ ID NO: 236 - DNA, 7118 bp, Homo sapiens
ggggatattcagatacatttattcaacaataaggccagtcaggcctcgcggtgacctgatgggatttcaaaaccttggttctcagcaaggcccagatttttgaatgaggatagaagtctggcgtttcctgcagtagagattaaaaaaaatatatcagcttaaacttcactgatgaaaaagtgactatgggagaaaaacagggggaaaaataacagcttcatttaaagttggagaggtttgagatttataatcttttctctgtctttcattcatttatacattcacttagtcattaattcatcaaatatttattgattactgttgaatacactaaggatacaacagaaaggaaaaatatctgtccttacagtttttacagatctcgtggggtgttacagtgaacccctgaaattaaactcaaaactattgttgcatcttttgctcctgatgcctctgccttcgccaccaggtttccatctcagctgatgcctgagctattgttggaccttctaattgattgacctttcatcttagagctctggggattcgtatctgtgaggtctcacaaaagtaaatcacatatttattccacatgattcctgccagttctaaacatcctcccctccagataaaacctctctgttcgccccacactaccattaccaaactagttttctcttccctaaactaaatatctctaaattttataattgttccctagaagactgtttccaggtctttaatttttctaaccattttttctttgaatgtacgggcttacaaaaattcttctacttctctattactgaaggacatctgacttccatatacttttttttcttttttttttcttttctttttttcttttttttctttttttaagacagagtctcactctgttgcccaggctggagtgcagtggtgtgaccttggctcactgcagcctccacctcccgggttcaagtgattctcctgcctcagcctcccaagtagctgggattacaggtgaatgccaccatgcctggctaatatttgtatttttagtagagacggggttttaccatgttggccaggctggtctcaaactcctaacaaaagtgatccacctgcctgggacttccaaagtgctgggattacaggcatgagccaccatgcccagccaaactctttaagattttttaatgctttcttgtcccacaatcattaactgctcattaatactgatttccaaatcagttagcatacataagcacacacacctaaacagaataaacaagagttgctatgctgttcactctagtttcatatattcactatccacatatagctatgtaaatgtaaattagtttagataatattaaatattcagctgatcagttttactagccacatttaagttagtgttagccacattaaggctactgttttgtggctagtggctatgtattagacagcataaacatagaacatttccatcattatagaaggttctattggagatgcaggtttatggaaaagaatttgccggtacagattccctttgaagacgtagaaggaatagaaaaagtgtttattgaatatatttgccaagcacataatcaccaaaaagactgatttgcaagcccttgtttggtattatctacttgtctcaaactagggtcagcgtctggctttagttactaggtaataagtttgggacttttaatcaacagtgaaaaaggcaatgtcatacattaggaaatatgttgtatttgagaaagcaacattttgtctctagacctaaattttcttatctgagaaatataggaagagaggtcatgttttctagcatacaaatgtgcctcccatatttacatagttttgaacaaatagaaagaataagcagaaactcggaggtttcagaggctaagcagatagggtgttccagccctctactaatatttttctaatgtttcactgtaaatgttgagcggcacttggaaatttcccaagtctcaaagctgttgttctcttgctttctcctcccattggatggaaatatgatgtttgagcttaatgtcaagaacatgggtcatgagaaaactaacaggtggcttcaaattctttttacaagtcttaattatggaaacagatttattacaaagtagaatacctaatgttttgggtctaaaacttcaggatattagacctctcatccagaggtcctatttccacaatacttgctaaactctgagaattttccaaaatggtttaaaacagcccaagaagaaggtttgcattacagaaaagggaatttatgcagtagaatataatggaaatttacacagtcatttgagcctgagtcaaagtctttaatatcaagtcaatctcagaaaaactaaagtcactcgtggaatcccttttatttgctttgttcattccacacctttatttaacctggcatgctcttttgatattgccaaaattcagaactctatttaaatggcattctattctttttttttccttttttttaagatggagtctcactcttgtcacccaggttggagtgcagtggcacaatctcagctcactgcaacctctgcctcccagattgaagcgattcttctgcctcagcctcctgagtagctggtattataggcgcccgccaccatggggtttcaccatgttggccaggctggtctcaggtgatccacctgcatcggcctcccaaagtgctgggattacaggagtgagccactgcacccggctggcattctattcttttcatggatcctttcttggccccttttaataaaaaatatgtatctctgcttcactcctgttgcactttatttacacctcatcttctggcatttgccccaagttataagaagccatcctatacatgctcatgatgttttcttagtcataagcacaagtaagacagggaatattagcatgatgcttgagacatgctaaggtttcagttgctgagtgagataggaaatctgtgttgaatctatttctctgtatcacatcacctacttatggtcactgaggaaatgaagctttactgaaactggctttcatatccataagtaaaaatatatttttggttatataatctatacaatttatatttgcataactgagggctttaaaaaacacaatcattgcaaccactaataatttttttaattaaaggtattttgtgtgtactttataaaaatccaagctatcgactattttgctgtaaaaaatataggcttttatcatacaagtgacttctaaaaaataatatttaatgctaaatatataaaagggagaataagaaagagataactgtttttggaaaaagtaaatagtttgcttttctcggggtgagattcatattatcagtacacttgaagataactaacttaaaatatatagtttaaaagaaactcaagtttgtactcaccgattttcaaaacataacacgcattcattgggataagtatttccatcagtcccacagacagggtcatatatcttggtgcatccattaagttcattgtaacatttggcctaaaaatggaattaaacagaatcatttcccattattctccattcttgagttcatagcaaaatctctgaaatggttttatttctctggggaataactgtgattgggagaatgatactgtgtgttgtaagagaaataacctactatctggagacagaaaaccttgttttaagtcatgcctctgctatttctaagctgtgtgacattagtaagtcctatggcccttctgaaactcagtcagttcatctgcaaaacagtgatgatattaccatttcccacctatctcatagtgttgttgtgagatttacatggatgggtgagataatgttcaagtttgcaattactgcgggtgctggcatctctcaggttggccacatcttggggcacgttcttccttgtacactgtagtccacacacactggtcttctattaggcacttaaaggcactaggcattgtcgggtgttggaagtctttgcattctactccagtaagagtttataatcatcaaatgattgtcattgtcctagacattgttctagtgctttttatatattattctgtttaaacctcctaactatcctgtgaactaagtattatattcttcttcaggtgaagataatgaggcacaaagcaataaaattagccaaggccacccagctaaggaattcctaaattcagaattcaaacctagtcagagttcctgagctttagctcttaagtactttattctactacatctccccaccagttttgttttactaacactcattttttttttttggctcaaaataacccctcagttacttcggagcaccctccctgatttttctaactaggctaagttcctaacggcagcagaactttttcataacacttatcacaaatgtaatattgcattcattcatgaacttttggtctatcagctgtctctgactagatataaatgtactgagaacagggacacttcttcctctggtctccaaatttactgaaattacctcttaaacaaaaaaatatgaaaaggttagagttagaatatttttctagaaggagaacctagtttattattttctgtcattcattataaattagagccacaccttggtgattgggagagctgcatgccaacatggtcaaactggctgtaaggaggaagggctacttggagtgaagttgagaaggcttccaccccaaatacttgtctacagctatcactagtctatataaaaaccccttcacagcaagcactgtaggactatatggaacttgcttatacatcagtgaaattgtccttcaatatacgcctgtgggttggaactactactaccatttgcatttctcacgttaaccctccctagcattcatactcctcttaacttcaggctaaactgaaaggtgacagcaaggctgcatttttgttggatcaaactgttccagtctgagaaataagaaattacaaatatctctttacctctcttcccagggagtcagctccagtgttacctagaaataaatcagatatggtaagttgggtcctaaatgaaagaagtcagatctattcttcatcagaattctctgctttcattgcagactgtgacttctttactaggctctttcattccccaccctttctgatttctctaatcttccaaaagtatctgactgattttcctgtaccccttccttggcaaaaccttaaaaagtttgagtaaaactttgattatgaccaaagtatctcgatttgatgttttaggaagttgatctatttccttgaaaacagaaattatgcacttactgctggaaatgaatcaggcactgagcaaattatcttttgaatactcacaaacattctcaaaaccagttactagatctttaatctcacaattagtgaagtataatttttatctcagtttacagatgaaagtatggagagtttttataactagctgtgaaacagttatcataagcagtaaccaggtcttctgatgcaaagttagctttttcaattacatttaaattcccttttgtaagtattgttgaaaaaatagagttcttttgccaactcactatcagttcccaaagagctatttccaacaattgcatcatatggactatgggtctaactcacatttgttgaatttacaggtagtcaaaatagctaatctctattcccccagaaaatagcagaggttttgctgacaacatataggaaatgataactgtggataagttcatggaagggaaagggaactaatatgatagcaatcaaataaggaaacattcctgaaaattaattttaatatcatcaatctttgaggtgatctgagcaaagaggtagttctttgtatctaaatgtaatgaaaattagtgaggcatctatgagcttggagaatttcccccgggatagtcagaacttgatgttgttgggggcccactggcttttagaatctagttgagtctaaaaactgaagagcaggtgctcatcacaggcatctatttgtattaattaacatgcatgaggagggggaaagggaacactgactgttgccataaatattcagcaaataaaacaaacaatattcttcctcttcttagcaaagtgctgatttggctctccacaggatccttcactacatgagaggtgaagttgaaaatgttaaccatttccagtgataaaaaggaaactgatcttggctctgcgggttcagagttgtctgtcaacattgtcaagatgcagttggaggtatatgtgcaccatctattcaagcagaatattttctttcaaaacattcaaaatgtgtaatgtaaatacacaaaatgcaatttttgtatttccagatactaataagaaataccaggaattgaaaataaaaaattccctttatatcacatatattagctattcagggataaatctgacaaactatacatgattcaagtacactgaaacctatacaataaaaaaataaatttttaatcagtcaaattatgccttttatactgaataactggaagccatttatctattttatgcaatcccatgagaatttaaaatttgtaatttggccttacacatttacagaatgagaagtatacttaaagttaaaatatttttacccttttttctctaccatatcccaacaaagggtcagccacatcaatagaggaaaaccattttatttctgggaatttcttactagtagaattgttttccttatagtaggttaaaaattcctcttaaaaaataattcttacctgttgattttatttcatctcattaggtccaaaacatctctcgaagactagactacatcaaaagtctagaagataatgtgcttcacaaagcaacaggtcaaaacagttttatttaaatttgaaaaatatgcaacacttaccagatagactcaacagggccaaggcactgagaagaaagatgcctgttaccttcatggctgaagttctgcgtccagaggtcagttgaaaactgcaccgcacttaccacgtctcttcagaagcctgggactggaagggtcatatggcagatggcagcaaggccccacctactgggct

SEQ ID NO: 237 - DNA, 3483 bp, Homo sapiens
acactttgtatggcaagtggaaccactggcttggtggattttgctagatttttctgatttttaaactcctgaaaaatatcccagataactgtcatgaagctggtaactatcttcctgctggtgaccatcagcctttgtagttactctggtaagtaactggaatacatctggaatatgtgacatttctttacttttctgttaataagagcacaactagtaagccttgcctcactgacagtggaatatggtggtaggaattgtatttttttttattttacttttaactgacacataataattgcacatatttgcagggttggaagaagttttggaatcacagaaaatggtgatgttggaaagtatttcagatccccaccatctaagctctagcccaatataagtattctaatacatcctacataggaagttagccaacttccacggagggtcaacaaagcacatttcactgctggatattggtcaccattcgtttttcttattttcctcaattttgagttaaaatttgactttataatttcttttgtgcttttgaactatatggagtcattcttgctatcatctccagttatccaatttgctagcttggttctcctgagatagctacattcatctgtttatccactcaatggatatttattgaatggctacaatttgttgggcactggataggcattggaagatttagacatgaagcagtcataaatattgttcttaaggtgctactctggtaggatagatagggcttctgcctaagttactataattctagactactgtaaacgtactgtgagatatccagatagaactcttttagtgtattggtgggtgattagtttaattttcaggtaagggtatagaagctggcttcttggaggagaatgggaactgatttatttttttggaaggaatcattgtaactatcaggaagacagtgtgggcacatgggaaaaagagatttcatgatagccactgctcattgagagaacagaaggctttgaagatcttctcccaggaagctgtaaacacatacagagaagatatttaccaaaatgtctgaaataagaagtatggagattaataatgaaaaattgattgccgcccacacctacaatggcaactttggcttttgatgtttattgaatttctgaaggaatttgtaacttcaccagttttggatatttcactgttctctaatgtccagggacaggtatctatgggcaaagtggcagcagaaaggaggtggggaaaataaataccgccccctctgggtgagaattttggagggacaataggtgattgaaaatttaaaaaaatatatacaggctccattttaataatttgaatggggaaataataggtttccaaaggaaaataaactatggcaggtcttagccagtaggaggatgtgtgttcttacgtgtgtgctcacatgcatgtgtgcatttatatatctgcacatgtttttgtaaaaaatacatcgtacatattttcctcaatctctactttttcccaccattcatcttctacgggaaagttatcttcctaaagccaaagatataaaacgtaattttcctatgtaaaagccttgatagcgccccactgccctcaggaaaaaaaaatccaaactcctttgtgtgacatccaacactttaaaaaatctgacctcactcaacttttgcagcctcactccctttatcttccatcctttggtcatagcctattggaaatctgcactccagccttctgggcagaaggctcaccatcctgtgtatgcacttttatcctaatggttccgtgcctttattggtcatgtttctaaaatgcttctcctcttctttaccttatgatcctgacatttgcctcaagacatagctctaacagcacttctggaaaattcctgcagcactctttcatgttagaattagtcatccctttcttgtgtttccatggagctttgtccataatgttagcatagcacatgctacactgtggcatacacagatcttctatcaccaactggactgtgtgaagtctctgaatgggcatccttgtcttatttgtctatgtatctgcacagactagatagagttggtgctcaattatgtttgtagcgttgagttgaattggttgggagcagtttcttgggctgtggttgggtccattcctgtctttatgtggagattcactatagcatctctcctttagcctcaaagctgtgagctgtggagacagtcacatacaaaataccatcgccttcagacaatcacaatgatctgttgaatgcttacgctgccagggtcagttgtaggcatgggtgcattagcgaaaaaacacacattccttgttctcatggagcctccattctaatgagaaaataaagacaataaaaacagcaaatgaagagttgctttttttaggtaatggtaagaaaaaataaatgacggagagtgactatggccattgcaggcttctccgaggaggtaatatttgaagagagaccaaataatgtgagaaagaaaggtaagtagctagctaaggaaaaaaagttctagggagatggaacagcaggtgcaaagggccagaggtagaagttttcaatggaagtaagatgagtggatctggaatggagctattgatggacacagggaaagaagatgaggtcatagtctgggcccagatgtgcctgtctcacctggtttctctttttcctgcagctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggtaaccacagcttgggaggctaatctgccaaaggggaggcatactcaccctgaatgtctagctcctcttcttgtcccttgtaaatgtgcatttccactttactgattatattcataggaagtttgcacatcctggaatctcaggaaaaatacaatttctacatttctgggaagggtttttgaatgatagtgacatgtgttatagttgtgacaataccatttaccaccttcgtgattttggatgagacgtaatcactctgagtttttgtttccccatcagtaaaatagtggccaaacaggacactggaagtgaatatgttttgaaacatgcgaattacatgtaagctgctctaaattttgttgtccttctacatttcaggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatacatt

SEQ ID NO: 238 - DNA, 13831 bp, Homo sapiens
tcctctccatcaactatgtgatcccaaagcgccatatttattctaactttctaaaagcaaaaatgcagtcagggtgttcaaaatgagttctgtttggttgaagccagagcctgaatcctgagaactcgttgggagttgctttgagggctctgtcctggaggacttgtggagccaaactggaaaagcaggatttggctgctcttggattgtccaggagccacatgggtgtgtcctttgaaacacaagccaaagagaggaaaacaattaccaagtagagctggtttaagacgttaaataaaccaaataacttttaacctttcccttaaaatttttatgcttctgcactttaaaatagaagaggtttcataataaaatcaactataatacattcttgaggaaatgagcaacaaaaacaacaaagcaaaaattcagagtatataaagaaagaatcagaaacaagaatgaagggagaatgtacattgaataaactcctaaggataagttgagtcaccagtttcactgagtttctggatagataggtgatgaaaaagaaaaaaactaagtcacataaatcttttttttttttttttttttgagacagagtccctctctgttgcccaggctggagtgcagtggctgtgatcctggctcactgcagcttctgcctcccaggttcaagcgattcttctgcctcagcctcccgagtagctgggactacaggcacccgctaccacacctggctaattttttgtatttttagtagagacagggtttcacagttttagccagaatggtctcgatctcctgatctcatgatttgcctgcctcagcctcccaaagtgctgggattacgagccacagtttcgctcttgttgccctggctggagtgcagtggcttgatcttggtttaccacaacctctgcctccctggttcaagcgattctcctgcctcagcctcatgagtagctgggattactggcatgtgccaccatgcccggctaattttgtatttttagtagagacagtgtttctccatgttggtcaggctggtttccacctcccgacctcaggtgatctgcccgctcggcctcccaaagcgctgggatttggtaggcacctgtaatggcatgaggcactatgcccagccatcacataaatcttataagcagaaaagaggaatctgactttagggaaggcatattttttttttttttgcctgatttctaaaagaaaaattttccataagacttcatgaaaacgtaatcaagtgacattgtggccacgggcaattttgcttatcaggtgcactggaatttcctgtctgacttacttattcctagatccctccctaggaagttctgactgagcaagtctaagcataaaagtctagtgtgtcctatagtacattttgccttaatccaaaacacttgtataaaaattaagaattcataaagtgactttctatccattacctcttttgataattttagtaatctagtgaggtttgtccaaatttgtttttaagcaggaaagaaaatttatacttaaaatatcaaatgacttaagacacaaaaaaagatgacttgaattcatatggttttaaacaatgcaggacaaatggagttaaaattttaattttattgaaaatattaaagccagtaaaaatcatgccaatgttgttcagtagaggctgagaggttctcagatgaaccaggtattcggttattggatatttttccaaatactgtacctctctctactcatcatatcaggttgtgtgtagaatctcttctctcagagttcaccttatttgtagagcattcataatgcttatcccctcctccagatattccttcttatcttttccaaggcattcccaaggcccctttatgcataactttatcatttccttccacagttatgagatacacagagctatgtgattgctgagtccataaacttctcaacagccagctagttattcattttggtagcattggctgattgatatagtaggtatggattaaagaagcattaaagaaatgtgtaaaaaaaaaaaaaagggagggatcggccgggaatggtggctcacacctgtaattccagcattttgggaggccgaaggggggtgaatcactgtcaggagttcaagaccatcatggccaacatggtgaaacctcatttctactaaaggaaaatacaaaaattagccgggtgtggtgatgcacacctgtagtcccagctactcgggaggctgagtcaggagaatcacttgaacccaggaggcagaggttgcagtgagccgagatggcaccactgcactccaacctgggtgacagagtgagactctgtctcaaaaaaaaaaaaatcaatgttaataagagaaacataagatctatctatccaactacctatcttaatttaggaaattctggctgcatgccatgtctcatgcctataatcggaacagtttaggaggctgaggtgggcatccaagtgatcacttagatcacttgaggccaggagttcaacaccagcctgggcagcatggtgaaaccctgtctctactaagaatacaaaaattagtctctcccttagttgcttccttctccctagtttaatgttttttatattacaaccctagattgagccattcctccctgctcatcagggcatcttaggttggttcatgcatcaattccaagtttttcatgtgcagttaaaaaatttatggcattaagattccctatgttttaaaaattcataaggagaaaagtggggctcaggcaggtaaagtggcctgaccacggttacataaccattaagtggctgatttagaagttgaatttacatcttgtctatgtcttctgttctttctgctcctccatgtggccttgcctattagactacatcatagaccagacctgtaggatgtactccaaggatttggggtgtgggtaccaaaaattataggtgtgtaccagaagccggaatgaaggcaaagtattaggacacctgcaagaagaggcaggctgttctctgagaagatgggaatgaagacatacaaacataagtgactgagtttaaaagcttaattggccttagggtaagagtcaggagtgtcggggttgggcatgttttgatttcaatgcccaagcctgattctcatccttagaagcacatgggaaagggtgggctaagttccgggggaatatgatagtagctttctgaacttacattaatcacacccaggttatgaaatggagccaatggggaaaaggagcatttccagaccagatcacaaacagaagttgggaaaggccatgcttcctgaatatgcagataaagtaactcaactaagcaaaggggtggtgttgtatttctatgaacatcttgaggtatgacttagattacttagcttaatcattattctccactgccttctcctatactattctgctctgtttccagtagcactatggcttagagatacagcacaggccttggaatcaggctgcttaaattcaaattgtgtcttcatcctttatcaatatagccacattagcaaacctccctgaaccttcatttccttatttataaaatttaagaataataatatctattttgcatagtgattatgaattaaatactacaagcccttagtcattaatcacttagcttaatgcctaaaacagagtaagaacacagttcataccagctactaatattactacttttccagatctaacacttttgttttcgtatttcaatatgcattttcaggagagacccgagtagggaaaaagcaagtatttctgagcactcaaactatattgtttgcccatatatctaactgcgtgagatagaaagtttgttatcctttctctctgaattaggttcagcaaatttcactcttcttatgagtaactaactgcatgattacgtgggtccttagattgctagtgcgtgctagcccctcatttcacaggctgaacttgtacaaagcaagttcctagcagatttgtgacaggaatcaggtctccaaacttgccatccttattcacttcatctcacagctctacctcctctcttaagaaaattttattattagaaacttgtacatgaaaaaaatatattcatttatttttttaaaatgtactttttctgcttgtaggtagacatgggtaaccaaaattattaaataaaactggacagactctttttcctttgtccaatacactgttatttcagttgtaaattttaagtgaaaaatcacctgaggatgtcactttgatgaatgttttccttcattatcatcaaattccataaatcctcttgagaaaaaaagagaaaataagaattacaattgagactgaacaggagtgttagaatgatcactaaggcgctgtataatgtttgagccacactgttcttctctagatttttctatgtcagaaagaaataagacctaaaatttctacatagttcatagtgggcaagtaatttatgcataattatcttttttgcatctgccaacaaacccattagttaggtatctattcacacataaactccataaagtcatatattttggtatatttttccagtaatatatccccagcacttagaacagtgcatggcaaatagtagaaattaataaatatttgttgaatgcatctttattatctctttttatgtgtgagaaaacctttgaagcttaaagattaaacaacctgtccaaagcacatggctggtaagttacaaagaaaatttaaaaatttggctctccagagtcattactaaatgctagaaacattatgccctatggcttaaggactgggtaccagggtatctgctgagatcgtaaaagataactaaaatatggtttgtgaattgcagtctagtggagaaaacagacaactcagatacaagtaatttaatacaatgtggggataaaagttgttatgaagatttctgcaaaggattatgaaatccctgaatatgaaaaactgaaatttctgatgttaagtgtctatgacttttttacagagtttgtttttgaattgggctttagaaaatgattagacttgccaagtgaacagagtggggttttggctttggggctaggcattttcagcagagggaaaaatcacacgcacagatattgggggtttatacaaacatgacctgctttaaaatgaaactcattagtcattggggcttcaggttgcagaggtgagaaatgtgactgaaagatacattggcatcagagaaggacatttgacatcagcctaatgcatttgcttgaattttggaggcaatggaaattcatgaaaaactttcaagcatggcagtgatatgaccaaatttaaatttttttgatataaagttctggtagtaggtagaagatgaattgatgagacagaaggtggaacttattagaaatccaataaaaagagagacagagaaaagtgaaacttattagaaatccaataaaaggaacttgggaaagagatgataaaggactcaacttgaccaactagtcagtggagctgaggaagagaaatgtatatagggtgcatatacatatacccgaggaaggtatatagggtagaatattcagcaattcgatgaaggtgatgatgagcaggaaggatttgagaagatccttagatttctggattctgggtggatgatgatgtgacttaatgagatatggaggaaggttttgagtgagatgatgggcttgggtttagaccagtggaatttgaaatagtggtagaaaaacgatggaattttgtagcaagcaatcagttattccatctggagctcaggaaaaaattgcaacagaaatgtgaatttgaaactcattagattataggcagtgttcccaatgtgtaaactgcaatgtgaagaaccaagcacgtttggaattctgaggaacaatgacatttggagggcaggtgcatgaagaaaagtcaaataaaaagaatgagaaagaatggctagtggtagagagagaaccaggaaaatacatcatggaacccagaggggaaaatattccctagaattaagggctctcaaagggtgagaggagttaagaatatgtatatttttcagaaaaatgatgagcaaaatgcagtctaggtagctccaagctgatccaaaagcaagtggagagaacaatccagtctattcattgtttcaaatgcatgtctctagcatttactatgcatctgacacaccacttaggcatcagacatattggagtaaataaagtaaaattcccacctttatgaatcattgttattcctctcattctctcttccaaatcaaatattgtttagtcattcaaggcccaaattacatcttgcttttgccataaacacttccctaagcacactggacccattgagaactcctttcgctggaaactgcctgtgatctttggctgacatttatcttgctactcatttttatttatggcattgtgcattggcttaagtaattttaccataaggactgcaaattatttgaggagaagggattaagagcctagactattccttcacaatccgtgtccctgctttgtacatgttaagtgcttagcaatactttctgacgtctcctcctatcctccaccccctattttgcttatggtcttcccttgagcagggagttatgggtatgttttagatcctggctctaccacccgcagatttatctcttgagcagatattgctgtgtctttgagcaaagatccttcaggatttctcagtcaaattgaggtagatgggctttaggtctgatctgcaagatatctttccttaattaattaattcaagtgcctgacactatatgccatgtactgtgctcttgcaaccagtcaggtgatttggtctctactttcacttagctacttgattaaaaataaataagtcatttcggatggtaacaaatattatgacactgtaacaaggtaaagtgatagagaataacaggcagtgggaatggaagaagacagtattaacaagaatggtcatagaatagtttctgaggaagtgacttttagattagctgtaagctcaagaactagtcattagaaaaggagagtattttagtaaggagggagagcaagggaagagagcctgagatggtaataatttctagcaacagaaagaaggtcatttactcagaatgtaatgagggaaagggaaaccagtagatgaagggccatttctgagcctagagcggacagcaattctttagcatatcagagagtcgactcttatggttaacacagagaaaaatgtcctattttatacttggaaaattccctagggaaggaatgaaaagaactcttagtgttctaactccttgttttgctgtgtggatgtaacaatactaattcaactggagtctaatctttagtttgtatgtaatgggtggtgctcctattgtcggcctatgactttccttcttgtttacattaacagtcttggaaaaataacagttgcaaaagcaaccacagtaggaaatgtaacaattaaaaaaaagcacctgtgagttttaacaatttgtggagaaggattgcctgtagaacactgcccaatcagatgacaatctatccctttaagcagatcagagattacaaaacccctgattactcctacatggaagtggttcttaatctgctattggttaaagacccctttgaaaatctaatagaagtcatgaacactttccccgggaaaatgcaaaaataaataaataaataaatcacactgacacaaaatattaataaaaatgtaaaggttttgtggatctttaaggcccatccatgcaacccagaacatctgatcaaggcatggcttttgaaaatttctgtatatcagaattacctgaaaagcttgttgaaaaccatatccatggccttgtccccagaaagatgcaaaatgggatgcagaaatctgcatttttaaaaataaattcccccaagggattctgtatcaggtgggtataccacacctagtcaaactctgcttaaggatctatatgggagaaaattagagagcagaggcttagagcagtggaaattgaaagcacctggaaatttggaagagtgaatttcatcttggagaactgaaatttgggagattaatatggggagaataaagcatacagtgtagtagtgtcaaatcaaaactatgtaggcaaaaataatatgtattgggaattagacacaggcttggaagcaggctgagaacattgggaagactctgggattggtgatctgcccgaaggcagtctctcatgatgaaaaccaacactcatgttgagaggttctctagattgtctttaaagagaggttatctactgtctctgctaaccttcttgagctactcaagctagaaaatataggcaggactcctcacacccatcactaacgaacatatcactacctcttaccttcatcacgtaatcacagtgcttacaaggggcgggccatctattattttaacttcacagttaaaatatgagcaaatagaggccttcagagtgggagggccttgttcaagaccacctagtaaaatagcaactgagttaggatcagaacttggctttttgttccttagtctagtgttcttcctcctccctatttgctcctgagattaaaaagaaaaaaaaaaaaaaatcctgtatggaaccacttgatgggaatgtcctttcccccaaaaagctcagggcagttgattcagatgcaaaatatattttaagtagggcaacatttttcaatgaaaaataacacatttacttatgccacaaattttgtttctcatgtattttaatgccatgaggtcattgtgtggtcattatcaacagagaattggacaaaaagcaacgtttttctcagtgcttacgtgctcctggacatggagcggaggatgaactcgactgcattctcaatgatctctgtgcccaggaggcttaggaatttggggaagtctggctttgggtctttgcccgagtcgtctggcttgtcgtctggcttgtctggtttgtcgtctgaaaaacaacagaatctcagaggtgattctcagcaacaaagaaggaatcattctttctgtgtggggaacgcttgggattctttctgacccactcacaaatttcatagccttatatggttatattcatcgaacatttaatgcctgtctggataaaatcttcacatgcattgtctcatttatttgtaaaaacaaacaaatagaccgactgatattgatacttaggtagacactggcaccgcctggtgagtgagaaaaccaaagttcccagaagctaagtacttatctcagagttaagcagccagtaagtgccagtgccaggactgacatacagaatgtctgtttttccatatgatctccatgcccatggtaataataatattaaagataaattatcaactgggtgaggtggctcatgcctgtaatcccagcactttgggagggtgagatgggagaattgcttgaggccagaagtttgagaccagcctgggtaacatagtgagacttccatctctacaaaaagtaaaaagtagccaggtgtgatggtgcacacctgtaatcccagctacttgggaggctgaggcaggaggatctcttgagcccagaagataggggctgtagtgagccatgatcgttccactgcactccaagcctgggtgacaaagtgagaccctgtctctgagaaataaaataaataaataaaaatgaaatatcaatgggtaacatttgttgaatacatgcctatgacgatctacatggattgtcttattttatcctcatagcaattctacaaggtaggaacaattatcccaatttaaaggtaaagtaatataatttgagagatgtttagaaactggttgaaagtcacatagttagtaagtggcagaaatacaattcaaacccatgtcagtttggcattaaaatttggattctaaagtactctatgatgagctgcacagtctttgatggaaaagttatgcaatttgcacttcttttagaagattcaaaatagtataacaataatgatgacaaagcaattctatcccttgcatatcacctagtagtttcataaatagtgattttacaaatgttgtgtaattttatcccctgagcaatcttacagagtatgcattttttagctcactgaactgaaaagtgaaaggattaagaggcttacagaagacctcatagacagtaagaaaaatgctaagatgataactgcaggcctcttaacactagattcttaagggcccattggaatgagggccaaggatccagagtgaggttgattatattcaaggtcccttgggggctttttgactttgcttgattgtctttattcccaggagatgagaagagatggaagagtgacagtagctacatgtggtcgcccctctgagccctggtcacaggataaagtgggacctttattttttaattgtattgtaccctgacaagtaatgttaccagactgggtacataaaaatacaggatgcctagttaaatttaaatttcagataaacaacaaatgcttttctggtactataaaaaagatccatgcaataattaggacaccctgatgctgaaagattattcattgcatatcagaaatccaaatctaactgtgtttctcgtagtttatctagcaacctcagcacaagttttaactcaagaagtcccaacttctagacaatgtacccctgactttggataaaggagatgtaactaccttttgtgtggaggctgccaaattatgtcagaaactttacatctatattatatcctaaaatggaaactattagtaaaaaagattggcaggcaattctatgagcatttattgtttactatgacacaactaaagatttgatagaagcaccagtttgggacatataaccaaaatcaatatactaatcatcacctattcatatatccaatgattggttccttcattcaaaaagtatttttgggcctacttttttaatgttttatttttgaaacagggcttcactctctcgtccaggctgaagggcagtgaagtgattacagctcactgcaggctcaacgtcctgggctcaagacatcctcccacctcagcctcctgagtagcagggacgacaggcatatgccaccacagctggctaattcttgtattttgtgtagagacggggtttcgccatattgcccaggctggtctcgaactcctgggcttgagtgatctgcccacgtcggcctcctgaagtgctggggtcacaggtgtgagccatcctgcctggcctgagcctactattatgtgcatagttatgctaagagtcaaggtaaaaaaaaaaaaagacaactgtagatatgaccttcacataaagtgctgggcaacccaggtactcagaaggattggtttgtttttattgtgggaaggaggcggaagcggaactcatgtgtaaggtgcctatcgtgcaggtactccatcagtgctttcagcacatgccttaatcgtcatttagctcagcagtggtatcacagttacagcagagaagacagatgctcaggaaaattaaatgactcacctgaaatcactcatctagaaagtggctgacccagggtttgaacctaattttttttaactccacaaagcacattattcacattgtataatacaacctccaaacaattgttctgtaaagacatttgccaaatgcaaagcagtaatttcttgcatgaaagatgagattttttctcctgtgtttctatctggctacttgcataataaattctattgacttgttattttaatatgacactaaaacctggcttttcaagatgcaagaagcctgggattggagtgggcggaaatcaaaatcttggccttagcttgtgaaccccatatatattgagaggtattaaagtgtgatggattgcatgctctggagttttatagatctgtctgattcctgcctttaacaaaaaattagccatgtaaacttgcacacagtgcttaactttgcatctctcagtttcctcatatgttgtcaggattgaaagatattttatatattatatatctatatatatatacacacacatacatatatctatattatatatacatacatatatcatatatataccacttatcgtagtaccaatcccaagataaacttaccttatataaataaataataaatgaaagaatgaataaataaatgttatctgttttattgttactattaataataatagcagcaaaatgatttataattcactttctcctctagtgctttagaagataatataaattttaaaaatgctattaaaatattaaacgattgatatcctagaaacaatcttcaaagtcaatagtttaatattttcttttttcaagtattatatgggatagcctttatttacagtaactactttgttgagtttcttagtgaatgtgaatataatgttcttaataaacagtattgctgatatttgtagagttttaatagtttacaaagtaattaaaaagcatattcatttgacctggtgaagttgatagttatcccgttttacagataaagaaactgaggttcaaagcagtgaacgatttaaccagtttcagagtttataagagacagggtggtgcctggtcttggtatcaaatctctcctttcacttcactgtagtgatttctttaggagtagaatggactgaataatatccgtggccatgtctagagtaattctgttgtaatgtctgtctgtgtgttcttcagccaagttacattcaaaggattctgtcactaaatgtttgcactccctctgttttctggtctatcattctgaatggagctcacagacttttgcagacaaacagtaaattaattaatgagaaggcagcatacagcatgagcttctatgtgcttggaaaaggtgggaaagaaatagttgctcgataatagtagaaagaatctaggaacctaggtttcactcccagatgccactttcacctgtatgtatgctcaagtaacttgccctctgcaacctgtttattaacctgcaaaaaggaaaatgataaaactgtacatgtttacatcattggattactatgagaaccaaatgagattatacatgacaacaatagcaggtagtatttattgcatgcttactatcaaccaggtacccttccaatttgtttcattccttttatttaattttcatgataactttacgagaaagttaaatgtccccatttatatgtgaggcctagagagattgaatagcattcctaaagtcacatttctggttagtggtagagccaggtacaggagttttattccagagtacatattcttcaccaatgaacattattaggaataattatcaaaaaataaatgccagtcagctcccatggaatttatactagaatagtgtcattatatcataagagcacataaaaaaatttcaaacttcatacatccactgaaaatagaggctaggtttttattaaaattctactttctttgtgttagaagatacacctcttgtctcccaggccagtgctctttctggagtgcccaaagaccccttctttcttttatgttctgaatcagtgccatcagctttctctagtcactgctaactactgaacaattcatgggctgtgatcagaagcacttacctgcatagcaggtcaggaataagacaagcagtcccaggacaactgtcaggcgaagtactgagacagccattctggtagcacggggtattcgtgcagataaattgttc
